United States Patent 7,635,798 (NUCLEIC ACID COMPOSITIONS CONFERRING ALTERED METABOLIC CHARACTERISTICS) - sequence listing, part 2

SEQ ID NO: 708 - DNA, 477 bp, Trichoderma harzianum
tcgcatcgcgccgttccgcgctaaaacggcgccctccgttgccttcttctattttctactggaacggaggagtccgtcctggttcctggactggactggacttggaacaagcagatgcagttagagagggggggaagagtgaaaatgccattgccagggaagaacctgtttggcgaggagggggaaaagctggtgggctgggcgggaatgtcgtcatggctccattctaggcctgtcgcttccaagcagcccactaaatccaacccagtaggtcagtttatgcacagaatagctgcatgtctggcaccatcatcaagggatccccgaaaggaacaaacacaaaaggaaaaaatcaccgccaagtggcggattgactcgtagagtctctttcggccattgccggtatgcctccgaatcagcctggcaacttgactgtgcgctaccggagcttgggccctaccagtattactggccggt

SEQ ID NO: 709 - DNA, 577 bp, Trichoderma harzianum
gtgttttggtgccctcgtccgcttccgggcgctcacctcagatggccgcgccgacccgagctgtggccggtgtggcaagcggcctgtcccggctggtgcctcgttctcgtccacggctgccaattgcctctgtttctattacagcaaagacgacggcatcatcgcgatggcactcgggcttctcgtcggtcaaccccaacgaggtctcacacttcaatgccctcgccgctgagtggtgggagccgcacggatcgtcgcgcctactacacctcatgaacccgctgcgccacgacttcatccgctcctgtcgcgagtcctccgacgacctcaattccatcacatacctcgacattggctgcggcggcggcatcttcgctgagagcgccgcccgcctagccaccaccaagcacgtcaccgccatcgatcccacaccgtccgtcctcaacgtcgcaaaagcacatgcccgcaaagacccttctttggcggggaagctgtcctaccgacagtcttcggtcgagcagctcgaggtccctgccgagggccagggctacgacgtcgtgactctctttgaagttat

SEQ ID NO: 710 - DNA, 585 bp, Trichoderma harzianum
gattgattgctcaaacatcacaacatcagggaatctctccaaatggctcggtcagccgccacaacggccaccaaagaggccaagcctcaggctactgctgctgctgctgctcctccagctccagctccaaccgacggcgataataagctgcacgacttcttctggacttacaccgaagagccgcaccgcacacgccgtctggccatcatcaaggcccatcccgaggtcctcaagctatgcggccctgagcctctgaccaaatatgtcgttgccggcgtcgtcgggctccagatcgtcctggcctacctcctgcggtcaacgcccttctggtcctggaagttctgggccgtcgcctacgtctttggcgccactgccaaccagaacctgttcctggccatccacgaaatctcgcataacctcgccttcaggagcccgcttgccaaccggctcatcgccatcattgctaacctgcccattggcatcccttatagtgcttcattcaggccgtatcacctcactcaccacaagtccctcggcgtggatggcctcgacaccgatctccccactgccctagaagccttcgtc

SEQ ID NO: 711 - DNA, 513 bp, Trichoderma harzianum
atacgacaaagtcaactacatgatgagctcgcacaagaagaagaacgacaacaacaacagcagcaacatcccggaggcaccactgccgccaacattcaaggagcagctcgaccaggaggcgatcgacagccgggttcaccagcatgagagcgaagaacactcgacagtgaaggatattgtcgataagatatcgcatgccattcctgctgtcgcccctctcatcggcggatcaaatccagacaacaaggtggaggagcataaagaggtgcctccggggcctcctaatcgaccagagcatgatacccagattgaagagtttgtgagggagcagcatcgaagcaacggcatcgagaatctgagcgagggaaagtcgtgatggattcatccacgctctcggttcagcagagtttcttcatgtaccaatagccatcaagcttttactttttcttgctttaatacagtgaaacctgcggctactatgcaggctctttacagataatccaggaaaaaaaa

SEQ ID NO: 712 - DNA, 438 bp, Trichoderma harzianum
ggatttgcgaaagggcgagattttgggtgggaggcggcagacggtgattggggcgatttgggcagctctgccaagggttgggttcatgaagatacagtacgtgttagtgatgtgaagctgctccatgatgggactcggaatggcggacggatgcggtcatgggcttttggagattggcttttcttggtgggccgagacggcatctaactggagatttgatgaaggggaattcgagctatcaatacggatatgcaggactggatgattctgatttgatggcccgaggtgaaacttgtctggaaacttgattcgggggcagcgagaaagattgcccaacgaccgggtgtcttttctttcttcctctctttgtctaagatgtacgaatacgtcggcggcagggcgagcacagttagccagaagcaaggggatggacttttt

SEQ ID NO: 713 - DNA, 386 bp, Trichoderma harzianum
gaacaagccacatcggggagacgggaagatggtgacacggatgcgtttgtggaggtgggtaagctttgcgcaacatgtgccagccttatcttgatattggacgcggcgacggcgaaatggttggaagggtgtgtctatgtgtaccgacaaacgcatggctgatgagacggtgaataaaactgcaccaagaaagagatgcatgagagatgaatgaccagtacctaaggtctatgacatgtcgctttgcactcggtcggactcattcacatgtagtaaatactacataacacccacttgctccagtaatcatcacttataataatacggcgagaagacaagttgacacagggcgaaacagggcggaacaaggccaaaaaaaaaaacaa

SEQ ID NO: 714 - DNA, 367 bp, Trichoderma harzianum
tttttctcgcaactcgctgcttggctgcgagtatctggcattagcacctgttgtgtgcgttggcctgccgtaggttgatgcatctgcagctgcagcgtttccgcatcacatcaccttcatcttacatgacaaaccccctctttttactcccttcgatacggttattggttcgaaggctttacaattcagacgtgcaggcactaagacatccatctcgactgttagaggttgtcttgctgcagacgttatcgtaccagcacggcttatatagcaccagacagacccctccgctgcagctggtttacttctttttattaatctcaactatcaccacggctacctattcttcacttcaaaaaaaaaaaag

SEQ ID NO: 715 - DNA, 417 bp, Trichoderma harzianum
atcttgggatgttctgcagacgattgtcaaagccggattaaccccgcaggcattgatggctgtctctcatctccactttgcatcctgttgttggggtaaaagaataagctcaccgtcattgctcagcttctcgaaatcgtgaagaatgaatcgccgaaaattgattacatgtactcaccagggacatgtaggcagcttcatatttcactcctccgacgtctcggctagacttagccatgtcgatcaagcatgagcaaatcccacattgttagctgtcaatcattgtccagtgtcatctccccacgtggcaaagacggcgtcaatcaatttggacaatccctgtgatatcttagacgcatccttggcatcttctaaatgcttaaagttttgagctgaaaatcggtcattaaagtaacg

SEQ ID NO: 716 - DNA, 329 bp, Trichoderma harzianum
tgaagatttgctttgttttctaagttcatggggtgcaattgagtcttctaaagcgtgctggtgcaacattcaagctgacgttggataaaccttcaaccgtaactcttgtacctctcaagacatcagaatcagatgatggatggattgatgaactgacctgcatctgcccactcaacaatttaatccagtcgagcttctacaacgccaatctcaaagctcacaactctgtattcactcatcttgaccaattctctttcagtttgacctcaatcactctttccctcatgaagaccgacgacgcagtgtcacaaaccaaaaaaataaaaaaa

SEQ ID NO: 717 - DNA, 562 bp, Trichoderma harzianum
gtctgactaacacaatggcttcgactgtgggcaagaccatcacctgcaaggctgccgttgcctgggaggccggcaaggagctgagcattgaggatgtcgaagttgctcctcccaaggctcacgaggttcgcgtgcagatctactacaccggtgtctgccacactgatgcctacaccctctctggcaaggacccggagggtgctttccccgtcatcttgggacacgagggagctggtattgtcgagtctgttggcgagggcgtcaccaacgtgaagcccggcgaccacgtcgttgctctctacactcccgagtgtaaagagtgcaagttctgcaagtctggcaagacaaacctctgcggcaagatccgagccactcagggccagggtgtcatgcctgatggcaccagccgattcaagtgcaagggcaaggaccttctccacttcatgggaacatcgactttctctcagtacactgtcctcgccgacatctccgttgtagctgtccagcccgatgcccccatggaccgcacttgtctccttggatgtggtatcaccaccggcta

SEQ ID NO: 718 - DNA, 284 bp, Trichoderma harzianum
cttcaacgagggcaattgctgggaggaaaacggcgtcaattggcagcaggagagactcttgagtctttttttcacaggggatgtaaatagccgtaggcggaatgacgtcagggctagcgcggacagttgccgaatttggaaatcagggacacgaacgttgcaaagggaacggcaccgaccaaagggcattgacagctggtataattgaggcatgtggatgatgtgttgagataaacagcacgatttacatgtcattgtgagaattgagttgcgtgcattgtttg

SEQ ID NO: 719 - DNA, 591 bp, Trichoderma harzianum
ggccgctatccgctcctcgatgcgagtccgcagctcctctactagggcagctttccgtcccagtgccgtcttctcgcggtccatggcatcggtcagcgagactactgagcagcagcccaagatcaagtcgttccagatctaccgatggaatcccgataccccgaccgagaagcccaagcttcagacctactccattgacctcaacaagacgggccccatgatcctggatgccctgatcaagatcaagaacgagcaggacccgtccttgaccttccgaaggagttgccgagagggcatctgcggcagctgtgccatgaacatcaacggccagaacaccctggcttgcttgtgccgaatccccgccgagtcctcgtccgatgtcaagatctaccccctgccgcacacctacgtcgtcaaggacctggtacctgacttgacgcacttttacaagcaatacaagtccattgagccctacctgcagcgcgacacccctgctgaagatggcaaggagtaccgccagagcaaggcggaccgaaagaagctggacggtctctacgagtgcattctgtgcgcctgctgctcaacctcgtg

SEQ ID NO: 720 - DNA, 399 bp, Trichoderma harzianum
ggaatgcttgagccaagagattgcctaggtgaggaaaaaagaagagagagaaaaaggcaatttgttagcgatccatggattgattccatgactagctaaacgaggctagatgagatgaggcagcgtgagagagatggatgggacgagatctggtgggtttggtttgggaggcggtttggaggtttggggatcatacagtagtactagtactacaagtgctgatgatgcatagataatgtacttgaggggcgatgagatgcgatgcgatgcgacgcggtgcacgcgtatgtcatccatcagcggtgatgccctctcagacgagtacggagtcggtaccagacagcaatcaaaattggcgggtgttggctctgctctggttgcaaaaaaagcgaaagtacg

SEQ ID NO: 721 - DNA, 416 bp, Trichoderma harzianum
gacgagacgagtctggagggatgagacgagacttggagcaaatatggcgttaccaaataagacgcggaggatggtccttggaacaagcactacaagagctcaagagctactatatagatgctatacgcccatctcggaacatttctgctgcagctactgttgctgttgctgctagtaacactgctagtaacgacgctcggcgaaaaccgtgcaccaaaacatatgctactaattactccttacagactactacagacattagatgacagagtagttgattccgaccaacgactggactggattaatcatacgaccacacgagaaaccttcaacatggcttcgatggatagatattgactgtttgtttttgggctctgacttggctgctctcgctaactccatctcaacttacccca

SEQ ID NO: 722 - DNA, 568 bp, Trichoderma harzianum
agcttgcgagcctctcaaatcgttgccagatttcgtcaagaccctcgacctcgcaagacactttacggcaaatttttttcgagacaatcagacaagatggtgctcgctgttgaccttctcaacccttcagcggcctctgaggccaagaagcacaagctcaagacccttgttcctcagccccgatccttcttcatggacgtcaagtgccccggctgcttcaccatcaccaccgtcttctctcacgcccagaccgttgtcatctgccagggatgcaccaccgtgctgtgccagcctaccggcggtaaggccagattaaccgagggctgctctttccgaagaaagtaaactgcccgcggggcggctttctttccttgggtactgatgactcttatggttatatggtggtgatcatctcggatctgcaaacaaaacatcatcgacgtgggggatagacattataccttgcgaaaataatcaatctcttttgcagatagaagatggaacacccaacacaggggcgtttgggggtctccgggatatcttgcatggcacatcattcttctcgttt

SEQ ID NO: 723 - DNA, 576 bp, Trichoderma harzianum
cagatggtggcgctcaagcatcccactcttgttcgcaagcttattctagctggaactgggcctagtgccggtgaaggtattgaaggtggtgatccggtcatttttgggcgtcttgcttcagcttcaaacgatgcagaagaaaagagcggctttttggagggcttttactccctgactgccaagaagcaatctcaaggcgggaactggtggaagcgtatgacaacggctcgccagaataggtctgattaccttggacctgaaggcaccaaggctcagatcgacgcagttcttcgctggtcgaaccctgaatatgtctctgagggctcatacaaccgtctgagcgagatcaagatccccgtcctcgtggccaacggcgacaatgacatcattatccccacagtcaacagctgggtcatgttcaagagactgaccaacgctgatgcccatctccacttatacccggatgtgggacatgggttcttgaacgagtatgcaggccagttctctggccttgtcaaccagttcctagacgcttaagtgggaatcaggggttctttaaaggcgcgagtctatcta

SEQ ID NO: 724 - DNA, 510 bp, Trichoderma harzianum
gtcgagttttctcgctggaaggtagttaggggggactgccgaagatgcatgaccccgggaggcttgcaagcaggcggagagcatacataataaagcttgacgaagctatcgcggtccgcctggaggtccccatagtacttgctcgcaaactgggcttttgtatcgacagtcaatatggcttaaagcagatgcgcggtaagagaggcacccttatgggcgagacgctgggagaggcactcggagacatacaggcaagctcgtcgggcggtaagccttttgcgcacattagtatattagcgcaagcaagcagggtagacgcaatggcaatcactcactatccatattgacttcctgaaagtttgagcacggagcttgcttgacaccaaaaggcgagggtttttaggggtgaactcttgaggtgagacagtgagtgagttgtgaaaaatagtatgctaaagggaagtgagactattatatagtagaataggaagtttcctagtgttacgacct

SEQ ID NO: 725 - DNA, 242 bp, Trichoderma harzianum
ttcacataatcatttctatagtattcgtgggttggtttggttcccaaaatagccatcgaatccaccctggttgatgattgtatatcctcgatatccaagagtgaatatttttggccctctcgaaccatccggaaggatggcggtagaagcctcgtgcatctgctggatacagagttgttttgtctcttgatgatctcgaccccgtcaatggtctgccttcgggcgcattggcggggtggatg

SEQ ID NO: 726 - DNA, 338 bp, Trichoderma harzianum
gaacagccctcaccgtcggaggagaaggggcactggccgcgcagatacctttcgtcgcgagaatcgtcagacagctctggcgagattgagcaattttctatttctcgagagtcgtttggctcgtaccgacgctcatttgatatctcggcacgatcccccatttctgggtacgacgttcccggtcgcatgagtctcgactcagctcgattcgctcgaatggctaggtcggcaatcaaccgtaacatagagcaactggccaccggtgaggagaactttgagggcgtcggactcgaggaccagaagcagccggcccggaaacgaggtttcttttccaaact

SEQ ID NO: 727 - DNA, 458 bp, Trichoderma harzianum
tgcccacaatgtcgctttctgttggtgcttctctgcggcctgcggccttccgctgcgttggtgcgtctgccgtgcgcatgcgatgtgcttttggcacaactgcgtccagaaggagtgagagctcgacgccgggcgagcttggggttggagagctgcagggcgcatcgtttcgcattgagcctctccggagggttggggaggatgcttcgactatgcgagcgagacttttataccaatctcggaagcgcggaaccctcgagtcggatcttttactgtctacgtttgcctcacagaacctgcccaccatgacggccgaagaactgcggcagtacgacctcttcctcgacgagaacgactgggacatatactactgggcgacgcagcgggagccgaattccacgacgaacccttccgtgacggcgagtccggcgagtgcttcggcgagcgaagggttcgag

SEQ ID NO: 728 - DNA, 484 bp, Trichoderma harzianum
gacgattcgtagcgattcaacacggcaaatcgtgagcggacgttgggaaatccggaaaagggaaaaagaaacagaacaagatggcgcagggctcgatcaaaaagtccaacaaggccgccgcgccaaaggccgtccactcgaagcgccaggcctccaaggtcaccaaacccaagaagaaggtcaacgccgacaagatgctcaagaagttcacttcgggcatggtagccaagacggaagcgctcttgggcgagagagcgggccatctggagttgattggacccggaaagaaggggagcaagaagctgtcgcagaagggaggatcaaagaagtttggctaaagaaagagcttggaaaatggaggaatgggcgctgggtgggattggaggagagggattgggataaggcgacatattcggactgcgagcgatattgattttttaacaactattctttttcttttttttacgatgacaaacatttctcg

SEQ ID NO: 729 - DNA, 573 bp, Trichoderma harzianum
agcgaacaagctcagttgatgcctcgagacagcggcagaaaccgacaaccacgaaccccaaactcgaattcgagcgcaaaccagagcacaggaagagggcaaatgtcgaacccaaacaactggcaggaggaggcgatgcggcgtctgcgccagatgcagacgcggggcgggtatcccggacgaggaggaccgcagatgcccagaggagcaaacggcgccttgattggaggaatcttgctggcgggcggcgcttggttgctgtcgaactcgctgttcaacgtggacggtggtcaccgagcgatcaagtaccagcgattaagaggcgtgagcaaggagatttacagcgaaggaacacacatcaacattccttggttcgagacacccatcatctacgatgtacgagcgaagccgcgcaatgttgcttcgctgactggcaccaaagacttgcagatggtcaacatcacctgccgtgttctgtcaagaccgaatgtcgaagctctgcctcagatttaccgaacacttggaaccgactacgatgagcgagtgctgccatcaattgtgaacgaggtcctg

SEQ ID NO: 730 - DNA, 441 bp, Trichoderma harzianum
cccacgcgtccgcccacgcgtccgcccacgcgtccgcacaatcaccactctcttacacatacatctatcaactccttgttgtaaaaccaccaccacattcaaaatgaagttcttcgccgtcgccgctctcttcgtcgccagcgccatggccggcccaatgggcagcgaaggatgcccaggtggtcttactggcaccgttccgctctgctgtgccaccaacgtcctcggcctcgcgaccctcgattgcagcacccccactgttcctgtacccaatgtcggcatcttccaggcccactgtgcttccaagggcaaacagcctgtctgctgcactgttcccgttgccggccagggccttctttgcaacaagcccactggagctcagtagagtgcctgttgtacttggatggtgaaccccgtccacgggatcacggggttcacaac

SEQ ID NO: 731 - DNA, 586 bp, Trichoderma harzianum
atttttgtattccaaagtagttaaccggtccaggtttctctttggactttttcgactcttacatctttcatttcttcctaagaactctttaataccccatacttcaaaatggctggcggtgatgttaagaagggtgccaacctcttcaagacccgttgcgctcagtgccacaccgtcgaggccaacggcggcaacaagatcggccctgctctgcacggcctcttcggccgcaagaccggctccgtcgacggctacgcctacaccgacgccaacaagcaggccggcatcacctgggacgacaagaccctcttcgcctaccttgagaaccccaagaagtacattcccggcaccaagatggcctttggtggcctgaagaaggacaaggatcgcaacgacctcattgcctacctcaaggagtctaccgcttaagcgatgaatgaagaaaaagaattgtaatgacagagatatcaatagacggggtgcggcgattgtactactatagataaagttagaatagtcgaagcaccatcactgtgcttgtaccattaatatccaactccgctttttcagcgactggacgctgctt

SEQ ID NO: 732 - DNA, 532 bp, Trichoderma harzianum
aagcaacaagcaacaacaaaacacatcaagttacaacccaacacaatctcttcaattacatcccacttatatactacctttaaagaaaacatccaatcaaaatgaccaaagtcctcatccttggcgctactggttatgtcggcaagagactagctgagactctagttcgaagcggccagcaccaggtatacggcattgctcgaactgaggccaaggccaaaacattggctctcgcagaggtcacgcccatcatctgcgctgatccagtaaatgaacctaaatcctatatgaaggctgtccgcgactaccacatcgatgttattgtcgacattgctggcgccaatcaagagtcggccaagttcctcagccatgccaaggagatcagccaagagcgactgaacagctatgccgcttctggcattaagggccctaagcttggattcatctattgttcgggcacttgggttcatggatctagtgataaagcagtcaacgatctcaacatcgctgggcccagcggtgtcacccctcc

SEQ ID NO: 733 - DNA, 576 bp, Trichoderma harzianum
gatagagccgacgaaccggaatatttgccattcaggcaaacaaagatagcttccccacgcgttaagagattgcagccgcgctaccaggccctcccaaagcttgcaagcactccgtagagacccgtaaacggagatggcacctcccgctccgtgagcgatttcggggagggggaggggaccaaagatcatgggggaggctttttattctatcgactctcgggaagcatctgctctcatcatcccattatcggcagcaaagcagccaagagcccccaccagacggccagaaactcggggtcagccctggcaacctggctcgatttctgtccttgtgtgggcgtgggcgcgtgggcgaagatgttttgagtgatggatgagaattaggaagagaccagggagagcaaccaataagaatctgacgataagcagccctgctgtgtggcggctagtgtgagccttttgggcacatgtttggagattcttgcgcgcccttgtacttgtactccgtagttttgaatggactcgggtacagtacggagctgatgtcgtgatgtttctaaattagataggagacgg

SEQ ID NO: 734 - DNA, 548 bp, Trichoderma harzianum
gcaattatattatgcttgacaagttgaaactgaccaaataacaaaatacaacaacaccatggctaccaccaacggcccatccaaattcatcccagaacagctcttccacactgttctcaccataatcgactactcccacgacgcctccggcgccaaccgcacgctattcgtcctcaaaacccacggcaccctcgccgctgcaaagaaatacgccagccacgccctagaagccgtcaacttcacagccgaagactttgaagtctatcgcatccgcgccgacgaagacccagccaaaccctggacccacggcgacggcgtgctggttttcgctcgctcctttgatgggcaggagtttctcgtgggaatcgacactactccgaacaatgaggctttgaccgcgacctcggatggagagatggtgctgcccgagggcgcaaagttcttgcactaccttttgcagattacggtggactacaacgccgaccgtagcggcagctcgcagaccacggaaattgaagggacgtatgtccatcgtgcggatgcttgga

SEQ ID NO: 735 - DNA, 326 bp, Trichoderma harzianum
aaaacccaaaataatcgccatcaattgcgcgccggccagcgattccctgccaccgagacgagcctcctcgaaatccgccgcttctccctagagccgacccggtttcctctctctcactctctcctccctctccggtccaaccggcagactttcgctccataacccatcatggccccctcatcgcttggtcgccccatgctccgctcgccggccctgagccactttgccttccgccgtttcgagagctctggcgccagcaaggccaccgacgccgccaaaaatgctgccggcaaggccaacgggtaccaggcaaaggctgcgcaggg

SEQ ID NO: 736 - DNA, 501 bp, Trichoderma harzianum
acaaagcatcccagagtcctcgtattcgcggggaccccaagttccacgatccgcagtcgctggtcggtttattggccgtctcagtccttcttggcaaacacgttgcatcgtctcatcatctcactcctcgtagcacaacatgtctgaagttgtggtgcgtgatgcgcgctactcagagttacccgaaattgctcgcgtgatggcaaaagcattctgggaagataatttgtttggccagctcattcaccctcatcgaaatcagtatccggatgatgtgcacctgtactggctgaggcgggctcgtgtcaacttctgggactgtcgctggcgatggctggtcgctgttgataaagatgagactggtcgtgaggttatcaccggtattgcgcaatgggcaagattgggcgatggtggtaagaggttggaccgctcgtacttggatcctcggaatttgctgaagcctctgtcttctattgccatgacaattcatgcctggttgtg

SEQ ID NO: 737 - DNA, 471 bp, Trichoderma harzianum
cccacgcgtccgcgcaagcgaaaaaggattaatcgcaactccgagatcctgctgaatcacaatgagacctactcaggttcgtctgggcggcggcgcccctcaacccaagactggccactggctcggtgactggggctcctttggtggtgccaagcagaagggcattatcgactacgggctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatgttgaattatgggtgtccaggggacacagtgtatatcagcgtctagattaggagaaaacaatagaaacgtttgactcta

SEQ ID NO: 738 - DNA, 415 bp, Trichoderma harzianum
  misc_feature (74)..(74): The residue at this position can be any nucleotide.
cagggtgtttcacaatgccgattgcacctataatcacattcaagggcggccagtgtgacgtcgacacatcgtcnaagccatacaaggtcacgccacagcctgaacctggttatatctatctatactccgaagatgatctggtgcatttctgctggcgacgacgggaccagcctctggatgaccccgaactcgacctcgtcatggttcccacagacggtagcttcctcccatacgaatacaagaccacccctcagcccacagcgaagaccaacgggcgcatattcgccctgaaatttggctcttcctctcagcgccacctcttctggatgcagtctaagccccagggacgaagtggcgacgcgagctacttcagcccccgggatcgcaagatcggcgacattgttcacagactctt

SEQ ID NO: 739 - DNA, 547 bp, Trichoderma harzianum
aaagtcattccttaaagacaaaagacatcgggtgcgttgccaaccaccttcttttacgcaaccctacaaacaacggcatctcgcccgcgcatctagtcgcctcgctccttcggcctcctccagcaacaacctcctcgcggtattctggaaatactaagacgctcgctcactcctttggatatacaacctagacagcatcttttatacaaatcgccaacatgaagttctccaccggctccatcttcctcgccgccctcggcgcctctgctcaccccagcggccacgctcacaagcgcgcccacgactctctcgagggccgcagcgactttgtcattgccaacaagcctgttgagcccagccctcccgtcgcgactcccactcccactccttcgcctgctgttcctactccttcgccttctggtgccggtcctcctgctcagaaggctgccagctctgctgctggtgtcggctctggcccttccacctacactcccttctgcggtggtaacaacaagcgtgctaccgctgctgagatcgcttacaaggg

SEQ ID NO: 740 - DNA, 528 bp, Trichoderma harzianum
aatttcacaagtttgaggagcaagccaggggtcgccaggcaccaccgtcaaaatgcctttccaaaagctcgccaagaacagcgcgtactacagccgctaccagaccaagtacaagcgtagacgtgagggaaagaccgactactatgctcgtaagcgcctcatcacccaggccaagaacaagtacaatgctcccaagtaccgcctggtcgtccgcttcaccaacaaggacatcgtcatgcagatcgtcagctctgagatcgctggtgacaaggtcctggtcgctgcctacgcccacgagctgaaggcttacggcatcaaccacggtctgaccaactggtccgccgcctatgccaccggtctcctgatcgctcgccgtgtcctcaccaagctcgggctcgacaaggatttcgtcggtgttgaggaggctgacggtgagttcaccctcaccgaggccgctgagaccgacgatggcgagcgccgccccttcaagggcttccttgacgttggacttgcccgtacctccaccgg

SEQ ID NO: 741 - DNA, 592 bp, Trichoderma harzianum
gtgctctgctatctcaattatctccgatctggcttgcagaagagtcatctgtaccgcaggaatctcacctaacaatgtttccaaccctcgtcagacggctggcccaatcagcaaaggagcccctcaccaaacaggttcccttgactatcataaacaatccctacaaggctcgaaaagtatggccacctgacttcaaagggttgactcatcaacaacagcttcggtttgagaagaagtacaagcgtcgcattaccctcgcacaccattcaccaagatgggagaagggtgtgaaatatgcgcagctcattacaattggagccgcgttggtatggttgcttttctattctgaattcgagtggtggggacgacagtataagccatcagaagagttgcgaaaacactacaccaatctctttggcgttcttgatcctgaaaagcgatacgagcgccggaaggacgccccagaagtaaatccatcatcaaaaaccccagagtcgaaatgagctgtaggataatggagctctccgatgcgtgtaatatagtacttgtatatatatggcgtttggcgcgatacccgtgttgggcaagggag

SEQ ID NO: 742 - DNA, 517 bp, Trichoderma harzianum
gactacgtacctcccccctacggcgccgatccccaaaccccggtagcgacacccaccggccagcctaaacacgaaccctatttcccgccgccaactcgaccccagcgagcgcaaggcttcgaggctccaaatcaaaacgccgcacctcccgtatcgtacaggcccgacggacggagtttcagaccgtcgctgcctccattatccacgtcgaccgacccctaccaatcttttggaagcgctggccttccatcgtcctcatcctcagatatgccgccacgaaaggtagtggcgcctccgccccctaccccagccgtcgagccgtctcctgtccggacaaaattcccgacggcccggatcaagcggatcatgcaggccgacgaggaggtaggcaaggtcgctcagcaaacgcccattgctgtgggcaaggcattagagctgtttatgatccagctcgtcacaaagagcgcagatgttgccaaggacaagggttccaagagagtgacggcgtccatgttga

SEQ ID NO: 743 - DNA, 627 bp, Trichoderma harzianum
gtcgagtcaccgcataaaaaaaaacacagggaaggcgctcagcccctctccccgccgacccttttttttccctgtcccgcatcaccaaaaaccaaaacacctcagagaccgtcgcctttcgcagccgccggttcatcaacctcgcctcccccaaactttcctttttcccacgagaaaccccggaacatccgagtttatgtccatcgaaaatctcaagtccttcgaccccttcgccgaagccgacgacgacaccggtgatatcaaaaaggtcgagaaccatatccatattcgtattcaacagcgaaatggtcgcaagtctctgaccacggttactggtcttcctgctaaatttgaccccggcaagattctcaccttcttcaggaaggaattcgcttgcaatggcaacaaggtcaatgatgaaaaggccggcgaggtgatccagctccagggcgaccaacgcaagaaggtcatggatttcctcgttgacaagaagagcggtctcggtctcaaccccgataacatcaccgttcacggtgcctaaatcgtcctctttcgcgccggcgccccggcccgcccttccagcgacttggcttcacagcatgctggtgatgagcgtgtcggaatggg

SEQ ID NO: 744 - DNA, 610 bp, Trichoderma harzianum
cccacgcgtccgcccacgggtccgcccacgcgtccgcgctttctaggcccttgtttcatttgagttcaaacgcttcttctcgtctctcgttcagaatttatttcgcgtccttcaaacaactcaaaatgaagtactctgtcgctgccgtctcggcctttgccgccgtcgttctcgccaagcccgagttcctcaactctgctttccaggtccaggagggcaagccttttaccctcgagtactctggctgctcttctggctgcgagattgttctccagactggtgctagcaccaacctgaaggacgtcaaggttcttgcttcttctgccaccggctcctccactaccgtcaccctggaggacattccctctggcatctacagcttcaagatcaccgacaagagcggcgagagcaactacagccagcagttctcctaccagggcagcggcaaggccatctccagcgcctcatctgccaccagcgctgctgagtccaacacggctgctcccacctccgagaccaccacggctgagcccaccagcaccaaggcttcctccaccaaggagcactccaccacgctggtcaagtcaaccactgctcactccaccaccga

SEQ ID NO: 745 - DNA, 629 bp, Trichoderma harzianum
gatgcccggaagacaagacgcttattccgggtccatgcccacaaactctcctcctcccccacagagcatctccagctactctcgcttcatccacgaccacacaaaacgccaaatgcaggcctttggagctgctctatcgcctacaagttccggtgcttcgggtcgatcatcagtcggtacatccatgaccaacggcacagcacctgccatgtaaccatcttgcatttccgcgggtgtccaaaagcgaaaactcgctgcttgaatttgcgcatgtttagctttagcggtgcttctcttttttccagtagcttgccattatggcagctacattggtaatctggacgggacttggaaaaaaatgaatttcgggacagtctaatatggaataacgcccccggtgtaacatggcgaatccaagattggaacgcctgcatagagacaaagcagcttctttttaccgatcacgcatttacactacagcaaaagcaactcttgcgtcacatcgaaaacgagccgacttggtgccactcgctaatttgtcgcttcgtttctatttattattgattttatgactatatgatacacgcacggggttttgggggggatctttatggcaggatactaatcgg

SEQ ID NO: 746 - DNA, 575 bp, Trichoderma harzianum
tggggtcgcaaatctacagcaaaaatggggtcgacaacgaccaagcagaccccggcgtcctttgtcgggaccagcaaggtcgtcgagactgactatccgctcatcgacaacgaccctcactttaagcgggttatcggatatgcgagaacgtcagactacgtagctggtgcaacctctgcggcctttgcaccgactgctctctatgccctcgagaggctcgccccgtcgcatgttggccggggaggctttgccaaagccatgcggttagccggattcattggcttggccggcggtttcctctacttttaccagcgatcagcccttcgattctacggcgccactgagaactcaagggaagtcgagatggatatgcgagagatggtttccaaggtcaaggcgggacagcctctgtatggcgagagcaagctgagccctcacctgcagggagttgcggcccgacagagcagatactctgcgctctttttcagcacagtaccgtggttcaactttgtcaaccacaaccagcacggcgtggacacgggcaagtactatcagcaggccgagagggaactgga

SEQ ID NO: 747 - DNA, 512 bp, Trichoderma harzianum
cgacaagtcgattgccctggtgagcaccattatcatcagaaaccgcaatcatgggtatctctcgtgactctcgccacaagcgctccgcctccggtgccaagcgcgcctactaccggaagaagcgcgctttcgaggctggccgccagggtgccaacaccaagattggcgccaagcgaatccacaccgtccgcactcgtggtggtaaccacaagtaccgtgccctgcgtctcgactccggcaacttcgcctgggcctccgagggctgcacccgcaagacccgtgtcattgccgtcgcctaccacccttccaacaacgagctggtccgaaccaacaccctgacccgtagcgccatcgtccagatcgacgctgctcctttccgacagtggtacgagtcccactacggccagcccatcggccgtagacgccagaaggcccaggccgccaaggagggcaaggaggtcgaggaggtcaagaagagcaagtccgtcgagaagaagcaggctgctcgctac

SEQ ID NO: 748 - DNA, 613 bp, Trichoderma harzianum
tcaacgccccgacaacccccaagtcacgggagccatgaggtacattcactctcaggagatcctggaaattccagagggcggtacgtttcaccattttccttttttttgatttcggccttgcagattcgatcgattgcactggaggaaaacatgtcttggatgacgatggaaaggaagaggtggaacttaatctctgctgttggagatgagggattggactggaacaatgggagggaactacgatcgaacgaaaatctgcttgctggcttggattacgcacttcttgaggaaaacgaagctgacattgaatttttttctccgaatagtcaaggtcaacatcaagacccgtatcgtcaccgttgagggtccccgaggcaagctcaccaagaacctcggtcacttggctgtcaacttcggtcaccccaagaagaacaccatctccatcgagatccaccacggcaaccgtaagaatgtcgccactctccgtaccgtccgctccatcatcgagaacttgatcaccggtgtcaccaagggcttcaagtacaagatgcgatacgtctacgcccattttcccatcaacgtcaacctggacaagaacaaggagaccggtctg

SEQ ID NO: 749 - DNA, 501 bp, Trichoderma harzianum
gtgtggcctatcgatcctttagtccctcggcatttgaggctagaggtgccagaaaagttaccacagggataactggcttgtggcggccaagcgttcatagcgacgtcgctttttgatccttcgatgtcggctcttcctatcataccgaagcagaattcggtaagcgttggattgttcacccactaatagggaacgtgagctgggtttagaccgtcgtgagacaggttagttttaccctactgatgacctcaccgcaatggtaattgagcttagtacgagaggaaccgctcattcagataattggtttttgcggctgtccgaccgggcagtgccgcgaagctaccatctgctggataatggctgaacgcctctaagtcagaatccatgccagaacgcggtgatagcacccgcacgtatagacggacaagaataggcttcggcttagtgtctcaccaggcgattcctccgtggtcctcgaagcgggccgcggtatttcgcgta

SEQ ID NO: 750 - DNA, 615 bp, Trichoderma harzianum
acggtcaccgctcaagggcttcctcgccggagtcacgatgaagaacgggctattaccacccttgcgattccttcgcagcaccagcttcctgggcgcaaaccaggcacgatggcttcacaagacgagggcggctccgacaatcccacagcctagaccattcgtccccgacgtccagaccttcctcacgctcattggccgcggcctcaacaagcacgcctccaagttcccgtcatgggagtctctcttctccctcacctcgccacaactcaaggagcttggaatcgagcctccccgcagccgcagatacctgctgcagtggatgcagcgataccgaaagggtgcgctgggacctggcggagacttcaaatacgtcacagacgggcaagctctgctgaaagtagcaacaccaccggcctctgttgtcagcgatgcgaaatatgtggtcaatgtgcctcaagaccaggaggcaggtctgggggattctgaaatccttcctcgacccaatggctacacagttagaggactcaagtcaatagcggggccgtttgcgacacccttgccgcaacaggccggtgcagtcgtcaaagttacggagggcatgtgggagcaacgcca

SEQ ID NO: 751 - DNA, 615 bp, Trichoderma harzianum
acacatcaagatggcctcttccgcccgtcagtttgcccgcgtggcaacccgcacaaccacccgctccttcgctgccgtcccccgacaggctttccgccagcagggtcgccgcttctactcttctgagcccgagaagaagtcatcctcctctctcctgtaccttggtgctgccgccgccgccggtggtctcggtatctggttcttcacctctggtgcctctgcctcttccaagacctttgtccccacccaggccgattaccagaaggtctacaacgacatcgccgagcgtctcgatgccgattatgatgatggcagctacggccccgtcctggtccgtcttgcatggcactgcagcggtacctacgacaaggagaccaagactggtggcagtaacggtgctaccatgcgattcgctcccgagagcggccacggtgccaacgccggtctgattgctgctcgtgacttcctcgagcctatcaaggccaagtatccctggatctcctactctgatctctggatcctcggtggtgtttgcgccatccaggagatgcacggtcccattgtcccttaccgacctggccgccgtgatggtgacgctgctgcttgcacccccga

SEQ ID NO: 752 - DNA, 542 bp, Trichoderma harzianum
ttcatcgctcaacaatcaattacaatcccgcaatccagtcgcgtcagacgcccgcttatccagactctctctctctcaaatcacagtcgaacacgttcttcgcaccatccacagccatgcctcccaagaagaccgaaggtgctgcccccaaggccaagtctggcgctgcccatgccagctaccaggacatgattacggatgccattctcaatctcaaggatcgcaatggctctagccgtcagtctctgaagaagtacgtcaaggccaacaacaccttgaacgtttcggacaacatgttcgattctctcttcaacaaggccctcaaggccggtgttgagaagggcatcttcgcccagcccaagggcccctctggaggcaccaagctggccaagaagaagcccgaggccaagaaggctgctgctcccaagaaggccaccgccaccgctaagaagaccaaggaggctcccgccaagcccgagaagcctgagaccgttctgaccaagaccaagtccggccgtgttgccaaggcccagaagcccgct

SEQ ID NO: 753 - DNA, 674 bp, Trichoderma harzianum
aaaacaaccgcagcaatggccgccgaaaggtccagcaaccccatgcgggagcttaagattcagaagctcgttctgaacatctccgtcggtgaatctggtgacagactcactcgtgccgccaaggtgcttgagcagctgtctggtcaaacccccgtctacagcaagggccgttacaccgtccgtacctttggtatccgccgtaacgaaaagattgctgtccacgtcaccgtccgcggccccaaggctgaggagattctcgagcgtggcctcaaggtcaaggagtacgagcttcgcaagcgcaacttctccgagactggcaacttcggcttcggtatcagcgagcacatcgatcttggtatcaagtacgacccttccatcggtatctacggcatggacttctactgctgcatgacccgccccggtgagcgtgtcacccgccgccgccgcatgaagagcagaatcggtgcttctcaccgcatcaagcgcgatgagaccgtcaagtggttcaagggccgcttcgatggcattgtccgataaacggtttaaaatccaaaccgaataaaatactttttttttcttgtcttgaaggaaatgggcatggcgaacatttgggggtaaaaaggatcatatggtcatgtattcttccgcttgatttttacatcagctcgtaccaa

SEQ ID NO: 754 - DNA, 685 bp, Trichoderma harzianum
tgatagttgacgtcttggtttgtttgttcgccgcttccaatctccgtgacacctccgccaccagttctctctccctccattgaactctctcctcccgagtaaatcaccagctttcgtatcttcacacaaacaattcaattcatctcaccatcatggctactgctcacgtctccgccgcccgctatggcaaggacaacgtccgcgtcctcaagaccgaccgcgacgccgccaccggcatccacaccgtcacagaaatgaccgtcagctgcctcctcgagggcgacatcgacgtctcctacacaaagggcgacaacagcgtcgtcgtcgccactgactccatcaagaacacaatcttcatcaccgcaaagctgaaccccgtcaaccccccggagctcttcgccgccatcctcggctcccacttcatcgacacctacagccacatccacgccgcaaacgtcaaggtcatcacgcaccgctggacgcgcatggaggtccgcggaaagccgcatcctcacagcttcttgcgcgacggccaggagacgcgcaacgtcgaggcccgcatcacgcgcaagggtggcatcgtcatcaacagcggcattgagggcctgactgtgctcaagagcaccggctcggcattccacggctttgtgcgggacgagtacaccactctgggcgagacctggga

SEQ ID NO: 755 - DNA, 397 bp, Trichoderma harzianum
cacacacaactcaaccaggctttcaactctcaactacaccacaacttacaatctcatctcgcgaccaaccaactttcacaatggagactgtcaagcaagccgtcaactacgtcgctgagtccgtccagggcgctgcctctggtatcagcaaggagaccaacaaggagattgccaaggacagcaacgtcgacgtttccactcgtttgtccgctggcaaggacgcccttggtgacaagatcgacgagactggccacaacaacaaggccgaggctcacaagcagctggctgagcacaactagattggcataaggagcttcgattgcttcacaggcgttgaaccggatcagagcgaagggaatatatagcctcactaggcaggaattgatgatttgaattc

SEQ ID NO: 756 - DNA, 646 bp, Trichoderma harzianum
cactgtcgctatcatggcccgcggaaggtcagcgtgatttggcgcgcgcaaaaaatcagaagaatgcgtccaaacatgtgagtcggttttgcatataaaatcctcaacaggaaccagggttgactaattcggtgtcgtgtctttgcagaaaggcggcaataccgagaacggatatgagcaagcaaaatccaagttgagtaacgccgagattatgaggcagaagcaagccaaaggtccgaacaaccaagtctacccaatacctcttacgaaccagtcaacttaccaaggcaacagccaatgccgagagagacctagcggcagcaaaggcattacaagagaaaagggacgcaaaggcgaagaaaccgactgaattgggcgcttcagctgtggaggttactggacatgcaaataacccaagaggatagcaagagatgggagaaaacacggcacggcgaaatcaggcgctccttgagactttcacaatacggcgcaaatttgggacaatctaggtgaagagggggaagcgttttttggcttaataccaggtatagccatggataatagcgaaatggatattttgttgcggtattgctattattattctaccaaaaaaagttcgacctttgtgtccctttttttcccctcg

SEQ ID NO: 757 - DNA, 602 bp, Trichoderma harzianum
attatcctcccctggcaagcaaaccacgagcctctgtcagataatcaatcgccatcatgcctcccaagttcgatcccagcgaggtcaaggtcatccacctccgtgccaccggtggtgaggttggtgcctcttcggcccttgctcccaagattggtcctcttggtctgtcgcccaagaaggtcggtgaagatatcgccaaggccactggtgactggaaaggtctccgtgtcaccgtcaagttgaccattcagaaccgtcaggctgccgtctctgtcgtgcccactgcctcctctctcatcatcaaggccctcaaggagcccccgcgtgaccgcaagaaggagaagaacatcaagcacaacaagtccgtcagcctcgatgagatcattgagattgcccgcaccatgcgcttcaagtctttcgccaaggagctgaagggaaccgtcagggagatgctgggaactgctcagagtgttggctggcaggtcgatggaaagaccccccaggctatcctggaggccatcgagaacggcgagattgatatccccgaggagtagagtgtctggttcagaccgcctgtcccaccgagaagaaattctcgtgca

SEQ ID NO: 758 - DNA, 475 bp, Trichoderma harzianum
cccacgcgtccgcccacgggtccgcccacgcgtccgcgagcacttggaccgccatggccgcatatataaagtccatgacgggggttgagctgcccatgctggacaagctggtctcaaccctcaattcattcaacatctggcgttcgcccgcaatggctctgccccaggtcaaatccctgcaggactgcgtcgactactcaaaggtcgttgagcctttcttgccccagctctaccagcttccccaccacatctgggagagcatcgacagtctcgatgccctgagagagctctatgtcacgacgaatcccctgatttcaggctttgcggcctctctggttgttgggcttctcgccttgatcgtgtccgagatcaatcgcaactattctcagatcgaccgcctgtggagtatcctgcccaatctatacgttgtccacattgcgctctgggcacgtgtagctggtttggcgcatggtcg

SEQ ID NO: 759 - DNA, 577 bp, Trichoderma harzianum
agcaattggaccctcgctttagccgaggggcgaagatataggccaagatgaggtcattaggagagcggttaaacctgcttcgaaagaaactcattaacatcagatgcggccccggcgcagcgatcctccccgcggaggtcacccggatacacatggacttcgccctccgtctaaaaggcggccacatgggagctaggaaattctggagagaatacctcccccgcctgaaataccacaacccttccatccccatgatcgtcaaccgccacgaccagaaccagctccccccaaccatgacaatctacctccgcaagggcggctcctcagtagcagacccagcgtcttcttcttcttcttcttcctccgaacccatcgcccagccctcatcctcccgaacgaacctctccaaggcccagccccccaccgcggacgagcgcgtcgtccacatcgacatggccaacaagcactcatcacacatcctcgagttcttcatggccgagacccgcgccgttccgctgcagcccacgaacgaggagattgccgagatgcaggccctcgaaacgctgcgcaagaacgc

SEQ ID NO: 760 - DNA, 341 bp, Trichoderma harzianum
ttctcatcacattccaaccatcttcatccagtcgtcttggattcatcaaacagctcttggatccgttctgatccagccaaccaaccatcgccatgtctgaacctctcaccaaggtcgaatccggcggtcaagggctgtcatcatcaccggccaaagagaaaggccataggaaaacaacctctagcgcgggtggtgttatgaccattggggaaatcaatgaaagccatgctcctctaaaactcgcaatagagacacagcagacagcgtggaaaataaatcatcggcccaaggatctcgacaatgatcatctgctacaggttcccctcagcaagcctcccatc

SEQ ID NO: 761 - DNA, 524 bp, Trichoderma harzianum
agatctctttcgatatctcatccttgcaactcgtctgtctcctgcagcaccgaatatcgtttcctggaaactttaaatctatcaaaacaacaacttccttttacacatccaccatgaagttctctagctttgctgtccttgccgttgccgcccttgttcaggccaacccagctccctctcccgccccatctcctgctcccggcctgggcgacttcatcgacgacgcttccacctggctcactggcaaggccggcgaggtcaagacctggctctccgacaaggctggcgaggcctcctccttcgccagccacgtccagtccaaagtcgacgccaacgagtccaaggccagcgcggcagccagcgccatcaaatccatcttcgacgatgcgccctccagcgtcatcgccagcctgacctccgaagccggctccaagttcagctccctcagcagcgttgccgccactgccaccggtgcagctgcctcctcggtcaacgccgacatttccaagctcagcgcctccctt

SEQ ID NO: 762 - DNA, 419 bp, Trichoderma harzianum
gtaggttgtcgatagcctcaaatatctagagagcagcgatagccacaagacactcgacaagactcgattcgagagctcgcgacaagcgcaccatagaaaatgccagctcggcggaacaggcgcttcttctcgcgagagccattccacaatgacgaccggctaacattgcagcacgccgaggggccttttggctttctcaatccaacaagagctcatttcgaccactcagcactggctccgaagccgacgcctgacgagatagcggaaccacatgagagcggcgatgatgcggaaaccaagcaccaacagacaaaacaagccgccgattcgaacgtccccgccaagaacgtcaagttcctatggcggtctcgagacaatcgaaagggtcggcatcccttgctcgttcaaaagccggtccc

SEQ ID NO: 763 - DNA, 530 bp, Trichoderma harzianum
tcgttcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctgggaatcggcgcctaccgagataacaatgcgaagccatgggttcttcctgtggtaaagaaggctgatgagattctccgaaacaaccccgaactgaaccacgagtatgccccgattgcaggtatcgagagcttcaccagcaaggctgcggagctgatgctcggcgccgattcgcccgctctcgcggagcgccgcactacgtctatgcagaccatctcgggaaccggtgccgttcacttgggagctctgttcctcgccaagttttacaaaggcagccagaccgtctatgtgtcaaatcccacatgggcaaaccaccatcagatcttttccaatgtcggcatcaaggtcg

SEQ ID NO: 764 - DNA, 521 bp, Trichoderma harzianum
cccacgcgtccgcccacgcgtccgcccacgcgtccggctccgcaagcgaagcagcatcttcggctcagacgacgtgtttgacggcctgaagcacaccttcaagatggacggcttcaagggctatgctggtcacttccacgagtccaccatcgagcaggtccggaatcacccggatgtcgagtacatcgagcgcgacagcattgtccacactatgcttcccctcgagtccaaggacaacatcatcattgaggattcttgcactcccgagactgagaagcaggctccttggggtcttgctcgtatctctcaccgagataccctcaacttcggctccttcaacaagtacctctacaccgctgagggtggtgagggtgttgatgcctacatcattgacactggtaccaacattgagcacgtcgacttcgagggtcgtgccaagtggggaaagaccatccctgccggcgacgaggacgaggatggcaatggccacggcactcactgctctggtaccgttgctggta

SEQ ID NO: 765 - DNA, 495 bp, Trichoderma harzianum
ggctctatcccctcatcatgaagtttgcagctcttctggccactcttgccccggccgttctggcattgccggcctctgatgccgcattgaccagacgccagaccagcctctcaaccatcacagaccaatatctcttcagcctcactctccctgatttcatttcccgccgcaatgccaagaacccagccacccttgactggacgtctgacggctgcaccagctcacccgataacccttttggattcccttttgttcctgcttgctaccgccacgactttggctaccaaaactaccgcatccaaaaccgattcacagagagcggcaagctcagcatcgataacaacttcaaggccgatctatacttccagtgccagacatcgagtgtccaaagcgtttgcaatgctcttgctgatgtttactacgctgctgtgagagcgttcggaggcggcgatgcttctcctggaaagcgcgaacaatcacaagaggacttggtta

SEQ ID NO: 766 - DNA, 338 bp, Trichoderma harzianum
tcgttctgcgcaccaactcgcccatcatggtgtctcgaagcatagccgtcgtctctcgcatggcgcccatgcgccatttgcgcccttctcctgtcttccgccagggacttcccagccttgtccggtactatgcagacaagatcatccaggtgccggtcatggctgagtccatatctgagggcactctcaagcagttctccaaatccattggcgactacgtcgagcaggacgaggagattgccaccattgaaaccgacaagatcgatgtcgccgtcaacgcaacagaagctggtgttatcaaggagtttttcgtcagcgaggaggacaccgtgacggtc

SEQ ID NO: 767 - DNA, 382 bp, Trichoderma harzianum
cccacgcgtccgtcacaggcttgccttggcaaatagacaacagaaaccctgtttcaagcccgttgactctgtgaagccagatctggatttggcttccatgcgtgcgtcttatactttcaggagaacgccgcagtagactacttaaagacttactctccccacgtcaagacgttcctcttcatccatcttttccaagcacgacaccatgactacccgctcccttcctagcaatggcagctctgcctttgactacatcatcgttggtggaggcaccgcaggctgtgtgattgcctcgagactctccagctatctggccgagctccgcgttcttctcatcgaggctggtccctccgactttaacctcaaccacgtcctcaatctg

SEQ ID NO: 768 - DNA, 384 bp, Trichoderma harzianum
tacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacctggtccgttggcagcgccatctccaacccaacaacccttgctcaaggcggttcctatggcgagaccttctcacgagaccccgtaaccggcggtcgtgccatcaaggtcaccgtccagcccgatggcctctacactggcaagccccagaccaacttcgccatcaaccttgaggggaacaccatctggtacgatctttcagatgtctttggcgatgccttcaacg

SEQ ID NO: 769 - DNA, 566 bp, Trichoderma harzianum
tagatcttacagtattacgaactcggtacccggggatcctctagagtggacctgcaggcatgcaagcttgagtattctatagtgtcacctaaatagcttggggtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactggccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtc

SEQ ID NO: 770 - DNA, 366 bp, Trichoderma harzianum
ccacgcgtccgcccacgcgtccggccacgcgtccgcgctcgctaagcacctggaaaacttaccttggcacttttgtcaatttcattctttaagagcaaccggatcaataatcttaatcaagctccctcgagtttaattcctaatagcgacaaaatgaagttcaccggtgctggcgctctcgccggcgttggcgtttctggcggctaggttcctcctagcaacgtcaccgttgtgaccggtgtcgttgaccaatacgtcacctactggccctacgctacccagatcacccacgggagcaagacctacaccgtcactgggcccaccactctgaccatcaccggctggccctggaccatcacccggccc

SEQ ID NO: 771 - DNA, 521 bp, Trichoderma harzianum
cccacgcgtccgcccacgcgtccgagcttaccacgcataaccatcaatcgcagtcacaaatcagctacaatggctcccatcaaggtcggcatcaacggcttcggtcgaattggacgtatcgtcttccgcaacgctgttgagcaccccgacatcgaggtcgtcgccgtcaacgaccccttcatcgagaccacctatgctgcctacatgctcaagtatgattcctcccacggtattttcaagggcgacatcgatgtcgatggcaaggacctcgttgtgaacggcaagaaggtccgcttctacaccgagcgtgaccctgccaacatcaagtggagcgagactggcgccgactacattgtcgagtccaccggtgtcttcaccaccaccgacaaggccaaggctcacttggctggcggtgccaagaaggtcatcatctctgccccctctgccgatgcccccatgtacgtgatgggtgtcaacgaggacaagtacgacggctctgccgatgtcatctccaacgcctc

SEQ ID NO: 772 - DNA, 593 bp, Trichoderma harzianum
tcgatcagtcgacaattcattcaagatgggtaaggaaacgcctgcaaagaccggtctggccgttggcctgaacaagggccacgtacgtcaatacaactcgcgatctcacctcgtggaggatctctgcccccaaccttgatctcggcagacgatggacgctgacgttttatggtttgtgtttgcctgaatatagaagaccactgctcgtgtcgtcaagccccgtgtttctcgcaccaagggccacctgagcaagcgaaccgctttcgtgcgtgaggtcgtcaaggaggttgctggcctcgccccctacgagcgtcgtgtcatcgaactgctccgaaacagcaaggacaagcgtgcccgtaagctggccaagaagaggctcggtacctttggccgtgccaagagaaaggtcgatgagctccagcgcgtcatcgccgagtctcgtcgtgctcactaaacgatttcttctttaagcgagcgggagagattcatcttggtaatggggaaaaacaaaaattatttcaacagggaaatgaatttaaaaaaacactacgggtttcgcatggatttggcgtggtcatgaattttgattgaat

SEQ ID NO: 773 - DNA, 542 bp, Trichoderma harzianum
cacaaaaatcgttcaagatgcagattttcgtgaagaccctgacgggcaagaccatcacccttgaggtcgagtcctccgacacgatcgacaatgtcaagtccaagatccaggacaaggagggcattcccccggaccagcagcgattgatctttgctggcaagcagctcgaggatggccgcaccctttccgactacaacatccagaaggagtccaccctccacctcgtcctccgtctgcgtggtggtgtcattgagccctctctgaaggttcttgcctccaagttcaactgcgacaagatgatctgccgcaagtgctacgcccgtctccctccccgtgccaccaactgccgtaagcgaaagtgcggtcacaccaaccagctccgacccaagaagaagctcaaataaatcatttcaccaaggatgtggcgtctgggttatggcattctggggtggcgaggacagaggtgcttctgctttattccggattttgtttctacattagcatcagggcagaggcaaaatatatcaatctagatgatgtct

SEQ ID NO: 774 - DNA, 575 bp, Trichoderma harzianum
tcatccttttgcttccagcagctatcaagacttgacttaaaaaaaccagtcctcataaagacatctacaatcagtcaccatgcagatcaccaagagcctcatcgctaccctctttgccgcttcgaccgcctttgcggctcccactcctgcggacaagtccatgatggccgctgtccctgagtggacaatcaccaacctgaagagagtgtgcaactccggcaatacctcctgcacatggacctttggcgtcgatacacatctcgccactgccacctcatgcacatacaccgtcaaggctaccgccaacgcttctcaggccaccggcggccccgttacttgcggcccttacactatcacatccagctggagcggccagtttggccctaacaacggcttcactacctttgctgttaccgacttttcgaagaagctcatcacctggcctgcctataccgatgttcaagttcagggcggcaaggttgtttcgcccaaccagagctacgccccgaccaacctgccatagatggaatgaatttgcttggaattactatacgcaaggtcaatttactcccaaa

SEQ ID NO: 775 - DNA, 598 bp, Trichoderma harzianum
aaacaagcttctccatcttttttcagactccttgagaagagaactcggacttagacttgacttaactgtctattacacacacagctctccactaaaagcatcgagctcttacacaacaacacacaaacaactttgtcaacactcacaaacccttatccggtttcactcaactcttttctctctcaacaacaaactcactcacaatcactatgccttcttctcaaggacaaagctggtgggcccgccactgcaccccccgacccccgatcaacaaggtcgtcgcctgcccctgccactactgctacaacaagcccgcctgcgagctcgactaccccgagtcgtccaactgctccgagacgaacacccctgctcagtcgaggcctgtcagcccccgaggccgcaccagctcgtcttcgtcttttcacgttgagaaggccgagaagcagtaaacgacacattcgatcatcgaaatcattcaaatcacaaaagcgagtacatctttgaagatcctttggatactataggatatacacacactttcggtttcaacattttctttgtgtcattctctctctactgagcgagcgaatacaaatat

SEQ ID NO: 776 - DNA, 438 bp, Trichoderma harzianum
atcaccactacatcttcccaagatactttggttcccccgccagctctgggaagctatccatccatcgacaccatggataatatcggcggcaccatcaagcgccgttcgacggaggtatggcaagctgcgcagaacaacatgcccaccatgccctctatgcctgccatgccttctttgcccgctctcccttctctggcggccatgccacaattctcgtttgattctttccggaggcaaccccagcaggaaggcctgaaaggcacctgggagcgcattgacttgcccccggttcctcgttcctcccactctcttgacatcatctctgggtgcgcctacatctttggtggcgagatcaccccccacgaacccgttgacaatgacattgttgtcattcgccttccctttagcagggctcccggcgactacttcaagatcccg

SEQ ID NO: 777 - DNA, 535 bp, Trichoderma harzianum
aaacatctcgactccctacagccaaaagcttctctcatgtccgactacgctcctcccacagggcctccgccgcccaaggcccccgaagttcccgctggctgggccgcccggtggaacgaccaatacaaagaatggttctacgtaaatatctacaccaaaaagtcccaatgggacaagcccaccagtcctgtcttccctgacggagacgccccgccttccgggcctcccccaggctatgacggccacaacgctccccgcacgtccgatgccaagacgaacccctatggcgatcagagcaacaactttggaggctcatcatcaaggcagacgcaggaagacgaggatgctcgcctggcagccaagatgcaggccgaagaaaatgcccgagctcgcagcgcttcttccaaccctcccggatacaacaactattccggaggcgctgccgattcgtaccgccagcagagcaccagcccgtaccctcccccgcaaagcagcccgtacggtacaccccagccgcagcagcaacagggcgaat

SEQ ID NO: 778 - DNA, 347 bp, Trichoderma harzianum
aatcaaactcttaatctctattcttaaatacatctacctctcacaatggatttcgtcaacaaggctatgggcaaggaggagcgctccactcagggcaccgctcccgctgctccccaagcaggcggccaggtccagaaggacgattacgtcgacaaggctttcgccatgggtgccaaaaagagcggccacaacatggatcgcaacacacaggagaagattacggatgcaggccgtaacatgtacgagaaggtgacaggaaacaaggtcgaccccaagtggtctaattaatgaacggacgagttatgactcacaacaagactgtacaatagtaataataacatcttacc

SEQ ID NO: 779 - DNA, 360 bp, Trichoderma harzianum
ataaattcgaggtgttttagacgcaagcttctcttttacacactgaagctgctgctgcaaccatcaccaacataccacacgcaacaacacaacaccaccacgtaataacgagcagaacacccctcgcttgaacttgttgcaaaaaacactctcgcctctatttcataaatcaaattacacacgaacaaaacaatgaatccaacagtcagaggcttctcaaccgccgcaagagtgcacccgccctttttgccacatctccgcccatcgccgcgccgagccccgatccgacgctggtaagcactcaactctctctcacgtcccccatccataaggataccatagcagcaaaaagacacaacc

SEQ ID NO: 780 - DNA, 515 bp, Trichoderma harzianum
atctaacagttcaatccagacaccgccaaaatggtcaagaagagaaagaacaacggccgcaacaagaagggccgcggccacaccaagcccatccgctgcagcaactgctcgcgatgcactcccaaggataaggcgatcaagcgcttcaccatccgcaacatggtcgagtctgctgccatccgtgatatctccgatgcctctgtcttcgccgagtacactgtccccaagatgtacctgaagctgcagtactgcgtctcttgcgctatccacggcaagattgtccgtgtccgatctcgcgttggccgccgtaacagggctcccccccctcgtgtccgctacaacaaggacgggaagaagatcacccctaccgctgcccccaaggtttaaaaaatgggtatgacgggaatgggttggacggagtctggtttactttaacgccttcatgtaatttgcttagatgaatacccaggacaaagagaatcctggagcctaaatgaatcggactttttttcttg

SEQ ID NO: 781 - DNA, 557 bp, Trichoderma harzianum
ggaaagcgtttgcacatcggtcaaaatgtctgagaagcctcaaaaggtcctgggcatgccgcccttcatggcggactttctcatgggtggtgtctccgccgctgtctccaagactgctgccgcccccattgagcgtgtcaagctcctcatccagaaccaggatgagatgatcaagaacggccgtctcgaccgccgctacgccggtattggtgactgcttcaagcgtaccgccgccgacgagggtgtcttgtccctgtggcgtggtaacactgccaacgttatccgatacttccctacccaggccctgaactttgctttccgtgacaagttcaagaagatgttcggtttcaagaaggagcgtgatggctacggcatgtggatgctcggtaacctggcctccggtggtgctgctggtgccacttctatgcttttcgtctactccctggattatgcccgtacccgtcttgccaacgatgccaagtccgccaagaagggcggtgagcgccagttcaacggtcttgttgacgtctaccgcaagaccctcgcctctgacggta

SEQ ID NO: 782 - DNA, 558 bp, Trichoderma harzianum
agcaaacaacaatacaatccatagaggattacctctcaactcaaccacctttacgacaatcgcaactcaataagattctttcagtgtattatcactcaagatttgaatttcgattcgaccaagaaaactccaatcaaatttattacaccatataatattttcaacttcaaacatttttctcaatatgtctgctgctaccgtcacccgcgctgctgccagcactgttcgcaagcctatttccttctacactcaagtccgaagaatgggccgtgtctttgagagccacccatacgagagatttgcaaccaccatgaagcctgcaaagcccgactactacaagaacatttctttcactgctggcaaggttgtcacttatttccccatcatcggcgccatgcttggctggcccgtcctttgcaaatgggctttggacggacagatcggtcgcctggtaagaggtgatagaggcaatggtatagagtgggacagcaaaaagatatagagatgtccatctttcgactgtatatatacactttgggcgtttggatggactatggg

SEQ ID NO: 783 - DNA, 237 bp, Trichoderma harzianum
gcgctccgccgtgcccgcagtctccatgcgggggcgggccagcgacaagaccaccgatggagtcgttcccgccaagcgccagcgcacagattgggtttcccacaaggacctggcccgtttaaagaaggttgccgatggacatcacgagaataccgttgccgtcaaagacgccacgtttgacctatgggatgcccctgcgccggtgacccaagatcctacagatttcctgcctgaaaa

SEQ ID NO: 784 - DNA, 498 bp, Trichoderma harzianum
aagcattctcctctcgttcagatctcaagagagggaagcactcaaaccaatcactcaacctcttcaagaccacctttcaaaacaaaccttcaacatgaagttcaccgccgttgcctttgccgccctcgctactctggctacagccagccctcaccctcctcctcctcacggttgcaagcctgctacctactcttgccttcccaacgacagcggttggcaagtgtgcagcactgccggtcagtgggtgtttgctggcacctggcctcccaagactgtctgcaagttcgacagccaaaatggcagcccctactgggttccccccaacttcaccatcccataaatccattaaatggggatcaacggggctacttacaaaagcctaccggatgagcatgagatttagagtttttggttgctaagacgtttcgtggcctgtcattgtcttgcagatcaatcctggacataaagtttacacataacatatggtacactcctttg

SEQ ID NO: 785 - DNA, 495 bp, Trichoderma harzianum
atcaccaattgcaccccgccatggcttcaccaatggctgcctctcgccatgtccagcgcgtggctacacagatccgtctgcgctcagcgcgggttcccagaggccaattgaccttcaatcgatgggcatcgtccgcttcgggcagtcggcgagctcccgccagcttcggaacttcatcctcggcagccgtttggcttgcagccgccgccattggcatcacggctcccttggcctacagcttgacaacagcagaacctgcaaagctcgacgtcacatcccttgccgaaaaggatgagcagaagaagagagaggcggttgtcaccgaagagtcgcccatgcgcctgcggatggaaaagttcatcaaggagcagcagcaaataattgtcaaggaactcgagcgcatcgacggcaagaagtttcgcaaagacgagtggacgcgacccaatggcggcggcggcataacctgtgtgctgcaggagggcaacgtattcgaaa

SEQ ID NO: 786 - DNA, 479 bp, Trichoderma harzianum
agaaccacagaattcatgggccgccgctatgcagatgggcacatcgagcagatcatggggcttcatttagcgaagcgaagcatcctcgaggcttggattcgtccaagccaaactagcgcagatagcaggtatcacgataccttgtctctcatttactcatgacgaattatcttgttgagaaaaaagaaaagaaaagagtcggcaacgcgcgttttggcgagcatggcttgtcgggatcttttgtcgaatctcggcggacggttgatacccagcatcaagggggtttgggcgcgcatagcgacgattttggttctgtgccgtttgccatctcatatcgagcctggagttttggacggctgatatttttcaccctcgtggaattttcctttgtcgtctagttcacgctgacaagttgttttttccttggtttattttgtctccttgcgcgcaagttgttgcacctcgagccggcgttttgg

SEQ ID NO: 787 - DNA, 422 bp, Trichoderma harzianum
cccacgcgtccgctgtctggcttactctgttactgaactcattgttctttgaattgaaccttacgatatcaattacaacccattgagctgctgcaccaccaagctaccacacttacatacaaacacacacacacacaaatcaccactacaataaccacacaaatcaacaacaccaaaacaacaacaacaaccgtcacaatgcccgtcaactacgtcttcacagagtccgccccctcccaaaacaactacatcagatccggccgcggcggcgctggcaacattgtccgctcctcagccctccctcccacatcatcatcctccgcctcctcctcagcctcccgccagctccccaaccagcgcttcttctctggcatcggcggcgccggcaacgtccaccaggccgacaagctccagcccgctct

SEQ ID NO: 788 - DNA, 604 bp, Trichoderma harzianum
  misc_feature (163)..(164): The residues at these positions can be any nucleotide.
caaagaaacaaaccctcgagtccaccggcttgtgggagacttccgcaaggccttcgccctcgaccccaatcgctccaacggcgtccccctgaacctttacttccgaaacccgacgcccggagccttggaccccctcagcttcgacgaccccgtcactattttnnctggctccattgccgacaacgcctactggaagcgtgatgtccgtcgcgcgtacccgcagctcagcgtcgttacgcagggcgacgccgtgtcgttgttgacggttggaagcgccgcacagcccaaggtcgagctgattggcgaggccggcgagaaggctctcgttgcggcgcagaaggagggcgagacgacgggcctggccaagttcctggagaaggcgcccaaggatgtggcaaaggacgtgttcgtcaatggattgcctccgctgccgagcggacaggccctggaggctggaggatgggatgtgcacaagtacgagctcaatgaggatcagacatatggtgaaggctatcctaccaggacgttcaaataacacgggcaatagggtcgacttgtgtaaatacagataagatgaagaaagattagaatttcccgaaaaaaa

SEQ ID NO: 789 - DNA, 157 bp, Trichoderma harzianum
caagctgggagaattgcgcccacgcggaaaccgaatattgggacaggaaatagacagactgaagggaatggagaagagaggatgaacatgtacaattacttgtatcaacgccgtaatgccacgacttattgcatgctttgaatcattggcacaaaaa

SEQ ID NO: 790 - DNA, 363 bp, Trichoderma harzianum
ggcgcgccaaaagactgtacacagacgtcttttgatatattttcaaaatgggtggcggtggaaaaatcccttaccccaagcacgtctggtcgccttctggtggttggtacgcccagcctgccaactggcgcgccaacacgctcatcgccggagccgccatgttcggcgtcatcgctattacgtggaagttcagcgccgacagggaacgatgggcgcataagccggagccgtgggagtggcatcctagccgatactggtcaaagcagttgatcgagtgggacaaggaggacaagctgaaggcagcaagcaacagcaaggagtagagttttctttttgggagaaggataatagacgaaattgtac

SEQ ID NO: 791 - DNA, 201 bp, Trichoderma harzianum
ggcaacaaggatatccgaaagttcttggacggtctgtacgtttccgagaagggcaacgttgttgaggaggcttaaatgtaccggacaaggatctctgtttcttttgcgtttctgggactccggagtggcgaaggttcatcattgcatgtcacgtagcaacggggctactcttttacaaaaaatacattaaaaagtaaagtg

SEQ ID NO: 792 - DNA, 630 bp, Trichoderma harzianum
gctttgttgatagtttggccgccactcgtaattcaattggggcgagcgagtgagttgcgagtgttggtttacgagcactactgggacgttctcctaccgataaaagaaaagaagaaaaagatggctgaggaagcatcgtttcgagacgcagttgcgtctgttcccggcctctcgggtgcttccgagtcggttgccgccgaccagcagcccaagaagttccccaagggagtggttctgggcaaggatggcaaaccatgtcgaagctgcacatcatttgcttcctgggccgcgcagacaaaaaaagacgtcgccaccggcagcagagcagtatctacaacagcaacagccgtcgcctcgggccctccggccgactgtccgcccgacgtcgagacccttggccggagcacctggacgctcctccactccatcgcggcatcgtacccagaattgccctcgcagggacaaaagtcggacctgctgagcttcgtcgggctcttctccaagctgtacccgtgctgggtatgcgctgaggacttccagggctacatggcgcggcagaagccgcaggtgaacagccgagacgagttttcgcagtggctgtgccgggctcacaacgatgtcaacaggaag

SEQ ID NO: 793 - DNA, 299 bp, Trichoderma harzianum
ccttctttcattgtcaccctcaaggacgatgtgtcagatgaacaggttgccgcagccaagcagaatgccaaggatgccggcggcacgatcacacacgagtacaccctgatcaagggctttgccgttgtatgtatcctgagggcatagttcactcgctcgctgaggacccctcagtgcaggccgtcgaggaggataaggatatgaggacgcagttttttttttttctctattctgttcttgttgcatctacatctacatacatctacattagaaagacgtaatatagagattgtatcaac

SEQ ID NO: 794 - DNA, 537 bp, Trichoderma harzianum
gccatgctgtgagttgtctctcctctgtcttgtatccaacgaacctggtcctggaaggctgcagcctcactgcctcacgttctcgtacgccgccagccagtgctagcatccgcatctcccgtggctcgtcgcggtgcagcaagcccccgtcactccttggtcacagagcgccatcatcatgccagcgtcgttgtcaccaagccctcagtcctctcagtcatccctgatggagaccattccagatgacaagggtcctgatttgaccctggataagcctttgccccaacgccccaggacgcccgctaagctcttgcgtcttggggtgcggaatcgccgccacgagtacctggtgaaaactcggtcgtattttgacaatctggaacatgaacttgctggtatgatatcgcatctcatttttttcaatctctctcctgttgtcggctgatgggtcatgtcgaccgatcctgtagcctcgagagagacctcatcatccctttccaaactgacttgactgaaaaccaacattgcggtgtcgtg

SEQ ID NO: 795 - DNA, 293 bp, Trichoderma harzianum
cccacgcgtccggggggggaattgaacgggggtgagggctttatgagagaggcgagctttcgtacgagccttcggatcagataagatcaggtcgggctggtgacaggcagccacggcccaccagggtccgccataggcgtacaacgaccccgtaagatcccagtaatggctcattaattgctccagctgtggctggcatgatcatcgtcacatggccgggtttgggcgactaaaattagcgggctgtgccagcaggatgagaccaagacggcagaggagcacggccgagaagg

SEQ ID NO: 796 - DNA, 435 bp, Trichoderma harzianum
atgaggctatgtttgccctacctgccatggtccaaggccctctcttctccatggccactgccgccgcccgtgagaacgagaagaccaacgtccgcgttaacgaggtgtatctgatgttccgcgttgaggttgattaggctgccaaggagcatggcgtctcaagcagctccgaattcgcctccgtctacgaaggaattttttacaaccctgagatccgcagctcgcgcgttcgtgttgcctcgcctgctgacttcaccgacctgaagtgggctaagaagttctaaaaagactgatgcgtcttttttaaaccttcgtgtttctctccattaagcattttgagaaatcatctccctgttgctggctgattacacatggttcagtagttgacaatactgttaaaaagaatgaaatgaaataaattgaaacaaaaaaaaa

SEQ ID NO: 797 - DNA, 117 bp, Trichoderma harzianum
cgtatctgcggatgccggggatggactccggtgtacttggcacggctcgcttccgtttgacataaaaatgcagtgtaacaggtagatggacgtacatgtagatgtaaatgcggtact

SEQ ID NO: 798 - DNA, 82 bp, Trichoderma harzianum
atcaaagaacaaacgcatcgttcaagatgagagccaaatggaggaagaagcgcgtcgtcgccttagcgcagagaagaaagat

SEQ ID NO: 799 - DNA, 131 bp, Trichoderma harzianum
aaaaaggctccaggcatcgtctttgacaaggaggactacactgctcgctacaactggtcaattccgctacgttcatacgcggaagaaaaagaacatgtcgctaacagcaatcgcaacaacaatgcagacgg

SEQ ID NO: 800 - DNA, 157 bp, Trichoderma harzianum
gcggcgtctcctacaagaaatcgttcgtttccctctgtcattgcgagcctgttgagcaacacaacaaaaaggcgtcaacacacaaagatccaatcgccagatctaaagcctctgtgctactcagtccaacaattgcacaaagcgacacaacataccg

SEQ ID NO: 801 - DNA, 427 bp, Trichoderma harzianum
atcctaaggtcgaagtcgacacgcgtgttttggagtagttgctgaatgctatggttggtttatatcaatatgatgagtttcagattagttcacaaaggttctttatggctcttttaaggatgggaagccgcagagagtcgtgatcctttcaaaacccaaggcgtcgcacgtccgacgctgtgtctgagcaaacattgttcacccttcaagtttccactacaacctcgaccggtaccaccatgagcggcatagaaaagcgcatgtggcttggacacctcaacaaggacctggggcccattccgaggccagaaatcccattcgccctcgtctggcttgtttaacgccttgcaggggggggagaggggaagctgagcatgggagagggagacggaaagaaaaaaaaagcaaacatatttgatcatcatgc

SEQ ID NO: 802 - DNA, 504 bp, Trichoderma harzianum
gctgcccaggcattcctctgggtcagcagctgacatctgccgtatcatcgctcgtatcagttcgtctcaacatggcgcccctggctcaggctgtgactgtgtctctcaaggacctgcagaatggagacgtctccttcgagactctgcagaaagcctttggccctgattccctcggtatcctagtggtcaaggacgttccacaagagttcgcccagctgcgccatgtcgccctatcatatggatcctatttgggaaacctgcccaaagaggaactggacaggttggaaaacgccaaagcaaagtatctcaccggctggtcgctgggcaaggagactctcaagaatggccaggccgacaccttcaagggatcctactacgccaactgcgccttttacgtgaatcccaccctagaatgcgctgagcccacggccgagttctcgccagagacgttcccagaatacctgtcggcaaacgtctggcccgccgagaatgtgcttcccggca

SEQ ID NO: 803 - DNA, 593 bp, Trichoderma harzianum
agcaatcatgaataatgaccaattccgaaagttgatgctggccaagtcgggcaaagcgtcaaaagatggcgcttcatccaaaggcacgagctccggtgcgaacacgggctccttgggatctcggcagcggagcagcatacctatgactccgcgatctttgggaggtgcccaggccgatttcgcgagacagctggctgagcgcaaccaagctctaaaccctccaaagaagtttaagacatctgtaccaaagggtgtgaaactaggggaaggatacatcgatagatcgcaagttcgagagagcgaagaggacgaccgagaagagagactaaaggcgttggaaaaagctttcaaagacgaagaaattgacgaggcaacatacgaaaagctacggtttcagattgcaggcggagatctggcaagcactcatctagtcaaagggcttgattttaaactcctcgaaaggatacgaaaaggagaggatgtctacggaaataagggagtagaaaaggatagcgccgaagaagcacccatagaggacgacgtggatgacgaattcgatcgactcgaagaacaagacgtacaagccattacga

SEQ ID NO: 804 - DNA, 522 bp, Trichoderma harzianum
gtagcattagctggaattttgttcatgcatctggcccagcaacaaggtgagaagagaaagacacgatacggatttgcaagtcggtcttcgagatctactctgctaggagacaacatcttgctcggcttttagaattctgacatgtcttgccgtggtgaaacgctcatcctccaggttaggtgctagacaataaacctcgacgggatcttcgagtcatgatgacgcacggcaaggcctccgaccttcctatcgaaacctggaagcctggtcttcttttgatacgagcaagatgtactgtacatcgtaatcaatatagctggcagagtatggacctggaaagattggcgatgcctccagactccagatcgaataaccaaattcttcgtcagaagttgccacagctgcacggtccctcgcgccctctaatcaagagagtcagctactcaactcagatagggcaacatatcccaataaacctctgcaataggcaggaggagatgcgtaatatactaataatggaac

SEQ ID NO: 805 - DNA, 621 bp, Trichoderma harzianum
ggcgtgggaatatgtgcccctcggaccgttcaacggaaagaactttggctcaactatcagcccttgggttgttgtcgcggatgcgctggagcccttccgagcccagccgctgccgaatgatacccctgttcaggattatctcaaggagtcacagaaggagagcgtgtttgacattcagcttgaagtcggccttacaactgcggatggcgaccatgtcgacctgtccaagacaagcggccgaaatctgctctggtccttcccgcagatgataacgcaccataccgttggcggatgtcctctcagggccggagatttgttgggctcgggaaccattagcggctcagagcctcgggaacgtggtagcttgcttgaaatgaccgagggcggcaaggtcgatgttcagctcgaaaagggcggggtgcgtcgcttcatccaagacggtgacagcctgaacatgcgaggatactgcgagaagaacggagtgcggatcgggtttggcgactgtgagggcacgattctgcctgctcacggggcgtaaaatttgggaggggacaacggcataatgagaaatgtaaccaaaatatccattagatgaaatcaaaaacagaagccaagagctct

SEQ ID NO: 806 - DNA, 114 bp, Trichoderma harzianum
ggaaccgcccggaggttgttgcaagatgccgccgcccagcagcgtcactatctcctgaccatgcggccactttttgttttatttcccgagagagcaaaagtcgtcccatcccat

SEQ ID NO: 807 - DNA, 128 bp, Trichoderma harzianum
ggctaatacatggctctttcccgctcagatacgtttacagtagcaggtactgcctaccaggactttacttgcttttggcaacttgggtaggccacggctgtcatgaaggcgcatctaatccgtacatt

SEQ ID NO: 808 - DNA, 508 bp, Trichoderma harzianum
gattgtccttcttccagctgccaaaatgttgaatccgctcaaggccaactcgcgcgtccttcgcagggcctccatccggagactggctcagccgtccgtctccgtcatctccaatcccatccggagcgcgggaagcctctcgcaacggcccaattcgggatttgtgtcgttccccggcgctctcaagagctccttcaccagctctctcaagtttgagacgcccgaatcatacacagccctgccgacgtacagagtcgtggaccagaatggccaagtggttgacccctccttcacccctgacatcagcgatgaggccgtcatcaagctgtacaaggatatgctgtacatctccatcatggatctcatcatgtttgatgctcagagacagggccgactaagcttttacatggtaagcgctggcgaggaagccgtgagcgttggcacctcgagtgtgctggacaaggatgatcccgtcttctgccagtatcgagagcaggggctgttcaag

SEQ ID NO: 809 - DNA, 582 bp, Trichoderma harzianum
gcccggaacaaggcctttttggtcatcgcttcatttcgcatatcggcgccattcgttctttccacctactgacatacaaacgcaccttattttctttcattcttactcttttcgtccagccatccgctctctttgtcttggcctcatcaccggtagcttcctgacagtaattcgcccgtctagcctgccgtcttgcccatcaaaagacaaagcgccaggaggggagaaccccagtatcgcgtctaccagccctgcggcttcgattcggctcaaccatccatctatctcggcggcgtcaaagacaagctccgacgaatccaactaaccagagcaccgagtctttgctctgcgtcaacttgaactcagctctctccttcgtctatcttacgcttcgagatattcatcatgtattcttcaaggcttatttcggtactggtcgtggtggtgtccatcctctgcatggcccaggccacttggtgggacaaccaaaaagttcaccaccgaggattgattcgacgagcggattccatttccgaggctctgaatggcttgaccggctcttcaagcccgagtagtccaccc

SEQ ID NO: 810 - DNA, 551 bp, Trichoderma harzianum
cccacgcgtccgcccacgcgtccgcgacccacgcgtcgtaccccgtccgaaacgttctcacaatggcgtcccgcttggtacgaagcgctgtcggcgcatctcccctcctccgaaccaccatctcacgatccgtcccggccatttctgccgccgccgtgcgatactcgagcaacgtgcccgccgaggagcccaagatttatgcccagagcatcatcgacgccctgcccggcagcagcctcatcagcaagaccgccttcctcagcggtgccgccggtctctccgtctacgccctcagcaatgagtactacgtcatgaacgaggagacggtcgttgccgtgtgcttgctggccgtctggactggtctgctcaagtacggcggccctgcctacaaggagtgggccgaggctcagaacgagaagatcaagaacatcctcaacagcgcccgcgccgaccacacggaggccgtcaagacccgcattgaggacgtcaagcagatgagcggcgttgtcgacatcaccaaggccctctttgaggtctccaaggagactgcc

SEQ ID NO: 811 - DNA, 299 bp, Trichoderma harzianum
gttgtttcttttggtggcgggtttacattgataagtgacggatatgcatcccgaaaatgacaaatttgtaagcatgtcactgccggcaaagaaccctgaatgctctagatgcttccgaaggattctccataagatgatatcccatgcagtttgtgccaaaatgggttaacggacgcccgattccgtgggtgtgcatttgattgagacccccatgtttgcagtgaatcggttgggtaagatgcattggagaggatgtacgtaggaggttcatttattgctgctcttattttccatgttag

SEQ ID NO: 812 - DNA, 192 bp, Trichoderma harzianum
catcgacaatggcatccctgctgcgcacgctctctctggccgcagggcttttgcgctcttctcaggttgtcaagccgtttgcggctggcagctttgcgacggcaacgagcagcccggcttcctcgtggatggtatggttgtccaagcccgcagttggagggaccctgcagcagacgcggggcatgaaggttc

SEQ ID NO: 813 - DNA, 541 bp, Trichoderma harzianum
cacgcggcgtaattgactactatgtgggcattcaataactcagtcacatgccaaagacctccccatccattgcatctccctcagtgaagaacaaagcagttagttgttggcactttgttcacccatcaacaaaaaatttcttgctccttgaattgaaagccctaaagggaaaaaaaaaattcaacagccgcgcatatagctcgtgactcgaccattttttgagctagtcatacgataaagctggggaaccaacaacgtgggcagatttccccccaggactcggcccacttccccagactcctccagactcctccgcagagtggaagatgcatgtttcttccaggttctgtgccgaaataagcctctggtatacttaatggcagatgtcgagctcgcacaatgcagtaaagtaataccgagctcgccaaagccctccaaagcggcatcattgggcgaactcggctatatgtctacgtgttggatagaatagagtgaccaagtcacgatcaatagtactttttacaatgcaaaaaaaaaaaca

SEQ ID NO: 814 - DNA, 365 bp, Trichoderma harzianum
  misc_feature (182)..(182): The residue at this position can be any nucleotide.
  misc_feature (196)..(196): The residue at this position can be any nucleotide.
gatggatttgagacaccaggaaatgcaatgcacctgtctctcgctactctgctggttaatttctgactctggcgctaatacacaacgacgatggcgatgctttttccataccccatagacccgctagtcccatctgacattactcgacgatcagcacatgtcgaccatcatatccgcgcatntgggctgctacggngatatttagatgccaagggcgagcctaaatgttgagctggttgaccaacgctgcttgtgaccaacaaggagcatgagttggcctcgtcagcattgctcccgccagaaatcttttacaaacacaatactacagtgtacctccttgggcttgactttctactactcgtaca

SEQ ID NO: 815 - DNA, 355 bp, Trichoderma harzianum
accacgcgtcgaagcaatatcattgtttgctcaggaggccaaagcgagcttttcgattgattgtcctctttgttctttgttacatttcatatttatttgcgtcttggggagccattgcaattgaattgctgcgctctgggcatcgtacacacgcatttttctcggcaattccggcttgagctgcacggcatacgaaattgctgccggtgcggactcttgcagtctccgaggctccgctatctccatctcaccggtgattccttgtgcgaggttcggcgagaattccagcaattattgtcactctttgtcctttcacgaacggagcgaaatatatataatcagctacgctgggtaa

SEQ ID NO: 816 - DNA, 691 bp, Trichoderma harzianum
cgcgtcgcccgctcagcatggaggatatggaccacctcagcctcaatacggcggccaccagaaccaatatcctcctcccggcggccctcccccgagccactacgcacctcctgcgcaccatcctcctccgggtctagatgcttacggctatcctctcaaccctccgactgccatgcacgcaaaggccggccccccgtctccctcggcccctcagcagtttggccacggtgctccgggcggctacaccttccagtactccaactgcacaggaaagcgaaaggcgctgttgattggaatcaactattttggcacaaaggccgagctcaagggatgcatcaacgatgtccacaacgtgtcggcattcttggttgagcgatatggctataagcgcgaggacatggtcatcctgacagatgaccaaagcaaccctgtcatgcgcccaaccaaggccaacatcgtccgtgccatgggatggcttgttaatggcgcccagcccaacgatgccttgttccttcactattctggccacggcggccagaccgaggacaaggacggcgacgaagacgacggctacgatgaagttatataccccgttgactttgaacaagctggacatcttgtagatgatgagatccacttccatgttgtcaagcctctgcagcagggagtgcgcctcacagccattttcgat

SEQ ID NO: 817 - DNA, 576 bp, Trichoderma harzianum
acgcgtcgctcttccgccttcttgatgacttttgtggacgcgcgcagtatctccttgatcttgtgcactggccgcaaatggggcttgcctcgtcgcctgtcagaaaaggggcacatgtcagtcattccaatgacgtgtataacgagggcgagtgaatattctgatacttaaggggtgtataggcagctatgggggtctgacgagatccagtgttactcacattttactttgcgctgcctgcacgtatcgctgttaagcagaagccgacggcagaagcgattagacactggcgtcgatagtctgaaagacgaatcattgcttaccaggctgtgataccacaaggtcagtaagagtaacagcggcagggtatggaagcaggggagtcgatgcaaagataacatgtccacacacacacgcacgcacgcaccgttgcatgcgcgacagtacgcatatcaggatacatgtatgtacacactcagatgcataggagcaaaggaatgggccgaacctagcgtcctgtttgaccaccaagcgcttacctgctatattcaatgctcgaggcattggctctcgatg

SEQ ID NO: 818 - DNA, 270 bp, Trichoderma harzianum
aaattaatctatcgtggtgatcaattgggagcttcataccaccactgagctcgttccggcttgctcgggcttcttcttctcgccaggacgagccttcttggctgctttcgcctgctgagagcctgctgctggcagacatagcaccgcgtatgccacctggacaacggcgacgacaggcagcgcggattgcagcgtcattttcggctctgccaccaggtcgttgaattgagcggccagtagcccgagcaggacagctactcggccgaaagc

SEQ ID NO: 819 - DNA, 550 bp, Trichoderma harzianum
gctgggttgagcctttttgcgcatcttgacctatatttacaccttagaacgacgcatatacatattcctaaacattacgcttatggcggttgataccgaggggtccgccatcaacattcctgctcccgcagctgccatgggactcacccaaacgcctggaaaaggcgctgcgagccacgatcttcacccgtcgggcaagcgggctcacggccgaggagtgcagatacttcgaggcctggctctcgctgtgtactttttaatctgctgtgtgactattgtcgcttcgcaagttcttgggtgttggctgtatttcgtgaaccgcgagatatactacgattacatggccttgaccaaacggtggtttgccatagtcgtaacttggatgacacagatttggggcccggtaatcatccgaatcagcggcgatgagtcagtcgcgggagagatccgtcccacggacggtggcggagtgcagttcaactttcctgagcggttggtgatgatagcgaaccaccagatttataccgactggttgtacctctggtgggtt

SEQ ID NO: 820 - DNA, 183 bp, Trichoderma harzianum
attcgtgtatatccgaggaatgccatgcggttgttttggtgtttgttgctgctatggaagagagtccaccagagctgaaaactgcttgctctcttccattgccattactaccaccactactgctaatgcttacgggcttggcacggtcaagcataactccaagcttgggctcgggaataaagt

SEQ ID NO: 821 - DNA, 669 bp, Trichoderma harzianum
tttgtcatgttgtaatgcaggatcacgattaatcttttcttcttctctcaacacacggccatgcggcgtgagagggatgactcagacgatgaagacattccgctgcatcacaaacgcccgtttggcgctgggctgaagcgcaagaaaattgagtttgtcaaagccacagacgcagacgcaagcaacacgatcaagaatctgggcaaggaaaccgcctctatcggagatgtctacgccagcatagtcctaggcggcagctccagggattcatcatcaaaacctgaaggcaccagcgatgaaaaggacgaccaaaaggaggacgctgttgaaaaagagccggaacctccaatatgtcccgtctgctctcttcccatcacaacgacgctgcagcaacacgaggcctcgcttgcccatcaagtcagcctggaacactcccaccctccatctgcactagatcgatcgcgcatgggtttgaaagccctggaatctcagggctgggatcccgattcccgtcttggcctgggccgagaaggcgagggcacccggttccccatcaaggtagccaggaaagaggacacgctgggaatcggggctactcgtacgcagccaaagcaggcggtccaagagaagcctcgggctctgactggcaaggaaatgcgcgctctggcg

SEQ ID NO: 822 - DNA, 197 bp, Trichoderma harzianum
gagattgcaggcaccctcaattggcatcacatcatgctggcgacaagagcactccgagcggcccacgggcccaagcccaacatcaccggcttcaacatgcgagccctcaaagaggccactggccagccccgatacgacccttgggagagagccgaggcatggcgatacaagggcaccttttccagatggaaccgatt

SEQ ID NO: 823 - DNA, 379 bp, Trichoderma harzianum
ttgataccctgttttgatatacaactactacatgttgggcaatgatggcgcaagatgggatgggatgggacaaggaggacttacagcagggactcaaaggtatatccatcttacctccctcgggcacttgaagcatgaagctttgttttgtttttgcaacacatctttgaccgcttctgcatgtggttccatgtataattatcatttcatttgtttgcacgaacttgggagggaatttttcatttgtatggatcaagatgtatgaggcacgggcatctcatgacaagatggcttgttatgtaatattatttgatgtcatacgacatgaagcaaaatattttttacaaaaaaatattataatgaaaatatctaaagatgt

SEQ ID NO: 824 - DNA, 486 bp, Trichoderma harzianum
cggggagctatgatgggcttcatggcgtggaaattggtttgttttctctcattcgttgactcttttcaatcaatatacacaagcagatgggtattggttaaagagggcgagcgagagattcacttcaacgcaaagccttgaagagagaacaactactatagcagttacatcaccacgtccaaactatttcgtgcattatgaatcctgcttcttgggacgcgcttgtggcacctcttcatcaatgggcatcagtgcgtctgccgtggcatctgcgcgacatcgtcacggcataaactggcgctacacctcgtgtgtcttcctccagggtagagccggccagctgcgtagttatgcagaggtagcttcttgagcccattggcggtcaggtcacttgtcgcccaatccgagctcaggaggcacttgcatggaatttatgcggatgacgcttgcagaagcgtttggaatacagtataggtgactacctcg

SEQ ID NO: 825 - DNA, 536 bp, Trichoderma harzianum
aacaaccaccaccaccaccactcaacctacaaacaacgtcacaatggccgccaagctctccgccgatctcctcttccagatggccaaggtccgccgctccatctatcccttgaacaagactctccccatctcaacctctcgcatccacgagatcgtcaaggaggccaccctccacactccctcctcctttaacgtccagaccaaccgtgccgtcgtcctcttcggcgccgagcacgagaagctctgggacatcacctccgagaccctcaaggccattgtccccgaggaccagttcaagtccaccgccgacaagctcgccctcttcaagggcggcgccggcaccgtcctcttctacgaggacaccgacgccaccaaggccctccaggccaagttccccatctacgccgaccgcttccctccctgggccgttcagtccctcggcatggagcagctgctcatttggactgccctcgaggttgagggcctgggcgccaaactccagcactacaaccccctgattgacctcaaggttgctg

SEQ ID NO: 826 - DNA, 645 bp, Trichoderma harzianum
gggcggacgcgtgggcgaataaccagacgtcgacaaattcctcaaaatgcctcccaagaaggtcgccgctcctaaggagaacatctccctgggcccctctgcccgcgatggcgagctcgtcttcggcgttgctcgtatcttcgcctccttcaacgacaccttcgtccacgtcaccgatctgtccggccgtgaaaccatcacccgtgtcaccggtggaatgaaggtcaaggctgaccgtgacgagtcctccccctacgctgccatgttggctgcccaggacgtcgccgcccgctgcaaggagctcggcatcaacgctctgcacatcaagatccgtgccaccggtggtaacggcaccaagactcctggccccggtgcccagtctgctctccgtgccctggcccgtgctggcatgaagattggccgcattgaggacgttactcctaccccctccgactctacccgcagaaagggtggtcgccgtggtcgtcgtctgtaattgctgtatttttttttatacaaacaaaaaaagtacggcatctgcatgcttggcgaacctttggtttgggatcaaggcaggagtttcgctatctggttcttttatgtggcgttgagaaaaaacgaggagaacggcccttaaagcctggt

SEQ ID NO: 827 - DNA, 345 bp, Trichoderma harzianum
aatcattcatccatcctccatcccatcccatcccatcttccaaaccacatcatcaatctctaagcgttgcccattatgaagagcgctttgatcgccgccgcggcgcttgttggctccgcccaagctggcgtccacaagatgaagctgcagaaggtctccctcgagcagcagctggagggttcaaccatcgagttccaggtccagcagctcggccagaagtacatgggcatccgccctactagccgtgccgatgtcatgttcaatgacaaggtgcccaaggtccagggcggtcacccagtgcccgtcaccaacttcatgaacgcccaatacttctccgagattacc

SEQ ID NO: 828 - DNA, 328 bp, Trichoderma harzianum
gagaggcgtttggtgatcttgacatcataggagctgctcttcgttgcggcaccagaacttgcgcgcatctttgaacagaatacttcgtggagcaattgctaccccatggctcgggtgcatcgtgtcagatacattaatcactcatagctgcaagtactctttgcgccgggggcagtgttttgcccatgagccgcgcaatgtcatcggtcttatgccggcattcaatcggaatacgactctggatccgtcgtgccggtctcgatatcgaagctcggggcaacaccaacaagatgtaacgtaaaataacaagacgaaaaacaaaaaaaaa

SEQ ID NO: 829 - DNA, 325 bp, Trichoderma harzianum
  misc_feature (136)..(136): The residue at this position can be any nucleotide.
  misc_feature (142)..(142): The residue at this position can be any nucleotide.
gcttgttcccccccaagggagtcggcgcttgctgcatggcaagtcatgtcttacgtctcgccattgcagccgcctttcctgatgaaaccagggaatcgccagccagcctagcttcagatggggtttgaagttcagntttttntactacttgggcggttaaaagggcctcggggattgctcgcagcaaggccagagagcgatgagatgggatggagagagagagagagggctgccgactaccggtgcactgcatgttatctgccgtaacatatacatgtacctacttagttaagatgtatcacgcacgcgaccatagtggctttcg

SEQ ID NO: 830 - DNA, 501 bp, Trichoderma harzianum
tcaaccagactcaactcaactcgactcaccaggcttccatctcctcgctactcaaaaaggctcagccttaccacttcctcctcctccaacctcatggcataaacgacacacctctctctctccgattggtgatggcaaaggcgacaacgccgcctccgagctacgaggccgtgtccgccgctcctcctcaccctcctcatccttcacatcctcctcaccctcctccgcctcccatctccgtcgcgacgccgggcctgtctaagcgccgtcccgcctcgtctccctcgtccccgacttcgtccagatcatcgtcgtccaacccctggtcatcgcccaccaagtcttggtcatcgtcgtcatgtccgcctccgcccgcgcctgtcctgcgacgtaacgtctcgtcttctagcctctcgtccggacggccttcggaactgacgcctctgaccaccaatggtcccctaacctcgacctcatcctcctctactgctcgcatgcgct

SEQ ID NO: 831 - DNA, 528 bp, Trichoderma harzianum
  misc_feature (404)..(404): The residue at this position can be any nucleotide.
gagccattcctgcgcaatcctgtagctgccctcacgcacatcccccggcacggtgtggcccgcgccgtccacggccacaaacgccagccggccggagctcttccacgaccccgtcgccgccatgctctccggcagctcccgccacggcgcgaggcgatagtcggccagcccgctccagcgcaggttctcgtacgcccagatgttgcccggcgtgttgacgatgtagtcctcgttgccctgcaggaccagcacgcggatgtcgcccaggttgggggttcggtaggcgtcgaggatgcgggcgacctcgcgggtggtggtccggaagggatctttggagtggacgaaggcggagttgaggaccatgtcgatgtcttcgaatatataatatgggggaagcttcaggnctttcttgatgtgggcttggttgatgtaggctgacatgttgcctttcctgatgtctgcgcagaagggccagttggggacatggaatatggactgttttgcaaatattagacaactacgttcaga

SEQ ID NO: 832 - DNA, 701 bp, Trichoderma harzianum
gacagaagcagttaactacttatacagctactatataagctttccaaccaacccctcacctgtcgcctcaacctcatacgactcatcatcctattcctccttcaacaatttcaattcatttcacaactctcagtcaagatgcaactcttcgccgtctttgccgctgccactacacttattgccggctccaacgccctcttcatcccccgcaacatccacgtcgcagacttccgcctctacagcgccgagggctgccacgacggcaacctcggcgtctggaccgtcattgatgacgacttcaagaatggcgaatgcaagggcctcaacgatagtgagcccaagtctctgagcctgacagacattaacaagggctgcacattcacggcttacaccgacgacaagtgcaccaagggcaagaaggatttcacaaagggacattgcttcgacaacaaggccggctggaaagcctggagcatgaagtgcgactacaaggactaaaagggtcctccctaccttcttttttttcctcaccgcaactttgccagcaccatttattttcatcacttttttttccattccttacatcatggtggagtttcacgtttttttgaatcaggattacactggactgatttgtgggaaccgggacatgaacacaacaagcatattgattgacacggaacgcattatggggttatcgg

SEQ ID NO: 833 - DNA, 664 bp, Trichoderma harzianum
actcacaatattggtttagcatttcaaaaccggcatcatggcggacgcagatttcaatcctgactctgtcaacctcacagctattgttgatcaagatggagacatcagagacatcatctgctttctcaatgctggcgacaacgactacaatggacagcttggtgcacgtgtttcggctctattcgtcatccttgtcatttcatcggcagccaccctgttccccgtcctggccactcgtgtccggcgtctacgaatcccgctctatgtctatctctttgcccgatactttggctccggagtcatcattgctactgccttcatccatctcctcgaccctgcctatgaggagattggaccggctagctgcgtcggcttgactagtggctgggctgaatacacatggccccctgcactggctctgacttcggccatgctcatcttcctgctggatttcttggccgagtactacgtcgagaggaagtacaagctggcacatgtcgaagtcgaaggcacaattacatcggatcctactgtccctcatactcatcaaggacttcactcggctgaccaggatggtgcaattccccctttcaaccagaagcctgaagagcacagccacgcttctagcgataagctcgcttcaagcgataatctcgatgtggaa

SEQ ID NO: 834 - DNA, 544 bp, Trichoderma harzianum
accactctcaagcaacaataacaacctttacccaacttcaaagactttcagtctctcaactcaacaccttcaagatgtctccctggtgagtcttctgaggaccattggtccatcacttgctcgggagttcctctttgctttaccttcagcgttccactacctgatctatgataccttctttcccaccaccgagcaaagcactcattagacatgtcactaacgattttctttcaatagcgcatgcaactcctgtggatgcaaggacaactgctccagctgctcctgcaccagctgcagcgtaagtcctgcttctctcccctgctttgggcattgagaaacttttccaccagaaagctaacagatgggaacatatagcactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccctaac

SEQ ID NO: 835 - DNA, 703 bp, Trichoderma harzianum
gcacggagcaccaccatggcttcaaggttgaagatctggggtgcctgcaggactctggcggtccggacgcagcccgtccgccttgcggctcagccattccgaaaccaggtttcagcgactcgattctatgccgtcgatgcgaccaacaaaccctccaattctccgagcggtgcaaagagagaagcttctagatcattttctaaatcagaaccaacaagttccagggttactgagggcacctctggagaattgacccagaaagccgcacaagagacatcttcatcacaagcctcacccattgaagcgctagacgatgcgaccttggaacaaatactatatggcggtcgacccgtaacaagtcagcgggagggcggcttgacagaggcgcaagaggaggctctatatcgcgagggtgtcattcccccaccagagcaggcggaagctatcgttgctgccgggtcacagtcaatagtccctgttggctcagaagtgcaaaacgccggccataagtttggtcttcctcagaagccctatccggacgggttccatgtcaagaagcgataccaccccgtgctggagcaaatcactaggctcctgatgcgacatggagaactcagtgttgcgcaaagaaacatggctgctgtcatgaacttcttacgaacgtcgcccgcccctatctacagcccgaaattccccctattac

SEQ ID NO: 836 - DNA, 684 bp, Trichoderma harzianum
gcactcacccctccaacccctccaaagatctcaccaccggccgaaccctcctcgatctctgcgccgagaatcagctcctcctctccgaatccgtcgcttccaaatatggctccaagctgcccttcctcttcaaggtcctgtccatcaacaaggccctctccatccaggcccatcccaacaagaagctcgccgagcagctccacgcgcgggactccaaaaactaccccgatgacaaccacaagcccgagatggccattgcaatcaccccctttgagggactctgcggattcaggcctctgggagagattgcccacttcctggagacggtaaagccattgagaactctggtcggagagagcgaggcgtcgcagtttgtgcaggctgccaagcaagagggcggtgacgaggcggcaaagaagaaggccctgcagacggcattcggaggattgatgtcgtcctctgccgaagacgttgacagagaaactgctagcctcgttgcactcgccgagtctgagggcgccgacttcgctgccggtggtgtgtcatccaccaagggcgctgtcctcgccgagcttgtcactcgactcaacggccagtttggctccgacattggcattttcgtcctcttcttcctcaactttgtcacactacagcccggagaggcgctgttcctcgtcgccgatg

SEQ ID NO: 837 - DNA, 436 bp, Trichoderma harzianum
gaccattactcgcatttgcgtccagagattggagtttgataatttttacaaacttgtacataatactgatgcattcagcccttggtcctgatggcatgagcagacatagcctcggccgacgattttgcccctgcaatggttctctgccgatgtttcccgcagcttcttggcagttggggtaatacgataatacgacgatggcatctttggcctgcacgccgaattggggtcaaatagacggtattccgaacatttcatatttaagaagctgtgctgcacgccaaccaacctttggaatggtgtgaattgtgaaggacatgatgcatggtataggccatgagctagtctcagagagatggagcctccggtgtaaaagttgtacattaatacgatcaaagcccgctacgaaaaaagaatggcaattgtattacccacg

SEQ ID NO: 838 - DNA, 700 bp, Trichoderma harzianum
gctgcatgtcttggacctgcctctcatcatctcatctccctcttgtttgaagaagagagatcttgtctcttcccacctctcacagtttgaagctgtgcattgttcaacagcaacagaaacatcatgtcagacgacggccacgaaaaggcgaaactcgagtctcacatagactttgtttccaccgcgccagactcacaagatgtcaacgccttcatcgatgacatggagggccagctcgaggcttctggaggtctcaagacgggcttcttccatgtgcagttcagcgacccgcggcactttacatggctgctcgtcgcctttgccagcatgggcggcctgctgtctggcctggaccagagcttgatctctggcgccaatctgttcttgcccaaagacttggacttgacggagaggcagaacagtttggtgaattcgggtatgccgttgggtgctgtgggaggcgccttgttgctgtcgcctgcgaatgagtactgtggacgcaagtgggcgattatcatctccatcctgctgtatactgttggtgctgcgctggaagctggctccatcagctttggtatgattgtttctggtcgtgtcattctgggtcttggtgtcggcctcgagggcggcactgtccccgtctatgtcgccgagactgtcgagcgccgtatccgaggcaacctcgtctcgctctaccagt

SEQ ID NO: 839 - DNA, 645 bp, Trichoderma harzianum
gcttgtcgccaataacccacacaacgcggcaagatgcgtacctacgaagacagcttctccggtcagaggatctaccctggaaagggtaagatctatgtccgtggcgacagcaaggtgttccgattcgtcaacggcaagtcggagtcactgttcctgcagcgaaagaacccccgtcgcattgcctggacggttctgtaccgacgacagcaccgcaagggtatctctgaggaggttgccaagaagcgcactcgccgtgccgtcaaggcccagcgtgccatcgttggtgcttccctcgatgtcatcaaggagcgccgatccatgcgccccgaggcccgatctgccgctcgcgccgaggccatccgacaggacaaggagaagaaggctgctgctcaggccgtcaagaaggctgagaaggctaagaacgccgccatcgccgccaagggccaggccaaggcaaatgtcagcaagcagggcgcaaagggcgcacaggtcaaggtcgccgcccgaacccgctaaaaatatgaatagacgggattgaggggagcgaggggagaaagatgttgtgtgcagtgcagcgcagcggatgagcaaaatgacacaaagtatggagtctgtggttcttgtctctttccggccggttcttct

SEQ ID NO: 840 - DNA, 410 bp, Trichoderma harzianum
ttgcatgttgcatttgtctttgctgttttttctcgggttcgggacgagaacgaaaaagaaaaaaaaagttgcgccagacgggatgaaaggcgagacaaggggctggcttgggctttgggcatgcactgggactttgggctgaaggttgaccgaaccgagttgctcaaactgcgacatcggtgctgtatcaggctgctatctatgtatcctcgtacaaggcaaatgcacacacggctgatctgagattacgggggggaagaaacgcactcagtggccaatatggtggttcgcacacccagcgtttgctctcctatgtcgtttgtatggcgggtatgctcatgcttgggctgaggtgatgcgcgtctgattccggctagcataccgaacccactaggtagcgagttgatagc

SEQ ID NO: 841 - DNA, 179 bp, Trichoderma harzianum
gcgcatcattatgccggcatgggcccggggtctgaccctcaccatttccgagaccagagcgtgccgcatttcgacaaggcgggccatacgcggacgcacgagcgggaggatcaccggcggtggcagcggcagagaagggctgtgggggatgatggcatagagtttgagccgcagacgag

SEQ ID NO: 842 - DNA, 252 bp, Trichoderma harzianum
atgacccctaccaggatgtcgaattacacaacttgaacgaggggacgagccaaggtggcacagcacgggaattgattcgagagtttttaaatgatacccatctcccagcgaggagattgcacttagaaaacgtggcggaggccctcgaaggagaaaatggtctttgttttgttcttcatcttctgccttgtcgaagggtcatgtatatgtcaggaatagctgtgcactaatatttaaacataagttccgtct

SEQ ID NO: 843 - DNA, 120 bp, Trichoderma harzianum
cggcgtacgagtagcaaaagcgtacggtccatctgggtccggttggtaggattggaacgagaaagaggggaatgggattcgagaacgtggaacttgcttgtgccctggcagtcttcgggt

SEQ ID NO: 844 - DNA, 91 bp, Trichoderma harzianum
atcaatggaacatgaagttggatgtgcgcagtactgtagcatcacatagactagaagctacatggaaatgcgacacagtgttgcacatccg

SEQ ID NO: 845 - DNA, 143 bp, Trichoderma harzianum
acgtccggatgaggagggggggtgtttgtgttgcgataggtaacttagtacgagtagattcaagatggagggggggaatgaatcttgcttgcttgactgcagtctgtagtgtaatcaggcaaataaggcaaatgaatacctgc

SEQ ID NO: 846 - DNA, 293 bp, Trichoderma harzianum
gatacagtacagaaatgctgcagtcgtacgagagccatgggtgctccgtcgagcgcctctagcttgacgccagaaggatcgaggctgattgacgatggagccctggcccgcttttggtcctgtgcgcgacagatgctgggatgaggagaatcgtgatgacgaatatgtattgatatcatatcgtgagagagacatggttggggcttactggtctctgtacgagtacgatgctgtacgttcgtgttgaattatcttgtactgtatcgtgttttgtcgatctgggtggtcagtct

SEQ ID NO: 847 - DNA, 556 bp, Trichoderma harzianum
tccgggcatgatgattgttgaacaggtacggaggttgggagacaggagactaacacaccttattgtgcaaactgtacagcacagcagaaagtggttacatcgccagaataagcttgtgattatggcctcaccttttccacagcccgcaggtgacaggccacatgcaatcttggcatactgttcctctctctctacaacagctgaactcagcccagtcgccaaggtttccttcacgctggctttcactcttatcatggagcattgacgagagccggcaccaacgagcataccaaggtgaaaaaaagttctccacaacactccgtccaatgtccaccttacatcctacagtacgcaagggccccgtaaggctattcagcttcaagcacaatcaagccatccaggcaagccgacaaaagccgtcggccgaatctctcctcgtatcgtcctaaaaagggcgcgcgtgagccgctttgaccacaagccttcacgtatcaaacttgcgcatggtgtacgagggagaagaaaaaaaaacggtcctcagccactgagatcccgt

SEQ ID NO: 848 - DNA, 301 bp, Trichoderma harzianum
agcgtacggctggcggcaagtaatactgtagcaggtacctcgtggagctccatcgggatggggccggttgggagtcggttgggcacaaacaaggtttctaactggatctatttctttccatgtgtcttttaatcattttgaattttattttccccggaggccgtgacacgtttttgacagatgggaggaagaggcggaggcagagagcaaaaaaacgctcacacgtgtcagtccgtagcggtgccttttttctaactgtccgtatctggtcagaggcggcggcagtaaataagtgttgcct

SEQ ID NO: 849 - DNA, 452 bp, Trichoderma harzianum
  misc_feature (299)..(299): The residue at this position can be any nucleotide.
cgtgtcttgtcattattactcgaccactcgcctcaatctcggcgatcaatatcttctctcgacgtggttcgatttcgattcgacgtatcggtgggggggcatgaataaggtaatggttgtgtttagttgggctcgaaactaatgttacccatcagtagtatcacctattgctgacgtcggcttgaggaagtgggttcaatcgtgatacattcggctcgtacagtgcaatacagataagatgatgcgatcagagaggcaattgttaggtcatgattgacggaggattcgagccgatgatngacaaggcgaccaaagaaagctgggcaatcccgaccccaattggatgattctggcaccccaagctgtgaattcggcttgacctttgaacatcaacttgctgtagggtagtgcaaccttggacgtaaagagaaggcagcgtcagcatttgttac

SEQ ID NO: 850 - DNA, 275 bp, Trichoderma harzianum
gaacattcagccttgtgcagggaagcagaaatcatatagagcatttatcaagcgaataacagaccctgagacactgaatcagagaagcttagaagctcttcttctctctgtctccgcgcctcttatcgcaaacagcccctctactgctgctgctgcctttgtcaggcctgtcttttcagtgtcgcatgccccgcctcatctttctaccttgcacaactcagcctttgcgctaatcaacgacatctgcgatctgtgtcggcagcagaagagtccca

SEQ ID NO: 851 - DNA, 644 bp, Trichoderma harzianum
gtcaattcggctctgcgcaacaccaagtagccatgtcgacaaccaccaccacaacaacggcgcagccgatcacggctgagaccatccttcgtctcttccccgacatcgataccaccagcgaagcgctctcaggccacgatgaggagcagatccgtctgatggacgaagtctgcatcgtaacggacgagaacgatgcgccaattggcaccgcaagcaagaagatttgccacctgatgaccaacatcgacaagggactcttgcaccgcgccttttccgtcttcctcttcaacgacaagaacgagctcctcctccagcagcgcgccactgaaaagattaccttcccagacatgtggaccaacacttgctgctcccaccctctgagcatccctaccgagacgggcgccaacctggtcgactctatcgctggagccaagcgtgcggctcagcgcaagctggatcacgagcttggcatcaagaaggagcaggtcccattcgaaaacttccgcttcttgacccgaatccattacaaggctcccagcgacggcaaatggggcgagcacgagagtacgaggctgagctgtcctacctatctacaggccatatgatggaacttgagctaacggtttctctaatctagttgacta

SEQ ID NO: 852 - DNA, 637 bp, Trichoderma harzianum
gcaaaaagcccaccaacatggcgacaatgtcaaatcagtcgctgagggcggctgttcggtcggttggacgattaaatggacggacggctaggtcttcgggccttacatcgaggcaattcagcacctcgccagctcatggcgtcagggctgtcttcgccgagacggacaacaccgaaatgaacaagatcctcaacaccatccaagaaaacatcatcctccccgcctacctccccgaaaagcagcgcaggctcgtctttgaccccaagatgaagtcctacctcgagcaaaaccccatcatcatcgaggtcgagggcctcgaacacaaattctcctccatcgaccacttcaccggtatcgaaaactcaaagacgatcctctccgaggccctcagcagcatgaagagccaggacgactgggccaacctgggaaccctcctggcggggtacaagaaggcggggatacggctcaaggcaaaccactgggggaagattgtgcgcatggcaggcaagagcggcaacattcacgccgtcattgagtgcgcgaagcagtctgacaagacgggcctcctgttcaccaaccgagagacggtggtacgggtgctctcttacatcaatgaaaaggtcagcggcagcaattg

SEQ ID NO: 853 - DNA, 631 bp, Trichoderma harzianum
tacaccagacgaagaaagcatccaatcgttcaccatgaagccccaaactttcgttgtcgctgccctcggcctcctgtccggagaagccatggcccagagcgtgccgcctctgatctcgtctgtgtctgccgccgtctcctctgccattgcctctggcagtgccattgcttccagcattcgctccgaggcctcgtccgtcgccagcagcatccgctcagaagcttcttccatcgcctccagcgagaccaataccgcaaccactggcactgagaccaccagcagtgagaccaccttgacaactaccatcgccaccaccaccacccaaaccactgtcgagtctgccaccacagagcctgccactactatccccggaaccaccaacagcgagactaccagggctgccaccaccattcctgctactacccgctctgccaccactcgcgtcaccaccagaacctctgctaccacttctacctctaccggtctggccattgctcccactgctgatgccaagctgctggctcccatcctcggtgctgccgccgccgtcttgatgctgtaaacacctgtctcttggaactactactatctatttcatatgttgggcggaggacttgatatggagcggacg

SEQ ID NO: 854 - DNA, 514 bp, Trichoderma harzianum
agcgccatcttgacccgcgagaacttgggccgctggtcacgcgccatggccctgggcactgcaaactggttcccttggccatttgccgtcacacagacgctttgggctggattcctctgcggaaaccgcttcatcgaatgggtcattggcaaggagcccgcgccggtgttcagcgtcaaagcggtgattaacccatactacgagaccaaggatacgcgacacttgtatatctacagcgaagatgatgatctcatcccgtatcaggaaattgaagagcacattgcacaagcacggaaaaggggatacaagtctgataatcacatgttcaagggaagcggccatgtgcgccacatgcaaatgtttaatggagagtactggggagctatcggaacgtcgtggaatagagcgacgagcgagccttctgaggaggcgtaatgggttgtgctcaaggccaaaaggggtcaagatggaaatttgcgttgctttctatagacgaactcgcgttgcttgtttg

SEQ ID NO: 855 - DNA, 587 bp, Trichoderma harzianum
agggtacgagtatatcgtggcaccaatgctgcaggtacctcgtatgtatgaagatggaaagcatcaatgaaaaatagggaccgccggttcagacggtttagacaagacgggacgaacctcgttttgtcagacatgatggaaatgacaacatccaaaccattttatagcatcagcaacaacccgccaactgcctcgatatctagcggttacgcggccctaacaaagcaaacaagcggtgctctttttttcccgtacggagtaatttgcaccaagtacgaatagctggaaacaggtacgaaatcgtatgcggagtctggccctccgtcttatcagatgtgctcctttacggtaatacctgcgcaggacctatacccgacacaggtctcaccacgcttcattttgctttggccgtggcaaaatccatatctcctagctcgttcatttatctcaacggttgagcttgtcgtttccaaacaacaggccatgtgcggatgtcatgacacgcctgtggacatgacagctgatggagggatgggctgtatacctgtccatgtatgtacgagtatgagtatgctcgccaagtcgga

SEQ ID NO: 856 - DNA, 670 bp, Trichoderma harzianum
gcgatgatccccgcagcagcaaaaacggccgaaatccatcccggctgccactaagaatctccctttggggcagccgctagtgtcgggagctgttcttcccgaacacttctgcgacgtgccttgccctgtttcagacaagctgatgatgatgatgggcttgcacgaccacgcgcccgtctgtgctacacgcccggatctgccttttcgcaggtttgcttgcgggggctgaggacagaggccagaggacaggatgcggtgagtaggctactctggaggacggggttgaatgaaacgttgatttggtttgttgttcgcgcctcacgccctctctattatcgcgctttcaacatctgcatctgtctttgtgatatattcgtttacagctcgcggacacgaatttttctccattatcagtcaactaagactcactgctctggtgcacttctctcctagggctttcaacgaatgctccagcgtaatactggactgctggtgcctcctattcgttgccgcctacagtctacagtctgcacacttgagacaagagagacagagagagaaatgccagcaccgctactctagacaatatcccttgctctccctacaggagagatatctccctcccttgcatgcccttttcagcaaacaactcttatcacccgaagctgag

SEQ ID NO: 857 - DNA, 631 bp, Trichoderma harzianum
gcattgactacacacataaatacaccagcaaaacatcttctgcgatttctagtgttttttcacttacaccagcgcgaccatcgccaaagctacatacaacacaacacacaacacaatacatacacatccagacactaccgtctaacataacacaaaccgccgaaatggtcactcaaccagccaagatccccgttgccgccccaggccccctcgctagagctttcccagccgtcatcgccgtcggcgtcatctctgccgtcgcgctaaacgttcgctcccaactcaagactcattcagccactcaggaccgcttcttctcccagtacaagaaccccgagagcgaagccgtccgccaaaaggtgtttgagggcgctgtcgaggacccccgcaagagctggttcaacgtcctgggctggtgactatttgaggattaagcaggggttttgaagacacaatcgcattgctgggcgtttattttaatttttagtatcgaggagttggaaaggatatttgttggctggtgaaggcgtcgtgcattgctgtttcgatgtgaccgcctggtgtataaatggcgaaagaaggggttgttgagaggcccgagtattgataccagccttatttagatggcact

SEQ ID NO: 858 - DNA, 576 bp, Trichoderma harzianum
cgacccacgcggcggcatctcgacatcagtcacaatggctttcggaactctcttcaccaccgccgaccaacctcgtgccgccgccatcaaggccgtcgccaaggccaacggcctcgagctcaacatctccaacgttgaggctggcaatcccactgctgagcacctcaaggctcaccctctgggcaaataccctgctttcctcggcgaggatgtttttgccctgagcgagagcattgctatcgccatctacgtcacctcccagaacgagaagaccacccttctcggcaagaccaagcaggactacgcttccatcctccgatggatgtcctacttcaacaccgaggtttgccccaagatcggtgcttggatcaagcccctgaccggcgcctccccctacaacaagaaggctgtcgatgacatctccaaggaggttgcccgtgctgttgatgctgctgaggagcacctcactcaccacacctacctcgttggtgagcgcatcaccctggctgatctcttcagcgctggcctcctctaccgcggcttccagtacttcttcgacaagcattggcgccagca

SEQ ID NO: 859 - DNA, 573 bp, Trichoderma harzianum
gcggtgacatcctaaccaaaaagaaacttgaccctcatcgtagccgctgtcgaggcgcaacctttacctgtattgattgcatggtatactttcccggcgtcgaatatcgttctcatacatcttgcatgacagaagagcagaaataccaaggcgcattgtataagccgaagcaaaacaacaagaagcagcagcaacagcagcaacatcatcagcaacaacagcccaccatgaactcgcatcggttaggcatggccaacacgttggccctgcagccatttgtcgaagatgtcaacgaagacaaggaatacgagtcgtggcacgagtacgaagacaagtctcgacctccccccgaggcgccaacccctccatctgccgccgacgatgaccacgtcaacgtctttgacttcctagacaactctcaaaccccgactgcctcaaacgtgagccatgcgcgagaccgaaaagctcctggtcccagcgacagcacctctcttgtgcgctacgagacaaagagcggagagctcctggagccggttattatggaccgagacggagagccgcttgtacaatacg

SEQ ID NO: 860 - DNA, 573 bp, Trichoderma harzianum
cccacgcgtccgggatcttggtgggcaccacgacgttcttctccatcctcatcttctcgatcaacactgtctttgctcaggaaacactcgcgcagtggattggagattacctgactcaatctgctggtgttacggttgtcttcgaatcagccatagtgcccaagtggaagaatggcgttatcgcatttcgtaatgtgtttatttcaagaagacccgggcagatcgaatcatccgtcagcaagggatcgtctgacgctgctgctgttgctgccgcagggcgccaggttcagcataacgggactgttaccgaagacgatggcaactatacgcaatttgatgtaacgatcgcaaacgtcaatgtcacactttcattcctcaactggtggaatggcagggggcttctcaaagatgtggaagtaaatggtgttagaggaattgtcgatcgcacctctgtccgttggccactgcagcaaatcgaccccttgtcttaccgccacaaacaccaaccaggcgattttgagattgaatctttcaaattggaagatcttttgctcaccattcgccaacctgatg

SEQ ID NO: 861 - DNA, 428 bp, Trichoderma harzianum
gcagaaactcgctgcggaatcaaccactggaatatgtcttatcaaggatatggccagccctacgggcaaccaccggctccccaggggtatgggcagtatccccctcctcaacaggggcaatatcctcctcaacagcaggggcagtaccctcctcctcatgggcaatatcctccggcccagcaagggcaatacgggcagcatcctccccctcagcagggaggttattaccagtctcccccggcccctccaggccagtatcccccaccacaagcgccctacggacaggcggcggctcagcaatacggggctcctcctcctcaacaccaacagccttacggagctcccccagtgcagcctacgccgccgtctattggctatggggcaccccagatcattcaatgggacgggaccccagatgcccaggcttt

SEQ ID NO: 862 - DNA, 458 bp, Trichoderma harzianum
gtggtctgactgtagaacaatctctctttggcctgtagtctctttgacttataatctggtctatcctggtgttgcgtggaaacttcagagtcctccctttgtgtgtgcgcgtgagccgaaacaatcaccacaattggtggtcgcacgccccggaaacaacaaagagcccgctgatccgatccggcatctccggcatacaatgcgccgctgctcttcttcttcatcaatcagctctcagtggtcctctataagcgaggaccagctcaactccatcgtccacatcaacaggatcaccaccgccgccaccacagtcaccgccagcaactcgtctgttgtatcttcatctgcctctgttgcaccctcaatcatgccttcagtccacacaatgtctgagcgccgcccttccaccccccagtatgagcgcagtcgccagggaagcacatgctccgtactgagct

SEQ ID NO: 863 - DNA, 525 bp, Trichoderma harzianum
gatcttgctgggagctgtgattttggcagcgcgaagcgtttccgggtgccaattctcaccactggaatcacaagtcccgagtactactctgtcaaccatggcctcgattgtgcgaccttctctggtgcggcagactgcgctggcggctcgttgcgccaagcctgctttccgaaacaacgccatcaagggttcggctttccacacctcgactcagctctctgcctttctgcctcccggacctcagcgaattgagggcacagtcaacgaccctgcccctattccccaacctaacgcctcgcacggctcctaccactggacctttgagcgcctcctcgccgccgggctcgtacccctctccattgctcccttcgccgccggctctctcaaccccaccaccgacgccatcctgtgctctgccgtcctcctgcactctcacattggcttccagtccgtcatcatcgactacatccccaagaaccgctactccggcctgggaaagatcttctggtggggcttgaacctggc

SEQ ID NO: 864 - DNA, 578 bp, Trichoderma harzianum
gttaacgagtcgtttgttgagctccttttcccttcccagtctttcgcttttgggtccgcacttctcctgcaggtcgccgtttccataccattttctaatagtatcacttccgcacatcttcacgaacgcgtctccccgtcgtcgtactatacagtcaatatggtgtctttcaaatcagccgttgccgccgccacgatggcctttgtctcgttggccaatgcgaagagctactacatcgaccctgacagtgtccctctggccacaagacagagctggtgccgttctgagacgtcgacatgccccatcatctgccagcagaccaccaacaagccgacattggtcaacgactgcagtcctgataccttgagcttcggttgtctctgtggtgataacaagcagcctaacatttctgagtacaccttgacactgccctttttcatttgccaggagtttgtggtccagtgcaggacagcttgtggctcggacaacacttgtgcgtctaactgcgccgaggataacccttgtggtgccaccgatcctaagcgttacaactcaacttcgactgctacaacaacaac

SEQ ID NO: 865 - DNA, 585 bp, Trichoderma harzianum
ggaacacagcccaagcaatagcacaaagaggggtctactccaaccatatccagccattatctagagaaaatagagaaagaaacagagaaaagccacgatatcggatatcgaccaacttcaaactggcaaagctgcaatcaacccccgacgttgggcttggtctagaatccgcccagctggctgaggaagcgaattccttctcctcgggctccgttatacttccttttacgtaccgtgatattgtgatagacagacgcctccaaaaaggaacatcacaacaaagtatcgccaagaatcctcatccgcaagtacacagggggaaacaacaaaacaagcttccgactcctcgactccagtggggggcatcccagccagtcaatgataaacacacaatcaaacagagcacgatacagagagaagaagcacctcaagccgccgtcagtttcaccccccctttaaaagagatttgaacccgaaaagggccgctcgcatattcaagcctttcgccaatgagatcccccatccatcctctcacatcccgcaccctccacaccaaatgcaaaacccccaataaattctgtcgac

SEQ ID NO: 866 - DNA, 604 bp, Trichoderma harzianum
aaacaaccatgcctcacaaacacaagtcaaggaagggcgaatttgaagcagaattcgatctcgcccctacagagaaagcgcgatctcttccagtaaacaaacgaaaagcggcatcaagttctggagagcaagtcacaaagaagcgtgccagaagctcattaagaggcaatgacactccgcgagcattcaagagaatcatggctgtggcaggggggaagaaaattagatcaggcttggatgatggtcaactcgacaaaacgactacgaaggctaccgatgtaacgagcgagaaacttcaaattcgtcccggtgaaaatttaggggcctttgccagccgggttgatgcggctctaccagtatcagggcttgcgaagaaaaccagcacgaatgcagagggcaaagacgcattaggattgaaagtgtatcgcactcgcaaagagcgcaaaatgcacaaactctacgatcagtggagggcagaggaatccaagatacgagaaaagagggaggaggagctagagcgcatagcagaacgcgacttggaagacgatgctgccggcattcttacttcagctgccttcgaaaacgacaatagccacacgaaaaa

SEQ ID NO: 867 - DNA, 459 bp, Trichoderma harzianum
gaagcctgcatcgcccgccatggccattacgccgacccaattcgccaagaagacggcgcagtcgaccagctggtcggatgcgaagcgtcgagtcctttcttcgtaccgcgaatggatccgagctgcgcctgagatccagaccatgtacaatgtccctctccccatttctaccctccgaacacggatgcgacaagagttcgagcgacaccgatacacgaaccagctgtccatagttgacgtgcttctcttcaagtcccatgcagagtaccaggaaacaatgaacttctggaagcagcagactcacatcttgtcttatttcggcgaaaactttagaggtgacaagaggcttccgtccagcttcatggctggtttccttgagggtcgaaattagaaagacaatgcaagaaagtttgttttgtaaatatctctgtataaagattttgtgccgaaaccctccaa

SEQ ID NO: 868 - DNA, 500 bp, Trichoderma harzianum
ggggattcattcagctggtcaatatttcacgatagagagaggggttgatttcaattcaattcaattacaggaggggtattcgtgggaccacctcggcagataccagtagaggcaaagggaatcccgcaactcaactcaaaacccgaagcctctccgctcccttatctagggcggggaattctgacgttgctgatccgatatccgtcgcgcggcacggcagtcagggacgggatgcggcaaagatttggcaattcgtctgggttgctgttgcagccttcttcactagaaatggaatctcgcggatcaaaagggaagtgtgggaagctctcgcgcggtacttggtgcgagttggagcgaaagcgaagggagccgcggaaagggttcggggccgtgattccggggcaagcggccagataccgacctgggtccgagttcgccgggtcgtagatcacgaggctggtccttagactcaaaatcccaagggtttggttatggtgtga

SEQ ID NO: 869 - DNA, 501 bp, Trichoderma harzianum
aatcaatgggcgagagacggctaatcgagcagagcgtgacgaggagcgcggcaatggcgagtgcgtgaaggggtgttgattcaagactgcgcgcgtgagggtgtgggagagatgaggcagaggccagaggcagctcaaaagggttcaaagttgagaatcgacgtcaagccgctttagtggctgatgggcactaagcctcagtggtcgacgaaaaacccacagccgaggcaagcctgcagacggccagcgggaaaaattgctgcagggcgggtagcaccgcagcagagaattgatggcaaagacgccacaggtggtatgacggctgtgattggaggcagaaaatatcgagatgtcaattttgccgattgttttgtgatccaagaagagaagaggagaggaaggcaaacaaagaggaaaagcttgaaatcctctctgatgcagatctctgtgatgcagatctgcggaaatgtccgtggaagacggcaaagtgattgtgacaaa

SEQ ID NO: 870 - DNA, 360 bp, Trichoderma harzianum
aagaggcaggaaactctcttttggccccagaaaatgccagactaggtccgaagaactatcgattctaacgccgatgatgtcgcttgccggcagtcgagggctcggaatcggcaacgcggttccttggtaattggccacaagctggggcactatctggagactatccgcccgagctgtccgtttggcctttcctaaattgcccattcgagttaatgatgtaatgaggagagggactcttgaaaatggatataagggcgcagtcgcgcaagctgttctgagctgaaaagaaaggagagagaaggtctctgtacaagcaggagaacaaatcttatctcaattgcaatttgaaattccatcgcc

SEQ ID NO: 871 - DNA, 578 bp, Trichoderma harzianum
gcagggtggtggcttcagcaactacagcggagggtctcagggaggctctggctatggcggcggcggcggctacggaggcggttacggcaacggtggcagctacggcaaccccggcggtgctggagcccagtcctcgtggtggtaaatactcacgctctctcgtgatgggcatatcactgtgtctatcattgtggctcaagtttcagccactactctttttttttttctcgtcttcacttttcccttatcgtcatttattctatttgcgcatcaattttgctttgataaaatcggttatttcacatttacgcatcatgtcatttgttttcgacgacacggcggcatcatgacctgcgaaggcggaagagtgccttttttttatttgctgcaaagggcagtaacggtcaggggcatttcacgacgcatgtgatagattgcatttcttttgatttcagcatcctccctcgcttgatacccttagaccgagaatagaggaacttaacgacgctggcagaacgtgtggtgttgagagatctacggttgttagatctggactaggacatcacggtttttttcat

SEQ ID NO: 872 - DNA, 193 bp, Trichoderma harzianum
aatacggattactcgcacatatcgcgtgagagggagcctcctcgtggttatttgatgctagaaatccgcaggtccgtgggttgtttcgggacaggaggaaacccatgggaaagggtcgcttcggatgaggctgtgccgtattacccgcgtatattgccactgaatgtgctgtgtctggtggttgtgttgcctt

SEQ ID NO: 873 - DNA, 509 bp, Trichoderma harzianum
acattcacttcctggggccgcatctcatggagcttttaccccaccatctcacagcccatcatctatctcatccaacctctcaccacaacagcacctacatctacaagagagaacgcttccctcttgaaaaagtaaacctaaataaacacatcaaatcaaagatcctccatcatgggcgacaaagaccgcatcagctggcacgtcctcgacaccaccggcggccgccccggaaagggcatccgggtccgcctcgaaggccccgtccccagctctcccaacgcccacactggcggcaacaccttcgagtccctcaccaacgacgacgggcggatcaccgtctggctggcctactcctcagagtcctcggccggcgaggtgcccgtctacactctcgaggacgtcctgggcgctatcaaggggccttcccggtggacgctgcgtttcgacactggcggctactttggcgaggaaaaaaacattcttcccagaagccaccattgtgtttcgtg

SEQ ID NO: 874 - DNA, 591 bp, Trichoderma harzianum
gttcgtgctgaagatttgcaatgcgcgcgcacatctgagtatcctgagacggctgcagtctactgcaacttgtactctacttggggtaccagatgctcccttcggagcaggatcacgattcaaacgcgcatcaatcacaggaaatccctgtcgtctgtgttttgttccaacccggaactgctcaaattgggaacccgaatgacatactgtttaccgccatgtgtgtggttggttctcttgagaatccgagacatattgtctgtgacaatcgcattgtcgacaaatcaacaaatcaaaaatgcgccgttgcgctgtttgccaaagttggtgggtgggatgctcttttattcattttgctcgcctttttttcttcttgcgctctagcacgccaacctggattccaaccttctgggaccacccgatcgatcgtggcagaattgaacgcacgaatagggcttttgtgtaacgctggaaaggaccacggtggccgctggtatccattctgtccgcacacttacttcggcattggggccaacgttcctggcgatgcagcgggactggtggcatgagtgggtagttgacatgttggct

SEQ ID NO: 875 - DNA, 563 bp, Trichoderma harzianum
aagaaggaatacaagactccaagatgcatcatcagcttctcactctcaccgctgctgctggcctcctcgcgacggcctcagctacctactcgaagcttcccagtgtcaatgtgccttcatgtcctcgtgttggcacgattagctacagcaagtcagtgcccgacctgacgcccttcccgctcacacaggtcaacctgtgctacacagacaagagcctcgagctctcattcattgcctatgacgaggtcaattacttcttcaatgcctctcagggtacaaacgacgacatctgggagtacgaagtcatggaggctttcctctacaagggcaccgaagaccctcagacatacgtcgagctcgaggtcaaccccaacaacgtcacataccaggcatttgtttacaacccctccaagaatcgcgcggtcggcgcacccttcgaccacttcttcgtttcggatcccgccacggacggcttcagctcgaagactgtcctcaacaagctcgcaaagacttggaagagcactgttaccgtccctctgggcatcttcaacgtcgacgtcggc

SEQ ID NO: 876 - DNA, 460 bp, Trichoderma harzianum
cggacgcgtgggaatgattctcatcaaagaacaaacgcatcgttcaagatgagagccaaatggaggaagaagcgcgttcgtcgccttaagcgcaagagaagaaagatgagggctcgctccaaataaacgactcgctctaccacttgacttgacacatctttcacattttgaatgagttcacgataaaacacgacaagcaaagctgctgcaccacggtaccactctatgaccgattacagccatcaagttggaatcagcatattggtgcgcctctccaattcagctacgggagtcaatggacgaacgcgagagatgaggactggacaatttcagtcaggtggagacatcgttttgaggacgcgaaggccatgaagcaaaacgctgctgcaagaagcacgcttaggatcgatacgttgcttgacaaagatcaaaggcagaatttacttcatttccaaaccag

SEQ ID NO: 877 - DNA, 555 bp, Trichoderma harzianum
ggaaatttgttcaacctcgacaaatcaaccccgtcgcccatagtacaagatggtaagttaacagtcaaccaaaagactctaatggccacagtttgtgagtcaaatgcgcgaaagcgcaattgatgcaacagcgtctagcttttatgcaaacctgttggaaaacattccgcctgacattcacacctcgtgtgtggactgaaaggtgaagacttggctggagacacaaatgtgttgctgaaatatgccacaatgtgttctcgttagagttcagagaagactttttggcttgagcccctcgctgatgtcttcttttctcaatgacagcctcccaaatctggcaagaaggtcgcccctgctccgttccctcagagcaaggctggcaagaagggacccaagaaccccctcatcgagaagcgccctcgcaactatggcatcggccaggacatccagcccaagcgaaacctgtctcgcatggtaaagtggcccgagtatgtccgcctccagcgccagcgcaagatccttcgcctgcgtctcaaggtccccccctctctggcc

SEQ ID NO: 878 - DNA, 492 bp, Trichoderma harzianum
gggggggacgatgcggcgcatgtaccaggtgtgcaagctggtgcacgccgatctgagcgagtacaacatcctctaccacgacggcaagctgtacatcatcgacgtttcgcagagcgtggagccggaccacccgcggtcgctcgagttcttgcgcatggatatcaagaacgtgggcgacttcttccggcgcaagggcgtcgacacgctgcctgaccgggccattttcaacttcatcaccgggcctgaggggccggtcgaggagcctgagctggcggaggcgattgccaagttatacgagacgagacttcctgctgcgaacgaggaggagggtgctgctgaggaggtggacacggaggttttccggaaccagtacatcccgcagacgctggagcaggtgtatgacattgaaaaggatgtcaagaagctcggtcttggagagggcaatgagttggtgtacaccaagttgctggctgaccaggttgttgcgcccaa

SEQ ID NO: 879 - DNA, 458 bp, Trichoderma harzianum
atttatcgagtttcacagggcttagcaactcctgtccggggggattggcagatcttgacaactgaggaggaccggatgccgtgacgtgtagctgctaggatgaatcttggattggagatttgccagtcgatttggatggtgcctttcgggatggaggggtggagggtggagagatatgactagtgtggaggtatcacagcgtcggggggctgtggagagttcagggtaagccatttgcggctttcacgctcagtaacactcgggggtttaaaactgactgatggcccatctataccttgcagaaaaaatttaggtcctcgcaagactctccctagagccgcgtcccgtcactactgctgctttggcatcaaatagtgctcaatggctaggccgagggatttgaagacgatagcaatgtaacccatacgatctgactgaacgacaaaacaaaacgatac

SEQ ID NO: 880 - DNA, 268 bp, Trichoderma harzianum
ggacggacccgtgggcggacgcgtgggcgacatcagtcacaatggctttcggaactctcttcaccaccggcgaccaacctcgtgccgccggcatcaaggccgtcgccaaggccaacgggctcgaggctcaacatctccaacgttgaggctggaaagcccactggtgagcacctcaaggctcaccctctgggcaaataccctgctttcctcggagaggatggatttgccctgagcgatagcattgctatcgccatctacgtcacctccc

SEQ ID NO: 881 - DNA, 337 bp, Trichoderma harzianum
acgagaacaacaatcaagatgtcggacgtagaagagaacaacgcccccgaggtcgtctaggaggttgaagtttccggagatgcccccaagggccagatgtccggtctggacgccctcaagggtgttctcaagctcgctctcatgcacgagggtctcgcccggggtctccgagaagcctccaagggtcttgaccggcgccaggctcacatgtgcgtcctgaacgagaactgggaggaggagggctacaagaagctggtcattggtctctgcaatgagcacaagattcctctcatcaaggttcccgatggcaagcagctcggcgagtgggccggtcttt

SEQ ID NO: 882 - DNA, 330 bp, Trichoderma harzianum
acaagacattgatcctcagtggtttttggtggaatgcgcatcctttctagcctttattatctgctgtgatgttgaggggcacaagagctgactggattggcagaagataatggcaaaaaagagatgcgcaaacgttagtacaagctcgaccaagagcatcatctttaccatcacatctcatttttcaaatacatgaaatggtcagatatattcatacgtgtccaagcgttcagaaaccagccaatctcagtcttacatacttggaacatttacatagtattgagtcgcctattcatcaggaaatcctggttcaacaaaactcctccactc

SEQ ID NO: 883 - DNA, 511 bp, Trichoderma harzianum
  misc_feature (358)..(358): The residue at this position can be any nucleotide.
gaaaatcgtcatcatcaccagactcgatacgcaaggtcaatacgatggcgagccacaagacattccgaaccaagcagaagctggccaaggcccagaagcagaaccgcccggttccgcaatggattcgccttcgcactggcaacacaatccgctacaacgccaagagaaggcactggagaaagactcgcctgggcatctaagcgatttcgcccaatcacctggcattcccgaccctcttgcaccgacggtaccgacgtctggtttctttggcatggtttcgcggtgaaatagtggcggatggcgtaaaagaaaaagattttttatcgtctttacggcgtgtgggggagggaggatgcanacgcaatggaatgggcacggttgcctggtttctcgattcttgatattgcttcatgtcacggtcggtcatagggaaaggaatgaacctattttgatgtccattttgctttttacccgaggatcagtttccttttctttctaaacattgtgctcg

SEQ ID NO: 884 - DNA, 587 bp, Trichoderma harzianum
gcagaatgtcccgcgccgggtctgaggccaaaatgggaagaccttcgatcagactcatctcgtcatacatcttcgactggattgttctcatcgtggttgctggagtcggttatgtcctcggtgttatcacgcccaacaagcggcccttttctctggtgaatccagacatctctttcccttttacagaacatgagaccgtcccagactggctgctctttgtcttgagctgcggtgtccctgccgtcatcatcgtcattgtctccatcatctttgtacctggagcaacagtacccaagaacacccctgcttcactgatatggaaacgtaagctatgggagcttcacaccggtcttctggggctcctaatgtccgttgcctgtggcttcttcttcgtcagcggtatcaagaacatgtgtggcaagcctcgacctgatctcctcgcacgatgcctgccagacctggagaacgcttccaagttcctgattggcggtttccaaggagagtccaagttgggcaacagcattggccagctctattcggcagacatctgccagcagaccgacaaggcgaagctcaacgacggcttc

SEQ ID NO: 885 - DNA, 527 bp, Trichoderma harzianum
gttgggactgccaacctccaattggatgcgcatcgtggtttgagggaacatgcgacaattaccttcctcaaacaccacagtcaatcaatcccgctgacagccgagggattgccccccatgccgccgcatctgcacccacggtcacgaatgacctcgtcactcttcgctacgacggtccttgccagcttcttcgttgttgccctaccgcacttattaccatgcccggtcccgcggacaaagtacgctgatggagagattatcgtcgacgaaaacggcagacggaagagatggaagaggagggatgtcgatacaaaagacggacttgtgcaattcaaccagacaacagacgatgagattgagcgtgcagcggagcgaatgacgagggaatgtcccgtaccgaaacccggagggatgttgggagagtggctcggattccacgccacggaagacaagacaagggcaaacagatgacgattgataccgccaaatgaataaaaagcaaagaaaaaagttcaaatatgaagaac

SEQ ID NO: 886 - DNA, 478 bp, Trichoderma harzianum
agcaattgcgcgccaaaagactgtacacagacgtcttttgatatattttcaaaatgggtggcggtggaaaaatcccttaccccaagcacgtctggtcgccttctggtggttggtacgcccagcctgccaactggcgcgccaacacgctcatcgccggagccgccatgttcggcgtcatcgctattacgtggaagttcagcgccgacagggaacgatgggcgcataagccggagccgtgggagtggcatcctagccgatagtacgtttatttttgattgtattgggtgtggttgtgggaatttggtcgtttttgctaacgtttttcttttgcttgaagctggtcaaagcagttgatcgagtgggacaaggaggacaagctgaaggcagcaagcaacagcaaggagtagagttttctttttgggagaaggataatagacgaaattgtacaaattctatacgaacaaaaggcaaacatttc

SEQ ID NO: 887 - DNA, 603 bp, Trichoderma harzianum
ggaaccaatgagtctacggctagccactcggcggctggcgctgtcaagcccatcttctccagcctcattgctggcgccgattaatggagtttcacatggaacggttggcgtactgactcagcgtcgtcacaaatggtcgatcaatgtgttcaaaggatgggggaaatctagttccaaagaatctggcgacagaggccaggacccatccgcctctgaattggacgatcccaagaagcgacagcagttcctgcaaaggaatatgcggggtggagtcgaagacaacattttccaggacgagattgaggccgcgaagccggtaaccgattctccagctgcccagacgacagaggaaaggacgaaggagagcctagcaatggtggtcgatccagatgctcggagccgtatccggtggcagcgaagaaaggtcatccaatcagtgcgccgcaacgggcagctgacgagagaggagaagatcaaaatgacggagcgcgagctcattcacaagagcgactttttcccaaccagcgtcaaaaaactggtcatgttggcacggcagattgccggcaagccagtcgacgaggctattcaacaaatgaaatggtc

SEQ ID NO: 888 - DNA, 529 bp, Trichoderma harzianum
actcggcacatcatgagttcaggatacggcatgcatggcggcgtcggccgttgctttcctttctggcaggaggtcatggcctgctatgtcgtcaacacatccgccgcagacgactcaggcaagaagaagtgctcgcccgtactagaggattactacgagtgtctgcaccacaagaaggagcatgcgagagcgctggccctacaagccgcatatgcccgagctcaatcggcaaccgcacgagacgatgcgccaagtgccagccagatccggaatctaggactgctagggaagacggaggacacaaaagcggtgcttggacagggaaactgaggcaatagacgtggcggagttcgatttcttctgcgcgaatacaacccccttggcgcgcatagatagcgcagcaagttcaatataggaaaagcagacagaactggagagccttttcggatgctgattgtgaattggcggctaattctgtcagtttggaggctgtaattctgtacaaattcgacgtacattttcatccacc

SEQ ID NO: 889 - DNA, 602 bp, Trichoderma harzianum
gccagcatcctttttcccttatcctcattgcgtcgctgatccgtgaccgagcctgcccaagatggcgcgcgtctacgccgacgtcaaccagaacatgccccgtagttactgggactacgacagcgtcaacatcagctggggagttctcgagaactacgaggtcgttcgcaagatcggccggggcaagtactccgaggtctttgagtgcatcaacgtcgtcaactatcagaagtgcgtcgtcaaggttctcaagcctgttaagaagaagaagatcaagcgagagatcaagatcctgcagaatctggcgggtggccccaacgtcgttgcgctgctcgatgtcgtgcgagactctcagagtaagacaccgtctctcattttcgaatatgtcaacaacaccgacttccgaagcctgtaccccaagttcaacgaccttgacgtgcgattctacatcctggagctgctcaaggctctggactactgccacagcaagggaatcatgcacagagacgtcaaacctcataacgttatgatcgaccatgagaacagaaagttgcgtctgattgattggggcttggctgagttctaccatcctggaaccgaat

SEQ ID NO: 890 - DNA, 602 bp, Trichoderma harzianum
aaatcttcaagcttcactacaatcaaaatgcagttctcccttgccatcgccgcctccgtgctggctgccaccgcctcggctgctcctgcaaccgtctccggcacaaacaccaacggctccatcttcatgttcggagacccagctcccgctcgcaaccttctcaaccaatttggtgcttgcggcctcaccacctacttcgtcggccaggtccccgacgacatgcccctggttgctatgcccgccaacatcttcgaccaattcggctctgctcagcacaacactctctgtgccaagatcatcaccctcacccgaaacggcgttactcgccaggctgctattgcggaccgcaacctcagcaacaccaactccattgacatgactcttgatctgtgggaggcctttggtggacacgacaacgacggcagcatcattcctggcttcagctggtccattgccaactaaggagttggtggaagtggcctgcggttgagtagactgcgacctgtacatatttctactctctttctgatgtatatatttatgacttttgagccctctcagcaggagattcttgtatatatatgatcctgcatgggagggca

SEQ ID NO: 891 - DNA, 581 bp, Trichoderma harzianum
cgaaagcatttgccatcgcacaatcgtcattcagctaccagaattccagttgttcaataaggagtcgcaatcatgggtggcggagatttaaacttgaaaaagtcgtttcatcccggtctgcggcggaaccagcaggccgtctacgaagaagaacaaaaggctctcgccgagcgcaaacgaacccagcagcgcatcaatgagatcaaggaggagcgcgcaaaggaggagatccagagacagctggaggctgcgggaggcaccaaaagggttgatcgcgtcgactggatgtaccagggccctaccgatggccaggctgggacaacagaagaaacagaggcctatttgctgggcaagcggaggatcgacaacctcatcaagggcaccgaccacaagaacctcgaaaaggccgctggacaggagagcttcattgcgctgcagaacgcgaacagcgcgcgcgacacagccgccaagatccgcgatgatcctctgctggccatcaaacgacaggaacaagccgcgtacgaggccatgatgaacgaccccatcagacgccgccagctcctctcgtccatgggcatcga

SEQ ID NO: 892 - DNA, 391 bp, Trichoderma harzianum
ttcacgaccatgggactcaccttgagggtgtcagcagttgtaggcagtatcttaagctgacacggacaccgtgctcggaaattttgtcaatggcagcgtccgtaatagacacaccctctgtcgtggcccggagcttgacaatcttcttaatctcgtctgccgagtatggggaggtggggatgatgagcattcgggcaaggaagtcaggaggaatgccatgagccgcgacaacgtcgtcggtacctcttattgtggacattccacggttggatgccaaaaccacaatgggggcgaggtgtgattccaatgctcggtttaaataggtgaagcactccacgtcaagcatgtgagcctattgtagtccagtgttagtatctgataccagtagatt

SEQ ID NO: 893 - DNA, 547 bp, Trichoderma harzianum
acagcctgaaaccgcgagtacaagcatcttgttgtaagctcgacgtgtgagctctcctttcgtctgccgtcaaaaagtcgatgccaaggagggtattgcagatgtgttgttggccatcagcttaccactgcagagatccaagcagtcatcccgtgtgcaggcacaagcccagtaagccgctgctcccaatatggaccacgtcagccatgccgccaaccgagtccctcaccgtcttccaagatggagatgctgtagggctcacccagcggtcgaaacataccgcctgtctgaggccccctccagggcatttgctagccgacctactgtactcgtgtctcgtacacggcagtcgaattggtatacctcctccgaagctggttcgtcatgcgcatgaaaaggctgtagcgagcaagactcagccgcccaatcacgaatatctcgggcatccttgtccgtccaggaataggcacaccactcgaaattaagctgccatgcaagacgtggcatgcggggagggtcccaaagatccttccaaacattccagaca

SEQ ID NO: 894 - DNA, 554 bp, Trichoderma harzianum
aacctcataacaaccacaatggctgcacaagaaggacgagctccatatccgccattcacacttgagacagctcaagtcaaagtcaaggccgctcaagatgcttggaacaccagaaacccagatggtgtcaaaatggcatacaccccagactcaatctggcgcaatcgcggcacatttctacaaggccgcgacgagatcaaggcgttcttaaccgacaaatggagcaaagaagacggctaccgacttcgcaaggagctttttgcttttacagacaacaagattgccgtgcagttctggtacgagtggcatgatgaggcaggccagtggtggcgcacgtacgggcttgaggactggacttttgccgagaatgggctgatgaggaaacgtcagatgagtggaaatgacgtgaagattagcgatgcggagagatggttcaaggatggcgttgatgtgaacaccgtcgacatttccgagaagcactggtgagggaggctatttactaaactttaatgaagtcttttgaatatatagataagcaaagtttggtttatgaa

SEQ ID NO: 895 - DNA, 178 bp, Trichoderma harzianum
aaacaagttatcgtggccatgggtttacacgaacgacgcttgcgattcaactggtgcccattaggaaagagaaaggaaatcagttgaaaatgctggcatgagaacactttacagcgaacgattgtaaatatcaaagtgacaaaatcaagtatcatggagccaggaagcggcaaatgtc

SEQ ID NO: 896 - DNA, 551 bp, Trichoderma harzianum
gttgaacggaaggaagtagccaatccgtcaactccagacacaatctctgccctcctctggcctcacaatgtccgccatctcccgcagcatcagatcagcatccaagctgcgagtccagtcgcgagccgcaagtggtctctgctcggcctccatcggcgccgctcgctttgtctcgtccggctttgctgtgccttcaacccccgcctcgcgcagcaacttctcgacttccattcccaagctttctggagcgcccatcatgtcttcctcgcgcgagtacgatcctgagatcaaggacattgccgactatgtcgccaacaagacaattgactctgagctagcttttgacactgctcgatggattctcctcgacaccctcggctgcggtcttgagggcctccgcttcaaggagtgcgccaagctgctgggcccgattgtccctggcaccgtcgtgcccaacggcacaaaggttcccggcactccctttgtgctggatcccgtcaacggagccttcaacattggcgccatgatccgatggctcgacttcaacgact

SEQ ID NO: 897 - DNA, 596 bp, Trichoderma harzianum
gctcgttattatcttttgtgtttaatcggttgattgagaaatcatggcgacgactgtgtcggaggcgcccaagatgggcattgagatgatgctggagcgcatcatgggcgcgatggagaagcagaaccaagaattgactgagctgcgaaaagaatgctcagatcttcgtacgtcgaacaagagcatggagattatgctccagaacattgctcaaggacgcagcaatagccctccgggtctctccgccggcatgtctcccagcattggccgcgagcgagcccgctcgcctttcttgcctcgccgctccacagccccccaggctggtccttctcaggtcttaatcacatcgccctctcacgatatcaccacccactcttttcccttcccggatgatcgtgagatccccggattctacgtcgtcatccctgcaggcggtgctggtacccgcctgtggcccctctctcgcgagaaccaccccaagtttctcctcgatgtcaacctttgcggcaacagcttgctgcagtcgacctgggaacgacttcttcctctggctggcccttcacgaatgactgtcgtcgcgggacctgctcactccg

SEQ ID NO: 898 - DNA, 595 bp, Trichoderma harzianum
aaaggaaacgctcaaaggtacgtttattactttgcacagctgcgagactcccatcagccataagaaaaccaaagaaaaacggggtttgttcatcatgtcacatccaccacctccaggcacgaatctccctgcgcgcccgcccgccagcacatcgaggccgggcttcagatcgagcttcaacccgtcgggccagaattctgccgccccggtatcatcgtcgtcgacgtcgtcgtactcgaatgcaaactccgcgcgagcagccgccgcctcgagctacccagctgcccaaacccactatggctcgtcctactcgagctatcctagccacggtgcgggctcgtccgtgaaccgctctgcttcgggatactcgtaccctcaagcaggcaatcagcagcaacactatccccagcaacaacaagcgcaaagctacgcccctcatgcctattcgcagcaacaaccgcagtcgtaccagggccagtcataccaggctcagccataccaaggccagcagtaccaagcagcaccgcgtatccagaacccttttcctacgccgggtgctgctgctgccgctggacccgattacgacccggacatg

SEQ ID NO: 899 - DNA, 358 bp, Trichoderma harzianum
caatcgccaaatacacaaatccattgcgctacaaagaacaagcaccatggacgccaagcctgccactttctccttggccgctgcgccagttgcttctcccgcagcctccgcgagcgcttccaagcccaagccgtgctgcgtatgcaaagaggaaaagtcgaagcgcgatgagtgcatgctcttctcaacggccaaggatcccgcagccgactgcagatcgctcgttgaccaatacaagagctgcatgcagggcttcggattcactgtataaatcaaaatatcttcatcttggcgctatgcctttgtacattatcaccatatagactactcggaaaagtacagcgctcgattattctac

SEQ ID NO: 900 - DNA, 406 bp, Trichoderma harzianum
agcgcagcaacagcccacgggacaggcgggaggacagtcgcagtcgggacaatctcagtcgcaggttccccagcacaagcgcgtctaccaggcgtgcatcccgtgccgtcgccgcaaggtgcgctgcgacctgggcagcgtcgacaacccgcacgacccgccgtgcgtgcgctgccgccgcgagagcaaggagtgcttctttagtgctacgcgccgcaagagaaagacggacgaggacgacagcgatgccgacgagtacgtggtgcgcaacggccgcaagaagctgcacgccgccgacagcccgcccttttcgcgcttcgacaagcgccagtacagcgacacgcccctgacccccgggggatcccatggcaggacccagccgctgcgcaggccggacggcaaggct

SEQ ID NO: 901 - DNA, 440 bp, Trichoderma harzianum
agtgacggcacttttcgacgacgaattgacgagcaattgatcgatacacgcggttcccgctgccagaacaagtcaagatggtttctcagactcccttccgcgctgcggaattcaagagcgcctacggccccaagtacgctttccagcccaactaccgcggcatcaccgtccagactgccacccgatatggcttccgagctgccaccatcggcggtggtctcggcgttgctctgatgctcttcgcctccagcctgccccgtgtccgttctgacatcctcgtaaaaatccccttggttggcggcttctgggagaagcaggaggttcaccctgccgacaaccctttctaaatgcacttgttggatggtgtttgtaaaattgtaacaaggctttgcgcagcttgcctttgtataagagatacacaatagacttttcctaaaccg

SEQ ID NO: 902 - DNA, 114 bp, Trichoderma harzianum
gttggaagtatataacttatccggctacaaggttgaatagcgttgcccaaaatgaatccctatccattccaattcaacagcacatcctcttcaaaagatgaatcaaccagggat

SEQ ID NO: 903 - DNA, 249 bp, Trichoderma harzianum
agagaacgcagataccttcaacaggctcgaggctcccgtgtctcgtgttgctggatggagtatccacaacgctctgatattcgaaaagtttcacgtcccagatgttgcaagaatttacgacagtattaaaaagacggttcagtactaagaatgtggggagcgagtaacgtgtgactttatctttgaatttctagagcttcttcctagcataagtgtaaataatagagaataaagctttctgtaacacac

SEQ ID NO: 904 - DNA, 596 bp, Trichoderma harzianum
gacacacagacgcactcacacactcagcttaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggcaggtgatgaagcaatttgcgtcggagatcgagaagctctcggagagggtgctggacctgctgtgcgagaatctgggcctggagaagggttacctgaagaaggccttcgccgggtcgaacggcccaacgttcggcaccaaggtgagcagctacccgccgtgcccgcgccccgatctcgtcgacg

SEQ ID NO: 905 - DNA, 603 bp, Trichoderma harzianum
gctgcttcgtaagatcaagcaagtgtacaatcatctcattctctatctacttattagtcatggggaaaagaagcgaaagtgaaagcggctcaaagccggagcgggaagaatctcacggcgcaccggctgagcttccgcaagaggtgatccctttcgacccggtgccgacatacgaagaatcgaggccagggccatcggattcggcctcactttccgtctcccattcactctctgccacagtctcggcatcaacaccgcagccgccggccggaacctcagccctggccccaaccgttacctcgccatttaatttccctaccgatggcaaaggcaaagacggctccgtgaatgctcctccaccagtctacaaggtcgggtcatccagtagcagctccagcgccgcccgaaccattgcctttcctcagatcaaaccagatccagactcgcctttcctggtggcctatgcccctgttcttctcagctatggcatcaccgaagaaacatggcggtctttcatgaccaccatctcggctttcctgacgggcaccatctcagatcgtgccctatcacatgccaccgatgtagctgctcacattggccaaa

SEQ ID NO: 906 - DNA, 134 bp, Trichoderma harzianum
gaatagtttaaagagcaagggtataagactgaattagaaagtcacctccaaatagcaagagctaatgatagctccgtgttgactaaaggcattgcaactctatactgtaggtagtttaaagctctcaacactaa

SEQ ID NO: 907 - DNA, 177 bp, Trichoderma harzianum
aggacgcgtgggcggacgcgtgggcggacgcgggggcggtatttgacatctaccattggcttggtgaagggtgacctaatacgagctgtgatgcctcggtattcagactcaggaggcgggcttcacactctccgccacagccaacccgaactctatcgaaatatcctccacgtcctt

SEQ ID NO: 908 - DNA, 595 bp, Trichoderma harzianum
gatttctccaccactcgctcggcatttgttctctcttcctcagcgatttaaaggacctgacccgtctcacgaatcaagaggcataaccgttactgccatctcagaccgctaagcagcgatatcgtcatattcgcggcgctgtgaaggacaagaacgagaacgagaactgttgaagcttggctcacccagtccccgcagcaatgggcctggcctacaacacctacctcaccagcaacaagatctacggttgcaaaacatgcaaggcgcatcttgcgaaccacgaggacatcatctctcggaacttccggggccaacatggcaaggcctacctgttccatcgtgtcgtcaatatcgacaccggtgaccctaatgagcgtaacatgaccaccggccgccacattgtccgtgacatcgcctgccatcagtgcaaagaaacggtgggttggaagtacgacaaggcttttgagacttctgaaaagtacaaggagggcaagttcatccttgaagctgagctgctatgtaacgtcgcttgattgtacgaatttcacctctttagcatgatttcatcaagatgggcccttcttttttctctcat

SEQ ID NO: 909 - DNA, 576 bp, Trichoderma harzianum
ctcccgttgagcatcaccagtcaagatgagcgccattaacaagatcgccgccaacagcccctcgaggcaaaacccctccgagcttgagcagaacattgctcaggctctcttcgatctcgagaccaacactgccgacctcaaggttgccctgcgacctctgcagatcgtctctgcccgtgagatcgaagttggccacggcaagaaggctattgtcatctttgtccccgtcccttccctgcagggcttccaccgtgttcagcagcgcctgacccgtgagctggagaagaagttctccgaccgccacgtcctcatcctggcttctcgccgcatcctgccccgccccaagcgctctgcccgctcccgcaacacccagaagcagaagcgccctcgttcccgcactctgactgctgtccacgacgccatcctggctgatctcacctaccccgttgagatcgtcggcaagcgtatccgcaccaaggaggacggcagcaagaccctcaaggtcatccttgacgagaaggagcgtggtggtgttgactacagactcgacacctactctgaggtctaccgacgatt

SEQ ID NO: 910 - DNA, 596 bp, Trichoderma harzianum
agaccatgaccgtgcaagccgagcccaaggtgcccatggacgccctggctgcccacactctcaagcacggtgtcattccaaagattgtcatggaattcaagggcatcactgttggtggtggctactctggcttttccggcgagagcagcatgtaccgctatggcctcttcaacaataccgtctccgagattgagattgtgcttggcgacggcacgctggaaacggccaaccgcgagcacaatgcggatctgctggagcacgctgctggcagcttgggcacgtttggcattgtcaccctgctcaccattgagctgattccggccactacctacgtcaagctggacgtccagctggtcaacgacgttgccaccgcccacgacttgtttgaggaggccaccaaggacgagtcgatccacttcattgatggagtctacttccgcaagggcacaattgccgtcatgtttggccgttttgtcaacgtcctcccccagggcaggtctgctcttaagaagatggaggttcactggtttgccgataccattgaggacgctctcaagaagaagcccaccgccgagaaacccatagacatctacatg

SEQ ID NO: 911 - DNA, 572 bp, Trichoderma harzianum
cccacgcgtccgatccctcggcatggcgtcgtctctccccaccgagctcggcagcaccatccaggccggccatatcagaagacatcccgaccctcgacaagacattgcgccatcaaccgccgccgacaagaggcagctggtggatttccacagcgcgagacgcggtgatatcgacaacgacgacgacgatatcccgtacagcgtcttgcgtcctccaaagaagcactacaacctcccaccccttccagacctgcgattcgagcagagctatctccacagcatcgcctcagccgatacgtggtggaaagtattactcattacagctagggatcaggtattgatgcccttggctcagggtgtcctcctcaacttggccttggttgggtggcagcattggaacaagaatgccagagtacacggtgactcaataggcattcgcttgaggaggtggtggtatggggtgaataattggaaactgcccgcccctactaagagacgggtgtagagaatgatggcggttggtttcaaaataaatgtgaacactccagtcgtgagtatgtattactactatc

SEQ ID NO: 912 - DNA, 317 bp, Trichoderma harzianum
ggcaaagggatatgtgaatttggcggtatacttttctgtctgaaggtctaggaggcggaagccctggtcattgcttgcaatggcggcggcaggactgtcagacctcctgggtttgtatatcttgatgtggttggtaatcccgctaacgtcgttggatatctgtccctccgagtagctcttcttatcctcggcagtcaatgactgcaggaagtagtcgccattgaaggtgccggccatcaagacaccgcagccggcatcaagggttgatatggcgggagacgccattccagcaaaagcacgcagattcatcgctaggt

SEQ ID NO: 913 - DNA, 589 bp, Trichoderma harzianum
aaaggagagcaagacagggcaaagtaaatcaaatctgtcgtggttacattgcatggtttactttgtacgcactgtcggatcggctggatgcttggcagcttttgcggcgcggcgtcatcaatgaaatattcatctctcaatccaggcacgcgagctcttttcgagatttccctggaaaagccacacaaagaaaggcaatctaggtgttgactaagcttctagataagagcttcacttcatcttctacgtcttacacaatatcgcatcccacctcttctatcaccatgccgatgcataagggcttcctgccgcgtgaaggtctgtgtgccgacgtgattctcaagctcattcgcagaacacttctgaacccgaacctcctgctgcctttgcttctgcttgcccgctacaccaagaagggccgggacctctcgatcctgcatcccaaggcagcacggaggcttaggctgctcttctacgttgccgtggctcgtggcttcagcggttggctctcagacaaagtccgcaacaactgggtcagcgacaggtatgagtggtccaaggagattgtgctcatcacgggcggcgcgtc

SEQ ID NO: 914 - DNA, 615 bp, Trichoderma harzianum
agtccagatagtcaacagatcaaacacaagacaaacctgcctgttcgattactttgcctccttgtagtacaattcgcaatagttcaccaaatcaccagtcatcatgcctgtcactgagtttgccattatcaagctgaggcccaatttcgaccccctcgagtttctcgagacactcatggagtgtcaagagattcaggacaattggattcgccgcaatcagccatgcaatctggcgcctggcatgaacctgagcagcatgtacacggatgccacagaccaatcaacacttctcatcacggcgccgtgggattcgcccgaggggcatggggaatggatccagagtcttgagaacaggacggccaatggcaacttaaccgagttcagcgctccgggttgcgactccgtcttgctcttccacatggacccggcgggagcgaggccacagatgcgggaagcctttcagcacaaggataccaacgacgtattcgacgtctgtcgcttaacattcaacggcgatcagcgggaggcaatacaaaccaaatatcaagcactggaaaacgagctgcgaaaggaaggtctggagaagagcatatgggcgggctggaggattgaaaa

SEQ ID NO: 915 - DNA, 182 bp, Trichoderma harzianum
gtcgtggatagcggatggatacttgcagggagtatggggtaagtgagtgagtgagtgagtgatatggatacagcgggatgatgatgatggtggtggtggtggtgttgtcactgatgttgtcgagtgagttgtttgttttgtttacctttggaattgattgaaatgaaatgaaatgaaacagg

SEQ ID NO: 916 - DNA, 637 bp, Trichoderma harzianum
aaaccaccgtcatcatgcctccagcaaggtactcgcgcccgccacaacacgactcgtggttcgcgcctctatccgtcgacctgatcctcaaggttctcaacgtcaccatcttccatcccttcatctgctggctgatcccgctgtgcctgcgcgcccagacgaccaaatgggaggcgccgcccatggtgggcgccattgcctgggccatcttcatctcggccatgtggatcgcgagcgcggtcaaccagcgcattgccaacggcgcgccgcgcgaggtggacctgggcgaggaggtgattgtggtgacgggcggcgcgagcgggctgggcatgctggtggccgaggtgtacggcatgaggggcgccagcgtggccgtgctggatgtgaacgagatggagaatggcgaggcgaggggcgtgacgttttacaagtgcgatgtgagcgacaaggagcaggtggccaaggttgccgttgagattgagaaggatctcggtacgcctactgtgctcattaacaacgctgctattgtcgtgggcaagccgctgctggacctctccatcgatgagatcgagaccagcatcggcaccaacctcctcggccccttctactgcctcaagacattcctcccagccatcat

SEQ ID NO: 917 - DNA, 425 bp, Trichoderma harzianum
gatcgggatcgagtggggaaataagatggagagtcgagagtgccttatgtaaaaacctgaccaccggcaggatggaatcaccagaatcaccagacttgtctccgggtctttcctctatcctgcattttcctgcaggacagggagagctgcctgcacctgcacaccgaggtacctggatactccgcgtggtgaggggcaggcagcgtgcgtccgaggtactgccaggctgccaggtacttgggacggcagtgcacaagctccgtacttggcgcgccctgccctttggtccagctttgggaagagatctccgttccggctgcctatcctccgctttcgtgcagctggggggagggttaaagacggctttcggtcaagagtcgaatcggtcctgattcagaaaagaaaacacgaacaaaaaaaaaaaa

SEQ ID NO: 918 - DNA, 574 bp, Trichoderma harzianum
acaagaccttgtgttgctttctgaccagcttgccgagaaggaaaatgaactccgtaatgagattgagaccaaggtgcagaatcatcggaggtggaaccagaatcatattgatctcactcgagatccgctttcgccggtaaaagcattgggtatggagctcaagttcagaccggcaaagacgcaatacttaatgacgccgccggcgtcaacgtcttcagagtcgatggatgtcgacgacgtacctgagcctatgcaactggacaagctagagctgccagtattccagtttcgtggtgcggacgtcgacgagacaccgcaaactaatcagccggcgttccgacgccgtatcggccgactccaacggctctggatcgatcgaagaggtctttcgacaccttctagggcagatgcgtacgagtactcggaccggtggaagtatgattctgatgatgaagacgatgagcctcccgtatacgaggttgatccctttgacacaagagcgctgaagtttagggctactatccctctcagcccatacatcttccgggcgaggccaacggcccctacagaagcg

SEQ ID NO: 919 - DNA, 577 bp, Trichoderma harzianum
gggcggacgcgtgggcgaccaccagcgccgccagaatgttcgccgcacgatcaagggcagtctgcgccgcccgccagctgcagcggacaacccgaacctacgcctccgagtcccacggccaccactcgcccgctccggtcaacgagtcctttggggccggatctgttattgccctgggcgctttcctgggcaccgtcctagtctaccagttccgccccacggagagcgacaactggacgccctctgccctgctcaacaagtatcgatcaaaggccgaggactgggaggccgtcaacactctgcacacaaaggccatggagcaggccggctatgacaggaatctgttcgagaacggctccaacaagcaccgatttgtcgacgtcgcataccccgaagctctccaatcccacgccgcgcgaaacatccaggccggccaccttgccaacattgaccatgctgtggaacactaccgacagcagcacctgaagatggaggagaagaaggcggccaagctggcggctgccaaggcagagtagttgcagttgctacagtatatccaatttatagaacaaagttt

SEQ ID NO: 920 - DNA, 671 bp, Trichoderma harzianum
aaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccggcgcgcccacgttcacgcacggcacgccgccgaaagccaccccaccgcccacgccgctgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacaggggcaaggcattgctgatggtgaatgcacaacacgcgtggcagactggccgaaaattgatgatttactgatgggcgactttggacttgaaatggggcatgccggatgggttacttgacagtatttacaccatttctattcaacaataaat

SEQ ID NO: 921 - DNA, 594 bp, Trichoderma harzianum
acgggacgagcgatcgatcaagtcagagacaacaaataccgagtggcgatgccttcatccgatagtcttgggaggcgggcctcacacggcgctgccagcctggcgacgtcggcatcttctatacacggcgcagcagttgggtttcgagaaggcctgggcttggctggagttgcgaggaggacgttgggaatctgctttctgctattgacggtgtttctatggacgctgtccaactttctcgccagctttatcttttccgatgcaacctacgataagcccttcttcctcgtctacttcaacacctccatgttcgccatctctttaatacccatgtttgtacgatatctgctccagaaaggattccatggcctacgaagcgacgtcaggcgcatgtgggcggagcatcgataccaagccgccccaggcagtcccgcgatagatgaagaagatcacctagctcaagaacgcttgctagtagacgaacgagaccccatggcaccaacctcgactccttcaaaagagaagctcagcttccgagaaaccgcagtactgagcctggagttctgcatgttgtggttcctcgcaaactatttt

SEQ ID NO: 922 - DNA, 627 bp, Trichoderma harzianum
aagggcattgaacctcgatacgagttcgggtgtggacttggttacacgacctttgcatattccaacatatccatcaactatattcagggggcaaacacgtatccatggccgggcggccctattgtcagcggcggacaaacggatctatgggatgcaatcgccaccgtcagcgtaaacatcaagaatacaggcagcgttgctggtgccgaagtggcgcagctctacattggtattccaggggctccggcgaagcagcttcgcggctttgaaaagccctttttgcagcctaatgagtcacagtcggtgacattccatctcacaagaagagatttgagcgtatggagcgtggagagacagaagtggcagttgcagcagggcaactacaagttctacgttgggagcagcagcagacgactgcccctgaatgggacgatggatttataagagaacctcagcaaggccagcggactttcagatgcagctcgagtatgccaaaatcgtatgctgcgtgatgaatggagctctgtatggggtacatcatgtgtagatacagctgcgagaaggttgttgtttcctccttcaagcgagctgagaaggcagcaactaaccgtctattgggatagatcg

SEQ ID NO: 923 - DNA, 623 bp, Trichoderma harzianum
tcgtcactcacactcacaactcaggaggggggaggatctccaaacctctactccttaatctacaatcctctagtcttcaagacaaaccccaaaaactccattcaaaatgaagttcttcactgttgccaccgtcttctttaccgctgtcctcgctgccccaggcggctactaccctcctcctcctcctcctacctataccctggctcccaatggcaacggcaacggcaacggcaacggcaacggcaatggcaatggcaacaccaacactggcggttctgccctgtgcccttctggcctctactccaaccccaattgctgcgccaccgatgtcctcggcctcgctgatctcgactgcagcgttccttccacaactccacacgatggcgctgctttccgaagcatctgtgcggcgactggcaagagagctcgctgctgtgttctccccgttgctggcgtagctgttctttgccaggaccccattggcgccaattaaaaggcatcgccaatatgactcacgaggtcctttgatgaatgtgttattgcacatggctcggacctacggtatcaagactgaacactgacttgaacatatgagtcgtgagcttttggatatatggaatatg

SEQ ID NO: 924 - DNA, 391 bp, Trichoderma harzianum
ttacatattacaaactgtcctcttacatgggagaaatatccaacatagacagcagactctctcaagggcatgacccgaaccgcaaagtgcaggccatttcccccctcagctccgataaacggcagggagaaaaactacgaccaaccccgagatgagcacaaggaaaacttgggcaccttctccgtggcaaacatccaggtccagatccgggagctcaagcaccccggttcacagcgcttcctcggcgccgtcaacgcaaacgatctcctcaccagaggcactctgaaagtcctcaagctcttgtacaacactcccccaaacccggagacgaccgttccgccaaccagctccgtgacgctcgtcctcgaggatatgcccggcgtggcctaca

SEQ ID NO: 925 - DNA, 653 bp, Trichoderma harzianum
ggccaacattgcgacgcaaccacaaaggggaggctttgacactcaactttctttgagctccacccggcactaggcggaagaggcgcgtctaactgaaaaaagaaaaaagctttttttctccgagcaggttccctctcgctttctctctctcgcgcggacaacggaacgaatcgaaacagcctcgtctttgtccaagctccaagctccaagctccaaagctcagcctcgcatccgcccgccatggacgccgtccggtctctcgtccagcccatcacacacaacctgccggcccccatccgggacctaggcgtgtcgatcgtgggcgaaacctgctacaaggcgctgctactcgacgtcgacgtcgaaaacacggaatgcatcaagctggccatcagcaagggcctgggcatcggcatcgtcggcgcatcggccgtcgtcaaggtgccccagatcctcaagctgctgcggtccaagtccgccgagggcgtgtcctttttgtcgtacctgctggagacgagcgcgtacctcatctcgctggcctacaacgtgcgcaacggcttcccctttagcacctttggcgagaccgcctttatcatgggccagaacgtcgtcatcgccatgctcgtcctcaactacagcggccggcccgccac

SEQ ID NO: 926 - DNA, 611 bp, Trichoderma harzianum
aagcctcttcgaccaccctctgccatcgtcagccttcgactctcttcaccaaacctcaacaagcgacaaattatcgccagggtgctccaacgctcgctccgccatcgccagtatcctttggacccatactttcgctctacaacacacacaacccctcttacgcccacatagcttcggctacgtcaagtttcggcatcatgtctagcagagatcgccgtataatgaaggagctgcaggatctgaccgaggacaaggacacttccggcattcatgctgccctagaacaagagggctcgctgaccgctctcaagggctggttctttggccctggaaatacgccgtacgctggtggcaaattcgtgattcacattcagcttcccaccgactaccccttcaagccacccaagatgaagtttgagaccaggatctggcatcctaatgtcagcagtcagacgggcgtcatttgtctcgacaccctcaacaagaactggtcgcctgtccaaacgatcaagacggctctcctctccgtccgaatgcttctcgaaaacccaaacccctcagatccacaggacggcgaagttgcacggatgctgctcgacagtcccgactcg

SEQ ID NO: 927 - DNA, 599 bp, Trichoderma harzianum
gcgcttgcgttgcgtgtacctccgtgaagcaaaaatgcatgctacatcggcccaacatgtgccagagatgcgaacgccttggcaaagaatgtgtctttctcgagttgtcacaacggaagcgcaagcgcagcgagtctcggcgcgtggaaaagcttgaaaacacagttaatcagctgattacgcacttgacaggcctgacaggacaggatgtaacaccgctagcatcaccctcccgaacaacacagtccgtgatttcttctgccgagggcatgttggctatccaaagagatagttctctttcacaatcaggggacctacaagaccgcagtccagagcccgtaattggacatgagagtgtttgctctattgttttggaagctctcaataacgatgaaacagaggcgctccttcagaaattccaacaaaaattcgtacctatttttcctttcgcggcgatttctatatacaaaggctcgtatcacatcaggcatctaaacccttttctgttcctgtgcatcatggccgtaactataggaccaaagcatcctttacgggcgcatgtgcaacatgaagtcgtgaatcagggcatccgccgaatg

SEQ ID NO: 928 - DNA, 487 bp, Trichoderma harzianum
atgagacctgttcggaagattctgcaagggagtcatttcaaacccgtaatgaaagatggcaagagaatgttgacgccttgctctccaggagacccggagaagattgagatgacgtacgacgatgtcaagccggaagaactgtcggctccggacgtgacactccaagattttgagatagctttggccgactcacatcctacagtgtccaaggatgacattgagaagcagattgaatggacgaatgaatttggaagcgagggagcttaggcaatggggcgtgtctttgagagtacatggcacagcggcgctttgaggagttagaggggcatctaggcactctttgcacatacaatgttgaattcgggaatcgtaatgcatctgtcttactggaaaagaagaagaagctgttcatattcgattctttttatggtagatagtgggccggcatctttgtaggatgtgattaattttgagtccaagatgaatt

SEQ ID NO: 929 - DNA, 576 bp, Trichoderma harzianum
cccacgcgtccgcccacgcgtccgcccacgcgtccgatgtattcagacggccaatcaccgaaacagcacaaataagaatataagcaattattggtatgatattgcaagctacatgagtcaaacatcataaagcacctaagatacagagagtgaaatttaagctgcctgcttcgtcagagcttcgctaatacgccagagcttttctgcctgtgcgggatcaacagccccaggcaacaagccctcttttgtcaagactccgtcggccaagtagtagccatccttgtctgacaaaatgtgttagtatttgattaggttacatgagtgaagttgaggtataggaatgctgggatacactgggtgtgacgtactggacagtcgagagtcgaaagcggcgataattccagttgaggatccctcagccaaggtcttggccttaatcgccgagttcaggttaccgttgtcatcgatccagcctatcgcatattagcattgtgacaaattcagaaagacaagcaatgaacagtaggatcaacgctgaaagagcgcaatccccgctggccaaagtgctggaccaag

SEQ ID NO: 930 - DNA, 600 bp, Trichoderma harzianum
attccaaacgcgcatcacgaccagcgatggttacttcctcgaacggaccaaacgaatactctggacgagcttaaaatccctcaaactcattcttttatacgccatagatcccctaattctacggacgttgcgtccagtccgcagagcccatcatgccttctgcgaccggtcaaaactgggagaaatacaccaagaaattcgccgacgatgagatagaggagaagaagatcacacctctcaccgatgaggatattcaagtgctcaagacatacggtgctgccccatatgcatcgaccatctcaaagctcgagaagcaaatcaaagagaaacaacagagcgtagatgagaagattggcatcaaggtatgagtcggcgcaactgcgatgcgtctacggctatctaacgtgttgacgtaggagtccgatactggtctcgcaccgccgcatttatgggatgtggccgccgaccgacagcgaatgtctgaagagcagcctttccaggtggcacgttgcacgaagattattgcggacgataagggcgacgagtcgaagagcaagtatgtcatcaacgtcaagcagattgccaagtttgtcgtccagc

SEQ ID NO: 931 - DNA, 538 bp, Trichoderma harzianum
ggaaattgccctccaaccgcaaccatgtcgaccctccccaggactctgggcaacctgcgcaagattggcatcaaggaatacttccgccagatgctgtacatcggtgacaccaagtacggtactctcatcggccaggatcgcttcggcaacaaatactacgagaacctcgaggaactgcccctccgaacccgctgggtcgactacgccaagcacgactacgatgcctcccacatcgagcccggctggcacgcctggatcagctactccgtcgacaagcccccgacccaggacagcctcatcgccacgggcaccagacactttgagcccgcccttcccaagcccaactttaccggaacgcgaggcgcttacaagccgtataacacagtgaaatcgaagcttaatgcttgggagccggtggccaaggatcgggtatgagtggtttttacgttttcttttttaaaccgtgggaaaatatggtgtacatattgaaatcgcgcaacaaacgcaaacaaatcaaacaatagacacagacatgtga

SEQ ID NO: 932 - DNA, 369 bp, Trichoderma harzianum
gcgatgtgaggctgatttggggtgtatgattcgtgagcgtgtaagaggaggcagcccacgactttctctctgtgtctgtgcttgctcacttgctcgcctccttggattcggcctgttgatccgaatcagaagtaaatgtgtttgagactgagacttggtctggtcgagacgatatgagatgtggcatggaattagaaacacgtgtttggtatggcgattgcgatgcgatgatccgcagaaagcaagatctcagggcgactaacacggatatacggaggttcgaccaagacacgaggaatgatggggaaagtctcagtatgtcactacggaatttatgattacgtagcaatgtatgaattatcatttcac

SEQ ID NO: 933 - DNA, 100 bp, Trichoderma harzianum
ggctgcacatccagatgctagatctggtcagaaccaattcatcggaagtccgatcccatacgagtactcgtatgacgacacttgctcactgtcatatctg

SEQ ID NO: 934 - DNA, 688 bp, Trichoderma harzianum
aaccagacggagagtctgtttcatacctggtcccagttctcgactggatccaacatcccacctaagccatcagcagaggagcgtgacatagaagcgagattggaggatgtattagacaagcgcgacaatgtcatcgcccagctcgcccgacttctggattctgaagcatccctcaacacatccgcgctcaaacaaaacaacctatccctgctccgagagaagcttgcctctcatcgccgcgacctgacccgtctcaagtctacactgcagcaagctcgcaatcgcgccaacctcctcagcaacgtgcagtccgatattgacgagtaccgcgcgaacaacccggaagctgccgaggccgattacatgttggacgagcgtaatcgcatcgacagaagtaacgatgcgacagacagcgtcctcagccaggcatatgctatcaacgaaagttttattatccaaagggagaccttggcgagcatcaaccggagaataaccatggccgccagcaaagtgccaggcatcaactcaataattggacgtataagtaccaggaagaggagagatggaatcattatgggaacttttatcgcattgtgctttatcgtcttcttctggttcaggtaaacgggccatcatacattcaccggtgctgcacatgtcgtttggcgtttagggggggtatatcagc

SEQ ID NO: 935 - DNA, 585 bp, Trichoderma harzianum
atcaatctaatcgcaagatcgcagctcgggcccaaaatcagtcaaaatggcccctcagaagaagagcaagaaggatgccaacagcatcaactccaagttggcgcttgttatgaagtccggaaaggtcactctcggctacaagtctactctcaagtctctgcgatccggcaaggccaagctgatcatcattgctggcaacactcctcccctgagaaagagtgaactcgagtactacagcatgctgtccaaggctcccatccaccacttcgctggtaacaacattgagctcggcactgcctgcggaaagctcttccgctgctccacccttgccatcctggatgctggtgactctgatatcctcagcgaccagcaggcttaaatagccgaaatctagtgcattcaaaacggcgttgggggtaaaacggttcaagggcaatatggataccatacactttcacattatgtgcgagacgaaaacttttgatgcgagacatcatctactaggaaggcaaatcctttggggatggaaaaaagccccagaaatttccaagtgatagttatctcaatggaataatacagccatga

SEQ ID NO: 936 - DNA, 613 bp, Trichoderma harzianum
aaagggggtgatattgggatacctagggacgcctctcaaaccggcctgttccatgaaggaaaccctgcagcagcgccgttagactgacctgacttgacgaaagcaccggtcgagacaggatgaatttgcgcagccgggcatcgcagccgcacccgcagcgcatcgcatcgcatcgcatcgcatcgcagcgcatccaagacaaggccggtccgggtccggcccagccagctgctttttttcatcatcttctttttgtttcggcgcccctcatgatatcagtccagtgacgctagagcaggtgtcacatggccgatgacaacaacgtggtggtgcagctaagctccggctagctgttatctggcgacggaatgtgtgtgatgccattgggtggtgttgcgaatggctgctggttcgcgcgggctcacactcacaccatccatcaccaacagcccaatgacctgttcaacgtcccttgccccatacggtactgtacatacatgtactcgtgcagtccagtccagacaatctcgctgacggaggggcgcgccacaagtggaatcaatggagtgatccaatgtgaaggcatttctgtcttcttggacaggcagggggt

SEQ ID NO: 937 - DNA, 657 bp, Trichoderma harzianum
ggccactgaactgcgcagcttcggcgaggaaccatgactttcctcatacttgtgattggggacctgcacatcccggacagggcgctggacattcccgccaagttcaagaagctgcttgtgcccggcaagattggccagactctatgtctcggtaacctcaccgacaaacacacctacgagtatctccggtccctgtcgccggaccttaagatcgtcaagggccgcaccgatgtcgaagccacgtctctccccttgacgcaggtcgtcactcacggcggcatccgaattggcttcctggaaggcttcacgcttgtttctaacgagcccgacctgcttctagctgaagccaacagactggacgtcgatgtcctgtgctggggcggcactcaccgtttcgatgcctttgagtacatggacaagttcttcgtgaacccgggcagcgcgacaggagccttcttgacaggagcaagcctggatgcggagcctacgtctccaagcttttgcctgatggatgtccaaggcatttcattgactctctatgtttaccaactaaagacggatgaaaagggaaatgacaatgtggcggtagagaaggttacttatacaaagcccgtggagccatctatgggttcatcatgacacacctgacttaattgt

SEQ ID NO: 938 - DNA, 638 bp, Trichoderma harzianum
acgcctgttcccgaaaaaccgtcaactttccaacatcgaccctccgagcagcaaaccgccacgatgttgattcccaaggccgaccgcaagaagattcacgagtacctcttccgcgagggtgtcctcgtcgcgcagaaggacttcaacctccccaagcaccccgatattgacaccaagaacctgttcgtcatcaaggctgctcagtccctcaactcccgcggctatgtcaagactcagttctcttggcaatactactactacaccctgacccccgagggtctcgactacctccgggaatggcttcacctgcctgccgagatcgttcctgctactcacatcaagcagcagcgatcacacgctcctccccgtggcatgctcggcgagggcgagcgtgagcgacgacctttcggtcgtggacgtggcggcgaccgtggtgaccgtgagggtggataccgaaggagggatgctggcgagggcaaggagggtggtgctcccggcgagtttgctcctcaattccgtggtggctttggccgtggacgtggtgctgctcctccttcctaaacgaatctgtctctttcggggttaacaaatcttatgatgcatggcgcaataagacaacggcatgtagtctaaaaaac

SEQ ID NO: 939 - DNA, 382 bp, Trichoderma harzianum
accatctcgctccggacacgggagagactgcgctgtccatctgatggcctagattggcagacgccggggcaattggcacgtacgctgccaccgactttgcatccccggggtcctgtcctgtctctccaaatccaaagacctcttctccatcgcacacgaagcatcgagccagagcatccagccccgcccagatcccagcccgagtacgttgcgtgaatgagcggccaagacgggacaaatctcgaggttacgctgcatctgttctaacctgccacgctgctacagtacaaggacaccctcaatcacatacggatcggccctgcgaatcagccctgcgactaataatagccctgtgaatcggcccctgctgaaccgccatccg

SEQ ID NO: 940 - DNA, 265 bp, Trichoderma harzianum
gtaccggctaaatactcgacgaaatggtgtgaatcgtcgcgtaatggttggacgatggagcgatgtctttatactctgctacgcttacttatccacaactttatttcgattcaccgtgtgctacaaatagcaccccacggcgggctctcggaattatagctacagtattaagcaattgtataatagattaaggttagttttccgagtgagccgttgcatctcgggcggcaatctggggagcatattagcaatagatgagcaatag

SEQ ID NO: 941 - DNA, 428 bp, Trichoderma harzianum
ggtgatctgaagagaatgggtcgaccagcgctacttgtacagtatcgaatgcacgatgcgtcttatgatcagcgcgtgtcttgcacatatgcatacgtcaaacaatgcatcctccacaatcttcatcatcactccacaaatagcttccatgttactttccgcattctaggtaccgcctcagtgttggctgaggtttgccacatgcacaccattgttgacgtaccatgtggctcagttcagccatcgacatctccagacaagcctaccaaagaaagtcagcctcagccttaactgctctcgagggtttcagtcatcaattagccctacagctccgccttccctcggcccgtgcggcaaaagacgactggagatctagattgtgagaaatacgaagatattagtggatttctcgtaccaggaacgaggac

SEQ ID NO: 942 - DNA, 305 bp, Trichoderma harzianum
gccgcctcctcacaagtttgaagaagcgctcaaggacggcatcacggaggcaatgaagctgtacaaggtcagagaggtcatggtaaagagatggtcgagcaatcgaaaccgatgaatggactgttgatgtctatttcaatttctacattttcctttgcagtgtctttttgtgtaacattacggcgatacctggggaatttattgaatgtgcaaatgctatgggaatacacgtcggcgacaacgtgtgtaatgtatacgagaaacgatggaacgaatctggatcaaattacagatgcattttaaac

SEQ ID NO: 943 - DNA, 522 bp, Trichoderma harzianum
tgtcagggagcttccgtgggctggcgccagacgcggttcgtgaatgcataggtgctctgctggcaactgacgtcttggggcttgggttgagggatgcgggcgtgttgtatggagaggtgcatgatgtgggagagagggcccctggtgagaccccaccgggtgagcggtggccatatgagctagcagaaggcgggatagagatggaagacacgaagaagccgggtcgcgaagaggcgctgttcagcattgatgtcgcggattgagggcccgacgacaggcgaggagtaggagaaccgcgggatgcaccttggccagacatcatgtgtaagccaaggtcgtccgatgctgggctggcggcccggcgcttctgacctgcgcctgcgtatgcatcttcaatgtgaagtctcttgagagaggatgtctcatcaatctccatatcgtcagcaaagctgccctgggtggaagtggcatcatcgctgttgttccgtcttgacctgcctcggggtgaacgatctggttctg

SEQ ID NO: 944 - DNA, 563 bp, Trichoderma harzianum
ggaagatacgcaattccacaatcgccatggcgaagccgtatgtgccgcatgacgtccttgacgagacggccaagacttcattggtcggcctgggcagcggcttcttcattgccgccatccagaatgccctgtcgaagcgcaacgtgggcgctatgagcgtctttacgcggggagctcccatcattggcatttgcgctgccggtcccggtgcctacgccttcttctcccggacgatgatgaacctgcgggagaaggatgatgcttgggccgccgcctttggaggcttcatgtgcggcagtgtcctcggacttcctttccgacgcacacccatcgtgctggctcttggtgctttcgttggcactgcccagggccttttccacgtcaccggaggaaaactggacagcttctacaaggaggaggatgagtttgagcgcaaggagactgttagacggacaacccggttgcccgttgagcagactattgccgagctgggcgagggacgaggcatccgtcctcctggatatgaggagagaagacgagagcgcatcaaggaaaagtatggc

SEQ ID NO: 945 - DNA, 624 bp, Trichoderma harzianum
ggccaaatgagattcttttctatttcgagccccaagcagagctcattcgttagcatcttgctacctacaccctgcatgcgcatacgcgatgaatgggcacccggtctgtctgcactctcgtaccctctgctcaaacaagcgagaaacagacgcctctgtcgtctcactcgctgcgccagcgccttggcctgggtaaagcggctgggtaatgcaatccggcgcaacggcctttgccatgtctggaacgcaatgctacgcaagtaacagtaatgcctgcgtttggtgcaggtcgtcgctcgccaccgctggctggctgacagccggcagtgccgcagacacgtataatgatcccactccaatacgtacagagacaactggcacacacccccaggcctgaacgagagacttggatctgggagcgagcaaattgatctgatgctggctagcacgtactacccgacttgacttgctaccatgttgatactgtatgcctcgcctcgccttgcacgaaccatctcatcgcaagtctgatccgacgtggagctaagcctaccatggcaaccgcggccacacatacaacacgttaggcttgtgacgatgcaagggagatggctctgccacggt

SEQ ID NO: 946 - DNA, 373 bp, Trichoderma harzianum
tcgtgtggcgccttgtctcagggacaacagacgacgagcaactcaaagaccagagctaaacatggcttggctagatggcaataagcagagcacgcttcaatcgagaacagacgcgctcgacaataaaggatgtgctacggcacagccattgggacagatgatgtcgcggttcaacggtaagtcttttgatcttgttgattgagcatcataacgtgaggccggctctagttgttcaggacgataaatgccacttgcaatgaccgaagctgtttgagtctcaatacactctgtaccagatgaaagggcttctatgtctgctaggttttcatagatttgtcatagttatgactcctgaagaagtagttgtactgcg

SEQ ID NO: 947 - DNA, 451 bp, Trichoderma harzianum
agccgagttaagcggcgatagaagcaacagaggtgaagttgtgccggtctggtggtttattggaaagaaacgaagagaagaatgttccggtcaagggaagcggcctttggtcagtagccaaagggcagatcaagcgccgccttggaggattaaaagggcggctgcaggggtcccaaggctggtgcgcctcatggaattgtatcgaagaaagtcgatggtgtggcggtgcccgataacgcaaaaagctggcaacctttgtgctgccatgcgggctatcagcgggtaccgccgagtatttgtttgtcactgtacagaggcgagacgtgaggccgagattcgcattggttcggagtctggagtagggaggacaatatggtagcacgattgtcattgtgattgctttgtttattagtacttaaaaaacaaataaaaaacgaaaaaaaacaaccac

SEQ ID NO: 948 - DNA, 132 bp, Trichoderma harzianum
gccaataggtggcctgcaggctgtttctgatacaaatcctcgtaatgcacagacgtgaatagtgctggcacaagtcacattgctgctgccttgaagggttccatttacattttggtgcagctctaccaaccg

SEQ ID NO: 949 - DNA, 646 bp, Trichoderma harzianum
tgataatagtcaaagaccaaatctcttctacggacattgagacgatatcaatgagccgagacaaaatggaaaaagcggaagcactaacgattcaactctttcttctccttggcgctgccctagtgtccatcggcggacgattatacgcccgatggcggcaggtcggaatgaagaatcttggtcttgatgatgggcttgccattacaggagtgattctctttgtgcccaatgtggtcttggcatacatgatgaacacgcggacccattggatgggcaatcattctgtcggcaacaatactacaacacagccgagccataacgaagatcaaatgagggaactgggatcgaaactctatctatacagctggttatcctattccgctgcattatggacgttcaaggcagcctttctcgcaaatgtccttcgtcgaattcccgaatccggcagacgacaaacccaccagtatctcggctttggcttcctggctgcaacatgggtagcaacgacgatggctctcctccaaagctgtcgaccgttgccccacatgtggcaggtttatcccagcccaggactgtactgccagcctgctacttcaccggtgctggcgtgggtttacttcagcttcgatatcgttacaaacctcta

SEQ ID NO: 950 - DNA, 215 bp, Trichoderma harzianum
ggattggctgtgctggggatgagatgagactggcggggtgaatggaggagagaggggcgtggagcgaagccggtgagatggaaagatggaaaggaggagggaaaaaaaaagttttgatcagatgaggggtggcgcacgagacgaggcacggaaaaggtacggcttagatggaagaggtaagatgagatgaggtactaggcaaatacttgagtgct

SEQ ID NO: 951 - DNA, 342 bp, Trichoderma harzianum
gaacaatgcagctggtgacaggtttgtcaagtggcaggggagaatcgtattcgtgtggcgatggtgatgtcgaatttcgaatgagggagccttggcgcgaagaaaaaagaagagagagagagagcggagaggagaggagaggagagtgaaagaaggagaagtagagaggagagaggagagagacgctgtggtgctaagcaaccacgagagaggaagatgaatgcggtttacaaggttgacattggcgaacgagcttggaccgctttgacaatgtgatgtgatgcaggctgggtactccaaatgtttccaattgaacgaatatccaatcagacaagtagagat

SEQ ID NO: 952 - DNA, 447 bp, Trichoderma harzianum
tgctcacttgacatggttttgccgcgtgctgcgctcctcctccctggttccagactgttacccgtctcggaatacagcgagacacggacgacggagatcgggaatgtggggccggagaatccgatgttcacacggattgagtctctggaatgtgtttgctacgtttttatcgggccgggcgatgtctgagcacgtgaagggagacgtgtttgacgtgtaagcaaaagaaggaaataactttacttctgggctcgtgggcttgggcttggatgatccaacagcatatgacgtctaagtgttcgaattgcgtctaaactacgaacccccttgcagttgatgggttagagctgaaaggggacgccgtttgcaatcaattaataagatcatccgttctgaagcgctacagcggtttgagtttcggtaatgccaaacaagctgctgacatgg

SEQ ID NO: 953 - DNA, 606 bp, Trichoderma harzianum
ggaggagtggccgccttggtagcgggcaaggatggcgatgaaacgtcaatcgtgcttgacccggtagctttggagcatgagtctgttcttgctgcctgctgcgttgcatatctacccaacagagatgagatcacaaatctgtggttcaaaggtcggctgccctcaacagcatctcacaatcatcagtcacttgtctcaagggcagtgcacgcgagtaaaggaacacatgggttgatatcggcggctctcagcgaagttattggcaattctcaaaactaaaagtacaccgcgttgagtaataatgacgataataacgataatctggatcatgtatgcgcattgcatacattcgacattcgcgtaggccaggtgggtgtgctccagaggggcatctcgaacatctggtgagcgaagagaggtcagcaccgctgtaagtgcaaccaatcaaattcattacgaataccattggctattgatggagacaatcaccaatgttaggtggtatgaggcattgctataaaatgctacttgttcgttaccacaatcagagaaatatcaagtatatttattaagatctatctaaagccttcatttccataccatatc

SEQ ID NO: 954 - DNA, 477 bp, Trichoderma harzianum
aattgacacccaaagcttcaataacctagggcaaccctcttatccacaatgaagaaagctgcgcctgcggcaaacgctgcccgagatgccggatctcacgatcatatgctccaaggaggccatgccataatgaaagacgaccctgaagacttcaacgctcccaagctttccgagaacatgtcgaagcagactggtcttgggggatccaagcagggcagcttgcaaggcagcgccggcactggcgatagtatgaggcagcgagacactcaaagccatgtaggtcaaacatgcggtggtatacaattgtgctgactagtatgagtgatgaatacggccacgtaaaaaacgagaatgcattgccgattcgaaaagctggtatcagtgggacatgcacacgatgataggagttgacgagaatcccgagtttgaaacatgttgaaataggttgtataatatcatggggagcaaaaccaatat

SEQ ID NO: 955 - DNA, 459 bp, Trichoderma harzianum
aacagcgggaagcaaaacaattcaatttctacttttcctttcaagtacaacattgtttgtaaaatactccaaaatcaatcgtatcaccaattctatcaactgcatcgccaaatcgccatgcctgagggacgtcaatctcctcctcccgagcgccaatccgccgcccaagtagggaacactggatccggcaaggcctcagatatcagcaagaccagccaaaaggacccaaaatcccagctcgactgtctcacatcgaaccccaagggaccgatggacgatgtgcttaaacacaagttttccagggagcctggaaactgtgagcgctaattagagcgactcgtcttccgcagttcgcgactaatgaattatcatagacactccgttgaacgcttagggagaataaatcgtcatgttgtacaatagtcattcatagcatcaattattgcatcgctatactat

SEQ ID NO: 956 - DNA, 530 bp, Trichoderma harzianum
  misc_feature (40)..(40): The residue at this position can be any nucleotide.
gctgactgaaaatgtttgaatcttgccaatagagtcctanatttgttcctgctatgggttcgacagcattttggcacaaggggacgtattttcgggttcaccgaaaaaaggaatcgtttgtcaacactcattcgtggggaggcccaatgaaagacctagaagagattaaggtttcttgctttggtcgttccatcgatccaatcaaagagttactcgcggatgccaaagctctttattataatgacacgcgccaaaagacgaccatctatcgtcccagagtcaaggagcaacgaagggaccataacatgtggcagcaagtaccacgacggcccgttagacccatgtcaacagttgtgctcgactctggcgaaaagcatgatattctggccgacgtcaacgaatatctgcacccctggacgccgcgatggtatgcatctcgaggtattccgttgaggcggggatatctgttccaagggccaccaggcaccggaaagacgaccttctcctttgcgctggggggcgtgtttggc

SEQ ID NO: 957 - DNA, 608 bp, Trichoderma harzianum
cactatagggcgaattcgagctcggtacccggggatcctctagaggcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactggccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtt

SEQ ID NO: 958 - DNA, 565 bp, Trichoderma harzianum
ggcaagtgcgtcttcttctcgtgtccacggagccaacgtttggcgcatcacagccgcggcagagcccaacttgattatcacatccttggtcacatccttgggttgttgtcgattcgccttccatcccctccatctaggcctaatttcatccacctccaaccttccgcccccaacctcctttctccttgtttacaacaacaacaaacgaccatcgattcgacagctcgcgtgcgcatacaacacacatatcgtcgccaacatgtcgttcatgggaggcgcacagtgctcaacggctggcaaccccctgagccagttccagaagcacgttcaagatgacaagacactacaacgcgatcgtctcgtcggccggggaccaggcggccagctgggaggctttcgcagctcgcctgccaatgcgccccaggatgagatgatgaacggtttcctcaatggtggcccaggtcttcaacaagagtttccaaccttgccaggcgggcctgctgcccacctgagcgctgcccctatgggcccttcgcctgcggcatgggcacaagacttcaacgcc

SEQ ID NO: 959 - DNA, 553 bp, Trichoderma harzianum
ggaatacaagactccaggatgcatcatcagcttctcactctcaccgctgctgctggcctcctcgcgacggcctcagctacctactcgaagcttcccagtgtcaatgtgccttcatgtcctcgtgttggcacgattagctacagcaagtcagtgcccgacctgacgcccttcccgctcacacaggtcaacctgtgctacacagacaagagcctcgagctctcattcattgcctatgacgaggtcaattacttcttcaatgcctctcagggtacaaacgacgacatctgggagtacgaagtcatggaggctttcctctacaagggcaccgaagaccctcagacatacgtcgagctcgaggtcaaccccaacaacgtcacataccaggcatttgtttacaacccctccaagaatcgcgcggtcggcgcacccttcgaccacttcttcgtttcggatcccgccacggacggcttcagctcgaagactgtcctcaacaagctcgcaaagacttggaagagcactgttaccgtccctctgggcatcttcaacgtcgacg

SEQ ID NO: 960 - DNA, 242 bp, Trichoderma harzianum
attctaaaacagtcagcagggctcgaggccttgtgcggcagatatgggggccagcgactccaagataggatttaagcagggcatcttcagattatcagaggagcgcaacattgcggcgcatgatccttactggacttcggttcgtcatgcctttgatcccagatggccgcggggatgctgatgctgatggggtcatagttttgggagcttcctgaatcgtcggaagatgtttttagtctttt

SEQ ID NO: 961 - DNA, 490 bp, Trichoderma harzianum
gtcctctcaatctcgttcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctggtatgtcgcaagctgcttgttgctgataatgtttttatttcatctggattcacatccaaccccttttgtccttgctgtccttatcctcccaaacccttcccgtcgcagccgtgacaagactctggcgcaatcctttacgattgcgacgtcggagccggcgaacccacaaatatcccatcgcttgactaatagctaccgtgtctaatgcactctatgactgatgatattcttacttacagggaatcggcgcctaccgagataacaatgcgaagccatgggttcttcctgtggtaa

SEQ ID NO: 962 - DNA, 507 bp, Trichoderma harzianum
taccgcattgcattccatttgattgcttcattttcagtccatttgttggtcttttctgaaatacccatataccggtgtacacccgtatatatacagctggttgaactgcactccgctcgcattcaatcttccccactacatcatcacatttcttctttctcccacaaacaacatcacacacaaccgtcatcatggccaaccgagaaattctgtcgtctcgaaccgagactctcaacaagtacctgaagctcgaccagaagggcaagatcatggccgagtatgtctggatcgattctaccggcgagactcgatcaaaatccaggacgctccctgagctcaaggacaaggaatacacccccgaggatctgcccgtctggaactttgacggctcttcaactggccaggctcctggtcacgattccgatgtctacctgcgccctgccgccgtctaccccgatcctttccgtggctctcccaacatcatcgtcctcgccgagtgctggaacg

SEQ ID NO: 963 - DNA, 508 bp, Trichoderma harzianum
attaaaccgcccctacttgcttttgctctctttgttgttcactcgcagctacaactctcgcccacaatgtctctcaagaatgacgctttcccttcctccgaggccttcgaggccatcaacgccgctctcagcagcagcgaagccgaccgcaaggacgccatcaagaatggcaaggccgtcttcgccttcaccctcaagaacaaggccggcgagacggccagctggcacattgacctcaaggagaagggcacagtgggcactggcgtcggcgagaaccccaccgtcactctgtctctctccgacgaagactttggcaagctcgtcaccggcaaggcccaggcccagcgcctcttcatgtccggcaagctcaaggtcaagggcgacgtcatgaaggctaccaagatgcgcccatcctgaagaaggcccagaccaaggccaagctgtaaaaagcgggcattggcaagttgggctgttgattatgggaaaacaggtggaaacaaaccattaa

SEQ ID NO: 964 - DNA, 284 bp, Trichoderma harzianum
ccaaacatgagctcaccccataggctgtcgccctggcacaactgggtcacaatcaggaactcaatgggaaatttctccctgatttctatgctgggtcttgcctttgccatcctcaacacatggacggccttggcagcttcaattacactcgctctcccctctggtggggctagttccgttatctggggtctgatcgtggccggtatctgcaatctgtgccaggctgcttctctcgccgagtgcctttccgcctaccccacaggcggaggtcagtatcactgggc

SEQ ID NO: 965 - DNA, 502 bp, Trichoderma harzianum
agctctgctctgttgtgtctgtatattaagacgtcgttcctgccatctcttcccccttatcctccctcttcttctctttctcgccaccctatacttacccctccttggccttgttcgtacaacaggaccaacaacttgtgaatgctctcatccttttccaaaagactcaagagcaagagattcagaaagtccaaagccatgatccgacccaccttcgtcggagccatagaccagggcaccacaagctctcggttcctcatcttcaaccagaggggcgaggtggttgccacgcatcagttagagtttgcacagcactatcctcatcctggatggcatgagcatgatcctgaagagcttgtttcgtctgtggagacttgcgttgatggtgctgttgttgagtttcgaagcagggtcacaaccgtgagcagattgttgccgtcggtatcaccaatcagcgtgagacaactgtcgtttgggacaagacgacgggcaaggcgctgca

SEQ ID NO: 966 - DNA, 369 bp, Trichoderma harzianum
ggattccaaccaaatctccgggatgggctcgacctgcttccgcgccgccgcccgcatggcctcctccgcctgccgctcggcggcctcccgctcaatcccctccgccgcgcggcgcggcgcccctcgcatctccaggctgccggtggagctcgggtgcagcgcggggttgtcgctgctgccgctgcacagcgcggtggcggcggcgaggctgacgtcgcggctgagcacggcgtcgcggacctgctgcgcgctctctcaggagatgggtcagtctgtcccaaggtgataaatgctggaagacctgctcatgtcgtgctatcagacaattgattttgtagagtgaactaaattggtttctgtgttgcctga

SEQ ID NO: 967 - DNA, 500 bp, Trichoderma harzianum
tgatgagcaaatcatctcatcaagctgggttttatcagttgttgatgctgaattaggtggttttcatttaaataattccaattctttcaacattcacttgacgaaatggcaaaccttgctactgggattcacaaattccaagggccggacattgaactaacttatacggtgcgaggatccggaccatatcttattattcaggcagcaggatggggaatttcttctcagtatcttcaaattgggctttcgcctcttgaggctcaatttaccctaatatacatggagccccgcggctcaggcccctccgagcgaccacaagaagacataatgagcacttccgatatgactgacgacctcgagcttttacgaaaacacttggaatttgaacaaattaatttgctcggtcattctaattgaggcaccatcgccttagcgtatgctgagcggtaccccgcctcagtccgaaacttgatcctcctcacacattggcccgaaggata

SEQ ID NO: 968 - DNA, 110 bp, Trichoderma harzianum
ggcagtagtacacagtcttggtcttgtctttgtcttgtttcttcgttgatataccggcgcctatcatgcgccgtctcctctccgtcagcgcctctgccagtgcccgcgga

SEQ ID NO: 969 - DNA, 565 bp, Trichoderma harzianum
cccacgcgtccgcccacgcgtccgctctccatatcgaatcttctcttctcctttgataccctctcggtgttgcagacagaatcatcagtcacaatggcttctcagcagatccgcactcccatcaccgatcttttcaagatcaagcaccccatcttactggccggcatgaacgtcgccgccggtcccaagttggcggctgccgtcaccaacgccggcggcatgggcgtcatcggcggtgtcggatacaccccagagatgctcaaggagcagattgccgagctcaagagctacctcaacgacaagaacgctccctttggtgttgacctgcttatcccccaggttggtggcaatgcccgtaagaccaactatgactacaccaagggcaagctcaacgagcttaccgacatcatcatcgagtccggcgccaagctgttcgtctccgccgtcggtgttccccccaaggccatcgtcgacaagctgcacaagcatggcatcctgtacatgaacatgatcggccacgtcaagcacgtccagaagtgcatcgacgtcggcgtcgacatcatct

SEQ ID NO: 970 - DNA, 205 bp, Trichoderma harzianum
gtggtgtcgatccaaggggacgcgtggcgaccgctgcacagcccgcgtgtggtgactagaggcggctaacaggtggtaagtaatcggatctgctgtctctcttgtgcagtctcacacatgtcgcaggggtgggttttgaatggagacgaagcttgttgcgatgaatcaagtcatgctagctgcatgcctgaccgagatgaggagg

SEQ ID NO: 971 - DNA, 243 bp, Trichoderma harzianum
cggacgcgtggggactagataggtagagatggtttggcggtcaatgctgtgctcgttagatgtctcacgggggcccgcatgtatctccatgtagttcctcgcacgcagcaagaaagaggcaaaacccgcgcggtgttagtagcgtttgccatcggaagacgatcgcccagcacgtcaaagaggccatttgatcagttactcgattggtgctcgcacgggttggttacgaaaaacaaaaaaaaa

SEQ ID NO: 972 - DNA, 545 bp, Trichoderma harzianum
cccacgcgtccgcccacgcgtccgaacgaatcgtccactcagctcggctcaatcatcatcacaatggctctcaacctcaccacgtcggctcgagccctgcgctccttcaagccctacacccgtgctgctctccttgccaacgccgcgcgatgctactctaccgctgagcccgatctcaagacaaccctcaaggaggtcattcccgccaagcgcgagctgctcaagaaggtcaaggcccatggcagcaaggtcattggcgaggtcaaggtcgagaacaccctcggcggcatgcgtggcctcaaggccatggtctgggagggatccgtcctcgatgccaacgagggcattcgcttccacggccgcaccatcaaggactgccaaaaggagctccccaagggcaagacgggaactgagatgctccccgagtccatgttctggctgcttctcaccggccaggtcccctccgtcaaccaggtccgcgagttctcccgtgagctcgcctccaaggcccagatccccgccttcggcaacaagatgctcgacga

SEQ ID NO: 973 - DNA, 615 bp, Trichoderma harzianum
attaggcattgacagcaaaccaattccctccataactgggcctcttcacacccgtactcagaatgaccgacagaatattccgcatctttaacccgggagaaccaaagggtgatcccgttgagaagaggcgcgctcagctgcgacgtgcccaacaatcttatcgagatcgcaaggacaagtacaccaaggcgctcgaggctgaactagcacggtctcggaagagcgaggcgggcttgacgttccagatcgagcagcttcgtgtcaaagttcagaaactggccagtctcttgtcccaaaatggcatctcacttcctccagattttgacaatgaggaacaacttcatgatgatgtaccgcgtatagattcatctccgctcacaacgcgtggacaaccacaaaccgctgaaggcttcctatcaagtacagattcaacctctcctgagtcggtgacggaccaaggagctatcttaaatagtggaaaccgcactctacggcagtacagttcgagaatcttttcccgacatcatgaaccgcaggttccagcgccgacgaggaccgtccaagatgagcccggtgacaggactcgccttgctgaacttgatcccacacaggtcg

SEQ ID NO: 974 - DNA, 324 bp, Trichoderma harzianum
tacgtggtctcttggggtgtagcaatcaatacttgtgtacacgtagatacagtagtctatgtccgtgtgcttctgggggtgggcattgattatctccgtgcggaggaatatgggggtgttcgtgtgtcttggtatcaatcaggctatgcgggaatacgatgtagttacgacgcctcctctactgtacattactgacatgccctgtaaagacaaggtgagcatacgagacaatgccgctgtctctttgggagggaattcgttagagtcagccaagagcgccatgttgaatgaaagaatcggacatggcttatcttagtcccccgg

SEQ ID NO: 975 - DNA, 513 bp, Trichoderma harzianum
tcttcctctgtctgctatctttcctcctatctcagtcacccatccatccttttcctcccatcttttcacacattattacaaaatgggcgccgccgacagaatttcccagattggaggccagatctccggcaaccctaccgccggtggtcgcgacaagatcctcgagaagcgccctgacgatgtcgtcgtcactgccgcctgccgtaccgccttcaccaagggcggcaagggtggcttcaaggacacccccgctggcgaccttctcgctggtgtcctaaaggccatcatcgaacgctccaagatcaaccctgcgctcgtcgaggacgtcgccgtcggcaacgtgcttgcgccgggtgccggtgccactgagttccgcgccgccgcttttgtcgccggcttcacagaggagacggccgtgcgtgcggtcaacagacagtgctcttctggcctgcaggcctgtgtcgatgtcgcgaaccagatccaggctggtatgattgatatcggtattggtgc

SEQ ID NO: 976 - DNA, 172 bp, Trichoderma harzianum
ggacaggggaagggggtgttagttgcgatagccgatgtttgcatgtgaaggccactactttaccaaaagaggatgctgggatggctgttgccggtcgagtaattaatatgcataatagtatccgcaggtgatgaggtgattttaatgtataattgctaaaaaaaaaacaaaa

SEQ ID NO: 977 - DNA, 317 bp, Trichoderma harzianum
cgaaaccaaggagtggctctctgaggttgctgagcatgcgcaggcgctcaaggtcgatggtggcttcgatgagggtgccgatctgggccccgtcatctccccccagagcaaggagcgcatcttgagcatcattgacagcgccgagaaggagggtgctacgatcctgctcgacgggcgtggcttcaagtctgaaaagtaccccaacggcaacttcatcggacccaccatcatctccaacgtcactcccgacatgacctgctacaagcaggaggatcttcggccccgtgctggtgtgcctcaacgtcgaaaccatcgac

SEQ ID NO: 978 - DNA, 75 bp, Trichoderma harzianum
gactcattgttggcatatggagcatcccaatcttattcgtactcatgtgatcgtcatcgctcatcatgctgacca

SEQ ID NO: 979 - DNA, 325 bp, Trichoderma harzianum
tcgaccgacgctcggcaacaatggcgacaattgcaagcggcttgcggcatgcgagatgcgcaagctcgattgctgcagctcaatggcggccggcaatcttcccgcggtcgaactttcaactcgccatccggtctataaccagcgactctcaaaagcctcccagtcttgaacttgaagccgccgagtccgtcccgatcccataccagggcgttacgcatgcgcgagttgttccggcgacaccatcttatttctcaagagaaccccagttcaacgattgatacattggaatctccaatctgctcaccaagtacaaccacctgcccac

SEQ ID NO: 980 - DNA, 120 bp, Trichoderma harzianum
gtcagcaatccgttcccagagaccgagaaatacctttcgagaggttggcatctcttctacccatcggatcggcatgggaccgcctaaacgcaacagcacctcgctgcctgccggctatgt

SEQ ID NO: 981 - DNA, 345 bp, Trichoderma harzianum
gtgtggtacagacgcccccgaggccgccgctggtcccgtgtccaacgggtcgcatgccagcaaggccaacccagccagctctccgtatcagaacgtcaacgacttcatctccaatgtcgcccgattcaagatcatcgagagcactcttcgtgagggcgagcagtttgccaatgccttctttgacactgaaaccaagattaagatcgccaaagctctgtaagcccgaaccacctcgcaactcacttggttctgttgttcctctccacactcgtctcatatgctaacatccctacggtgacgagtttggtgtcgactacatagagctcacaagtcctgtgtcttctc

SEQ ID NO: 982 - DNA, 515 bp, Trichoderma harzianum
ataaatagtagctgcttgttgtgaagcactgctttcatcaaaacaagtactctccaatcacatctggtgttcgaacaaggtcaccacccaacaacatttcgcatattccatcaggtcgatcgattcccaagtccgacaatcaccatggctgacgaaaccgtcaacatcgctcccaatgagaaggagaccaacggtgtccagcagcagacggcggtaccgcgccagggcttcacacacaaccaccacagcgacttcaatgagatgaccattggccagtatgctcaggcttttggtggtgctctccaacccggggcatggaggccatatgagcaccgcaagctcgccaaccccgcccctctgggtctttctgctttcgccttgactacctttgtcctctccgccatcaacatgcacgctcgaggagtctcggcccccaatgtcgtcgtctctctcgcctttggttatggcggtcttgttcagctgcttgctggcatgtgggaggttgctgccggtaa

SEQ ID NO: 983 - DNA, 514 bp, Trichoderma harzianum
aaaacatcacagtgcacatcagggcgcgagtacttcgcaatagagcggttgcgtcaccgaaaaccaccgacgccgtaaagcctgacagcaccccaaagggcaagagaaaggccgccgaagagtcttctcccgttgtgctgaagaagcagaaatccgccaagaaggaagatgtcgagaccaaggcagccaagtcacccaaggcagccaagtcaccaaagactaagaaggaggaaaagaagaaagaagaagaaaagaagcaagatgtgattgacatggaggaagattccgagtctgagggacaagaagatgagggaaatcttcaggctttggccgtcaacattgacccggaagaagaggcccccgtgaacgacgaagaattccagcccggtcaggacgttggcaagatccccaaggtctcgaaagacgtccagaagtcgatcaaggcatcgaaggaagaacctggcgtcgtttacattggccgaataccccatggtttctacgaatacgaaatgag

SEQ ID NO: 984 - DNA, 506 bp, Trichoderma harzianum
gcagcctaaaagcaaaccgtctcatcttacatggccttgttcctttccatactccattcttccccaaccccaacaccccgccagccgttctgtcagcgccacagcgcattagcctcatcacctcattgctcactggtctgcaaacattgcgcaaggcggtgaatttttcatgtcgagaattgacattatataacagcacgtattctaagattcatgtattaagtgccgaggaaattcatttcttccccatccgtcaaagtcctaggtaagtaacaatgcattaatcgtaatgtccaactcggagagttttcaatactccttatcgataagtcattatgtaatcaatcctgccgggaagggaaattttgctcctctcccaaacctcaaatcgcatctccaaagccctgtgacgacatacaacacccgaacagcaatatcaaacccccaaacaccaaggaacaagccctcaccccgtattttacctcccagtttacaaaaacaaaaca

SEQ ID NO: 985 - DNA, 857 bp, Arabidopsis thaliana
cccacgcgtccgctcgatttcagatttaagatctcagatacaaaactccgacatgtctacgttcagcggcgatgaaacagctcccttcttcggcttcctcggcgctgcagccgcactcgttttctcctgtatgggagctgcttatggaaccgcaaagagtggtgttggtgtggcttctatgggagttatgagacctgagttggtgatgaaatctattgtccctgttgttatggctggagtgttgggtatctatggattgatcattgctgttatcatcagtaccgggattaaccccaaggctaagtcttactacctctttgatggatacgcacatctctcgtctggtcttgcttgtggtcttgctggtctctcagctggaatggccattgggattgttggtgatgccggtgtcagggcaaatgctcagcagcctaagctctttgttgggatgattcttatccttattttcgcagaagcgcttgctctttacgggcttattgtaggaatcattctttcctcacgagctggccagtctagagctgaatgagaatctaaaccacaagactgctcaaaggtacttcctttacttctgtgtgcgttttgttttatcgtgattagtatgatgtatcatcgggaaccaaaaattttactggattcttggaaatttgtttcggaaacaaaaccgcctatcttcattctccttttcttttccggtggttactctccgatgtagaattttattgtttgattctgtaataaagaagctctgaggagtttggtatgtttttgtattcttgtatttgtcctgaggaagttaaatacatttatttgtaaagaagtttgcttttctgaaaaaa

SEQ ID NO: 986 - DNA, 664 bp, Arabidopsis thaliana
gcagcatgcagactccgtacactacttcaacgcaggggcaatattgtcattcttgtggaatgttccaccaccatagccaaagctgctgctacaacaacaacaacaactccaacgccggttcttactcgatggtcttctccatgcaaaacggtggcgttttcgagcagaacggtgaggactatcatcactcttcctccctcgttgactgcactctctctcttggaactccttctacgaggctttgtgaggaagatgagaaacgtagacgctctacttcatctggtgcttcttcttgcatctccaacttttgggacttgattcacaccaaaaacaacaactccaaaacggcaccgtacaataacgttccttctttctccgctaacaagccaagtcgcggttgttccggtggtggtggtggcggaggaggcggtggcgggggtgactctcttctcgctagacgctgtgccaactgtgacactacttctactccactatggaggaatggtcctagaggccctaagtccctatgcaacgcatgcggcattcgtttcaagaaggaagagagaagaactactgcggctacaggaaacaccgtcgtcggagctgcaccggttcaaaccgaccagtacgggcatcacaactctggctacaataattaccatgc

SEQ ID NO: 987 - DNA, 208 bp, Arabidopsis thaliana
ttatcatctggtaaagtcatggacaagacttgccctatccgctacattaagcctccaagaaaggaacggaacaccgccgtgagcaccgtcggattcaacgttgtttgctactccactgccgtaatcatccatgaacctgatctcatttgccggataattacacggaaccctctgcgtcgagtggtgatgagcccacggagtaccatta

SEQ ID NO: 988 - DNA, 731 bp, Arabidopsis thaliana
gcagcatgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataataa

SEQ ID NO: 989 - DNA, 758 bp, Arabidopsis thaliana
gcagcatgggaactccagaatttccagatctgggtaaacactgctccgtcgattattgcaaacagatcgatttcttgcccttcacatgcgatcgctgccttcaggtgtattgtctggaccatcgtagctatatgaaacacgattgtccaaaaggaaacagaggagatgtcactgtggttatttgtccattatgtgctaaaggagttagattaaaccctgacgaagatcccaacatcacctgggagaaacatgttaatacagactgtgatccatctaactacgaaaaagctgtcaagaagaagaaatgtcctgttcctagatgcagagaactcttgacattctccaatactattaaatgtcgagattgtagcatcgaccattgtttgaaacatcggtttggacctgatcatagttgttctggacccaagaagcctgaatcgagtttctcattcatgggtttcttgagtacaaacacaaaagaagctcctgcatcatcatcatcttcttcgagatggtctagtcttttcgcttctgcggaagcaagtattagtagactcggtaacgatataagccagaagttacagtttgcgagtggcaatgatgacaattcagagatgacgcaagagaggaatggaatacagaattctggcaaagttacgattgatgtttgtcccatatgtagtagagggtttcgtgatccgctggatctattgaagcatatcgataaggatcatcgtggcacttctaaagcctaataa

SEQ ID NO: 990 - DNA, 543 bp, Arabidopsis thaliana
gaagtgaactgcagcatggattattcttcgatgcatcagaatgtgatgggagtatcttcatgtgcaacacaagattatcaaaaccagaagaaaccattgtcggcgactaggccagctccaccagagcaatcattaagatgccctcgctgtgactccaccaacacaaagttctgctactacaacaactacagtctctctcaacctcgctacttctgcaaatcttgtaggagatactggaccaagggtggaatcctaagaaacatcccaatcggtggtgcttaccggaaacacaaacgctcctcctccgcaaccaaaagcctcagaacaactcctgagcccacgatgacccatgacggcaaatcattcccaacggcgagtttcggctataataataataacattagcaacgaacagatggagcttgggttagcatatgccttgttgaacaagcaacctctaggggtttcttcacatctagggttcggaagctctcagtctccaatggccatggatggcgtgtatgggaccacgagccatcagatg

SEQ ID NO: 991 - DNA, 139 bp, Arabidopsis thaliana
gttactacaataaagcaccagtattaatgtagttgacagtactgctccaaatctctctccctgaatcaatctgatcaacatgaccatgaccatgaccacttcctcctcccatgttcatctgccaggggaatccccacaa

SEQ ID NO: 992 - DNA, 865 bp, Arabidopsis thaliana
gcagctttctgcaacttctccaaatctcatactttccagaaaatcattttcccaagaaaaataaaactttcccctttgttcttctccccccaacagcaatcacggcgtaccaatcggagctaggaggagattcctctcccttgaggaaatctgggagaggaaagatcgaaatcaaacggatcgagaacacaacgaatcgtcaagtcactttttgcaaacgtagaaatggtttgctcaagaaagcttacgagctctctgttctttgtgatgctgaagtcgcactcatcgtcttctctagccgtggtcgtctctatgagtactctaacaacagtgtaaaagggactattgagaggtacaagaaggcaatatcggacaattctaacaccggatcggtggcagaaattaatgcacagtattatcaacaagaatcagccaaattgcgtcaacaaataatcagcatacaaaactccaacaggcaattgatgggtgagacgatagggtcaatgtctcccaaagagctcaggaacttggaaggcagattagagagaagtattacccgaatccgatccaagaagaatgagctcttattttctgaaatcgactacatgcagaaaagacaggaagttgatttgcataacgataaccagattcttcgtgcaaagatagctgaaaatgagaggaacaatccgagtataagtctaatgccaggaggatctaactacgagcagcttatgccaccacctcaaacgcaatctcaaccgtttgattcacggaattatttccaagtcgcggcattgcaacctaacaatcaccattactcatccgcgggtcgccaagaccaaaccgctctcagttagtgtaataa

SEQ ID NO: 993 - DNA, 654 bp, Arabidopsis thaliana
gcagcatggcgttatccgggtcgggttcttactatatccaaagaggaatccccggttctggtcctcctcctcctcaaactcaaccaacgtttcacggatcacaaggatttcatcatttcaccaattccatctctccttttgggtcaaacccaaacccaaatccaaaccctggaggtgtctctactggattcgtgtctcctcctttacccgttgactcttctccggctgattcgtcagcggcggcggcgggagctttggttgctcctccttcaggtgacacgtctgtgaagcggaagagaggacggcctacaaaatatggacaagatggtggttctgtttcgttggcattgtctccttctatctccaacgtttccccgaactctaacaaacgtggccgtggaagacctcctggctccggcaagaagcaacggctatcttccattggtgaaatgatgccttcatcaactgggatgagcttcacaccgcatgtaatcgtagtttccattggtgaagacattgcttcaaaggttatatcgttctcgcatcaaggtccacgagcgatatgtgtcttatccgcaagtggtgctgtctctactgcaactcttcttcagccagcaccttctcatggaactattatatacgagggtctattcg

SEQ ID NO: 994 - DNA, 448 bp, Arabidopsis thaliana
ttatcatccacgcattagatcaatgtccatatgggggtgatgcatatccattgaccttgaaccagttgaccaaatgcctacaggagtctgaacaatgttctgactttgctgaggaacaggaggtgacgttgctgctgtgtgatcgttgttgttttccaaagcatcagtatcttggacatcttcagaagtttcttcacgtcatataatcttccctttcggaattgcccaaatgaagctgccaacaatgagctggacttggcttgctgctattataggacctccaattccaccaccaatgacacgaccatcggggctagcaagtgagaccgctagacttccagtgcggtttgggtagtcattgtcagtcgtgttcagataagaacttgagagagatatgagctctaatagaccctcgtatataatatttccatgagaaggtgctggctga

SEQ ID NO: 995 - DNA, 498 bp, Arabidopsis thaliana
gcagcatgagtttaccaagctccgatggatttggttcgattccgagcacgggacggaccatgacggtgtcgttttctgaggatccgacgacgaagattcggaagccgtacacaatcaagaagtcgagagagaattggacagatcaagagcacgataaatttctacaagctcttcacttatacgatagggattggaaccaaaatagaatgctttgtcggatcaaaaacagcagttcagatactaagccacgctcataaatactttctcaaagttcagaagagtggtgctaacgaacatcttccacctcctcgacctaagaggaaagcgagtcatccttatcctataaaggctcctaaaaatgtagcttatacctctctcccgtcttcgagtacattaccgttgcttgagcctggttatttgtatagctctgattcgaagtcattgatgggaaaccaggatgtgtgtgcatctacctcttcttcgtggaatcatgaatcg

SEQ ID NO: 996 - DNA, 428 bp, Arabidopsis thaliana
gcagcatggcggcttctccgttggtggttcagaaaacagaggaggagtggcgtgcggttctttctccggagcagtttcgtattcttcgtcaaaaaggcactgaaaagccaggaactggagaatatgacaagtttttcgaggaaggaatcttcgattgcgtaggatgcaagactcctctttataaatcaaccacgaagttcgattccggatgtggctggccagctttctttgaaggactccctggtgccataaaccgaacccctgatccagatgggagaagaactgagatcacttgtgctgcgtgcgatggacatttaggccatgttttcaaaggagaaggttacggtaatccaaccgatgaacgtcattgcgttaacagtgtttcgatcagttttaacccggcaaaatcttcctctataatctgataa

SEQ ID NO: 997 - DNA, 956 bp, Arabidopsis thaliana
gcagcatggatgtgacagatgatgaagagatccaccaagatcgccattcctacgcttctgtttccaagcatcatcatactaataacaacaccaccaacgttaatgctgctgcttctgggcttctccctaccaccaccagtgttcatgggcttctcgaatgtcctgtctgcaccaattctatgtaccctcccattcatcagtgtcacaatggacatacgttgtgttcaacctgtaaagccagggttcacaaccgctgcccaacttgtagacaagagctcggtgatatccgttgtttggcactggaaaaagtacccgaatcacttgaactaccttgtaaacacatgtcacttggatgtcctgaaatcttcccttattacagtaagctcaaacatgagactgtatgtaacttcagaccttatagctgcccttatgctggatccgagtgttctgttacgggcgatatccctttcttagttgctcatctgaggggtgatcataaggtggatatgcattctgggtgtactttcaaccatcgttatgtcaagtctaatcctcgtgaagtcgaaaacgccacatggatgttaactgtctttcactgcttcggtcaatacttctgtcttcactttgaggcattccagctcggaatggctccagtctacatggcgttcctgcgtttcatgggggacgagacagaagctcgaaactacaattacagtttagaagtgggaggttatggtcggaagctgatatgggaaggaacaccaagaagcgtaagagacagccacaggaaagttagagacagtcatgatggactaattatacaaagaaacatggctctcttcttctcaggtggagataggaaagagctgaaacttcgagtcactggaaggatatggaaagagcaacaacaaagtggtgaaggtggaggagcttgtatcccaaacttgtcttgataa

SEQ ID NO: 998 - DNA, 434 bp, Arabidopsis thaliana
gcagcatggaaacgaaggcggctcctgaagctggtatgatcaaaaagtccaacgaggagtggcgtacggttctatctcctgaacagtttaagattcttagagagaaatctattgaaaagagagggtcaggagaatatgtgaagttgttcgaggaaggaatctactgttgtgttggttgtggaaatccggtttataaatcaaccactaaattcgattccggttgcggttggccggctttttttgatgctattcctggcgccattaaccgaaccgaggagagagctggattaagatatgagataacttgcacaaaatgtgatggacatctaggtcatgtcttaaaaaatgaaggttttccaacaccaactgacgaacgccattgcgtcaacagcgttgctctcaagttctcttccgctatcacatctcagtgataa

SEQ ID NO: 999 - DNA, 653 bp, Arabidopsis thaliana
gcagcatgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcg

SEQ ID NO: 1000 - DNA, 845 bp, Arabidopsis thaliana
gcagcatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccaagcaaaaacaagctcttgcgagacagctgaatctaaggcctagacaagttgaagtgtggttccaaaacaggagagctagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttagtaa

SEQ ID NO: 1001 - DNA, 1067 bp, Arabidopsis thaliana
gcagcatgggttccaattttcattacacaatagatctcaatggagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaagcaacacactaataacgaccaatcctcaaacctaagcaattcggaaagacagaatggttataacaacgattgcgtgattaggatttgctccgattgtaacacaaccaagactcctctttggagaagtggtccgagaggtcccaagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtgataa

SEQ ID NO: 1002 - DNA, 663 bp, Arabidopsis thaliana
gcagcatgctgatgtcatcgctctatcgccaacaacactcatggcaacaaacagattcgtgtgcgagatctgcaacaaagggtttcaaagggaccagaatttacaactacatcgccgtggccacaaccttccatggaagctaaagcaacggtccaaacaagaagtgataaagaagaaagtatacatatgtcctatcaagacttgtgtacaccatgatgcctccagggcccttggagacctcactgggatcaagaaacactacagccgcaaacacggtgaaaagaagtggaagtgtgaaaagtgttctaagaaatacgctgttcagtctgattggaaggcacatgcgaaaacttgtggtactcgtgagtataaatgtgactgtggcacgttgttctccaggaaagatagtttcatcacacatagagcgttctgcgacgcattaactgaggaaggagcgaggatgagttcacttagtaacaacaatccggtgatctctacgacgaatctgaattttggaaatgagtcaaatgttatgaataatccaaatcttcctcatggatttgtacaccgaggagttcatcatcccgacattaatgctgctatctctcaattcggtctagggtttggacatgacctaagtgcaatgcatgcgcaaggtctatc

SEQ ID NO: 1003 - DNA, 157 bp, Arabidopsis thaliana
ttatcaacccaatggagcaaaccttgcgagttcttgaggcaaaaacggacgacgacccgtttggtgagggtgatgctcgttgctcactccaagaaaatcccgggttagacccatctgttgagccgggtttagacccgatcggttcgattgaaaggga

SEQ ID NO: 1004 - DNA, 549 bp, Arabidopsis thaliana
gcagcatgcggatgttgtgcgatgcttgcaaaaacgcagccgcaatcatcttttgcgccgccgatgaagctgccctttgtcgcccctgctatgaaaacgttcatatgtgcgacaagctacctagtcggcatgtacgtgttggtttagctgaaccaagcaatgccccatgctgtgatatatgcgaaaatgcacctgccttcttatactgtgagatagacggtagttctcttagtctgccatgtgacatggtagtacatgttggtggcaagagaccacacgggcggtttcttttgctgagacagagaatcgagtttccaggggataatgctaaagaaaacaatacgagggacaatttgcagaaccaaagagtctctacaaatggaaatggtgaagccaatgggaagattgatgacaaaatgatggatctaattgctaatccacaaatagtacatgaaccatcatcaaataacaacgggattgatgtatataacgagaacaatcacgaacctgcaggcctagtaccagttggacccttgaaacgaaagtctg

SEQ ID NO: 1005 - DNA, 719 bp, Arabidopsis thaliana
gcagcatggagtggtcaacaacgagcaacgtagaaaacgtgagagtagctttcatgctaccgccatggccggagtctagttcctttaactcgctccacagcttcaactttgatccttacgcagcaggaaattcatatacgcctggcgatacacaaaccggaccggttatctctgtaccggaatcagaaaagatcatgaatgcgtaccgatttccgaacaacaacaatgagatgataaaaaagaagagactaacgagtggacaattagcttcacttgagcgaagttttcaagaagagatcaaattagattcagacaggaaggtgaagctgtcgagagagctcggtctgcagccacgtcagatagcagtttggttccaaaaccgccgtgcacggtggaaggcgaagcagcttgagcagttgtacgactcgcttagacaagagtacgacgtcgtttctagggagaaacaaatgttacacgatgaggtgaagaagctgagagctttactaagagaccagggtttgatcaagaagcaaatctctgccgggaccatcaaagtttccggtgaggaagacacggtggagatttcatcggtggtggtagctcatccaagaacggagaatatgaacgcaaatcaaatcaccggagggaatcaagtttacggtcaatacaacaatccgatgctggttgcttcctctggctggccgtcatacccctgataa

SEQ ID NO: 1006 - DNA, 437 bp, Arabidopsis thaliana
ttattacgtacttgtacttgttgtttttttataaggatctaatcctagacggagctcaagatctatcacgtctgcactttgagataaagccttttgaagtatcctcatatttttcttttcttcatctcctaaacctttttcgcttttatcatcttctccttttcttcttggaccgaccgtatcaacgaagaaaggtaactcaataagctcttgcccaaaccgatttctcgaagtggtgcaaatggcatcttcactgtcttcttcttttaggttcgcttgtcgaagttttgccctgtcttttctgtggatgttcatgtgccctcctaaagcttgtgcgttggaaaaacctctctcgcaaaattcgcatatgtatggtcttgcttgtgatccggaccatgaatatgatcgacgatccaagtattttctattcatgctgc

SEQ ID NO: 1007 - DNA, 770 bp, Arabidopsis thaliana
gcagcatggacgaggctaccggagaaacagaaactcaagatttcatgaacgtcgaatccttctctcagcttcctttcattcgccgtcctaaagataagaaccctaaacccattcgtgtcttcggaaaagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacgcgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattatacacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaataa

SEQ ID NO: 1008 - DNA, 926 bp, Arabidopsis thaliana
gcagcatgactcaaaagctgtttatacagtatagtctacggtcttacatcgtattttggaaatatgaccaaattaccccttggtttgtccataaatatcaagctccaacaatgcaattcttcccttttccccttctaatttctctcatctctctattagaaaaattattagcaattatgttgtccactggaccggccttttcattctccgaaccgggtttggttaatcaattctcgggtttccaaaccgggttcactccttgggaatgggattggtctgatctctttttcgtggaccaaatgtctcttgaaccggccatccctaatccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgataa

SEQ ID NO: 1009 - DNA, 512 bp, Arabidopsis thaliana
gcagcatgggtcaaaagttttgggagaatcaagaagatcgagcgatggttgaatccaccataggctctgaagcttgcgactttttcatctcaacagcttcagcttccaacactgccttgtccaagcttgtctcaccaccaagtgattccaatctccaacaagggttacgtcacgttgttgaaggatctgattgggattatgctcttttctggctagcgtccaacgttaatagctctgatggttgtgtcttgatctggggagatggtcattgccgtgtcaaaaagggtgcttcaggtgaggattactctcagcaagatgagatcaaaagacgtgtgcttcgcaagcttcacttgtcgttcgttggttcagatgaagatcatcgtttggtgaaatcaggagctcttactgatctcgacatgttttatctggcttctttgtacttttcctttaggtgtgataccaataagtacggtcctgctggaacctatgtgtctgggaagcctctttgggct

SEQ ID NO: 1010 - DNA, 598 bp, Arabidopsis thaliana
ttattactgtgatagagaggcaaggagcttgtccttcaactgctcagcggtgcagccaccctgaggccggagagtgaatgtgtgaaccacaccctcctctgtgatggccacgttggaatcatgaggcataacttcattctccctcaacgtttgtatcacctttgaaactggatgagtttccaacggacagcttagccttacaactgcatcatcatgcctctgttgataatcaacctctgctggagttatctgattactctccctcctcttcattatctgcttctctgtttcatacaccctgattttcttctgcatatccgtgatgtaagtgattgcgtctgcaaggagcgaagccttgtccatcttggagatgttaggcaccaccgctctcaaagcgtagaatctctggttcagcttctccctcctctgccgttccgcttccacgtggtttagagcctcttctcttccatttgctggttttctccctctcttcctcggcttttgctcgtcagttagatacaatgtctcatctttcccttgctcataaccatacacttgattagagcctccgatcgcttgcacctcatacgattccaat

SEQ ID NO: 1011 - DNA, 607 bp, Arabidopsis thaliana
gcagcatggagagacgaacgagacgagtgaagttcacagagaatcgtacggtcacaaacgtagcagctacaccatctaacgggtctccgagactggtccgtatcactgttactgatcctttcgctactgactcgtctagcgacgacgacgacaacaacaacgtcacggtggttccaagagtgaaacgatacgtgaaggagattagattctgccaaggtgaatcttcttcctccaccgcggcgaggaaaggtaagcacaaggaggaggaaagcgtagtggttgaagatgacgtgtcgacgtcggtgaagcctaaaaagtacagaggcgtgagacagagaccttggggaaaattcgcggcggagattagagatccgtcgagccgtactcggatttggcttgggacttttgtcacggcggaggaagctgctatagcgtacgatagagccgcgattcatctcaaaggacctaaagcgctcacgaatttcctaactccgccgacgccaacgccggttatcgatctccaaacggtttccgcctgcgattacggtagagattctcggcagagccttcattcaccgacctctgttctaagattcaacgtcaacga

SEQ ID NO: 1012 - DNA, 656 bp, Arabidopsis thaliana
gcagcatggctctcgacactctcaattctcccacctccaccaccacaaccaccgctcctcctcctttcctccgttgcctcgacgaaaccgagcccgaaaacctcgaatcatggaccaaaagaaaacgtacaaaacgtcaccgtatagatcaaccaaaccctcctccttctgaagaagagtatctcgctctttgcctccttatgctcgctcgtggctcctccgatcatcactctccaccgtcggatcatcactctctttctccactgtccgatcatcagaaagattacaagtgttccgtctgtggcaaatctttcccgtcttaccaagcgttaggtggacacaaaacaagtcaccggaaaccggttagtgtcgatgttaataatagtaacggaaccgttactaataacggaaatattagtaacggtttagttggtcaaagtgggaagactcataactgctctatatgttttaagtcgtttccctctggtcaagcattgggtggtcacaaacgttgtcactatgatggtggtaacggtaacagtaacggtgacaatagccacaagtttgacctaaatttaccggctgatcaagttagtgatgagacaattggaaaaagtcaactctccggtgaagaaacaaagtcggtgttgtgataa

SEQ ID NO: 1013 - DNA, 548 bp, Arabidopsis thaliana
gcagcatgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttcttggaaaattactagtaa

SEQ ID NO: 1014 - DNA, 173 bp, Arabidopsis thaliana
ttattataaatccatcaagacaaatggatatctccctcgaaatcagaatcatagtccaacggaaccgacgggaacattcacatcatcccttcgatcatgtaatccagaaaaatagacatccccaacagcgcatcttcatccatataaaaagcatcactccgctgcttcccagt

SEQ ID NO: 1015 - DNA, 995 bp, Arabidopsis thaliana
gcagcatgaatcttgaccaagaactcgccgagatcagagctagcagttccgaccacaccaattacttctacagctcggagaggagagagcacatgttcgacaaagtgttgacaccaagtgacgtcggtaaactaaaccggctcgtgattccaaagcaacatgcagagaacttcttccctttagaggacaatcaaaacggcacagtgttggatttccaagacaaaaacggcaagatgtggaggtttcgttactcgtattggaacagtagccaatgctacgtgatgaccaaaggatggagccgtttcgtcaaggagaagaaactcttcgccggagacaccgtctctttctaccgtggctacatccctgacgataacgcacaaccggagagacgacggaaaataatgttcatcgattggaggcctagagccgagataaacttcgtacacaacattaacaatcataacttcgttttcgggtctccgacatatccaacggctaggttttatccggtgacgccggaatattccatgccataccggagttttccaccgttttatcagaaccaatttcaagaacgggaatatttagggtatggttatggtagagttgttaatggtaatggagtgcgttactacgcaggatcaccgttggatcaacatcatcagtggaatcttggtcgatctgagccgttggtttatgactcggttccagtttttccagcggggagggtacctccgtcggcgcctcctcagccgtcgacgacgaagaagctgaggctgtttggggttgacgtggaagagtcttcatcttcaggggatacacgtggcgaaatgggagtagcagggtactcttcctcgtctccggttgtgatcagagacgatgatcaatcattttggaggtcgccacgtggcgaaatggcatcgtcttcttcggctatgcagctaagtgatgatgaagaatataagaggaaagggaaatctttagagctttgataa

SEQ ID NO: 1016 - DNA, 1079 bp, Arabidopsis thaliana
gcagcatgatgatcggagaaactcgcaggacttatcccactgttgaaatacctccatggccggtacttgaagagcttacaacgtcggagtttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcccggagaaaaagctcgccggagagatccgaggaagtaccattactctggtacggcttgtcctgattttcgtaaaggtggctgcaagaaaggtgactcttgtgagtttgctcatggtgttttcgagtgttggcttcatccagctcgttaccgtactcagccgtgtaaagacggtggtaactgtctccggaaaatttgtttctttgctcattcaccggatcagcttaggtttttacatactcggagccctgacagagttgattcttttgacgtttcgtctccgattcgtgctagagcatttcagctgtcgatttctccggtttctggttcgccaccgatgagtccaagagctgactcggagtcttctccgatgactcagtcactgagtcgatctctcgggtcttgttcgataaacgacgtcgttccttcgtttaggaatttacagtttaattcggtaaaatcatttcctcgtaacaatcctttattcggattcgggtcgccccgtggatcgatcttgggtcctgggtttcagtctctgcctacaacaccgacccgaccagggaatctggatatttgggagtatggtttggaggaagaacccgtaatggagcgtgtcgttgagtcgggtcgtgagctacgagaaaagatgcgcgagaaactgcacaaggagaattgcatggatcgagttgcccaggatccggatcagaatttgggtgaggctcctgatgtcgggtgggtatctgaccagctcatgtaataa

SEQ ID NO: 1017 - DNA, 863 bp, Arabidopsis thaliana
gcagcatgaacaacaatcattcctatgatgatcgcagttttcacattccacttcatccttctaacacaagcaaccctaatccaaatctccagtttgctttatcttcaagctacgatcacagtcctaagaagaaacgcaccaaaaccgttgcttcatcctctagttcttcaccaaaatccgcgtcaaaaccaaaatacaccaaaaaaccagacccaaatgcccccaaaatcacacgtccatgtactgaatgtggcagaaagttttggtcttggaaggctctctttggtcacatgagatgtcaccctgagcgtcaatggcgtggcattaatcctcctcctaactaccgtgtgcccaccgcggcttcttcaaaacagttaaaccagatattaccaaattgggtctcatttatgtccgaggaagaccatgaagtcgcttcctgtctcttaatgctgtctaatggtacaccatcatcatcgagtattgaacggttcgagtgtggaggatgtaagaaagtgtttggatcacatcaggctttaggaggacacagagcgagtcataaaaacgttaaaggctgtttcgctatcacaaacgtaaccgatgatcctatgacggtttctacttctagtgggcatgatcatcagggaaaaatccttacgttttcagggcatcataagtgtaatatctgttttagagtgttctcgagtggtcaagctttaggaggtcacatgagatgtcattgggaaaaggaggaggagccgatgatcagtggtgctttggatttgaatgttcctccaacaatacaggatctttctacttcggacacatcagggtgttgtttagatcttaggttaggactctaataa

SEQ ID NO: 1018 - DNA, 640 bp, Arabidopsis thaliana
gcagcatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatc

SEQ ID NO: 1019 - DNA, 538 bp, Arabidopsis thaliana
tagcgtttgcgtgcagcggtttctctttgtgcgttaaagaagacggccgcgacagggagaccaagatcatactcgaccgcaaatttacgagtgttgaaatgatccctcgaagggatattaggaaagataacacgtctttgcttctgcctgaacagaacaaacacaaacctatgtatccctatgcttggccttggcaattcatagctcaccacctctttgccaaacgtagcatctgttgtgccgggaatgtttgtaacgatccagtgcaggtgttcttttagaaaggggtcactaggacctggaacatctgggtctgtcatcaccaaagtgaagaaggatctgagatcaccaccatggatctcaaccctaggcttggaggaaacagaagaaggaaagagctcatggccattggagacttgcttcttgttataactaacattcatcttagttgttggagtgaagaaatcaagaacatctcctaccactctccccattatcaatggctctatcactctagttcccatattctccatgctgc

SEQ ID NO: 1020 - DNA, 695 bp, Arabidopsis thaliana
gcagcatgtctatgtcgtctatgtcctccccttcctcagctgtttgttcaccggaccacttctctccttccgaccatctctgctatgtccaatgcaacttttgccaaaccatccttgcggttaatgttccttacacaagcttgttcaagaccgtaactgtccgatgtggttgctgtaccaatctcctttcggtgaacatgagatcatatgtcctcccagcttctaaccagctccagctccagctcggtcctcactcttacttcaatccccaggatattctggaggagctgagagatgcaccgtctaacatgaatatgatgatgatgaatcaacatcctactatgaatgacataccatctttcatggatcttcatcaacaacatgagattcctaaagcaccacccgttaaccgccctccagagaaaagacagagagtcccatccgcatataaccgattcatcaaggaggagatccaacgtatcaaagctggtaatcctgatataagccacagagaagcctttagtgctgctgccaagaattgggcccacttcccccacatacacttcgggctcgtgccagacaatcaacccgtgaagaaaaccaacatgccccaacaggagggagaggataacatggtgatgaaagaagggttctacgctcctgcagctgctaacgttggtgtgactccttattaa

SEQ ID NO: 1021 - DNA, 450 bp, Arabidopsis thaliana
gcagcatggccaagatgggcttgaaacccgacccggctactactaaccagacccacaataatgccaaggagattcgttacagaggcgttaggaagcgtccttggggccgttatgccgccgagatccgagatccgggcaagaaaacccgcgtctggcttggcactttcgatacggctgaagaggcggcgcgtgcttacgatacggcggcgcgtgattttcgtggtgctaaggctaagaccaatttcccaacttttctcgagctgagtgaccagaaggtccctaccggtttcgcgcgtagccctagccagagcagcacgctcgactgtgcttctcctccgacgttagttgtgccttcagcgacggctgggaatgttcccccgcagatcgagcttattctcggcggaggaggcggcggctcgtgttatcagatcccgatgtcgcgtcctgtct

SEQ ID NO: 1022 - DNA, 1028 bp, Arabidopsis thaliana
gcagcatgatgcatcagatgttgaataagaaagattcagctactcattccactttgccataccttaatactagcatctcttggggagtggttccaactgattccgttgctaatcgccgcggttctgctgaatcactaagcttgaaggttgattcaagacctgggcatatacaaactacaaagcaaatcagttttcaggaccaagattcatcttcaacacagtccactggtcaatcttatactgaagttgctagtagtggtgatgataatccttccagacaaatctccttttcggctaaatcaggatctgaaataactcaacggaaggggtttgcaagtaatcctaaacaaggctcgatgactggatttccgaatattcactttgctcctgcacaggctaatttctcatttcactatgctgatccacattatggtggtttattagctgcaacttacctaccacaggcaccaacatgcaatcctcaaatggtgagtatgattcctggtcgtgttcctttaccagcagagctcacagaaactgatccagtctttgtcaatgcgaagcaataccacgcaattatgaggaggagacagcaacgtgctaagcttgaggctcaaaacaaactaatcagagcccgtaagccctatcttcatgagtctcgacatgttcatgctcttaaaaggccaagaggatctggtggaagattcctaaacaccaaaaaacttcttcaagaatccgaacaggctgctgctagagaacaagaacaggacaagttaggccaacaggtaaacagaaagaccaacatgtctagattcgaagctcatatgctgcagaacaacaaagaccgcagctcaaccacttctggctcagacatcacctctgtttccgacggtgctgatatctttggacacactgaattccagttttcaggtttcccaactccgataaaccgagccatgcttgttcatggtcagtctaatgacatgcatggaggtggagacatgcaccatttctctgtccatatctga

SEQ ID NO: 1023 - DNA, 665 bp, Arabidopsis thaliana
gcagcatgatgaagagattaagtagttcagattcagtgggtggtctcatctctttatgtcctacaacttccacagatgagcagagtccgaggagatacggtgggagagagtttcagtcgatgcttgaaggatacgaggaagaagaagaagctatagtagaagaaagaggacacgtgggcttgtcggagaagaagagaaggttaagcattaaccaagttaaagctttggagaagaattttgagttagagaataagcttgagcctgagaggaaagttaagttagctcaagaacttggtcttcaacctcgtcaagttgctgtttggtttcaaaaccgtcgtgctcggtggaagacaaaacagcttgagaaagattacggtgttcttaaaacccagtacgattctctccgtcataactttgattccctccgccgtgacaatgaatctctccttcaagagattagtaaactgaaaacgaagcttaatggaggaggaggagaagaagaagaagaagagaacaacgcggcggtgacaacggagagtgatatttcggtcaaggaggaagaagtttcgttgccggagaagattacagaggcaccgtcgtctcctccacagcttcttgaacattctgatggtcttaattaccggagtttcacagatctacgtgat

SEQ ID NO: 1024 - DNA, 376 bp, Arabidopsis thaliana
gcagcatgtctgtagatttctcatctgagcgtgtttgctatgtccactgcagcttctgcaccacgattttagcggtaagtgtaccatacgcaagtttgttcacacttgtgacggtgagatgtggccattgtaccaatttgctatccctcaacattggagtttcacttcatcaaacctcagctcctcccattcaccaagatcttcagcctcatagacagcacacaacctctctggtgacaaggaaagattgtgcatcgtcttctaggagcaccaacaatttatcggaaaacattgatcgtgaggctcctagaatgcctcctattcgcccaccggagaaaagacaacgtgttccttcggcctacaacagattcatcaa

SEQ ID NO: 1025 - DNA, 298 bp, Arabidopsis thaliana
ttagtaatagccattagacttttggcctgcaactgactggtctaattgcttgcctttcttgttgccatccagctttaatccaaagtgaatgtgaggaaaatgtgcccaatttttagcagcagtgctaaatgcctcacggtggctaatctctggattgcaagccttaatccttaggatttcgtccttgatgaatctgtcgtatgccgtatgaacacgtggtctattctccggtgtgctaataggatgaatactaagatcctcaggatcaatgttgtccgatatatagtaggtgctccta

SEQ ID NO: 1026 - DNA, 641 bp, Arabidopsis thaliana
taggagccaaagtagttgaaaccttgagggaaagagtcagaaaccggaggcattctgctgaacattggactatgtacgtactcagacgagtagtcgtcaccggtccaggtccactgtggttggctataacacgaattcgacaagtcgctcgggagaggaggcagctcattactactgtcattagaatagcaataagaattcgaagattgagagccaccaaacatgtaactgtccacttgatcacaatgagggctgaagcattggcgagtcagtggatgagtattggttaaacatcatcatgtaatcgacaggatcattggtaggaggagcaggaggaggtggaggaggaggaggatcgtcaggagaaacaatggaggtgacggatgaggaaggaggcatgtctgagtgaacaaagttggttctggcacgtgtgccacgcatggaccgagcagctgtatggtaggccgaggcagcttcttccgccgtatcgaaagtgccaagccagtgacgctccttcgtagttgggtctctaatctcagctgcgtatcttccccaaggccttgttctcaccccaagaaaccttgtaccaacctgatcgtcttgcttcttcttgctctttgatgatgttgtgttcatgctgc

SEQ ID NO: 1027 - DNA, 325 bp, Arabidopsis thaliana
tcatccaaaatagttatcaatttcgtcaaacaagtcttgacgttcatagaccggcgtcacatcaacgacgtcgttttcatcctcgtgaagaaacctcgtaagttctttcatgaacgcagtgttttcaacacaagactcctccaacatcatgaaatcttcatcattcagaaatgtggagaacccgatagtatcctcatcatcaacgttgttattaccaacgaaattatcgcagtacattagaggattgttaacggaggaatcagagaacgtggacgaagaacacgtcagattaacgttaccatcaacgtcaaagttcgatgaaact

SEQ ID NO: 1028 - DNA, 649 bp, Arabidopsis thaliana
gcagcatggtgcggacaccgtgttgcaaagctgaactagggttaaagaaaggagcttggactcccgaggaagatcagaagcttctctcttaccttaaccgccacggtgaaggtggatggcgagctctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggccccacttgcttctactagtcacactactaatactacaactacaagtg

SEQ ID NO: 1029 - DNA, 566 bp, Arabidopsis thaliana
tcagttcggctgctgcatctgggaaaacaagtattcgtcgaacattgagattgagcaaggcaaggagctgctgctagaaccaaacctggtttggttggtgttgtcgttgtaagcagaagaatcaggtggtggtgcttcaaagaatccattcatatgatactctctctgattcattggaatatacacctgagcatgcggaagagtaagaggaagaggaggaggaggcaacgtttggtgatgattcatatcattgtgaagattgggattgtatgctgtgatattattattattagtgaactgctgctgcgagcttgtgtcctgtatcagctgtccggtgtttagttcatcaagaaagcttgtttcttgacccggaattgtcatttcaggagatttccctgttccaaagtagcctggatagctcccgaatgaagaactcgctgagcactcgacttccctctgcgggattgaattgtgttcctcggtgacaatgttggtggtgttgctattaagaatccatgacatagattgaagctgttgttctaaaggaatctgaatcccatcttgca

SEQ ID NO: 1030 - DNA, 597 bp, Arabidopsis thaliana
gcagcatgggaagggtaaaattgaagataaagaagttagagaacacaaatggacgccaatctacatttgctaaaaggaaaaatgggatcttgaaaaaggctaatgagctatctattctttgtgacattgatattgttcttcttatgttctctcctactggcaaggctgcaatatgttgcggtacacgaagtagcatggaagaggtgattgctaagttttctcaagtaacaccgcaggaaagaacgaaaaggaagttcgagagtcttgaaaacttgaagaaaactttccaaaagttggatcacgatgtaaatatacgcgaatttatagcctcaagtaattcaacagtagaggacttgagtactcaagcaaggattctgcaggctcggatttctgagatacatggaagattaagttattggacggaaccagataagattaacaatgttgaacacttgggacagctcgaaatttcgattaggcaatcccttgatcaattgcgtgcacacaaggaacattttgggcagcagcaacaggcaatgcaaatagaaaacgcaaactttgttaaggattggtcaacatgctcgatgcaagatggga

SEQ ID NO: 1031 - DNA, 255 bp, Arabidopsis thaliana
tactcaaccttaggtgttattactccacaatccctaaaaccaccattgccgccggattcgtataaacctccgacgacgaatccaccacttgttttctgcatttccgccatgtaactcctcacttcagcttttatcatctcctgcaccaccgtcataaactcacctctacgtccttctcctctctcctctacattaatcttcatctgactctcaaatctcggaaacatcaacgcgttgttgttattgttatggctc

SEQ ID NO: 1032 - DNA, 394 bp, Arabidopsis thaliana
ttaataactccataacgatacgtcgtcatcatcgccgtcgacttcatgattatgattccactgtacggacggaagcggcaaaagcatcccttctgccatattagccaacaaactcggcatctcaaacatcgcctcatcgtgcatataaaacgcattttcgctctgttccgccgtgtaaatagcctccaccaacgtctcctccatgtcgaagccatgatccgtcgtcgcatcacacatctcatcctgaaacgccaacgcagcttcagccgccgccttttggatgtccttagcgcaagttgattccgggattcggagtctccaagccgagtcagcgaaattgagacaggctgatcggccacgaagggctaaagcggcaacgtcgtgagctcgagct

SEQ ID NO: 1033 - DNA, 665 bp, Arabidopsis thaliana
gcagcatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgattctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataac

SEQ ID NO: 1034 - DNA, 656 bp, Arabidopsis thaliana
ttaatagctccataaggacacgtcatcatctccctcgacatcaaaattatagttccattgaaccgacggcgacggtaaaagcatcccttcggccatgttatccaacaaactagacatccccaacatcgcctcttcatccatataaaacgcatcttggctctgttccggcgtataaatagcctccaccaaggtctcctccatgtcaagaccatgagcatccgtcgtcatatgacacatctcatcttgaaaattcaacgcggcttcagccgccgccttttggatttccttggcacaggttgattccgggattcgtagccgccaagccgagtcagcgaaattgagacaggcagatctgccacggagagctatggcggcgacgtcgtgagcacgagctgccatctcagcggtttggaaagtcccgagccaaatcctcgttttcttgtttggctctctcaactcacacacccacttaccggagtttctttgacgaactcctctgtaaattgggtgacgagtctcacgaaacttcttccttcccgctggtttcttggggcagctcgtggcaagcttcggactgtaatcaccgcctgaggaaaccggagactcgtaatcggagccaaacatttcagaaaaggcagaaaatgagttcatgctgc

SEQ ID NO: 1035 - DNA, 192 bp, Arabidopsis thaliana
atccgtcgtcatatgacacatctcatcctgaaaatccaacgcggcttcagccgccgccttttggatgtccttggcacaagttgattccgggattcggagtcgccaagccgagtcagcgaaattgagacaggctgatctgccacgaagggctatggcggcgacgtcgtgagcacgagctgccatctcagcggt

SEQ ID NO: 1036 - DNA, 169 bp, Arabidopsis thaliana
gcagcatgaactcattttctgccttttctgaaatgtttggctccgattacgagtctccggtttcctcaggcggtgattatattccgaagcttgccaccagctgccccaagaaaccggcgggtcggaagaagtttcgtgagactcgtcacccaatatacagaggagttcg

SEQ ID NO: 1037 - DNA, 773 bp, Arabidopsis thaliana
tcaagcggcgtaacagccaaggtaattgtaaatgggttcaagagtcagatccagattgttcctcctcatcgccgtttggtcttcttcttggtacaaaccacccatatttaggaaaggagaagtctgatgagcgatcatgtaaagatgggggtgttgaaatggttgtggctgtggtacatcgtcgacgctgcggttcagctgctcacattgggtttgttttgtccttaggatgttttccctctcctttatctgtttggtaagcatgctgttttcctcctgtatctccttctcctttctttggaggtggttgagggactcattcatgagttgattttttctggagcgaatgtgcttaagagcagtctcaagctgctgctccagattttggagatccttgaggctcattggttccaactcttctcccagataatgcctttggtttctctccaaaagctcaatcttggccttaagcctgctatactccattgaccagttcgtctgtgcattaacgtgagagtcaggtgcaatcagctgtctctcggcgtaagaatacctctcgtagcgttctagtaccttctccatgcaagattcagaggagtactcgaacaatttgcccttatgggagaagacaataagggaaacctcggcatcacaaagaacagagatctcctgagctttcttcaaaagaccagttcttcttttcgagaatgtcacttgtctattgatcttgttctctatcctcttcaattcaaccctaccccttcccatgctgc

SEQ ID NO: 1038 - DNA, 1109 bp, Arabidopsis thaliana
ttagctcaaagcccttaaatcttgtctcaccatctgacttgatacaccattgtttaccattccactaaatttcgagtgagcatactcacgacgaaactgatcatcagccttcaaactctgttcagcttccttcccactcctaatccaagcagtattgttcaggtcatttgatatagagatcaattctttatctaactctgcagaagaatgttcctcataatccacaaactctgatcccagcaccgacgatgatgacagtgttgtgctgtcttgatggttgcagcaaccgtgaccgcattttgaagggataataggatcataacaaagagactgaagaaatttaccagccaatgagtcaggtcttgatgcttgaaccaaaggtccctcacatggagccatgtatcctggtttacagacactgaaagcacccattcgagccactggacgataaacaccagttttactattttgctcccgaggaggctcctttgcttcatcatccattttatcatcacttaatacaccggtttcttcttcttgaggtagatgttctttgggggatgcgtttgatatccttctgaccattgatggatacagttgatatactatctctgtattagacatcaatagaggaatcttccattgttctgctggtttacgtctaagattagagttccaatgattcttaatggcattatctgttctcccaggtaagagtttagcaatcacagaccatttgttcccaagaaccgcctgtgcagacattatcatatgctcctcctcatcagagaaaggttttcgtttgaggataggatcgagctgattacaccaacgtaatcggcaagatttaccagagcgacctgggattccacgggagattagattccagttcctcggcccacacattttcacaagcctcgtgagagcctcatcttgctccggcaaccaaggtcctttcactttactctttccgccgccgttcgcgtcgcttttcgctagctcggcgagctctgcctcaactgctttgtgtattgcattttcaaaactcttgcaaggattccgggacgatattagctccggcggacgagagatttctccgttcatgctgc

SEQ ID NO: 1039 - DNA, 508 bp, Arabidopsis thaliana
ttattgaccatctaaagtgacgaaagcatccttaagaagtccttgtgcttcttctctcctcctcttaatgtcttccacagcttgtttcctctgttgaatttgaagttccataatgtgaataagcgttgctctcgcttggtgaggcctcaaggaattgagaaggtgatgcaagttcttgaagattgaagaaatttcaccaattctcttcgcatattgagaaggtctgtcaacaagaacatcagcaagctccaatatatgtaactgtagttctctattcagtgacctgagttccttcttgtaatcaagattagaatcttttggataaagttgaggcactccttgttcttctaagcttggaagaacatcttcagtagtatagttgcctccaaaacagacgtaggtgccttcaatcggaggaggaggtccaggagcagaatcattgtttcctgagaaatccttgtacagtctgtaatatggaggaggaggtggatatgtagctgtaggctgc

SEQ ID NO: 1040 - DNA, 165 bp, Arabidopsis thaliana
ggtacctgcagcctacaactacatatacacctcctcctccatattacagactggatcaggatgtctcagacaacactgatcctgctcctgaacctcctcctccgatggaaggcacctacgtctgttttgcaggccactatactactgaagatgtccttccaagct

SEQ ID NO: 1041 - DNA, 302 bp, Arabidopsis thaliana
gcagcatggccaagatgggcttgaaacccgacccggctactactaaccagacccacaataatgccaaggagattcgttacagaggcgttaggaagcgtccttggggccgttatgccgccgagatccgagatccgggcaagaaaacccgcgtctggcttggccctttcgatacggctgaagaggcggtgcgtgcttacgatacggcggcgcgtgattttcgtggtgctaaggccaagaccaatttcccaacttttctcgatctgagtgaccacaaggtccctaccggttccgcgcgtagccct

SEQ ID NO: 1042 - DNA, 1015 bp, Arabidopsis thaliana
taaattgtatcagaagaagagttttgtgtggcgtcaagatcgtccttatggttagaaatgggaaagtggtaatcatcccatagagggcttccaggtccccattcctctggaattgcattgaaccatgcctcagcccaacccgtctcctcactcacccctcctactgccaatgccgtgctcgaatcatcctctcctcttctgcttgagtcttcactagtagtccccgtctcacattgtttctgatgcacgggagttggctcttgtttattgagaaaaagttcagggaaattgagcctagcggtctctcccctcaacttgaaggcctcgcggtcgtaggccatggcggcttcttctgctgtatcgaatgtccctacccagagacgtgtcctgtttcgtggcttacggatctcggcaacccattttccccagtggcgttgcctgacacctctatatagcttggtggcgctgaagggttgaaccggtggcctcgtcagtggcagatcgctttcttgtcttaacatgttcatcatcatcattcttccgctcggactcagcttcagaatgtctctccagtactgcaatagatgttgttgttgttgctgctgttgtgcaacatatggttgcacctgttgttgaggatcaaacgagatcatttgttgctgtctttgtcctgaagggtcattcgggtgtaaaaatcgttgttgattttgaatcgctggagggaggtaaaagggaaaagagacagagcatgtagttgttgttggcggctgaggagtagcataagaagatacgagatagggattatgtcggtcaaaggttctagtcttcctaagacttcttggaaacgtagaggaagcatctcctaaccacatgtccgagccaggacccgaatctttatacttgccgctactaaactggaactcctcctccaactccatctcatcctttttctctgcttcactggtaccaaggaccctgattgattttcccttgttcttagcagtagccatgctgc

SEQ ID NO: 1043 - DNA, 647 bp, Arabidopsis thaliana
ttagtaactccaaagcgacacgtcaccatctccttcgccgtcataattatgattccattgaacagacggcggcggtaaaggcatgccttcagccatattatccaacgaagtcggcatcccaaacattgtctcctcatccatataaaacgcaccttcgctctgttccggtgtataaatagcttccaccatcgtctcctccatgtccaggccatgattcgtggtcgtcgtatcacacgtctcatcttgaaaagccaacgccgcttcagcagccgctttttggatatccttggcgcatgttgactccgggattcgtagccgccgagccgagtcagcgaagttgagacatgctgatcggccacggagggctaatgcagcgacgtcgtgagcacgagctgccatctcagcggtttggaaagtcccgagccaaatcctggttttcttgtttggctctctcacttcagaaacccacttaccggagtttctttgacgaactcctctgtaaattgggtgacgagtctcacgaaacttcttacggcccgccggtttcttcggacaactcgtggccaacgtcggacaataatctccgccttgaggctcgtaatcggagccaaacatttcagaaaaagctgaaaatgagttcatgctgc

SEQ ID NO: 1044 - DNA, 842 bp, Arabidopsis thaliana
ttaagtggaagaactctcatcattaagcagcaaatccaaactgctaaagtcactaatttcccacaggctcatcatattgttctctataatgttgtccacaccattattattatcattattactattaccatagtcggaccactcgaactccgggaactgcaaatccttcaagaaactcgaatcattagaagaatgcgaagatgtggacgtggatgaagacattgttgaattgctgcagataaggtctaaagactctgtttcaataagagggacatcttcgacaccatactcaagatttatctccatgaattgatcatcacctaaagactcttcaagtcttgatatgttcttgatgttgttctctaaaggacgctccattgtttcttgaaaaggaactgtattattctgtagcttctttaagggttctccgtcttctttttcgacgatagagagtggtttatgtgtaagaggatcaatccccattttcctcaacttcttcttgatgtgagtgttccaatgattcttgatttcgttgtctgttcttcctggtaaatgagaagctatctttgaccacctgtttccaagctgggaatggagatcaatgaccatcttctcttcgtaatcagagagaagacctctcttaaggtctggtctaagatagttagtccaacgaagtctgcaactcttgccacacctaagaagaccagaaagcttaggaacagctctccaacaacattgtccattggtaaggatgaagtttatgagcttcctatcctcttctgcagtccatggtcctttcttcaaccctactttgtcacagcatggttgtctccccatgctgc

SEQ ID NO: 1045 - DNA, 976 bp, Arabidopsis thaliana
tcgaagaaattagtgttttcatccaatagaatatcaccaatctgtccaccagaatcctcaaacaaccacttctcaaacaaagaccattgactttggttactgcagcatccagttatgtctggtttggtctcatgatcaggtgaaacaccagcctgttgatatgagtgatcaaactcagaaaatgactgaaatgcccctgcacactccttcccatcatcactcttgatcacttcttttacctctgtagaagcgatttgatccgcggagttttgagtcttcggcgagtttttcacccaccctttgagcaatttcgcgatattttcggtgcttgaggcataagttgtagatgtttcttgcgtcctaagaaacccgctagctgaggaagtagagcgtcttgattcagcagaggaagacgttgttgtcactgtagatgtaatgattggtgcaacggcaggagataaagcctcagagagagcctttttcgccaagtggatatcggtttgaagtcgcctttcccattggcctcttgagatgtttgagttggaattagcagaagaagacgatggtgaagatgagagcgaggaacggtcaagttcttgatgagaatcttgattgactttgttgagtttcttcttcaaatgagtgttccaatagttcttaatgtcattgtctgtcctttgtggaagatatgacgcaattgcagcccatctatttcctaagagggcttggagatgaacaatcatcttttcttcatgttctgtgaaattgcctcttttgattcctggccttaaatagtttgtccatctaagtctacaactcttgctgcatctaagcagcccagtattggtaggaacagctctccaattaccaggaccatgttcttggatgtaagtgactaaaatgatatcttcttcaggagtccatggccctttcttcactcctcctttgtcacaacaaggaggcctcaccatgctgc

SEQ ID NO: 1046 - DNA, 526 bp, Arabidopsis thaliana
gcagcatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggaaggtgttttgtactgtaagcctcattttgagcagctctttaaggagagtggtagtttcaacaagaactttcagtcacctgcaaaatcggctgacaaatcaactcctgagctgacaaggacgcctagccgagttgctggcaggttctctggtacacaagagaaatgcgccacttgtagtaaaactgtgtatcctattgaaaaggtaacagtcgagagccagacatatcacaagtcctgcttcaagtgctcacatggaggttgcccaatttcaccttccaactacgcagctcttgaaggaatcctgtactgcaagcaccatttcgctcagctcttcaaggagaagggaagttacaaccacttaaa

SEQ ID NO: 1047 - DNA, 715 bp, Arabidopsis thaliana
tcaacttctgttcttcacttttctaatgcccttggagcaagtccgattgcttccgatcccttcattattcgtatacgtttgcatgaatcaacaaacatctcccacggtacgtctcctacaagcatccagtcgccatctttatcttcatatgttggaacataatctgatccgtttagaagatcgatcaatttactctcattcatgaaatctttcattccttgtggtccatagttgcctatggtaaaagagctaaacattttgcttaaggcgttggagagatcttggtaagttttgtagagtttcaagtcaattttccgtaggtacggtgcaccgtccatgctaaccttcacataagccacggtggcacatgcggaggcggatgaggtggctccactgctgccagaagtcttatcgtttccttcggtggcatctccggtggtcggtttttggccggacatgacgttcttgcggaaagatcgtaccggtggccatcccacaacttgtgccttggctggtggttttacgaccttctccttcatattctctaaatcgactttggaaactgaatccatagccgtcgatgaaagattcagtttgagatcaacagtctcagaaaatcctcttttaccattattttttccagccatttctcctccgtgattcccacccggtagccctaatctcagctccgtggcctcaaaattaatcatgctgc

SEQ ID NO: 1048 - DNA, 627 bp, Arabidopsis thaliana
gcagcatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctt

SEQ ID NO: 1049 - DNA, 551 bp, Arabidopsis thaliana
tcacttcttctcaccgaatcccaagccatggatcatgttgtggcctccggaagtaatggaagtaggagagttgggtatgtacttagcccaatttttggcagcagcactgaaagcttcacggtgtggtatttccggattggcacttttgatgcgttggatctcatccctcatgaagcggttgtatgcagatgggagcctctgcttcttctcaggaggtttgacgacaaagggaggtgagggagatgggggctggtcgctggaggtggaggaagaggaagaagaagagcttcccttcttatagtcacttccaccaaagctctgcatctgaagggtgaggctaacatggccttgaagaggaggagttgtggtgagaaacgagaggttaccacaatggccgcatttcaccgttaccgtgtcaagcattctcttcaatggtatcccaaccgcgaggatggtgttgcagatgctacaccggacgtagtagagatgttcggcttgaggggaagcccttgaagccgtcatggttggtttctcttctaggttcatgctgc

SEQ ID NO: 1050 - DNA, 99 bp, Arabidopsis thaliana
tcatatgaactacttgtcgacataatcttggttcgcgtcataatcgagatcatgatgcccatggacataatgagaccaaccaatcatgtcttgcatcat

SEQ ID NO: 1051 - DNA, 80 bp, Arabidopsis thaliana
tcatatgaactacttgtcgtcataatcttggctcgcgtcataatcgaaatcagaatggtcatggacataattagaccaac

SEQ ID NO: 1052 - DNA, 497 bp, Arabidopsis thaliana
gcagcatgtcaagaaagccatgttgtgtgggagaaggactgaagaaaggagcatggactgccgaagaagacaagaaactcatctcttacattcatgaacacggtgaaggaggctggcgtgacattccccaaaaagctggactaaaacgatgtggaaagagttgtagattgcgatgggctaactatttgaaacctgacatcaagagaggagagtttagctatgaggaggaacagattatcatcatgctacacgcttctcgcggcaacaagtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggatataaccagcagtgac

SEQ ID NO: 1053 - DNA, 103 bp, Arabidopsis thaliana
tatagccacccccaaaaagccactgatacaccgagatgatcgcgctatattgaagagcagatcacgagaacgttccccaaatagctccgatcatcggcatgat

SEQ ID NO: 1054 - DNA, 458 bp, Arabidopsis thaliana
gagcatgatgaacagattaagtagttcagattcagcgggtggtcgcgtctctttatgtcctacaacttccacagatgaccagagtccgaggagatacggtgggagagagtttcagtcgatgcttgaaggatacgaggaacaagaagaagctatagtataagaaagaggacacgtgggcttgtcggagaagaagagaaggttaagcattaaccaagttaaagctttggagaagaattttgagttagagaataagcttgagcctgagaggaaagttaagttagctcaagaacttggtcttcaacctcgtcaagttggtgtttggtttcaaaaccgtcgtgctcggtggaagacaaaacagcttgagaaagattacggtgttcttaaaacccagtacgattctctccgtcataactttgattccctccgccgcgacaatgaatctctccttcaagagatta

SEQ ID NO: 1055 - DNA, 604 bp, Arabidopsis thaliana
taattgagcagcgggagagtctccggtattttgttgccggagctacttcccggaaacattcctctctcatcatctgttgccagcaacgtattctttcccatctggctagccagaacctggttctcttctctcagcaatttctccttttctttaagggactcgatatactccatcatcagttctgccttcctagctctacttacggacagagcagtctcaagttgttcctccagagaaattagagaatctacacttacattatcgacatttggttcttcaagcttgctttggactgtttctagtaactccttgtgtggaagataattctgaattttttcttcaagatctaaggctctaagttcatcagcatgttgtatttcataacgatcaatgatcttggaaatgtcgtcaccggaggaagagtcatagagttttccggaggcagatacgacgacaacagcgacggaggattcacagagaatcgaaagttgtcgagctttgtcgatgagaccattgcgtcgtttggagaaagtgacttgtcgactgcttttgttctcgattcgcttgatctcgatttttcttcttcccatgctgcagttaatta

SEQ ID NO: 1056 - DNA, 502 bp, Arabidopsis thaliana
gcagcatgaatagggaaaagttgatgaagatggctaataccgtccgcactggcggaaagggtactgtcagaacaaagaaaaaggctgtgcacaagaccaatacaactgatgacaagaggcttcaaagcactcttaagagaattggagttaactccattcccgctattgaagaagttaacatctttaaggatgatgttgtcattcagttcatcaaccctaaggttcaagcttcaattgctgcaaacacatgggttgttagcggttctcctcagaccaaaaaattgcaagatatccttcctcagatcatcagccaacttggaccagacaacatggacaacctgaacaagctagcagaacagttccagaaacaggcttctggtgaaggtaatgccgcctcagcaaccatacaagaagaggatgatgacgatgtcccagagcttgttggagagacattcgaaactgctgctgaagagaaaacaccagctgctgctgcttcttctta

SEQ ID NO: 1057 - DNA, 761 bp, Arabidopsis thaliana
tcagagcatccatcctggaatgtaaccgtttccctgctgcgcctgagcttgggttgtcgcagttatttgctctgagcataccggattatcataccccatttgcagagttggattgcattcaagaggctggtatagtccctgagactgagcttgatgatgcgcgtaggtaacattctgttcaccaccttcccatcctcctcctcctcccatatgatgacttctcacaccaatcatatcatccagcttcattgccaaagctctattggtttcaagcaacatttgctctttattttgaagatccgagagctggtcaagcatgtactgtgtcttgatggaccgaacttgcttgagagagccgtccagttgacgctcaagctgctctaactcctttgaattcaaaggtcctaaatcctccccaagaagatttctctgttgacgttgaaggttctcatatctacccttaaggttcagatattctctgtagctgttctcaagttctttggcaggtttgttgttgacttcaatggatccatagctgcatttctggtaccgatcaagtgtcttgagcatgtttgaggagctgcaaaactcatagagctttccacggttggagaagatgatgagagcaacttcagcatcacagagaacagacaattcataagctttgttcaacaaaccgttcgtacgctttgcaaacgttacttgtctgttgattttgttctgtatcctcttcagctgtactgttcctcttcccatgctgc

SEQ ID NO: 1058 - DNA, 607 bp, Arabidopsis thaliana
tattgctgtatctttctgaattccgagagcacggggtatatattctcaaaggctttgtaggtctcatctctcatcttggctcctgttattacgatcttcccagagacaaagattagaaggacgatttttgggactttcatcctataaatcagccctgggaagagctcgggctcataacttgagaaagcagcgtgagagtaagcaagaccttcaagtcttatagggaatttgacatcacaagaacctacaatattctgaatcttgaaatccttgaattttgcagggaatcccaatttctgcacaatcctagcatactttctagcagccatcttcgaaaagtcctcgctcttagctccagtacagaccattttccctgaggcgaatattaatgctgtagtcttcggttctctgatcctcattatcaccgcagcaaaacgcttgggattatattcagcattccgagcctgcaaagctatggctttaagatctagcttgcagtctaagttcaccgtggagacaatgttttgaagagtaggaacaatccctgaaggatgcttgctaagatcaactggattactcccttccaatccttgatcagtcatgctgc

SEQ ID NO: 1059 - DNA, 486 bp, Arabidopsis thaliana
tcaagaaggttcatgagaggaggttggaagccatttgtctgcagccaattttgatgaggagtagaagtagaattaaaaatctgattgtgatgatgaggagagaatcctgatgatgctgcagcatttgtcaacacttggttcgtcgaggcccgaccatcaaaccggtggttctcagccgccggaaacagtgagaatccgcctccgctaccaatgttgctgctgcccggaaattggtggtttgaattgggagtatggttaagcattccggtttgacctaatccaagaacttcattagagtggagagaatcttgttgttgttggttcatcctgagccgcatatcttgacttttatgtttcgaattagccgaatttcccaagctcaaatcgaggttgtgatcttgtggagtagtaggattccctgatgactcggcattgagttcctcatcgtaaatactcggatcaaagttggtcacggcgtctttgccg

SEQ ID NO: 1060 - DNA, 378 bp, Arabidopsis thaliana
gcagcatgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctaaccaccggatcgtccgcgggtaaagctaccaacgttgccgctgccgtactggagccggcacagccgttgaaaaaagagtcggcgtgga

SEQ ID NO: 1061 - DNA, 442 bp, Arabidopsis thaliana
gcagcatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagacaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataaaacttctggcagcagtggagccacctcatccgcctccgtatgtgccaccgtggcttatgtgaatgttaccatggccggtgcaccgtacctacggaaaattgacttgaaactctacaaaacttaccaagatctctc

SEQ ID NO: 1062 - DNA, 168 bp, Arabidopsis thaliana
gcagcatgactgatcaaggatcgcaagggagtaatccagttgatcttaacaaggatccttcagggattgttcctactcttcaaaacattgtctccacggtgaactgatactgcaagctacatcttaaagccatagctttgcaggctcggaatgctgaatataatccca

SEQ ID NO: 1063 - DNA, 745 bp, Arabidopsis thaliana
taatgagttctaacatcagaaacccgacaattccgacacgactcattacgaaacaacccaatccgacaacacaaacacaccgcatcactctcatgagctccaaacaactcggaaccccaccgtcgagtcgactcagccgagtcaacaacactcactttccgagtcgactcgtaccgataactcggtccaacagagagttccaaattcaacacccaatcttcctcgttcccataatccttctccgacgtcgttccactactctcacaattattaaccataccaatctcttcacgcaccggttccggtttaaccggtccagagaaatcaagatgtatagtctcaacgacatcgttttgaagagacgacggagacacgacggattcgttgatcagacggtgagagtttggatcaatcccacggctgagaagcttcctcttgatatgagtgttccaatagttcttgatctcgttatctgttcttcctggtaatctcccagctattaaagaccatttgttaccgagcaagctatggagcttgatgatgagttcatcttcttcttcagtaaaattgcctcttttgagatctggtcttagataattcatccatctcaatgtacaactcttaccacatctttgtaatccagcggcgcgagggagagatcgccagcaaccttcaccgtgtttacggatgtaatcaacaagaagctgatcttcttctttagtccaagctcctttgttcatgctgc

SEQ ID NO: 1064 - DNA, 701 bp, Arabidopsis thaliana
ttactcaaatggagattttccccaaatggaatgcctctgagcctttctctctcggaacccattattgctttcttcatggtcctcaaaaacattgcatggtagtatcgcattgttatcttcctcacaaaaacattgatctgaagcagctctcttgttgtgagctggaggaaaatgggcccaatttttggcagctaagctgaaagcttccttgtgagccatgcttggattctgagcctttaacctcctgatctcttccttgatgaagcaattgtaagctgaaggagctctttgtcgcttctcaggtggtttattgacaacttggtaaacacgagacacatcttcatcttcattgtctgaagatgaaaccaaagtcgttggactgttctccttctcctgattcaccttccatgcttcttcttccacaccatctgtagctgcaacctcctctttcccggtctcatcaagatgggagagagaagcaaggagatggagaggaatgaaggaagccttcatcaaattgacagagagaaggcttgtgcaatgcccacatctcacagtcaccaccattgacaagcttgtaaacggtacactcaccagcaaaatagtggtgcaaaaaccacactggacatggcaaatctgccccggcagatcaaatagatggttgagtgttgtcgtcatgttggggagctttgtcatgctgc

SEQ ID NO: 1065 - DNA, 323 bp, Arabidopsis thaliana
gcagcatggattattcttcgatgcatcagaatgtgatgggagtatcttcatgttcaacacaagattatcaaaaccagaagaaaccattgtcggcgactaggccagctccaccacagcaatcattaacatgccctcgctgtgactccaccaacacaaagttctggtactacaacaactacagtctctctcaacctcgctacttctgcaaatcttgtaggagatactggaccaagggtggaatcctaagaaacatcccaatcggtggtgcttaccggaaacacaaacgctcctcctccgcaaccaaaagcctcagaacaacccct

SEQ ID NO: 1066 - DNA, 578 bp, Arabidopsis thaliana
ttaagcagcgacgactttgtccttggcggcattctctcctcctccttcgagctggctcaagtttcctttctccttgatcagctgaatatgatgatgcttgcaatatagcttaccctcgtgagctatgtaattcgaagggcttatcgtgcagcctccatgtgtacacttgaagcagctcttgtggtacaatgttccattcaccgataccttctcaattggatacacggttttgtcgcaaccaacgcatttctctcgtgttccaccaaacatattcgaaactttggttccagcaggtctctctccctccaaaggcctatcaggtttcccaatctttggtgtcccttcgaagcttttctcaagacttccagttctcttgaagttttgatcgaaatgtggtctgcagtagagaactccttcaaaggagttgtaattgctaagcttgagagttcctttgcaatggtgacatcggaaacaagctttgtggtagacccggttatcggcggttaacttgtcgacaagataaactgttttgtcacatgccatgcatttctgggttgttcctgcgaacgccatgctgc

SEQ ID NO: 1067 - DNA, 393 bp, Arabidopsis thaliana
tcaccatgaagatcctcctgtattactgaacatcccattccaatatgtattattaccatgactcttctcttgggttgtgcttgaaagctctttcatgtctgaaaaagggaacaaaaccctacttgctccattcatgtcatcattgttatcttgagctctttgattactgttgatggtgttatgtccaatcccttgatgatgatcaatggagaatgaaaggttgttattactctgtttgtaatcaggcattgttggaaaccctaaagatgagtacaggactgagtttgaatccatcatttgaccaggcaagaacgtgttcatgcctcttgaagagactccattggatcttagaagctcaagagcatgatgatgatgatcttgcatgaccgggaa

SEQ ID NO: 1068 - DNA, 172 bp, Arabidopsis thaliana
gcagcatggaaactacaaagttgaggccacaagagaaagtaaattgtccaggatgcaactcaacaaacacaaagtcctgtcatcacaacaactacagtctcacgcaaccaagatacttctgcaaaggttgtcgaaggtattggaccgaacgtggctctcttcgtaacgtccc

SEQ ID NO: 1069 - DNA, 709 bp, Arabidopsis thaliana
taggaaagttgtagccctagtctgattgatttttctctaggagctggttgtagttgtatgagttgaagttgcggtggtgcatatgttgtggttccattgcttattggatctacacttgaattgccttcaatcgcatttgttcttccatgaaccttcttttgcaatttaatattttccttacgcattatatctacaatattttgtagctcgtgattctctttttggatgatttgtcccttacgattaagttctctgatttcatttgtcataagttgatcctttttgagacgaacaccttttagacttgttactagctggtcttcaaggttttgtaggtcgttagcattcattccagaaagttcctctcccactagtttcctgtggcattcttgtagatattggagctgctgctgcaaacttgcaacctctctttgccaaaactttatctctgaggcatgattcagaagttgatgctgctcctcttttactctgttgtaccgctcaatgattgttttcatacttgaattgcttgcgtagtcgtagagctttccggtgctagagaatatgataacaccaacttctgcatcacaaaggatcgataactctttagctttcttaagcaaaccactccttctcttggagaaagtcacttgtctacttgtagagttatcgatccttcgtataactatcttccctctccccatgctgc

SEQ ID NO: 1070 - DNA, 61 bp, Arabidopsis thaliana
ttaataggacgatgatggtgcaatcaattacttggcctcggtgacgacatgggcatgctgc

SEQ ID NO: 1071 - DNA, 148 bp, Arabidopsis thaliana
gagctaactgcagcatgtctagtaataatgtaatgtctttcatccctccaaatttgatgatccaaacctctcacgactatgatcatcctcatcaatctccatctcttgttcctcttcttccttcttgctccctacctcaatatctcca

SEQ ID NO: 1072 - DNA, 324 bp, Arabidopsis thaliana
tcaattcttctccattctgttcatagctaagtcagtccacgtgtcatcactcctccgtaccgaacccaaacccaaatccatacctggtaaccaacgcgacccggactcgtaaacaagcccacccatctgcatattcgacgccaacaacgaactaaaactcgcaccattcggatctccaactggtaacccgtataacatccgggtcggattcatttcttgacccgaaactctctcttctttttcttctgacccggacccatgatgatcaggtttctcagcgacggtttggttcttgagattactagacggagaagaaccggatcg

SEQ ID NO: 1073 - DNA, 278 bp, Arabidopsis thaliana
gcagcatgtcttatacaggaactcaacagaaatgtaatgattgtgagaagattgttaatgctgttaaacttctctctgctgatggaccttggatatcacaagtcttgcttcaaatgcactcactgccaaagcatgcttcatgtgactacttactcatcaatggaacgtgttccgtactgtaaggctcattttgaccacctctttaaagaaagtggtattctcaacaaaaacttccagtcacctgcaaaatcggctgacaaatcaactcctgagctgac

SEQ ID NO: 1074 - DNA, 340 bp, Arabidopsis thaliana
gcagcatggggagacaaccatgctgtgacaaagtacggttgaagaaaggaccatggaccgcagaagaggatacgaatctcataaacttcatccttaccaatggacaatgttggtggagagctgttcctaagctttctggtcttcttacgtgtggcaagagttgcacacttcgttggactaactatcttagaccagatcttaagagaggtcttctctctgattacgaagagaagatggtcattgatctccattcccagtttggaaacaggtggtcaaagatagcttctcatttaccaggaagaacagacaacgaaatcaagaatcattggaacactcacat

SEQ ID NO: 1075 - DNA, 226 bp, Arabidopsis thaliana
gctacaataaagcaacactattaatgtatttgacagtacagatccaaatctctctggctgaatcaatctgatcaacatgaccatgaccatgaccactgccttctgccatgtgcatctgacaagggaatcgccataagaacctgtctggatcacttgtcgccatctgctccatatcgcctccaccatttccaaacgcatatcccgtgttctccatctgatggctcgt

SEQ ID NO: 1076 - DNA, 80 bp, Arabidopsis thaliana
gaggttaactgcagcatggattattcttcaatgcatcagaatgtgatgggagtatcttcatgtgcaccacaagattatca

SEQ ID NO: 1077 - DNA, 464 bp, Arabidopsis thaliana
gcagcatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctg

SEQ ID NO: 1078 - DNA, 449 bp, Arabidopsis thaliana
taataagccatgtcttgcacaccagtctcagccatcttctccaaatcttcttgtgtcaacagagttttccttcccattgtacccgccttatcatacggttgagccattttccgaagaaactctcgagcaatgtgaatagccatatcagtgcttagattcaagtgtgcatcacgcagatgcgaaagtatccaaccaggtagtttggaccgcttatcatgacggctgtatcttttgtctgcaaatatcatcatcccataatcagcctttgaccggattactcgccctacacattgagctgcttgcctcaaggcatcaaaagttaggaaatcgccttcttttatttgaaatgtatcgcgcaaatactccaatcttgctcgtaatatcttgcttaatgtatactgtaatggtactccgtacattacaaccagtcttccataatgacgatcaaa

SEQ ID NO: 1079 - DNA, 253 bp, Arabidopsis thaliana
gcagcatgatctttacaatcgaagacgtaactgtctacttcccttatgacaacatatatccagaacaatatgaatacatggttgaattgaagcgagccctagacgctaagggacattgtcttctcgagatgcctaccggaactggtaaaaccattgctcttctctctctaatcaccagctatcgactctctcgtcctgattctccgatcaagcttgtttactgtactcgtactgtccactagatggagaaaac

SEQ ID NO: 1080 - DNA, 559 bp, Arabidopsis thaliana
gcagcatgatgaagagattaagtagttcagattcagtgggtggtctcatctctttatgtcctacaacttccacagatgagcagagtccgaggagatacggtgggagagagtttcagtcgatgcttgaagggtacgaggaagaagaagaagctatagtagaaaaaagagggcacgtgggcttggcggaaaagaagaaaagggtaagcattaaccaagttaaagctttggagaagaattttgggttagagaataagcttgagcctgagaggaaagttaagttagctcaagaacttggtcttcaacctcgtcaagttggtggttggtttcaaaaccggcgtgctcggtggaagacaaaacagcttgagaaagattacggtgttcttaaaacccagtacgattctctccggcataactttgattccctccggcgtgacaatgaatctctccttcaagagattagtaaactggaaacgaagcttaatggaggaggaggagaagaagaagaagaagagaacaacgcggcggtgacaacggagagtgatatttcggtcaaggagga

SEQ ID NO: 1081 - DNA, 744 bp, Arabidopsis thaliana
taaaggcgaccactaccatgttcaaaacttagaggaagctgatcaatagcaaaagaagacatcttactttcatctgcatccatgttccatatagattccaaggaactttcccatgttggagaagccagaggagggaaattcaagtaacagctttgctctgagtagtagttgtcttttaccggtttaataacgtttgctccagactgattaatctctctccatatgtcatccatggagtagtacccgtcttcgcattcttgattcattttcccgttggagcctccagtgtcttgactagtagtagtggtcatagatgatgagcaacagttcgaagatgaggaagtaggagacataggtcgcttcttctcttgagccttcttcctcatatgagtcctccagtagttctttatctcattatctgttctccccggtaatttccgggcaatttttgaccacctgtttccccatttggcgtgaagctcaaggactaaacgctcttcttgtggagtcatcttaccacgtttgagaccaggatgcaggtaattaacccaccttaacctgcaactctttcctgttctgtttaaacctattcttatgtttctccctccaccttcaaacctgaaactttcgctacaaaatcccatcttcgatctccgaacaagtggacaaagttgaccaagaggatgtcctcctgttctgtccacggtcctttacggtattcttcttgcacaagtttcatgctgc

SEQ ID NO: 1082 - DNA, 481 bp, Arabidopsis thaliana
tcaatcgatgaccaaagacataatcttatcctgaagatttggctgaatcggttgcactctatatccaaactgcccatcatgatctctcatcatcattcctcttgcgttgcttgctatatccatctcctgttgttgcagctggaaagtgagttgccgttgctcctccgccatcatcttctcatttctcctctttgatataaggatctccatctggtggtctcggactttgtcgaggccatgttcaatggcgtgctcgacagccatcagatttttcaacttgagagactgtatatcttctcccttcaaatgcctgagctccagttgtaagctatcattctctttcttgatcctatcaatctcattgctaaggttctcatgcttagcatcccatagtttcttgccagataacttctggtattggtccaacatagcaccaagatccatggaaggacaacagtaatcaatcatcttaccattactt

SEQ ID NO: 1083 - DNA, 86 bp, Arabidopsis thaliana
gcagcatgggtagggaaagatcgatataaagacgatagagaacgcaaacaacagagtggtgacgttctcaaacaggaggaatggat

SEQ ID NO: 1084 - DNA, 598 bp, Arabidopsis thaliana
gctactcaaccttaggtgttattactccacaatccctaaaaccaccattgccgccggattcgtataaacctccgacgacgaatccaccacttgttttctgcatttccgccatgtaactcctcacttcagcttttatcatctcctgcaccaccgtcataaactcacctctacgtccttctcctctctcctctacattaatcttcatctgactctcaaatctcggaaacatcaacgcgtcgttgttattgttatggctcgaactcgtgttctcagctccaggtagtgacaaactcaacgaagtaggtggatcctccgaagacgaagacatttcaaccggtaacggctgcggaaccaccgtaaaaccgccggaaatcggcattggtttaaacagctgagcaacaggagacgacggtgacggaatcgtgctagaatcactaacatcgattccgttaggactctcaggactcatgtacaatccagtatccaccggagcaaaagcagaatcaaagctaacagatctcctcttcttcggccgatcctgatcttcctccgtctccgtcaccgtcgtaaccgccacacctccgctgcatttcctctt

SEQ ID NO: 1085 - DNA, 342 bp, Arabidopsis thaliana
gcagcatggcggatcgtgttaaaggtccatggagtcaacatgaagatgagcagctacgaaggatggttgagaaatactgaccgaggaataggtctgcgattagcaaatcgattccagctcgatctggtaaatcgtgtagattacgttggtgtaatcagttatctccggaagttgagcatcgtcctttctcgccggaggaagatgacactattgttaccggccgtgctcaatttggtaaacagtgggcgacgattggtcgtcttcttaacggtcgtacggataacgccggtaaaaatcactggaactctacgcttaacaagaaatgccccggaggtgtggcgg

SEQ ID NO: 1086 - DNA, 280 bp, Arabidopsis thaliana
ttaacataaaccctgagaggcagagtttccaacagacaaaaagtcgaaaaatggaacacaattctcgttaggaattcggctgttttgatcgacatcttcttcttcgtcttttcttgaattacctatcaattcgtgtatcttcgaatccgtgtttacttgaagaaaattgtagaactccatcggtcgtttagtttggtctattgctccttcttgtattggagtagtactacttctgaacccgatctttccggtcaagaactctttgaggacttgaaaatga

SEQ ID NO: 1087 - DNA, 366 bp, Arabidopsis thaliana
gcagcatgatgtgtagtcgaggccattggagacctgcagaagacgagaagctaagagaactcgtcgaacaatttggtcctcataattggaacgccatagctcagaagctctctggtcgatctggtaagagttgtagattgagatggtttaatcaattggatcctaagattaaccgaaaccctttcacggaggaagaagaagaaagggttttaacgtctcatcggatccatgggaacagatggtctgggatcgctaaattttttcccggtccaactggtaacgctgttaaaaaccattgggacgtcatcatgggtcgtcgtgggcgaaaacggtccaagctccgtccacgaaggcttggccatgatg

SEQ ID NO: 1088 - DNA, 428 bp, Arabidopsis thaliana
gcagcatgatagcttcagagagtaccaagagctgggaagctagcgcagtcagacaagagaatgaagaagagaagaagaaaccggttaaagattccggtaagcatccggtttatcggggtgtccgaaagaggaactggggaaaatgggtgtccgagatacgtgaacctaagaaaaaatcccgaatatgggtaggaacgtttccttccccggagatgggggggcgtggacacgacgtaaccggtcttagcatcaaaggagcctccggtatactcaatttccctgacctaaccgggtctttcccacgccctaactcggttagccctcgagacatccaggtcgcgggtctcaaagccggacacatggagacctcacaggctttttcttcttcttcttctttaacgttttcatcttcacagtcttcttcttcg

SEQ ID NO: 1089 - DNA, 824 bp, Arabidopsis thaliana
ttatggtgcaccagaagaattcagggtctcattagagtctgtctcaacttgttcagagcctgatgagttggttgctgaacccctttctctgtctctccctcctgcatcctctcccgcttctacctcacttttcttcgcaaaccggcctccactcgctcgtgcccttctcattgcatgcttgtgtcttgactcgtgaagatatggctttctgtcccggatgactttcctctctagctctgccttggcacgtgcttttcttcgccttagaattccctcgtactgctttgcattcacataaacgggctcttgtgccatgtcaagtggcagagctgttctttcacgaggcattccaagatatggacgaaaacccaattgctgatgaccatatgctcccatcaatcccccataatatggatcctgatatgggtttgggacacaagcgatatagtgtccaacaagctctggtggttgtacaagtggctgatcatgcatgttacggatagagagcgctgggtcatttccttccattccgtgattatctactgaacgagaggaagttgcagcttgtgaatccttccaagtgccatcgttttcaccattcaacgcaccgtcttcagatgctgaatgaacatcgtttgactcggaaccattggggcaatccaaagaagaggaatttgatggaattccagaaggtctcgcttgaggtacaacaccaaaggagttgtttttccaccagggctctgcatacatcatcggctgctgaacagcatggtgattattgacttcctcttcgttttctcttcccggttttgattgcatgctgc

SEQ ID NO: 1090 - DNA, 132 bp, Arabidopsis thaliana
gcagcatgcatagtttgaatgaaacagtaatgaccgagagaaatgcgcgatctaaagtgtttgtttaataacccagctaataaggctaatgacatcatagatctgttgtggcttgcccggccaagagagtga

SEQ ID NO: 1091 - DNA, 177 bp, Arabidopsis thaliana
ttaatacattagatcatcagaagactccatgagaggatggttcataatataatacatgtacatctgattcacgaataattcatcaaaatccaaatcatgcacatggttctgatacatgcccatgtagtggtagaagttgtcgctagtgtccaggaactcgatcatgtcattgacata

SEQ ID NO: 1092 - DNA, 119 bp, Arabidopsis thaliana
gcagcatggaatcgacatcgtcgagaacaaattcgtcgactgttcacatgtcgtcatgatcgaaggatagtctcatggagcagaggacacgtaaatggatggtctcaaaccgtgaatct

SEQ ID NO: 1093 - DNA, 998 bp, Arabidopsis thaliana
tcactctctgggtcgagcaagccataaggagcttagagcccgtagccgtgagaagtaatcgtgtattgcaagtagagcacgtgctgactgtctcgttgttaatactcttatcatctgttgcaatgtttgtagtctcaaattatcagcctggcggataaatccttcgagtgtacctaactttcccattgccatggccatctgacccatgtagcttgcgacattccctgatgaacttgaaccaagagtcccgctcgataaagtatcagctagtgactgttgtaagctctccatcccttgagacaaagcatcttcagcctgctgcgatgtctgttgcaggttatttatgcccatcaactgtctctctgtcattggctccaactgattcgccagaagctttagaagttcggatgaacgaaatccaccgagccacaagaaacatctctcagctggtgttttccacatgccagatagcaagtgaaagacatcattcttagctgcattgctctttatcctgaaaagctcctcatagtgagccatcacaccatcgactattattcgaagctcagaatcacctgcatgcgcattcagagcagacctcagctcgttcatttgcttgttcttttcttccaaccaccgtgaatgttcagcatcaaacgccaaagcaccatttccaccagtagaatgggcctggtctcctgtgcctgaaatgaagacgccctgctgtcttgctctttgcagctcctgctcaagctgggttagtttcaagcggctgttctctagctgctgaacataagccttcttcctcaatctgcttttccttgctgcctcacggttttgagcaagcctacgaagagtcttttgatccatctttcccttcgatcggtcactcgaatcagaagcagcagtattcactagtgctccctccgacccaagatcaggatgatctgtgtcgtcatctgttgagacatcagttctcggactggtatcagccatgctgc

SEQ ID NO: 1094 - DNA, 209 bp, Arabidopsis thaliana
gcacatgatagcttcagagagtaccaagagctgggaagctagcgcagtcagacaagagaatgaacaacagaagaagaaaccggttaaagattccggtaagcatccggtttatcggggtgtccgaaagaggaactggggaaaatgggtgtccgagatacgtgaacctatgagacaatcccgaatatggctaggaacgtgtcctgccccgg

SEQ ID NO: 1095 - DNA, 315 bp, Arabidopsis thaliana
gcagcatgatgtgtagtcgaggccattggagacctgcagaagacgagaagctaagagaactcgtcgaacaatttggtcctcataattggaacgccatagctcagaagctctctggtcgatctggtaagagttgtacattgagatggtttaatcaattggatcctacgattaaccgaaaccctttcacggaggaagaacaagaaaggcttttagcgtctcatcggatccatgggaacagatggtctgtgatcgctacattttttcccggtcgaactgataacgctgtcaaaaaccattggcacgtcatcatggctc

SEQ ID NO: 1096 - DNA, 519 bp, Arabidopsis thaliana
gcagcatgatgtgtagtcgaggccattggagacctgcagaagacgagaagctaagagaactcgtcgaacaatttggtcctcataattggaacgccatagctcagaagctctctggtcgatctggtaaaactgactttatattaaagtcatttctttaatttcttacaaagcatatataaactagggtttaatatatttatataaaaatatatatgttggtttgattggatcttttggtttcaggtaagagttgtagattgagatggtttaatcaattggatcctaggattaaccgaaaccctttcacggaggaagaagaacaaaggcttttggcgtctcatcggatccatgggaacagatggtctgtgatcgctagattttttcccggtcgaactgataacgctgttaaaaaccattggcacgtcatcatggctcgtcgtggccgagaacggtccaagctccgtccacgagggcttggccatgatggcacggtggctgcgactgggatgattggtaatt

SEQ ID NO: 1097 - DNA, 407 bp, Arabidopsis thaliana
gcagcatgcccctctcgtcaccaaggccaagggccgtaaactcacggctgaggaactctggtcagagctcgatgcttccgccgccgacgacttctggggtttctattccacccccaaactccatcccaccaaccaagttaacgtgaaagaggaggcagtgaacaaggagcaggcaacagagccggggaaacggaggaagaggaagaatgtttatagagggatacgtaagcgtccatggggaaaatgggcggctgagattcgagatccacgaaaaggtgtgatagtttggcttggtacgttcaacacggcggaggaagctgccatggcttatgatgtcgcggccaagcacatccgtggtgataaagccaagctcaacttcccagattgcaccatcctcctcctcctaa

SEQ ID NO: 1098 - DNA, 390 bp, Arabidopsis thaliana
gcagcatgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgtcggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaaccattacagaggagtgaggcagagaccgtgggggaaattcg

SEQ ID NO: 1099 - DNA, 447 bp, Arabidopsis thaliana
gcagcatgcagagcagcttcaaaaccgttcctttcactcctgatttctactctcagtcttcttacttcttcagaggagatagttgtcttgaggagttccatcaaccagtcaatggttttcaccatgaagaagctatcgatttaagtccaaatgtcactattgcttcagctaacttacactacacgacgtttgatacggttatggattgtggtggtggtggtggtggtggcttgagggagagacttgaaggaggagaagaggagtgtttggacacagggcaactagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaaggga

SEQ ID NO: 1100 - DNA, 147 bp, Arabidopsis thaliana
atggatcccagagagatccaccaccaccaacaacaacaacaacaacagcagcagcagcaacaacagccacatctacaacaacagcaacaaccaccgccagggatgttaatgagtcaccacaattcctacaatcgaaaccctaacgcc

SEQ ID NO: 1101 - DNA, 105 bp, Arabidopsis thaliana
gcagcatggggagacagccatgctgtgacaagctacgggtgaagaaagggccgtggacggtggaggaagataacaagcttataaacttcatactaaccaatggcc

SEQ ID NO: 1102 - DNA, 377 bp, Arabidopsis thaliana
gcagcatgggaagagcaccgtgttgtgacaaagcaaacgtgaagaaagggccttggtctcctgaggaagatgcaaaactcaaatcttacattgaaaatagtggcaccggaggcaattggatcgcttcgcctcaaaagattggtttaaagagatgtggaaagagttgcacgctgaggtggcttaactatcttacaccaaacatcaaacatggtggcttctctgaggaagaaaaaaacatcacttgtaccctttaccttacacttggtagcaggtggtctataatcgctgctcaattgccgggacgaacatacaacgatataaaacactatcgcaacacgaggctcaagaagaaactcattaacaaacaacgcaaggat

SEQ ID NO: 1103 - DNA, 145 bp, Arabidopsis thaliana
ggagcatgcccctctcgtcaacaaggccaatgtccgtaaactcacggctgaccaactctgggcagagctcgatgcttccgccgccgacgacttctgcggtttctatcccacctccaaactccatcccaccaaccaagttaacgtg

SEQ ID NO: 1104 - DNA, 637 bp, Arabidopsis thaliana
gcagcatggggagacagccatactgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctgacttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaaga

SEQ ID NO: 1105 - DNA, 380 bp, Arabidopsis thaliana
gcagcatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccacgatttggctcgggactttccaaaccgctgagatggcagctcgtgctcacgacgtcgctgcattagccctccgtggccgatcagcatgtctcaacttcgctgactcggcttggcggctaccaatcccggagtcaacatgcgccaaggatatccaaaaagcggct

SEQ ID NO: 1106 - DNA, 488 bp, Arabidopsis thaliana
gcagcatggctacaccaaacgaagtatcagctcttttcctcatcaagaagtatctcctcgacgaattgtctccgttgcctactactgccaccaccaatcgatggatgaacgatttcacgtcatttgatcaaaccggtttcgagttttctgaatttgaaaccaaaccggaaataatcgatctcgtcactcccaaaccggagatttttgatttcgatgtgaaatctgaaattccatctgaatcgaacgattccttcacgttccaatcgaatcctcctcgcgttactgttcaatccaatcgaaaaccgccgttgaagatcgcaccaccgaaccgaaccaagtggattcaattcgcaaccggaaatcctaaaccggaacttcccgtaccggttgtagcagcagaggagaagaggcattacagaggagtgaggatgaggccgtgggggaaattcgcggcggagattcgagacccgactcgtcgtggaactcgt

SEQ ID NO: 1107 - DNA, 680 bp, Arabidopsis thaliana
gcagcatgatgtgtagtcgaggccattggagacctgcagaaaacgagaagctaagagaactcgtcgaacaatttggtcctcataattggaacgccatagctcagaagctctctggtcgatctggtaagagttgtagattgagatggtttaatcaattggatcctaggattaaccgaaaccctttcacggaggaagaagaagaaaggcttttagcgtctcatcggatccatgggaacagatggtctgtgatcgctagattttttcccggtcgaactgataacgctgttaaaaaccattggcacgtcatcatggctcgtcgtggccgagaacggtccaagctccgtccacgaggccttggccatgatggcacggtggctgcgactgggatgattggtaattataaagactgcgataaggagagaagattggcaaccacaaccgctatcaattttccttatcaattctctcatattaatcattttcaagtcctcaaagagttcttgaccggaaagatcgggttcagaattagtactactccaatacaagaaggagcaatagaccaaactaaacgaccgatggagttctacaattttcttcaagtaaacacggattcgaagatacacgaattgatagataattcaagaaaagacgaagaagaagatgtcgatcaaaacaaccga

SEQ ID NO: 1108 - DNA, 155 bp, Arabidopsis thaliana
gcagcatgcccctctcgtcaccaaggccaagggccgtagactcacggctgaagaactctgggtcagagatcgatgcttccgccggcgacgacttctggcgtttctatcccacctccaaactccatcccaccaaacaagttaacgtgaaagaggag

SEQ ID NO: 1109 - DNA, 319 bp, Arabidopsis thaliana
gcagcatgggaagagcaccgtgttgtgataaggccaacgtgaagaaagggccttggtctcctgaggaagacgccaaactcaaagattacatcgagaatagtggcacaggaggcaactggattgctttgcctcagaaaattggtttaaggagatgtgggaagagttgcaggctaaggtggctcaactatctgagaccaaacatcaaacatggtggcttctccgaggaagaagacaacatcatttgtaacctctatgttactatcggtagcaggtggtctataattgctgcacaattgccgggaagaaccgacaacgatat

SEQ ID NO: 1110 - DNA, 550 bp, Arabidopsis thaliana
gcagcatggagcgagacgaagaagcgggtggaccgatgatggagatgtgcactaacggcggcgaagagacgtctaatcgaagacctatcataagtggcgaaccgctcgacatcgaggcctacgcggctctctacaaaggtcgcacgaagatcatgcggcttctcttcatcgctaaccactgcggaggaaaccacgcgcttcagtttgacgcgttgaggatggcttacgatgagatcaaaaagggtgagaatacgcagttgttcagagaagtggtcaataagattggcaacaggcttggggaaaagtatgggatggatcttgcttggtgtgaggccgtcgatcgtcgtgctgaacagaagaaagtaaagctggagaatgagctcagttcttatcggacaaatttgatcaaggaaagcatcagaatgggttacaatgactttggagatttctattacgcatgtggtatgctcggagatgctttcaagaactatatccgaacacgcgactactgcactacgacaaagcacatcattcacatgtgtatgaatgc

SEQ ID NO: 1111 - DNA, 395 bp, Arabidopsis thaliana
gcagcatgcccctctcgtcaccaaggccaagggccgtaaactcacggctgaggaactctggtcagagctcgatgcttccgccgccgacgacttctggggtttctattccacctccaaactccatcccaccaaccaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgacgttgcggccaagcagatccgtggtgataaagccaagctcaacttcccagattgcaccatcctcctcctcctaa

SEQ ID NO: 1112 - DNA, 507 bp, Arabidopsis thaliana
gcagcatggattccagagagatccaccaccaacaacagcaacaacaacaacaacaacagcagcagcagcaacaacagcaacatctacaacaacagcaacaaccaccgccagggatgttaatgagtcaccacaattcctacagtcgaaaccctaacgccgccgccgctgttttaatgggtcacaacacctccacatctcaagctatgcatcaaagattaccttttggtggttctatgtcaccgcgtcagcctcaacaacatcagtatcatcatcctcagcctcagcaacagatagatcagaagactcttgaatctcttggatttgatggatcgccttcttctgttgccgccactcaacaacattcgatgagatttgggatcgaccatcaacaggttaagaagaaacgaggtagacctaggaagtatgctgctgatggtggtggtggtggtggtggtggtagtaacattgctcttggtttggctcctacttcgcctcttccttctgctt

SEQ ID NO: 1113 - DNA, 639 bp, Arabidopsis thaliana
  misc_feature (502)..(502): The residue at this position can be any nucleotide.
gcagcatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgacacgacgaccacgaatcatggcctggacatggaggagacgatggtggaagctatttatacaccggaacagagcgaaggtgcgtnttatatggatgaggagacaatgtttgggatgccgactttgttggataatatggctgaaggcatgcttttaccgccgccgtctgttcaatggaatcataattatgacggcgaaggagatggtgacgtgtcgctttgga

SEQ ID NO: 1114 - DNA, 665 bp, Arabidopsis thaliana
gcagcatgtcaggatctgagacgggtttaatggcggcgaccagagaatcaatgcaatttacaatggctctccaccagcagcagcaacacagtcaagctcaacctcagcagtctcagaacaggccattgtcattcggtggagacgacggaactgctctttacaagcagccgatgagatcagtatcaccaccgcagcagtaccaacccaactcagctggtgagaattctgtcttgaacatgaacttgcccggaggtgagtctggaggcatgactggaactggaagtgagccagtgaaaaagaggagaggtagaccgaggaaatatgggcctgatagtggtgaaatgtcacttggtttgaatcctggagctccttctttcactgtcagccaacctagtagcggcggcgatggaggagagaagaagagaggaagacctcctggttcttctagcaaaaggctcaagcttcaagctttaggctcgactggaatcggatttacgcctcatgtacttaccgtgctggctggagaggatgtatcatccaagataatggcgttaactcataatggaccccgtgctgtgtgtgtcttgtctgcaaatggagccatctccaatgtgactctccgccagtctgccacatccggtggaactgttacatatgaggggaga

SEQ ID NO: 1115 - DNA, 587 bp, Arabidopsis thaliana
gcagcatgatgatggagactagagatccagctattaagcttttcggtatgaaaatcccttttccgtcggtttttgaatcggcagttacggtggaggatgacgaagaagatgactggagcggcggagatgacaaatcaccagagaaggtactgattgataaaaagtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgacatgcaaaagcatggagaccaagttctgttattacaacaactacaacataaaccagcctcgtcatttcctgcaaggcttgtcagagatattggactgctggagggactatgacgaatgttcctgtgggggcaggacgtcgtaagaacaaaagctcatcttctcattaccgtcacatcactatttccgacgctcttgacgctgcgaggcttgacccgggcttacag

SEQ ID NO: 1116 - DNA, 644 bp, Arabidopsis thaliana
gcagcatgtcggatgcgtattgtacggattgtaaaaaggagacggagttggttgtcgatcactcagccggagataccctttgctccgagtgtggtttggttttggaatctcactccattgatgagacctctgagtggcgtaccttcgctaatgaatcttccaacagcgatcccaatcgtgtcggtggtccaaccaacccgcttctcgctgatagtgctttaaccactgttatcgctaagcccaatggttcatctggtgatttcttgtcttcttctctcgggaggtggcagaatcgtaactccaattccgatcgtggtttgattcaagcttttaaaaccattgctaccatgtctgaaaggttgggacttgttgcaactatcaaggatcgggctaatgagttatataagaggctggaggatcagaagtcaagcaggggaagaaatcaggatgcactttatgcagcctgtctgtacattgcttgtcgccaagaggacaagccacgaactattaaggaaatatgcgttattgccaatggggcgacaaagaaggaaattggccgagcaaaagactacattgttaagacattgggactggagcctggtcagtctgtggatttaggaactatacacgctggtgatttcatg

SEQ ID NO: 1117 - DNA, 657 bp, Arabidopsis thaliana
gcagcatgtcagcctcttcctcaccgcctcctccaaccaccgccacctcgaagtccaagaggggaacgaagaaagagattcaagagtcgcttcttactccgaggttctacacgacggacttcgaggaaatggaacagcttttcaacacggagatcaacaagaaccttaacgaagcagagttcgaggctctgcttcaagagttcaagaccgattacaaccagacacatttcgtgaggaacaaggagtttaaagaagctgcagacaaattgcaaggacctctccgacagatcttcgttgagttccttgagcggtcttgtactgctgagttctctggtttccttctctacaaggagcttggtcgaagactcaagaaaacaaaccctgttgtggctgagatcttctctcttatgtctagagatgaagcaagacatgccgggttcttgaacaagggattgtctgatttcaacttggctcttgatttgggtttcctgacaaaggcaaggaaatacactttcttcaagccaaaattcatcttctacgcgacttacttatccgagaaaatcgggtactggagatacatcacaatctacagacacctcaaggaaaaccctgagttccaatgttacccaatcttcaagtactttgagaactggtgtc

SEQ ID NO: 1118 - DNA, 630 bp, Arabidopsis thaliana
gcagcatgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatg

SEQ ID NO: 1119 - DNA, 379 bp, Arabidopsis thaliana
gcagcatggataaagagaaatctccactacctccttgtggaggtcttcctcctccatctggatcaggtcgatgctctgcattctcacaagctggtcccattggtcatggttcagatgctaatcgaatgagtcatgatattagccgtatgcttgataacccacctaataagattggagatcggcgagctcattctgaaatacttactctccctgatgatttgacctttgatagtgatcttggtgtggttggtaatgctgctgatggagcttctttctctgatgacactgaagaagatttgctctctatgtatcttgatatggataagttcaattcttctgctacatcttctgcccaactcggtgacccatcacgaactgc

SEQ ID NO: 1120 - DNA, 683 bp, Arabidopsis thaliana
gcagcatgggaagaggaagagtagagctgaagaggatagagaacaaaatcaacagacaagtaacgtttgcaaagcgtaggaacggtttgttgaagaaagcttatgaattgtctgttctctgtgatgccgaagttgctctcatcatcttctccaaccgtggaaagctctatgagttttgcagctcctcaaacatgctcaagacacttgatcggtaccagaaatgcagctatgggtccattgaagtcaacaacaaacctgccaaagaacttgagaacagctacagagaatatctgaagcttaagggtagatatgagaaccttcaacgtcaacagagaaatcttcttggggaggatttaggacctttgaattcaaaggagttagagcagcttgagcgtcaactggacggctctctcaagcaagttcggtccatcaagacacagtacatgcttgaccagctctcggatcttcaaaataaagagcaaatgttgcttgaaaccaatagagctttggcaatgaagctggatgatatgattggtgtgagaagtcatcatatgggaggaggaggaggatgggaaggtggtgaacagaatgttacctacgcgcatcatcaagctcagtctcagggactataccagcctcttgaatgcaatccaactctgcaaatggggtatgataatccggta

SEQ ID NO: 1121 - DNA, 654 bp, Arabidopsis thaliana
gcagcatgggaacgagcgaagacaagatgccatttaagactaccaaaccaacatcttcggctcaggaagttcctcccacaccgtatccagattggcaaaattcaatgcaggcttattatggcggaggaggtactccaaatccttttttcccatccccagttggatctcctagtcctcacccctatatgtggggtgctcaacaccatatgatgccgccttatggcaccccagttccgtacccagcaatgtatcccccgggggcagtctatgctcatcctagcatgcccatgcctcctaattctggtcctaccaacaaggagcctgcgaaggaccaagcttctggcaagaagtcaaaggggaactcgaaaaaaaaggctgaaggaggtgataaagcgctctctggttcagggaacgatggtgcctctcatagtgatgaaagtgtcacagcgggttcatctgatgaaaatgatgagaatgccaatcaacaggaacagggttcaattcgaaagccaagctttggacagatgcttgctgacgcaagttctcaaagtacgactggtgaaatccaaggttcggtgcccatgaagccggtagccccggggactaatctgaatatcgggatggacttatggtcttcccaagctggtgtaccag

SEQ ID NO: 1122 - DNA, 523 bp, Arabidopsis thaliana
gcagcatgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttgatcggtaccagctctcggatcttcaaaataaagagcaaatgttgcttgaaaccaatagagctttggcaatgaagctggatgatatgattggtgtgagaagtcatcatatgggaggaggaggaggatgggaaggtggtgaacagaatgttacctacgcgcatcatcaagctcagtctcagggactataccagcctcttgaatgcaatccaactctgcaaatggggtatgataatccggtatgctcagagcaaataactgcgacaacccaagctcaggcgcagcagggaaacggttacattccaggatggtgctctga

SEQ ID NO: 1123 - DNA, 651 bp, Arabidopsis thaliana
gcagcatgggaacgagcgaagacaagatgccatttaagactaccaaaccaacatcttcgggtcaggaagttcctcccacaccgtatccagattggcaaaattcaatgcaggcttattatggcggaggaggtactccaaatccttttttcccatccccagttggatctcctagtcctcacccctatatgtggggtgctcaacaccatatgatgccgccttatggcaccccagttccgtacccagcaatgtatcccccgggggcagtctatgctcatcctagcatgcccatgcctcctaattctggtcctaccaacaaggagcctgcgaaggaccaagcttctggcaagaagtcaaaggggaactcgaaaaaaaaggctgaaggaggtgatacagcgctctctggttcagggaacgatggtgcctctcatagtgatgaaagtgtcacagcgggttcatctgatgaaaatgatgagaatgccaatcaacagggttcaattcgaaagccaagctttgggcagatgcttgctgacgcaagttctcaaagtacgactggtgaaatccaaggttcggtgcccatgaagccggtagccccggggactaatctgaatatcgggatggacttatggtcttcccaagctggtgtaccagtga

SEQ ID NO: 1124 - DNA, 637 bp, Arabidopsis thaliana
gcagcatggctcgtggaaagattcagcttaagaggattgagaacccggttcacagacaagtgactttttgcaagaggagaactggtcttctcaagaaggctaaggagctctctgtgctctgtgatgccgagatcggtgttgtgatcttctctcctcagggcaagctctttgagctcgctactaaaggaacaatggagggaatgattgataagtacatgaagtgtactggtggtggtcgtggttcttcttctgctacttttactgctcaagaacaacttcaaccaccaaatcttgatccgaaagatgagatcaacgtgcttaagcaagagattgagatgcttcagaaagggataagctatatgtttggaggaggagatggggctatgaatcttgaagaacttcttttgcttgagaagcatcttgagtattggatttctcagattcgctctgctaagatggatgttatgcttcaagaaattcagtcattgaggaacaaggaaggagtcctcaaaaacaccaacaagtatctcctcgaaaagatagaggaaaacaacaatagcatattagatgctaacttcgcagtcatggagacaaactattcctatccgctaacaatgccaagtgaaatatttcagtt

SEQ ID NO: 1125 - DNA, 639 bp, Arabidopsis thaliana
gcagcatgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttggaattgaaagcacaatcgaacggtataatcgttgttacaactgctctctaagcaataataagcctgaagagactacacagagttggtgtcaggaggtgacaaagcttaaatccaaatacgaatctcttgttcgtactaacaggaatttgcttggagaagatcttggagaaatgggtgtgaaggaactgcaagcgctcgagaggcagctcgaagccgctcttaccgcgactcgacagcgcaagacacaagttatgatggaagaaatggaagaccttaggaaaaaggagaggcaactaggagacataaacaaacaactcaagattaagtttgaaacggaaggccatgctttcaaaacctttcaagacttatgggcaaactcggcggcatcggtggccggggatccaaacaattctgaatttccggtagagccttctcatcctaatgtattggatt

SEQ ID NO: 1126 - DNA, 686 bp, Arabidopsis thaliana
gcagcatgggaagaacaccttgttgtgacaagattggtttgaagaaaggtccttggacgcctgaagaagatgaggttcttgttgcgcatatcaagaaaaatggacatggaagctggagaacacttcctaaacttgctggtttacttcgctgtgggaagagttgcaggctgagatggacaaactatctgagaccagacataaagagaggtcctttcactgctgatgaagagaaacttgttatccagcttcatgccattctcggcaacaggtgggctgctattgcagcacagcttccaggaagaacagacaacgagatcaagaacttatggaacactcatttgaagaaacgtcttttatctatgggtcttgatcccagaactcatgagccattaccttcatatgggttagctaaacaagctccatcttcaccaacaactcgccacatggctcaatgggaaagtgctagggttgaagctgaggcaaggctttctagagaatcaatgctctttagcccttctttttactctggtgtagtaaaaactgaatgtgatcacttcttacgcatttggaattccgagattggtgaagctttcaggaatctcgctccattagatgaatcaactattactagtcaaagcccttgctcgagggcaacatcgacctcatctgcacttctgaagagctca

SEQ ID NO: 1127 - DNA, 574 bp, Arabidopsis thaliana
gcagcatgatgatggagactagagatccagctattaagcttttcggtatgaaaatcccttttccgtcggtttttgaatcggcagttacggtggaggatgacgaaaaatatgactggagcggcggagatgacaaatcaccagagacggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaa

SEQ ID NO: 1128 - DNA, 537 bp, Arabidopsis thaliana
gcagcatgggaagagggaaagttgagctgaagaggatagagaacaagatcaatagacaagttacttttgcaaagagaagaaatggtttgctcaagaaggcttatgagctttctgtcctttgtgatgctgagattgctcttctcattttctctaaccgtggcaagctctacgaattctgcagcagccctagtggtatggcgaggacggttgataagtatagaaaacatagttatgcaacaatggatccaaatcaatcagctaaagacttgcaggataagtatcaagactacttgaagcttaaatcaagagttgagatccttcaacattcacaaaggcatttgctaggtgaagagctatccgagatggatgtgaatgagcttgagcatctcgaacgccaagtagatgcatcactaagacaaataagatctaccaaggctcggtctatgcttgatcaactatctgacctcaaaactaaggaggaaatgttattggaaaccaatagagatcttaggagaaagttggaggacagtgatgcag

SEQ ID NO: 1129 - DNA, 374 bp, Arabidopsis thaliana
gcagcatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaagattcatctccaaaggtggaggatttctttgggacccat

SEQ ID NO: 1130 - DNA, 227 bp, Arabidopsis thaliana
gcagcatgggaagaggaagagtggagatgaagaggatagagaacaagatcaatagacaagtgaccttcgcaaaacgaagaaacggtttgctgaagaaagcttatgaactgtctgttctctgcgatgccgaagttgctctcatcatcttctccagccgtggcaagctctatgagtttggtagtgccgcaatcgtgctcacaatccatggtcataatcatagttgcaac

SEQ ID NO: 1131 - DNA, 330 bp, Arabidopsis thaliana
gcagcatgggaacatgaaaattaaatctgcttacgatacagaacagtatcaaccagaggagtaacttctgcaacacgtaccaccggtatgttaacgacaccttatcacttgtctgttctctgcgacgctgacttcgcactcatcatcttctccaaccgtggaaagctctatgactcttgcagctcctcaaacatgctcaacacacttgatcgggaccagaaatgcagctatggatccattgaaatcaacaacaaacctgccaaagaacttgagaacagctacagagaatatctgaagcttacgggtacatatgagaaccttcaacgtcaa

SEQ ID NO: 1132 - DNA, 567 bp, Arabidopsis thaliana
gcagcatggcaaatcgcggaggtgaatatctgtacgatgagttatggaaattatgcgcgggacctcttgttgatgttcctcaagctcaagaaagagtttattattttcctcaaggtcacatggaacaactcgaagcgtcaacgcaacaagtcgacttaaatacgatgaagcctctttttgttcttcctcctaagattctctgcaatgttatgaacgttagtcttcaggcggagaaagatacggatgaggtctatgctcagattactttgatccctgttggaactgaagttgatgaacctatgagtcctgatccctctcctcctgagttgcaaagggcgaaagttcactctttcaacaaggttttgacagcgtctgatacaagcacccatggtggcttttctgttctaaggaaacatgccacggaatgtcttcctccggtggatatgactcaacaaaccccgacccaggagttaataaccgaagatgtgcacggttatcagtggaaattcaagcatatttttagaggccaaccacggaggcatctattgactacagggtggagcacct

SEQ ID NO: 1133 - DNA, 631 bp, Nicotiana benthamiana
ttgaaagtagatattttctcggacttcgaagacatcttcgggtaacaatttggagaaaggagaatggcgttagtttcaggaggaaggtcgacactgaatccgaatgcacctcttttcatcccgtcttatgtgcgtcaagtggaggatttttcacccgaatggtggaatttggtgacaacttcgacatggttccatgattattggacgagccagcatcaaggagaggaatatggcgatgatgcttttggttttgctgggaatgatgttgctgacttgcttcctgaaaatatcgatcttgatgttgatgaagatattttgaacatggaagctcagtttgaagaattcctccaatcatctgaaagtgaacaacaaggaatcaagtcatcgctctatggtgtcaatggtttacccaagggttcggaggcactcgtacggacactgagcatgccaaaggggccaaaatctcccattgagccaccaaagtactatgagaaaccagcaaagattgttagcccaaagaacagccttcgccgcatccagcagcctcgctaaatgtagtttagcttaagcaaaagctcttggtttgtagtttgggaatgtcagtccttaatttgcagcttttagtcttctt

SEQ ID NO: 1134 - DNA, 163 bp, Nicotiana benthamiana
atcgcacagatggctgcacctactgctgctcactggtcagagaagtataatcaactagttgctgacttgaagaagaaaggttatattgttgtcaactacattcctttgataccagttgaagaaatctcaaaggcatataaacaggttgagtctgctgcgcatg

SEQ ID NO: 1135 - DNA, 623 bp, Nicotiana benthamiana
  misc_feature (515)..(515): The residue at this position can be any nucleotide.
gccattacggccggggatggagctgcaagattggaaggaggcattgaagtattgcagattaactatcccggtttataagagagtttatccagaatgtcatcctttgctcggactgcaatattacacttgtggaaaacttgaatggtggcttggtgagactgaggaagcttataggtcactagccaaggcagcagagatactgcgaattactcatggaacaaacactaagttcatgaaggagctttttgtgaagttagaagaagctcatgcagagttctcatacaagatttcctccaaggaagaagaggatgattgaactgcatccgcagatgcacattacctttgtagacaacagatataaaattccatttcaccagttcgacaaagggcggcccctctttcctaattattacaatgaaaagtttctagtgagatgctgatctccctttcctactgtctacttttgatggaagttgaggttactgttgtgagagaaaataggctatcatggcagnttcttctatcttatataagagacttagagttttgatattcggaaaggggtgcaaggcatggttcattggaagctgtaaatagctagaatttgtggcgttcattgcatt

SEQ ID NO: 1136 - DNA, 403 bp, Nicotiana benthamiana
ggccattacggccggggggtcttgtggctatagcattgcgcagcaggctgctcttttccacagcatgaaatcactctttatgaacaaacccttgatgatcgtgtgcaacaaaacggacttgcagccgttagaagggatttctgaggaagacaagaagttagtcgcagagatgaaagatgaagccatgaagacagtgatgggtcaaggtggcgaggcaacagatgaagcaggtgtgttgttaactatgagcacgttgaccgaagatggcgtgatttcagtgaagaatgcagcttgtgaaaggttactgaatcagagggtggaattgaaaatgaagtcgaaaaagttgaatgactgcttgaaccgcttccatgttgctatgccaaaaccacgtgaccagaaagag

SEQ ID NO: 1137 - DNA, 374 bp, Nicotiana benthamiana
ggccattacggccgggaagcctaaaggtggattaaaggaggcattgaaagttgaccctaataaagtaagacgactaagtttaagtgaacaggctctcgaaaaggctgccgaatctcatgggatggaaattgtgaggttcacgcaaagaaacattttaagggtgtatcctaaaggtactaggtttaactcatccaactacaagccactaattggttggatgcatggagctcagatggttgcatttaacatgcagggatacggtagagcgctatggttgatgcatgggatgttcaggtcaaatggaggctgtggttatgttaaaaagcccgatttcttgctgaatgttggccctaatagtgaagtttttgatccta

SEQ ID NO: 1138 - DNA, 420 bp, Nicotiana benthamiana
ggccattacggccgggccaactctcaccgaccagttcgcttgatgcaaattcaaatagcttcagtttggaaattggtaatggtgaatttagtggagctgaattgaagaaaattatggcaaatgagaaacttgcagagatagccttagcagatccaaagcgggccaaaaggattttagccaaccgccaatctgctgctcgttcaaaagagcgaaagatgagatacattgcggagttagaacacaaggtgcaaacactgcagactgaagccaccacattgtctgctcaactgacactgttgcagagagattctgctgggctaacgagccaaaaccacgagctgaagtttcgtttgcaagccatggagcagcaagctcaactccgtgatgcactaaatgaagcattaactgctgaagtacaac

SEQ ID NO: 1139 - DNA, 267 bp, Nicotiana benthamiana
caacaggccagagagaagaaagaagagaaaaatatgggcggattgagaggcggcgcaaattgttttccaggaggatggggtgcggcggcagtagcaaaaccatgcgagtattgccacttagacgccgcactcgtgttctgtcgagtagacaacatgttcatgtgcttggtctgcgacacgagggtgcaccgaaacgcccgccacgaacgtgtatggatgtgcgaggtttgcgagcaggcagcggctagtgtcacgtgcaaggctgac

SEQ ID NO: 1140 - DNA, 619 bp, Nicotiana benthamiana
cggacgcgtgggaaaattttctcctcagctctctgttttgatccgtcatcaaatcttctgaggaataatgagtcgttcaagtaggacaatttatgttggtaatcttcctggtgatattcgtgagcgagaagttgaggatctgttctacaagtacggcccgatagctcatattgatctgaaagttccaccaagacccccgggttatgcttttgttgagtttgaagaggctcgcgatgctgatgatgctattcgtgggcgtgatggctatgattttgatgggcatcgcttgagggttgaacttgcacatggtgggcgtggtaactcatcagcaaatgatcgttatagtggcaatagtagcggtcgtaatcacaaatttggagctcccaaacgtaccgagtatcgagtattagttaccggattgccccattcagcatcctggcaggatcttaaggatcacatgcgtcgagctggggatgtttgtttctcacaagttttccgtgagggtggtggaaccactgggattgtggattatactaaccgcgacgacatgaaatatgctatcaaaaaacttgatgaatctgagttccggaatgctttttctcgttcgacgattcgcgtg

SEQ ID NO: 1141 - DNA, 367 bp, Nicotiana benthamiana
aaataatgggaagaggaagagttgaactaaagaggatagagaacaaaataaacaggcaagttacttttgcaaagagaagaaatggacttctcaaaaaagcttatgaactttcagttttatgtgatgctgaagttgctcttatcatcttctctagccgtggcaaactctatgaattttgcagcacttctagcatgatgcaaacacttgaaaagtatcaacaatgcagctacgcctctttggacccaatgcaatcagctagcgatcatactcggaacaattaccatgagtatctgaggctaaaagctagagttgagcttcttcaacgatctcagagaaatcttcttggggaggacttgggcacactaaa

SEQ ID NO: 1142 - DNA, 576 bp, Nicotiana benthamiana
caaggccaaaggcagtgtttaacttatggttaatactgcaggataggctgcctaccaaagttcgagtgaaacaatggaattcaaacattgacagcatgtgcattctgtgtcaacaatgggaagaatcaagaaatcatctcttctatcattgtcctttcactaccatgatgatgcatcaagcaatgggttggataggagttactcagcctacatttcaatcttgggatcgattcatacaatgggttgtagccaaggctaagggaaggactgcacgagctcatgctatgaagctgatatttgcagaagtttgctactgtgtttggcttgaaagaaactccagaatattcacaaatatgtcaaagtgtgttagccaattgcttagaaatactgcctacatttgtcatgttagaagtcatattgagtttagcctacaatttcaacaggttcaatgtaattagaaatggaggtatagtataggagtaggagaggagcttcttattgataattagctgtgctagctgattatggatttgtaatgacttatcattggtgattaataaaagaaagttaattacc

SEQ ID NO: 1143 - DNA, 645 bp, Nicotiana benthamiana
cccacgcgtccggtggcaatgttggatattcctggctaccaggaagtgcgtgatcctgctgatcagcacggagagatgcgtatggacgtagatcacatgtcttatgaggagcttcttgcattgggagagcagattggaactgtaaaaaccggtttatcagaggaggtcattgttagccatttgaaaacaagatcattttcatcatcggtaactccttgcaatttggaaagggctgcatgttcggatcacaagactgatttctgtgtcatatgccagtctgattacgatgatcaagagagcattgggacactcaagtgcggacatgagtatcatgcagattgcgtaaagaaatggttgattatgaagaacaattgtcccatctgcaagtccacagcattgttgacggaaggaaaggatttgtgaaagcaagtgatagatggtcactggatctatcattaaaaagaacgatgatttttgttttcttgctaagtatttatttgcgttcctgaaactgtactatatgtttgtacatactctacagggtatggcgaatggtcaacctgtccagaaacatctttattggcgctatatctatcgcctgaaattgtacagaaacctctaacttttgtctgtcgcctgaagttg

SEQ ID NO: 1144 - DNA, 81 bp, Nicotiana benthamiana
tcgcccacgcgttcggtggcaatgttggatattcctggcttccatgaagtgcgtgatcctgctgatcagcacggagagatg

SEQ ID NO: 1145 - DNA, 661 bp, Nicotiana benthamiana
gccattacggccggggggctctttctttgaccaatgttcttcattttgcttctcctcttgaactgaaaaattcattgtattgtgacaattggttgaagaaggagtaccacagtggggttgggatgtttgggtctggaatgaatttgataaccacaataattggttttggaatgagtgcaacttttattgtgtttgtgtgtataagactgatttgtgggaggataagcaggagacaatcaaggcaaatgtttgagattgaatcagggattgatcttgaaatgccagagcatcgaattaatgggcttgactcagttgtggttgctgcaattcccaccatgaaatttcatcgcgatgctttcacctcctcggaagatacacagtgcagtatatgtttatcggagtaccaggagaacgaagttctgagaattatgcccaaatgtggccataattttcatctttcatgcattgatatatggctaaggaaacagtctacctgtccagtttgccgtctttctgtacctgaatccattgaaaataaacaaaggcgtcctccaatgcttggcagggatcgaaactctgatagttctgagatttcagttgagcattcaaggcaatggctgctacctattgctgaacagtcgcagggtactgtaagtaacag

SEQ ID NO: 1146 - DNA, 509 bp, Nicotiana benthamiana
atcgaacataggtttccgattatcgccaaacaactgatataggggatcacacaaaggtgtatacagcttcttggtgataaacagacaacatgccggccacagcaggtagggttcgcatgcctgcgaacaacagtgttcacagtactgcagccctacagacgcacggcatctggcagagtgctattggttatgatccatatgctcctagcaaggaggacgacacgaaatctacccagaaggcgtcagcagctgatcctgaaaatgcttatgcgagctttcaaggtttgcttgcacttgcccggatcacgggatccaacgctgatgaaactcgaggagcgtgcaagaggtgtgggcgggtaggccacctcactttccagtgtaagaattttgtgagtgttaaggatgataacaaggataaggatccggaggcgattgaggctgctgtgttgtctggattggagaagatcaaggggtctaagataaagggaaaagcagaaaatgaggagagc

SEQ ID NO: 1147 - DNA, 526 bp, Nicotiana benthamiana
aatcaattgacccatttgcaacagtcatgggacctgaacattgaggtcgcgtaaatttgtatggtcgtggggttacaaagactatcttgaaacaaaaatctagaaattctagaccctcttcaaagactactgataatataatggagcaaaaactaaaggaaatggaagagagaaggcaacaaaggatgcagaaaaatttcgaggaacgacaggaaacttggtggcaaaaaattacacttaatgttgttgcacaacttcagcatattaacccagatttacgaattgatcctaatatgctagcatttggtgattgttcactcggagaagcttcctatgcacaacaagattcaattcaactaatcaatcgtccatctacgtgcagtactaatcaaggtgtttacttaattattgcaaaatattgcatctccttctctttcttcttcttcttctttttcttcttcaccacttcttcttcttcttcttcttcttcttcttcttcttcttcttcttcttcttcttcttcttc

SEQ ID NO: 1148 - DNA, 533 bp, Nicotiana benthamiana; identical to SEQ ID NO: 146

SEQ ID NO: 1149 - DNA, 631 bp, Nicotiana benthamiana
ggaaatattattgggagagaggggaaatttcacctttggtttgaccccactcaagcttaccacaattatgctatcctttgggatcccaatgagatcatattttttgtcgacgatgttccaatcagaagataccctaggaaaaatgatgctacatttccacaaagacctatgtatgtgtatggttccatttgggatgcttcatcttgggcaacagaggaaggaagaattaaagccgattatcggtaccaaccattcgtcggaaaatataacaattttaaaattgctggttgcactgctaacgagaacccttggtgcggacgctcgccctccagctctccgtctagagctggtgggctgagccgccagcagatagcggccatgctatgggtgcagaggaactataaggtgtatgattactgtcgggaccccaggagagaccatacccacactcctgagtgttagtacaattcgtaaaaaatgcattatttgcataaaatttcatactgttagtgaatataagctgaaatcacgaataagaggaatgaaacgtgtaaaggaatatttggtcatttcaccagaattgactttcaattgtactttatctttgagtaaatgttttttgttttttaat

SEQ ID NO: 1150 - DNA, 575 bp, Nicotiana benthamiana
ttgagaaggaggttcctgccgatgaagacgagtctagtgatgaaaaggaaacatctgaaaccagtcctgaataataagatggagatgaatatgattctgagacggcagaagatgaagatgattctgagaaggcagaagatgagaagaagcctagaactaacaaggtgaaggaaaccacttatgagtgggagcttttgaatgatgcgaaagctatatggcttcggaatccaaacgaggtgacagaggtagagtatacacaattctatcactcacttgctaaggacttgagtgatgagaagccccttgcttggagtcactttaatgctgaaggcgatgttgagttcaaggctgtactatttgttcctcctaaggctcctcatgatttatatgagagctactacaactccaagaaatccaacttgaagttatatgtcagacgggtctttatctctgatgaatttgacgaattgctgcccaagtacttgaggttcctaatgggtcttgttgattctgacaccttacccctcaatgtctcaagagaaatgcttcagcagcacagcagcttgaagacaatt

SEQ ID NO: 1151 - DNA, 583 bp, Nicotiana benthamiana
caggcgtctctctcgtatctgagttcaagttccggcagtggatgcggcaaattcaaatttagatgttatgcaatagctacgcaagtgtatatacagcaaggagaacgatgatggtggatactggtgcaactgctaaaggaggacctgtcgttgatgtttcaccggagaaggatgataataatggtggtttcgctagcggaggatggaagagtgaagatggaagactgagttgtggttattcaagctttagagggaaaagagcaaccatggaggatttttatggcattaaaacttccaaagttgatggacaaacagtttgcttatttgggatatttgatggccatggggttcccgagcagctgagtttctgaagaaacatctctttgagaatctaatgaaacatccagagttcccaacaaacaccaagttggccataagtgaaacatatcaacaaacagacatggacttcttagattctgaaaaagataccttccgagatgatggttccactgcttcaacagcagttctagttggtaaccatctctatgttgccaatgttggagattcgcgaactataatatcg

SEQ ID NO: 1152 - DNA, 532 bp, Nicotiana benthamiana
tggagctatctttcagggggaaagggtttcatatcagaggaatgagtttctgtaaatgatggaatggggcgaactaaaaatggatttatggtttgggaattgaaaacccctagcagctatgttatgtgctcaagtcaacaaggtagtactagtaaccaaggatttcctgaattgggttctcaaaatttgatgagaaaaactatgtacagtgaccaaagtatttttggttcagtggcagctagtcctagtgcagcatattctggggaaaataaatctaagtctagttccaagttatcaagctcagttgtggaatcaaactctaaagattcatcactgattgatttgaagcttggaagatttcctgatcaaatagatgcaaatgtttacaaatctcccaagattatgcctaatgtctcttgtgctgagtccattgttccagccaagagaatgagagcaggaggtgtgaattcctatccattttgtcaggttcaaggttgtgggaaggatctcagctcttgtaaggattatcaca

SEQ ID NO: 1153 - DNA, 649 bp, Nicotiana benthamiana
cttttttctgaattctgtttgtagccatggcagaagtagaggctacgaaagtggagactgagaaagttgtggaccctactccccctgcacctgaggctcctgcacctgttaaagaagcagaacctgttgttgaaactcctaaagaagtggctgatgagaaagctatagttgcaccagctctgcctcctcctgaacaagtcaaagaaaaatccgatgattctaaagcactagttgtcgttgaagataaacctgctgaggagaaaaaggagggatctattgacagagatgctgtgcttgctcgagttgcaacagagaagagactgtcactaatcaaagcatgggaggaaagtgagaaatcaaaagccgaaaacaaagctcagaaaaatgtatcagcaattgctgcatgggagaatagtaagaaagcaaacctggaggctgagctaaaaaagatggaggagcaggtggagaaaaagaaggcagaatatattgagaaaatgaaaaacaaaatcgctctactccacaaggaagcagaggaaaagagagcgatgattgaagctaaacgtggagaagatcttcttaaggcagaggaattggcagcaaaataccgcgccactggaactgctccaaagaaactccttggatgtttttg

SEQ ID NO: 1154 - DNA, 345 bp, Nicotiana benthamiana
ggaaactacctaagcacaataatgtatcatggagggggagtggaggtatgcaagacggcaaatctgatgattcaaccatgtttaagaatttggttggtggctattatgatgcaggagatgcaataaaggttaacttccctcaatcttttgctctcactatgttaagttggagggggattgagtatagggcaaaatatgaagctgctggggagctctcatgtcaaagatattattaaggggggtactgattacctcctcaaaaccttcaattcctctgctgatactattgatcgcattgttgcacaggtggggaaaggggatacttcaggagggccagatcccaat

SEQ ID NO: 1155 - DNA, 310 bp, Nicotiana benthamiana
cggacgcgtgggcggacgcgtgggcgaaaatcctagcgccttcagcagcagttggtttgtgaaatggccaagtccaaaaatcacacagctcacaaccagtcgtacaaggcccacaggaatggcatcaagaagccaagaaagcaccgccattcatctaccaaagggatggatcctaagttcttgaggaaccagagatatgctaggaagcacaacaacaataagagtggtggatctgccgatgaagagtaaacaaatcacttaaaagtaaccatggctagcacttctttttgaatttgggattttttttctt

SEQ ID NO: 1156 - DNA, 114 bp, Nicotiana benthamiana
ggcggaaaaaggaggaaaagggttttctctaccaaaaaatggaaagtctgccctcaaatctcctgcatccaaagggaaggatgatatctcagcaaaatcgaaaagaggaaggaa

SEQ ID NO: 1157 - DNA, 114 bp, Nicotiana benthamiana; identical to SEQ ID NO: 1156

SEQ ID NO: 1158 - DNA, 626 bp, Nicotiana benthamiana
cgagaaactagccgcagaaaatgttcagtccctcttggaagagaaaaacaaacttataaatgagttggagaactccagggaggaggaagagaaaagtaagaaggcgatggaaagtttggcatcggcattacatgaagtttcttcagaagcaagagaagccaaagagaggtggttgtctagccaagctgaacatgaacattacgaaacacaaatagaagacttgaagttagtattgaaagcaaccaatgaaaagtacgaaagcctgcttgatgaagcgaaagagaaaattgatgatctcactaattcagtcgaacaatctaagaatgagcaccaaatttcgaaggctgagtgggaggacaaggagctttatctgatgaattatgtaaagaaaactgaagaagaaaactcttcaatggaaaaagaaataaaccgattggtaaatttgctaaaagaggctgagcaagaagcttctttcgaagaggaagcagttcagttgaagaattccctgaacgaagctgaatctgaggtgacctatctgaaagaggttcttggtgaagcaaagggtgagagcatgaagttgaaggagtcgctgttggacaaggaaaatgaagtgcagaatattcttc

SEQ ID NO: 1159 - DNA, 193 bp, Nicotiana benthamiana
ttacaatgataatggctttttagaagaactattatctctaagaaatgactcatgggatactactacaacacttgttcctatggaaatgacagatttttacaactttgaatctttaaactctcttgatattccacttccttgtgcttctactactattactacctctaattcctttgaagactactcatatgat

SEQ ID NO: 1160 - DNA, 881 bp, Nicotiana benthamiana
aaatcccattgagacaacgtataaattacaacaaaaatcatcactggcaacggcaaataaacaaactaattcctacttctctacttgttccaaatttatcaaaagctttggaaggccaaatccgcctccttttttggattgccaaaaccatgccacatctaagaggcaaaacaacatgaattcgtactgttcaatttcatgaacaattttatactctacaaaagcatcttacttctgggggaatctatgtagatgctttatcttggccatgtttttctgtgaccacattttctgcgcttattagtttctctggctgatgcttctcaagaaaagcttgtttctgcaagatattcatcatctcctttgttctattctcctctccttcaagctgcattttcactattgcttctgcttccttatttattggtttgaagtagtcatcaacagcagcctcagtctcctctagcttcttcttcaaagcttgcatctcttccaccattcgcctaacttctgacaatatcatctgttcaggaaccttccttattgctgccttcctctcctccgcctgtttaaggcgttgttgcatctgtaatcgataagatcggattcgacgctcttcgtagcctgaaagaaccctaatatagaacattgctttcctcccaaattctagaagcttcttcatcctaggtaatcaagtttcagtttccaatattatatccagaaagcgtgaaacgattagcagctttattttcttcacgtttgaagaattggattcatagtcgagctgaagctgaagaagcctcgctttcagttgttgctcggctgcgtttcgtgcctgctccctttcttcgttcttttttttcttccccggccgtaatggc

SEQ ID NO: 1161 - DNA, 630 bp, Arabidopsis thaliana
cccacgcgtccgaaaatatcccaaaaccaaaaacagaggaagaaagaagaagaaaagatgccttcaagcacattctccgggactgttagcacgccgaagctgtcggtggcagtggacatgggaaacccttttctcaatctcaccgttgatgccttcctcaagatcggagctgttggagtcactaaatctcttgcagaagacacttacaaggccatcgagaaagggagtctctccaagagcactttggagcatgcgcttaagaagttgtgtaaagaaggtgtttactggggagctgctggtggagtgtacattggaacagaatacggaatcgaacgtatccgtggcagcagagattggaaaaacgcaatgttagcaggcgcggcgacaggagcagtgctctcagcggttggtaagaaaggcaaagacactattgtgatcgatgccattcttggtggcgcgcttgcaaccgcttctcagttcgttaacaatcattatttctactgattctccatcttcctttagggaccaatttggttcatatggtgtggattcctttgtttactctttaaataataataaaaaacaatgtagtgtttttgaaatgaatacattcgagtattgttgacgtta

SEQ ID NO: 1162 - DNA, 895 bp, Arabidopsis thaliana
cccacgcgtccgcatttttccatcttcctcatcaccttcccaagaagaagaacaccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttgaagtcaaattaaaaggataagtggtatcgattatatatttgattaacacattgattggtgttaattgctcttttttttcttacgatgaaatacattgttcagtttcttttgattgtctgtgttttgatc

SEQ ID NO: 1163 - DNA, 146 bp, Nicotiana benthamiana
tagcttctcatttcaccattttcttaacatcccctacatttcaattagttttttatatgactatttgggatataattatatcaaaattataagcacggggcttgtcagcactagcaatggctcatattaagatgttgatatgggca

SEQ ID NO: 1164 - DNA, 608 bp, Nicotiana benthamiana
tccgaaggaaaggaggtgttgtacgactatgaagataaaattaaggaggcagtctttcctggacttcaaggtggtcctcacaatcatacaattactggcttggcagttgctttgaaacaggcaatgactccagaatacaaagcttaccaagagcaatgccttagcaactgctcaaaatttgcccaggcgttagcgggaatgggttatgaacttgtttctggtggaacagagaatcacttggtcttggtgaacttgaaaaacaagggtattgatggctctagggttgaaaaagttttggaagcggtacatattgcagccaataagaacactgttcctggagatgtatctgccatggtccctggtggcatcagaatggggactcctgcactcacatcaaggggatttattgaggaagattttgtgaaagttgctgaattctttgatgctgctgtgaagatagcagtgaaaataaagggtgaagctcaaggaacaaagttgaaagactttgtgacaacactgcagtctagtgcttccatccagtcggagattgcaaaactccgccatggtgtggaggagtatgcaaagcagttccctacaattgggtttga

SEQ ID NO: 1165 - DNA, 504 bp, Nicotiana benthamiana
gccattacggccgggataactagagagaaaaatggctttgagaatgtgggcttcttcaacagccaatgcattgagagtttccactgcctcaagagctaatctttcccctgcttattcactctctagatgcttttccactgttcttgatgggttgaagtatgcatcttcacatgaatgggtgaagcatgagggctcagtggcaacagttggaatcactgaccatgctcagggtcatcttggagaagtggtgtttgtggatctaccagaaactggtgctgctgtttcacaaggaagcagttttggtgctgttgaaagtgtgaaagctaccagtgacattaactgtccaatctcggacgacatcggtgaggtcaatacaaagctaactgaaacacctggtttggttaattcgagtccatatgaagacggctggatgattaaggcgaagccgagcagtccatccgagctagaatcattgatggggtccaaagagtacacaaaattctg

SEQ ID NO: 1166 - DNA, 1110 bp, Artificial
  Synthetic
acgcgtcgcgattctaacggaggaacagtggcggccctgtgattgtgattagggttctagcgatcgatcgattgagggtgctgtagcgcgctggtcgcggcaacgattgttcttcgcctttgccgctatggcggaaaagaagaaggccaagaccgacaccgaagaggtggcggaggacaatgagctggttagcgccatcgagaagttgcaggatgtacaggacgagttagagaaggtgaatgaagaggctagcgacaaagttctggaagtagagcagaagtataacgaaatccggcggccagtctataacaagagaaacgagatcatccaaagtataccggacttctggctcactgctgtaattcttgagccatccagttctatgcgaacttctaaccgaggaggaccaaaaggtgttcaagcatctccagtcattagacgtagaggatttcaaagacgtgaagtcgggatactgcatcactttctcgttcaaaccaaacccatacttcgaagatactaaactagtgaaggtgttccggttctccgacgaaggcacaacctcgatctcggggacgacgattcggtggaaagacggaatggatttaacaaatggaccagaggcggaaaaggaaggcaacaaaaggcctttagtggaagagagcttcttcaagtggtttaacgatagccaacagaaagaaactgccgaaggcctccaagacgaggtcgcggatgtcatcaaagaggatttgtggccgaatcccttgaagtacttcaacaatgaaggggattcggaatacgaagaggacgaagatgaagaagatgacggacaggggacgaagcggcccgccgatggttttgaagaggatgaggaagagcccgacgacgacgatggtgaatgctgaaagccttgtttatagcagagaaaccaaaagttccagttccttccagctcgtttccagatgaccgtattaacacagtacgtttttcgtgagagaagatattagtcttttgaaagcaaacgaaggatttttccgtgtagcgctctcgctcgagatgttttttttttctagttcttttatattaactttagttgaagatagttgatgtttc

SEQ ID NO: 1167 - DNA, 630 bp, Artificial
  Synthetic
agaatgtacctattggtagtaaataaactaaatattccaaaagagaaagcttactctcatcattgctaaaattgagaacctcataacacaaactttacacatctgttatagaagcaagccagcaatgtgttatctttgggctcccatcattcctcaccatcttcctcctcttcatcgtcatcgtcttcttctccctcttcgtcaccatcatcatctccatcaaaatcctcttcatcagcatcattgttgaagtaggtgagagggttggaccagagatcttccttgataatatcagcaacctcatcatgaatctcatccccagcatcttccttatgttgagcatcagtaaaccaagtaaagaaactctcctctggcaatgcacgtttatttcctttcttatcatcatggttcactccatttggcaagcccttgccctccttccatttgataggagttgcagtgatttttgttgttccttcttcaaggaaagtaaatgtcttggtaagcttggcatcctcaaagaacgggtttgaagtgaagtgaaaagttatagagtatccagatttcacatctttggcatcctccacttccagagagttcaagtacttaaaaatcttttggtcttcttca

SEQ ID NO: 1168 - DNA, 738 bp, Artificial
  Synthetic
agtagcactccaacaaagagcacttctgcacttgcaagctctgttgcctatttttccagagaagagaaaaatatgggtgctgacaaagggaagaagcaaaaagttgatgaagagaacaacatcattgatggtgagctcgttttttccattgagaaattgcaagaaatacaagacgagcttgagaagatcaatgaggaagcaagtgataaagtattggaagtggaacagaagtacaatgagatccgcaagcctgtctatgacaaacgaaatgacatcattaaagctatcccggacttctggttgactgcttttttgagtcatcctgtcctaggtgagcttctaactgaagaagaccaaaagatcttcaagtttctaagttctattgaagttgaagactctaaagatgtgaagtcgggctactcgataacctttaacttcaatgcgaatccttattttgaaaatacaaagctggcaaagacctataccttccttgaagatggacccacaaagatttctgctacaacaataaaatggaaagaaggcatggccattcctaatggagttgcacatgagaagaaaggaaacaagcgatctcatgctgaggaaagcttcttcacatggttcagtgaagtcaatcaaaaagatgaggatgaggatgaggccctagagattcaggatgaggtcgctgacataattaaggatgacttgtggccgaaccctctcacctattttaataac

SEQ ID NO: 1169 - DNA, 285 bp, Artificial
  Synthetic
atagcacttttgtacttgcaagctctgttgcctatttttgcatataagagaaaaatatgggtgctgacaaagtggaagaagacaaaaagttgatgaatagaacaacatcattgatggtgagctcgttatttccattgcaaaatggtaagaaatacaatactatcttgagaagatcaatgaggaagcatgtgataaagtattggaagtggaacagatgtacaatgagatccggaagcctgtatatgacaaacgaaatgacatgattaaagctataccggacttctg

SEQ ID NO: 1170 - DNA, 601 bp, Artificial
  Synthetic
aggaaggaaggctaaaaccctagcgagcgcgcgagcgagcgagggctctctgcttccttgcgatgacggcgccggcggacaaggggaagaaggccaagaccgacgccgacggcggcgccgccgaggagaacgagcagatcgacggcgccctcgtcctctccatcgagaagctccaggagatccaggacgagctcgagaaggtcaatgaggaagctagtgacaaggttttggaggtcgagcagaaatacagtgagattcgcagacctgtctatctccgaaggagtgacattatccaaacaatccctgacttctggctgacagcgtttctgagtcatcctctacttagtgagcttttgaccgaagaggatcaaaagatgttcaagtacctggagtctgtcgatgtggatgattctaaagatgtcaagtcaggctactccataactcttaccttctccgagaacccgtactttgaagacaaagagctcacgaagacatatgccttcgctgatgacggaacaaccacaataaatgctacttgcattaagtggaaggaaggaatggaaattgcaaatgggaatgccaagaagaaagggagcaagcg

SEQ ID NO: 1171 - DNA, 697 bp, Artificial
  Synthetic
tgctagtggtgctatcgttgtaaagggaagatggctcaagcagtagcgatggccgggctttgctcatccctctcctcggccgcttcctcgctcgacggggccggctctcgcctcttggcctcctccccttcttcctctgccccctctaaaccatcccttcgcctccctttaatccgcgctagctcgtcgaatccctcagaagacgcttctgctaaatctagtactagacgccaaatcttgtccctcgttgctgtctctgctttgcttgtctctaaacaagccctcgccgaccctagccctatcaagctctttggccctcccgccccttctggtggcctccctgggactgaaaatgccgacgaagctcgagatctagacttgccattgaagaatagattttacctgcaacctcttcctcccgtggaagcgatcgccagggcgaaggaatctgccaaagagattgtgaatgtgaaggcattgatcgacaagaaggcttggccctatgtccagaacgggctccgatcacaggcttcctacctgcgctttgacctcaacactgttatcgcttccaagccgaaggatgaaaagaaagctctcaaaagccttagcactaagctctttaacactatcaataatctggactatgctgctagaagcaaaagtaccacccaggcggagaaatattatggagaaactg

SEQ ID NO: 1172 - DNA, 869 bp, Artificial
  Synthetic
gtaccacaacattaacttataatttcccccacgctacttctatcaccctgcctaaaacaaatttcagaaggttcaccaaaatggctcatgctatggcttcaatgggtggcctaattggttcttctcaaactgtgttggatggtcagctctgtggttcagcccgtttgagcactgttagcaccagcagaattgccttggctagaccaggtctcagcattagagcccaacaggggtctgctgacactgaaactagccgtagagccgtcatcggtcttgttgctgctggccttgctggttcctttgctcaagcagcctttgctgcagctaaatcaatcaagattgggggcgctcctcctccctctggtggattacctggaactttgaactcggatgaggcaagggactttggtctaccattgaagaagaggttttaccttcaaccattgactccagctgaagcagcccagagagttaaggattcagccaaggagattgttagcgtcaagaatttcatcgacaagaaggcctggccatatgtccagaatgaccttcgtctcagagcagaataccttcgctatgaccttaaaaccgtcatctctgctaagccaaaagaagaaaagggaaaactccaggacctgactggaaagctcttcaagaccattagtgatctggaccatgcagcaaagaccaagaacagccctgaagcagagaagtactatgctgaaactgtatctaccttaaatgatgttttggccaaacttggttaaaaagcttttctgaactagtatgttattacttcctgtaacttatcgaatacttcttgaatccaattgtgaagaatgattttggaaaaattgtttaaaaatccg

SEQ ID NO: 1173 - DNA, 356 bp, Artificial
  Synthetic
tggtatcaacgcagatggccattacgccgggggcctgaaacaaatttcagaaagttcaccaaaatggctcatgctatggcttcaatgggtggcctaattggttcttctcaaactgtgttggatggtcagctcagtggctcagcccgtttgagcactgttagcaccagcagaattgccttggctagaccaggactcagcattagagcccaacaggggtctgctgacactgaaactagccgtagagccgtcatcggtcttgttgctgctggccttgctggttcctttgctcaagcagcctttgctgcagctaaatcaatcaagattgggggcgctcctcctccctctggtggattacc

SEQ ID NO: 1174 - DNA, 414 bp, Artificial
  Synthetic
cggacgcgtgggtgccaccaacagattctgcagctagagttttaagaatctgcaaaggatatcataaatgtgaagccattgatcgacaggaaagcttggccatatgttcaaaacgatcttcgttccaaggcttcttatcttcgttatgatcttaacacaatcatttcctccaaacccaaggatgagaagaagtcactcaaggatctcaccaccaagctcttcgataccatcgacaatctggattatgcggcgaagaagaagagtccttcgcaggctgagaagtactatgctgagatagtctctgctttgaacgaagttcttgccaagcttggttaagcattttaatttctgcatttttcttgtaaattattattcttggtttttggtcttgagtactttagactcaaattcgtg

SEQ ID NO: 1175 - DNA, 684 bp, Artificial
  Synthetic
attttggttgctgaaaaaaagaagcatttgctgttggaaaaacctactgctttgaatgtaagtgaactggataagattgttgaagcttgtgaaagaaatggtgttcagtttatggatgctagtatgtggtatcatcatcctagaactgctaaaatgaaggagttcatttctgatcctaatctctttggacaagtcaaagcaattcacagctcatcatcatattcacctggtccggtatttcttgaaaacaacatcagagtaaagccagacttggatgcccttggggcgctgggagatgcgggttggtactgcattggcgcaatattatgggctatgaaccaaaacctgccaacaactgtgacagcactgcctactgttgcaagaaactcggctggcgttatcttgacatgcagtgcctccctgcattgggaaaaagaggaaactgtcgctacattttactgctctttcgtttcacatgaaacgatggacttgatagtttatggctccaacggtaccttttatctctacgacttcattatccccatggacgagaactctgcttcgttcagctttacttctggtgccaagttcgtggatcgccatatcggatggaacatgaaacctcgggcagttgaagtaacttctaagtttccgcaagaggcttctatgattcaagaattttct

SEQ ID NO: 1176 - DNA, 294 bp, Artificial
  Synthetic
tggtatcaacgcagagtggccatacgccgggggtatcatcatcctagaactgctaaaatgaaggagttcatttctgatcctaatctctttggacaagtcaaagcaattcacagctcatcatcatattcacctggtccggtatttcttgaaaacaacatcagagtaaagccagacttggatgcccttggggcgctgggagatgcgggttggtactgcattggcgcaatattatgggctttgaaccaaaacctgccaacaactgtgacagcactgcctactgttgcaagaaactcg

SEQ ID NO: 1177 - DNA, 1044 bp, Artificial
  Synthetic
atactaggttgcgctaacatagctcggaaactatcacgctgccatcgcgcttgctccaaacgccactatctccgccgtcgggagccgtacgatcgaaaaagcaacagcgtttgctaaggaaaacggctatccgtcgactacaaagttatacggcagttatgaggctgttctggatgatacggaaattgatgccgtttacatacctcttccgacaagcctgcatgtgaagtgggctgttttggcggcccagaaaaagaagcacgtttagctggaaaagcccgtcgctttaaacgtgaaggagctggatacgattttggaggcgtgtgaattgaatggggtgcagtacatggatgctaccatgtggatgcatcatcctcgtagtgttaagatgaaggagttcctctatgattctcagcgttttggccaactcaaatcggtacacagcacttttgcttatcttggtgaccaagagtttctaaagaatgacattcgtgtgaaagccgaccttgatgctctaggtgctctaggcgatgctggttggtacagtattcgtgcgatcttgtggactactgattatgaattgcccaaaactgtgacggctctgcctgatccagaattaaatgaagctggagttatcctatcctgtggtgcttctttgagttggaaagacggaagggtagcaactttctattgttcgtttttagccaatttggtcatggatatcgctgctaatggatccaaaggaaatttgcgggtgcatgactttgtaattccgtttcaagaaaatgttgctccattttacacggtggaaagttcgaggtttggtgaactttctatatcgattcatcctgcaccaaatgagcaaatagtaagcactgatctcccacaagaggctctcatggtaaaggagttctctaatctggtccgaagtatcaaaggggaaggttgtaaacctgagaagaagtggccaacaattagtagaaaaacacaacttgtggtggatgctgtcaaggcgtcaattgacaagggttttgagcctgttga

SEQ ID NO: 1178 - DNA, 613 bp, Artificial
  Synthetic
gtagattgacaatggcctcttgtctgtcagtcctgttgctcttgtgtctagcacttgcaggttcagtctccgggcaacaactgtcggctacattctattcgaggtcgtgcccgagagctctggccatcatcagggccggcgtgagagctgcggtggcgcaggagcctcgcatgggggcgtcactgctcaggcttcacttccatgactgctttgtccaagggtgcgacgcgtccgtactggtgaacgacacggccaacttcaccggcgagcagggggcgaaccccaacgtcggatccatcagaggattcaacgtcgtcgacaacatcaaggcgcaggtcgaggccgcgtgcaagcagaccgtctcctgcgccgacatcctcgccgtcgccgcccgcgactccgtcgtcgccttgggtgggccgtcatggagggttcttctcgggaggcgtgactcgacgacggcgagcttggcgctggcgaacagcgacctgccacctccgtccttcgacgtcgccaacctcaccggctcgttcgccgccaaggggctgagccaagccgacatggtggcgctctccggcgcgcacacggtcgggcaggcgcagtgccaaaactt

SEQ ID NO: 1179 - DNA, 578 bp, Artificial
  Synthetic
ggcctgcccggggaccgtctcctgcgccgacatcctcgcgctggcggcgcgcgacctcgtgggcatcctcggcgggccccggttccccgtcgcgctgggccgccgcgacgcgcgccggtccgacgcgcgcgacgtcgaggggaacctcccgcgcaccaacatgtccgcgcgcgccatggcggtgctgttcgcgcgcaaggggttcacgccgcgggagctcgtggcgctcgccggcgcgcacaccgtggggttctcccactgcggcgagttcgcgcacaggctgtacagcttcaggagcgccgacgggtacgacccgtcgctgaacccggcgttcgcgcgcgcgctgcagagctcctgcgccaactacaggagcgacccgaccatctccatcttcaacgacatcatgacaccgggcaagttcgacgaggtctacttcaagaacctgccgcgcgggctcggcctgctcgcctccgacgccgcgctgtgggagtacccggcgacgagggtgttcgtccagcgctacgccgacaaccggacgggcttcttcgaggacttcgccgcggcgatgcaaaagctcg

SEQ ID NO: 1180 - DNA, 674 bp, Artificial
  Synthetic
aattatatagggttgtgatgcatcactacttctggacagtagtggaaccctaataagtgaaaagatatcaaacaccaacaggaattcagctcgtggatttgaagtaattgacgagattaaatcagcagttgaaaaagagtgccctcaaactgtttcttgtgctgatatcttggctcttgctgcaagggattctacagttttagctggtggaccaagctgggaagttccattgggaagaagagactccagagatgctagtataagtggctccaacaataacattcctgctccaaacaacaccttcaataccattctcacaaaattcaagttgaaaggacttgatcttgttgaccttgttgctttatcggggagccacacaattggaaatgcaagatgtaccagcttcaggcaaaggctctacaatcaatcaggcaacagtttaccagactatacattggatcaatcatatgctgctcaattgcggacaagatgccctaaatctggtggtgaccaaaacttatttttcatggattttgtttcccctacaaaatttgacaactactacttcaagaacttgttggcttcaaggggcttgtttaattcagaccaagttcttgtgactaaaaatcaggcaacattagccttggtgaaactgtatgcagaaaacaatgaca

SEQ ID NO: 1181 - DNA, 691 bp, Artificial
  Synthetic
gaagcctctgtttctttggcaggtggtcctacgtggaatgtttcattagggagaagagacagtagaacagcaaaccagggaggagccaatacttctattccttctccttttgaaggcttaagcaacattacaacaaagttttctgctgttggccttaacgttaccgatctagttgccttatctggtgcacacacctttggacgtgcccaatgtcgcgcattcagtgcccgtcttaacaattttaatggcacaggaaatcctgacccaaccttaaacacaacttttttggccaacctaaggcaaatatgtcctcaaaatggaaatgcctcagccttggctaaccttgatcctacaaccccggatacttttgacaataattatttcacaaatttgcagaataatcaagggcttctgcaatcagatcaagagttattctccacacctggtgcagcaactgtctcaattgtcaacacatttagcagtaaccaaaatacattttttcaaagcttcgttcagtcaatgattaatatgggaaatattagcccattaactgggaccagtggcgagattcggtcagattgtaaaagagtcaattgaagcaaaagttttggctaaatgtatttttgtttctgaagcaaagtttggtaagccaagtctgcacgttttgttatgaacaaagttcttaatttgc

SEQ ID NO: 1182 - DNA, 738 bp, Artificial
  Synthetic
tggtatgaacgcagagtggcattacggccggggaaaacaaaaactcaaaacttcacatctttagtagtagcatcaatattcaagatggttctccaaactcaacttgggctgaacaagcaccaatcctacgctcacgaacaaaactactattgcgatagcagccatggcggctctatgcaaatgacaaggccttcgggctattcgaccttgccatatggtcagtccactcacaaccacatgatgatgggtcatggtggccaacaccatggcggaccctatggcggtcatggccatggccatggcggacactatggtagtcatggacatcatggggcgcatatgccccatgactccaccaacttttcaagcagcaccaatatggtccatagtgatggtggctatggaagtggaatggaacaatctacccatatgggcatggggtcgaccaattatcaaggccatggttatggtggcagccaccctagtcagtacagccagagccagaagctcaactgggcacttaaggatttggaggaataaatttatgataaattttatgctatcctgtatggtggaagtatgtgtgtgtgttttggtagtggatttgcctatatatgtagcataaagaactactacctgaagaaataatgtactaagcagtctgctggtttgcttgtttatctatgtatctactttatcattactaaatgatgaataattataagtatgtttataact

SEQ ID NO: 1183 - DNA, 340 bp, Artificial
  Synthetic
tggtatcaacgcagagtggccattacggccggggaccaagcaaaaactcaaaacttcacatctttagtagtagcatcaatattcaagatggttctccaaactcaacttgggttgaacaagccccaatcctacgctcacgagcaaaattattattccgacggcagccatggcggctctatgcaaatgacaaggccatcgggctattccaccatgccatatggccagtccactcacaatcacatgatgatgggtcatggtggccaacatcatggcggacactatggtggtcatggccatggctacggcggtcatgaacatcatggggcgcatatgccccatg

SEQ ID NO: 1184 - DNA, 705 bp, Artificial
  Synthetic
aaaactcaaaacttcacatctttagtagtagcatcaatattcaagatggttctccaaactcaacttgggttgaacaagccccaatcctacgctcacgagcaaaattattattccgacggcagccatggcggctctatgcaaatgacaaggccatcgggctattccaccatgccatatggccagtccactcacaatcacatgatgatgggtcatggtggccaacatcatggcggacactatggtggtcatggccatggctacggcggtcatgaacatcatggggcgcatatgccccatgactccactaacttttcaagcagcaccaatatggtccatagtgatgctggctatggcagtggaatgcaacaatctacccatatgttgtcagccatgggcatgggatcgaccaattatcatggccatggttatggtggcagccaccctagtcagtacagccagagccaaaagttcaactgggctcttaaggatctggaggaataaatatatgataaattttatgctatcctgtatggtgaaagtatgtgtgtgttttggtagtggattttgctaattatatagcatgaagaaactactacctaaataagtaataatgtactaaacagtctgctgctttacttgattatcaatgcatctacttatcattactaaatgatgaataaaaaataaaagtatgtttataacgaa

SEQ ID NO: 1185 - DNA, 921 bp, Artificial
  Synthetic
taaatcttgctgcgatctgcacgccagctgattataatgctcgtccacttgacacaatctacagcaacttcattgacgctttaccagtggttaaatactgctcagaaaatggaaagcgtctcattcacttttcaacttgtgaagtttatgggaaaaccataggtgcctttttacccgaagacagcccattgcgacaggatcctgcttactacgtccttaaggaagatgtctctccttgtatttttggatctattgagaagcaaaggtggtcctacgcatgtgcaaagcaattgattgagaggttgatctatgctgagggtgctgagaatggcttagaattcaccattgttaggcccttcaactggattggtccgaggatggatttcatacctgggatcgatggtcctagcgaaggtgttccgagagtgttggcttgctttagtaataatcttttaagacatgaaccactaaagctagtggacggtggacactcacaaagaaccttcatatatattaaggatgctattgaagctgttctcctgatgattgaaaatcctacacgggctaatgggcagatctttaatgtcggcaatcccaataatgaagttacagttaggcagcttgctgaaatgatgactcagatgtattcaaaggtgagtggagaatctcctcctgaaacacccaccattgatgtaagttctaaagaattttacggcgaggggtacgatgacagtgacaagcgaattccagacatgaccataattaacagacagctcggttggaacccgaagacatccctatgggacttgcttgaatccacgctgacataccaacataggacttatgctgaggctgtcaagcaggcaatgtcacagacaactggaaattgaatttgaaatcagagcagtggttagtgtgtgc

SEQ ID NO: 1186 - DNA, 709 bp, Artificial
  Synthetic
atagcccattgcggcaggatcctgcttactatgtgcttaaggaagatgcctccccttgcatttttggatctattgagaagcagaggtggtcatatgcctgtgcaaagcaattgattgagagattgatatatgccgagggtgctgagaatggcttagaattcacaattgtaaggccgttcaattggattggtcccaggatggatttcatacctggcattgatggtcctagtgagggtgttccaagagtgttagcttgctttagtaataaccttttaagacgtgaaccactgaaactagtcgacggtggggaatcacagagaacttttatatatatcaaggatgctattgaagctgttctcttgatgattgaaaatcctgcaagggcaaatggccacatttttaatgtgggcaatcctaacaatgaagttactgtgcggcagctggctgaaatgatgactcaggtttattcgaaggtgagtggagaatcttctcttgaaacgcccaccgttgatgtaagttctaaagaattttatggagaggggtacgatgacagtgacaagagaattccggatatgacaataatcaacaaacagcttggctggaatccaaagacatccctatgggacttgcttgaatccacactcacctaccaacacaggacatatgctgaggttatcaagcaggccatgtcaaagacgactgcaaattg

SEQ ID NO: 1187 - DNA, 692 bp, Artificial
  Synthetic
actcgaccacttgatacaatttacagcaatttcattgatgctctaccagtggttaagtactgctcagaaaatggaaagcgtctcattcacttttcaacttgtgaagtttatgggaaaaccataggtgcatttttacccaaagacagtccattgcggcaggatcctgcctgctatgtgcttaaggaagatacctccccttgcatatttggatcaattgagaagcagagatggtcctacgcatgtgcaaagcaattgattgagaggctggtctttgctgagggtgctgaaaatggcttagagttcaccattgtgaggccctttaactggattggtcctaggatggatttcattcctggcattgatggtcctagtgaaggtgttcccagagtattggcttgctttagtaataatctttttagacgtgaaccgttgaaacttgtggatggaggagaatcacaaaggacgttcatatatataaaagatgctattgaagctgttcttctaatgatcgaaaatcctgcaagggccaatggccatatctttaacgttggtaatcctaacaatgaagttactgtcaggcagctggctgaaatgatgactcaggtctactcaaaggttagtggagagtcttctattgaaacacccaccattgatgtaagttctaaagaattttatggcgaggggtatgatga

SEQ ID NO: 1188 - DNA, 889 bp, Artificial
  Synthetic
gctcgtggaaatggcttgctgtgtgtgcatcgatcaggctagcgtcgggatcctggagaaatggggcaagttcgtgcgcgtgctggagcccggattcagctgcgtcgtgccgtgctttggccagttcgtggctgggacgctgtccctcaaggtgcagtacttggatgtgcggtgcgagaccaagacaaaggacaacgtgtttgtgtccctcgagtgctccatccagtaccgcgtggtgcgggagaacgcggacgatgctttctacgagctgcaaagccccgagcaacagatacgttcctacgtcttcgatgtgatccgggcgtctgttcccaagatgtcgctggacgaggtctttgagcagaagagcgacattgcgaaggcggtttcggatgagctagagaaggtgatgagcgcgtatggttactcgattgagcagatactcatcatcgatattctccctgatgctgcggttcggaaagccatgaacgagatcaacgcagcccagagaatgagaatggcggcagtcgagaaaggagaggctgagaagatcctgcaagtcaagagggccgaagccgaggccgagtccaagtatttgtcggggctgggagtggccaggcagcggcaggctatcaccgacgggctgagggagagcgtgctgaccttctcgcaggatgttcccgggacttctgccaaggaggtgatggaccttgtcatgatcactcagtacttcgatacccttaaagacattggtgccagctccaaaaacactgctatgttcatacctcacggacccgcgcacgtcaacgacatcgcccagcagctccgggacggggttctgcaagccaacactgctgcgtccttgatggattgaatggaatctcatgcttat

SEQ ID NO: 1189 - DNA, 823 bp, Artificial
  Synthetic
gggagcaaatgggtcagtcgctttgctgcttccaggtcccccagtccaaggtggcgatcaaggaacgatggggcaaattcgacgaggttctagatcctggatgccacttcgtcccctggtgctttggcagcaacattgccggctctctcaacctccgcatccagcagctggatgtgcgctgcgagaccaagtccaaggataacgtattcgtcacggttgtagcttcggtccagtatactgttgtccaggccgacgccatggatgcatactacaagctgtctaacccgagggaacaaatccaagcttatgtctttgatgtcgttcgtgcttgcgttccaaagatgaacttggacgatgtgtttgaacagaagaacgaagtagccaaggctgtcgaggacgagctcgaaaaggcaatggctacatacggatatcgcatcgtccagactttgattgtcgacgttgagccggacaaacatgttcgcaacgcgatgaacgagatcaatgcagctgcgaggatgagggtggcggccaacgagaaggccgaggccgagaagatcctccaggtgaagcgagccgaggccgaggccgagtccaagtacctctcgggagttggtgttgcgaggcagcggcaggcgatcgtagatggcctccgcgagagcgtcttggcgttctcgcacaatgttccagggacgagtgccaaagacgtgatggacatggtgctactgacgcagtatttcgacaccatgaaggagattggcgctgcttccaagtcttccaccgtcttcctcccgcatggaccaggcgctgttcgtgacgtcgcgga

SEQ ID NO: 1190 - DNA, 699 bp, Artificial
  Synthetic
ggcttgctgtgtgtgcatcgatcaggctagcgtcgggatcctggagaaatggggcaagttcgtgcgcgtgctggagcccggattcagctgcgtcgtgccgtgctttggccagttcgtggctgggacgctgtccctcaaggtgcagtacttggatgtgcggtgcgagaccaagacaaaggacaacgtgtttgtgtccctcgagtgctccatccagtaccgcgtggtgcgggagaacgcggacgatgctttctacgagctgcaaagccccgagcaacagatacgttcctacgtcttcgatggtcagtatctcatatacgtcggtagtctaggcccattgtgatatgttactggcagtgatccgggcgtctgttcccaagatgtcgctggacgaggtctttgagcagaagagcgacattgcgaaggcggtttcggatgagctagagaaggtgatgagcgcgtatggttactcgattgagcagatactcatcatcgatattctccctgatgctgcggttcggaaagccatgaacgagatcaacgcagcccagagaatgagaatggcggcagtcgagaagggagaggctgagaagatcctgcaagtcaagagggccgaagccgaggccgagtccaagtatttgtcggggctgggagtggccaggcagcgacaggctatcaccgacgggctgagggagagcgtgc

SEQ ID NO: 1191 - DNA, 556 bp, Artificial
  Synthetic
caaaggacaatgtatttgtcaatgttgtcgcatcaattcagtatcgtgccctggcggacaaagcaaatgatgctttctacaaactaagtaacactaagggtcaaattcaggcttatgtttttgatgtcataagagcaagtgttccaaaactcaatctggataatgtctttgagcaaaaaaatgaaattgctaaggctgttgaagaggaacttgagaaagctatgtcagcttatggatatgaaattgttcagacacttatagttgatatagtaccagatgagcatgtgaagagggctatgaatgaaatcaacgctgctgctaggttgagggtggctgctaatgagaaggcagaagctgagaagattttgcaaattaagagggctgaaggggaggccgagtctaagtatctcgcaggcttaggtattgcacgacaacgtcaagcaattgtggatggtctgagagacagtgtgctaggattttcagtcaatgtgcctggaactagtgcaaaggatgttatggacatggtcctcgtaacccagtactttgacacaatgaa

SEQ ID NO: 1192 - DNA, 386 bp, Artificial
  Synthetic
cccacgcgtccgagcatatctaatcggagctcggagaaatttcggttgtgaagagaagaaagatggggaatttgttttgttgtgtgcaagtggatcaatcaacggtagcgataaaggaaacattcgggaaattcgaagatgttcttgagcctggttgccattttcttccatggtgtcttggtagtcaagttgctggttacctctctctaagggttcagcaattggacgttcgttgcgagacaaagactaaggacaatgtgtttgttaatgttgttgcatcgattcagtaccgtgctttagctaataaggcaaatgatgcgtactacaagctcagtaacacaaggggtcagattcaagcttatgtgtttgatgttattagagcgagt

SEQ ID NO: 1193 - DNA, 665 bp, Artificial
  Synthetic
ggaaatggcttgctgtgtgtgcatcgatcaggctagcgtcgggatcctggagaaatggggcaagttcgtgcgcgtgctggagcccggattcagctgcgtcgtgccgtgctttggccagttcgtggctgggacgctgtccctcaaggtgcagtacttggatgtgcggtgcgagaccaagacaaaggacaacgtgtttgtgtccctcgagtgctccatccagtaccgcgtggtgcgggagaacgcggacgatgctttctacgagctgcaaagccccgagcaacagatacgttcctacgtcttcgatggtcagtatctcatatacgtcggtagtctaggcccattgtgatatgttactggcagtgatccgggcgtctgttcccaagatgtcgctggacgaggtctttgagcagaagagcgacattgcgaaggcggtttcggatgagctagagaaggttgtaaaaaggtttcctatattgctctcgctcacaattgtcaaacaggtgatgagcgcgtatggttactcgattgagcagatactcatcatcgatattctccctgatgctgcggttcggaaagccatgaacgagatcaacgcaggtaagcttctgatgtacgaagtttccgcaactttcctctctttttctttcaaaacagcccagagaatg

SEQ ID NO: 1194 - DNA, 623 bp, Artificial
  Synthetic
gaattagtccccaggaaaatatagaggcataggtcaaaaatattaccccttttcggattgtgaacttggggtgttcaagtgtaattttttaacttggagtgttccagtcagattcatacgacaaattttcttgactaagggtgtgtttggtatgaaggaaaatgttttcattggaaaatgttttctttgaaaatgaatggtgtcgagaaaatttgtcatattaatctgagatagtctaggttgctggttgataacgacaagttccttaggtttaatgtttcatgggttacttttgtggatcatctttcttttaatgcgatatttacagagcatgggcaacatgttgtgctgcgtaaaagttgatcaatccacggttgcaattacggagcagttcggcaagtatcaaaatgtgcttcagcctggttgccactgtctcccttcgttcctgggatttaaggtagctggtcatctctccctcagggtacagcaactggatgttcgctgcgataccaagacaaaggataatgtatttgtcaatgtagtggcatcagttcagtaccgtgctcttgcaaacaaagcaaatgatgctttctacagactaaccaacactaagggtcaaattc

SEQ ID NO: 1195 - DNA, 697 bp, Artificial
  Synthetic
gtaaaaacccgccaagcggtcttcgtctgtaagaggcaatagaaaaacgcgctaatcagcaacatcaaatttactcaaaccctaattggcaatacgaagcgatgggaaatgctaactgtgtattttgtggatgcatagaacaagcgagcgttggtgtggttgagaaatggggacgttttgacaggcttgcagaaccggggcttaacttcttcaatcctttagccggcgaatgcctctctggtattctctccaccaggatcagttctctcgatgtcaaaatcgagactaaaaccaaggacaatgtctttgttcatttagtgtgctcgatccaatatagagtgatcaggcaaaatgctgatgatgctttctatgagttgcaaaatccgaaggagcagattcaggcttatgtatttgatgttgttcgagcccatgtccccaaaatgaatttggatgaacttttcgagcaaaaggatgaagttgctaaggctgtgttggaggaacttgagaaggtgatgggtgcgtatggatataacatcgagcacatactgatggttgacattattcctgatgcttctgtacgaaaggcaatgaacgagataaatgcagctcaaaggatgcagcttgctagtgtatacaagggagaagcagaaaagattctccaagttaagaaagcagaagctgaggctgaagccaagta

SEQ ID NO: 1196 - DNA, 659 bp, Artificial
  Synthetic
cccacgcgtccggctaccttcccttcctgataaacaacaccaccctgtcatagtgtctcatttaggcatatcctgataccagctggctattctctcttgcccttccacgttcaagtttccgcccaggtacggccggaagctatctaaggactgcagctatgggcaatttgttctgctgtgttcaagttgatcagtctacagtggccattagagaacagttcgggaagtttgatgctgtgcttgagccaggatgtcactgcctgccttggtttgctgggaagcgtatagctggccatctcacactcaggttgcagcaactggatgtgcgctgtgaaaccaagacaaaggacaatgtgtttgtcaatgttgtggcatcgatccagtacagagctttggctggcaaggcaaatgatgctttctacaagctgagcaacacaagatctcagatccaagcttatgtcttcgatgtgatcagggcaagtgttccgaagctgaacctggacgacgcatttgagcagaagaacgacatagcaaaggcagtggaggatgagctggagaaggctatgtctgcttacgggtttgagattgttcagacgctcatcgttgacattgagccagacgagcacgtgaagcgagcgatgaatgaaatcaatgcagct

SEQ ID NO: 1197 - DNA, 685 bp, Artificial
  Synthetic
  misc_feature (528)..(528): The residue at this position can be any nucleotide.
ttgaaaagtggaagcggaaaggggaacgtgagttcagagcagaggttgagattatcagccgtgtacaccatcgtcatttggtttcactcgttggttattgtatctcagagcaacaaaggttacttgtctatgactatgtgccgaacgacacacttgactatcatcttcacggtaaaggcgggactatggattgggctacccgagtaaaagtagctgctggtgcagcacgtggacttgcttatctgcatgaagattgccatccccgcattatccatagggatatcaaatcatcaaacattctcttggatatcaactttgaagcacaggttgcagattttgggcttgcaaggttagcaggtgatgtcaatacacatgtgtccactcgtgtgatgggaacctttggatacttggcaccagagtatgcatctagtggaaaattaacggagaaatctgatgtttactcatttggcgttgtgcttttggagcttattacggggcggaaacctgttgaccaatctcagcccttangtgatgaaagcctggttgaatgggctcgacctttgcttactcaagcacttgagactgaaaattttgaagatatagtagatcctaggcttgaaaagaactttgttgcgagtgagatgttccggatgattgaagcagctgcagcttgtgtacgtcattc

SEQ ID NO: 1198 - DNA, 619 bp, Artificial
  Synthetic
gcggtatttgcatgaagaatgcagagttggttgtataatccatcgtgacatgagaccaaacaacatccttgttacacatgattatgagccactggttggagattttgggttggcacgatggcaacctgatggtgacatgggtttgacacgagagtaattggaacattcggttatctggcaccagaatatgcacagagtggacaaataacagagaaagctgatgtatactcttttggggttgtgttagttgaacttgtcactgggcgcaaggctgttgacatcaaccgacccaagggccagcaatttttgactgaatgggcacgccctttcttggaggagtatgcaattgatgagctcatagatccacgcttgggtgaccgctattgtgaaaatgaggtctattgcatgttgcatgcagcaaaactttgcatacgacgtgatcctcattctaggccccgcatgtctcatgttctacgcatactagagggcgacatggttgtcgattctggctctgtttcagccccaagtagtgattctgggagcaggagctggcgaatgctgaatgaacaacagaactgtagagactggagcccagctcgacaagattcacatcgagtgg

SEQ ID NO: 1199 - DNA, 455 bp, Artificial
  Synthetic
gggtgggaaagattgcccgatattaagctggaagacacggcttgggattgctttagatgctgctcaaggattggaatacttacacacgtcatgcaatagacacataattcaccgggatgtcaaaacggcaaacatacttctcagttcggcaatggttgccaaagttagtgactttggcttgtccaaaactttcgataagaaaggaacatcacatatcaccacaattgtcaagggaacccctggatatctcgatccagaataccattcctataacaggctgacggaaaaatcagacgtctatagttttggagtggtaattttcgagattgtttgtggtcgcaagccaatcgacacatcacttccagaaaatgaagtgaacctttcaagatgggcatgtcaggaacttcagaaaggcaacatgaaaggaattatggatccccgcatggcggactaca

SEQ ID NO: 1200 - DNA, 666 bp, Artificial
  Synthetic
cccacgcgtccgacttatgggacgctcttcacaaaggctttgttcatcttgagtggcgtactcgtcatcaaatcgcggttggagtagctcaaggattggcttaccttcaccatgatctctccccaccaatcattcatcgcgatatcaaatcgacaaacatcttgttggatgttaactatcagcctaaagttgcggactttggcattgcaaaggtgttacaagctagaggcaaagattcaaccacaaccgttatggctggcacctatggttacttggccccagaatatgcgtactcgtccaaagcaacgatcaaatgcgacgtgtacagtttcggggttgtgttgatggagctgatcacggggaagaaaccggtggattcgtgtttcggggagaacaaaaacatagtgaactgggtgtcaacaaagattgacacaaaagaaggattgattgagacactagacaagagattatcagaatcatcgaaagcagacatgatcaacgccttgcgtgtggctatccgctgtacaagtagaactccaacaatccgtcctaccatgaacgaagttgttcagcttctgatcgacgcaacgcctcaaggaggacccgacatgacctccaaacctacgaccaagattaaggattcaatagtgtcagatcatctcacgc

SEQ ID NO: 1201 - DNA, 617 bp, Artificial
  Synthetic
acagctccactccacacattaacatcatcatcaacacacacaactaccatggcccgcaccaagcagaccgcccgtaagtccactggtggcaaggctccccgtaagcagctcgcctccaaggctgctcgcaagtccgccccctcaaccggcggtgtcaagaagccccacaggtacaagcctggtaccgtcgctctccgtgagatccgtcgttaccagaagtctaccgagcttctcatccgcaagctgcccttccagcgtcttgtccgtgagatcgctcaggacttcaagtcggatctccgcttccagtcctctgccatcggcgctctccaggagtccgttgaggcctacctcgtctccctcttcgaggacaccaacctttgcgccatccacgccaagcgtgtcaccatccagtccaaggacatccagctggcccgccgtctccgtggtgagcgcggttaagcttgtcacttcatgatgccgacctcacgacaactttctggtcggtgatggatctttggttactttcttaggcgtttttacggaattcatggtcacggtcttcaactcgggtttatgggtgcactggagcggtgctgagcatgtagtatatccagcta

SEQ ID NO: 1202 - DNA, 338 bp, Artificial
  Synthetic
cagagagcagttagcagagagaagtttgaagaagaaggagaacaagaaaaaagagaaaatggctcgtaccaagcaaactgctcgtaagtctactggaggaaaggcacctaggaagcaacttgctactaaggctgctcgtaagtctgctcctactactggtggagtaaagaaacctcacagataccgccctggtactgttgctcttcgtgaaatccgtaagtaccagaagagtactgagctcctgatcaggaagctcccattccagaggcttgttcgtgaaattgctcaggatttcaagactgatctgcgtttccagagtcatgctgtgttggctctgc

SEQ ID NO: 1203 - DNA, 303 bp, Artificial
  Synthetic
cccacgcgtccgcaaaactcgcttcctgataatcaaatcaaaagcttctctatcaagcttatcgaaaagtcacatcttttggaagaaacaatggctcgtaccaagcaaaccgctaggaaatccaccggaggtaaagctcccaggaagcagcttgccaccaaggcggcgaggaaatcagcaccaaccaccggaggagtcaagaagcctcaccgttaccgtccaggaaccgtcgctcttcgtgagattcgtaagtaccagaagagtactgaattgttgatccgcaagcttcccttccagcgtctc

SEQ ID NO: 1204 - DNA, 671 bp, Artificial
  Synthetic
ggggaaagatttcgtcgcgctagggttttctgattcgtcgtccatggcgcgtactaagcagactgctcgcaagtccacgggaggcaaggcgccgaggaagcagctcgcgaccaaggccgccaggaagtcggctcccaccaccggtggagtgaagaagccccatcgctaccgcccgggaacagtcgctcttcgtgaaatccgcaagtaccagaagagtaccgagctgctcatccgcaagctgcccttccagaggcttgtgcgtgagattgctcaggacttcaagacggatctgaggttccagagccacgcggtgctggcgctgcaggaggcggcggaggcatacctggtgggtcttttcgaggacacgaacttgtgcgcgatccatgccaagcgggtgaccatcatgcccaaggacatccagttggctcgccgcattcgtggagagagggcgtaagccacagggtgctattcatgacccgttcgctgctactgatgaaggacatagaaaagtcttagaaggatcactttgttttgtaatatactattagaacagcaattcaagttgcttttgctgtgatttagtcaaataaatttcgtggtgtatgattgcattagctcaatcgttatatttgtcacactactaaacttctatttaatccaagttcacaccc

SEQ ID NO: 1205 - DNA, 444 bp, Artificial
  Synthetic
tgatctaagagtagttgagttgaaaatggctcgcacgaagcaaaccgcaaggaagtcgacgggagggaaggcccctcgtaagcagctggccacgaaggctgctcgcaagagtgcccctgccacaggtggagtcaagaagccccacaggttcaggcctggaactgttgcccttcgtgagatccgaaagtatcagaagagtactgatctcttgatcagaaagttgcccttccaacggttggtgcgtgaaatcgctcaagatttcaagactgacctccgtttccagagctctgctgtgttggcactgcaagaggctgcagacgcctaccttgttgggctctttgaggacacaaatctctgcgctatccatgccaagcgagtcaccatcatgcccaacgacatccaacttgccacacgcacttaggggggaccgtgcctaagctcttt

SEQ ID NO: 1206 - DNA, 689 bp, Artificial
  Synthetic
accaagtcttttttcaagcatcttcacagtcaacacatcacaacaactcatcatggcccgcaccaagcagaccgcccgtaagtccactggtggcaaggctccccgcaagcagctcgcttccaaggctgcccgcaagagcgctccctccaccggaggtgtcaagaagcctcaccgttataagcctggtaccgtcgctctccgtgagattcgacgataccagaagtcgactgagctcctgatccgcaagctccccttccagcgtctggtccgtgaaatcgctcaggacttcaagagcgatctccgcttccagtcttctgccatcggcgccctccaggagtccgtcgagtcttacctcgtctccctcttcgaggacaccaacctttgcgccatccacgcaaagcgtgtcaccatccagagcaaggacatccagctcgcccgccgcctccgtggtgagcgcaactaagttggagagactttgggaggaacgttgcagacatgacttttgcttttcacacgagtgtttctggggtcaagggataatcaggcgttacaaatgagagtttttattcccctttatggttcggaatgtatattaccagtgcgtcagggaaaaagcactgcataaatgcaaacgaggttcacggcctcacgggttaacgaactataataactgcatcactctaaaaaaa

SEQ ID NO: 1207 - DNA, 663 bp, Artificial
  Synthetic
tctgcttccgtgcctttctcttcctccgcttcaggtaagagattgaggatggcccgtactaagcagactgctcgcaaatctactggaggcaaggctccaaggaagcaattagcaaccaaggctgctaggaaatctgcacctaccactggaggggtgaagaagccacacagatacaagccaggaactgttgcactccgtgagattcgaaagtatcaaaagagcactgagctccttattaggaaactgcccttccaaaggttggtccgtgagattgcccaggatttcaagacggacttgcgtttccagagccacgctgtgcttgcacttcaggaggcagctgaggcttaccttgtgggcttatttgaggacaccaacttgtgtgctattcatgccaagagagtcaccatcatgcctaaggatatccaacttgccaggaggatccgtggggaaagggcttagcaacttttccttaaaaatttggacaactgcaccaatggttttaataacaataagatatctattgacatagatccccccactatctattggtcttttgaacttggattttagttcaaatattgcattgaaaacattgtgtttatgcctactatgtgttgctctcaatatagttttgagaatatggaccctttgaagtaataattt

SEQ ID NO: 1208 - DNA, 690 bp, Artificial
  Synthetic
ctgcccacgcctcaattcaaaaaatccattcgaatttcgcagcaaagagatcgagagagagatccatcaatccatcatccatggcgcgcacgaagcagacggcgaggaagtcgaccggcgggaaggcgcctcggaagcagctggcgacgaaggcggcgcggaagtcggcgccggcgaccggcggcgtgaagaagccgcaccggttccggccgggcacggtggcactccgggagatccgcaagtaccagaagagcacggagctgctgatccggaagctcccgttccagcggctggtgcgggagatcgcgcaggacttcaagacggacctccggttccagtcgtccgccgtcgccgcgctgcaggaggccgccgaggcctacctcgtcggcctcttcgaggacaccaacctctgggccatccacgccaagcgcgtcaccatcatgcccaaggacatccagctcgcccgccgcatccgcggcgagcgcgcgtaagccgccgccttcgacgcggttgcgttgcgtagcgccgaagcgatctggggggatcaacgacgacgacgtgacgtggtcaacttgttgattcccctctcgcttccgcgttttagatctcgttttcattagcagctttgtaatagggtttggtcggttaattagtgtaaaaacagggttcggttaaagactcaaaatcaaa

SEQ ID NO: 1209 - DNA, 582 bp, Artificial
  Synthetic
gagtctttaaccgaaccctgtttttacactaattaaccgaccaaaccctattacaaagctgctaatgaaaacgagatctaaaacgcggaagcgagaggggaatcaacaagttgaccacgtcacgtcgtcgtcgttgatccccccagatcgcttcggcgctacgcaacgcaaccgcgtcgaaggcggcggcttacgcgcgctcgccgcggatgcggcgggcgagctggatgtccttgggcatgatggtgacacgcttggcgtggatggcgcagaggttggtgtcctcgaagagcccgacgaggtaggcctcggcggcctcctggagggcgagcaccgcgtggctctggaagcggaggtcggtcttgaagtcctgcgcgatctcgcggacgaggcgctggaaggggagcttgcggatcaggagctccgtgctcttctggtacttgcggatctcgcggagcgccaccgtccccggcctgtagcggtggggcttcttcacgccgccggtggtcggagcagacttcctcgccgccttggtggcgagctgcttcctcggggccttgccgccggtggacttgcgggcgg

SEQ ID NO: 1210 - DNA, 698 bp, Artificial
  Synthetic
cccacgcgtccgcacaaaagcagatagaagaaagaagaaggagaaaagaaaaaagagaagatggctcgtaccaagcaaactgctcgtaagtctaccggaggaaaggcacctaggaagcaacttgctactaaggctgctcgtaagtctgctcctactactggtggagtaaagaaacctcacagataccgccctggtactgttgctcttcgtgaaatccgtaagtaccagaagagtactgagctcctgatcaggaagctcccattccagaggcttgttcgtgaaattgctcaggatttcaagactgatctgcgtttccagagtcatgctgtgttggctcttcaggaggctgctgaggcatacttggttggtctctttgaggacacaaatctttgtgccattcatgccaagcgagtcaccattatgccaaaggacattcagcttgctaggcgtatcaggggcgagcgtgcttaatttgataaagtgtggtagctttgttggtgcttttagatctttttgttaaaagactgatggtattaaaatttagtagtagggatgatatgctatgttgatcttatagtgtggtggatggaggtggtgaaacatagtatatgttggatctttctaatgttttgttgtcacaccgctggtgttgaacaagtttcagaatttgcatctaatgtttagttcaactctatggt

SEQ ID NO: 1211 - DNA, 660 bp, Artificial
  Synthetic
tcttctacttttgcagtttcctctctaatttcaagccatcctcatcagccttcaaaatcaagcaatcctaaggaaatcagatggctcgtacgaaacaaactgcccgtaaatctactggaggcaaggctccaaggaagcagcttgcaaccaaggctgcccgtaaatctgccccaacaacaggaggagttaagaagcctcacagatacagacctggaaccgttgctcttcgtgaaattcgcaagtaccagaagagcactgagctgttgatcaggaaattgccatttcaaaggcttgttcgtgaaattgcacaggacttcaagactgacttgcgttttcagagtcacgctgtgttggccttgcaagaagcagctgaggcataccttgttggattgtttgaggacactaatctgtgcgccattcacgccaagcgtgtgactatcatgcctaaggatatccagttggccagaagaattaggggagaacgagcttagaatgattttttctgctttctcttgcttagattattgaagttttttctttagcgttttctgtttttttcttcttcatataggtagttttactagatatgaatggatgtggagtactggaaatttgatactctattaaatagtcgattttcagctttagccaaaaaaaaac

SEQ ID NO: 1212 - DNA, 662 bp, Artificial
  Synthetic
gccattacggccggggaaccaaagcaatttccaatctacaaaactctttcttatggctcgtaccaagcaaactgctcgcaaatcaacaggtggaaaggctccaaggaagcagctagcaaccaaggctgcaagaaagtcagctccggcgaccggaggagtgaagaagcctcaccgtttccgtccgggaactgttgctctcagggaaatcaggaagtaccagaagtctactgaattgttgataaggaagctgccatttcagaggctggtgagggaaatagcacaggatttcaagacagatctgaggttccaaagcagtgctgttgctgccctacaagaggctgcagaggcttaccttgttggcctctttgaagatacaaatctctgtgccattcacgccaagagggtcactatcatgccaaaggacattcagcttgctaggaggattcgcggcgaaagggcttagaatgaagcttgttatgcttatggttatggttaattcgtgttctctgatctagggcattgtttttgtgtgtttttgctgaatgttagggttagtgatgtaaatcaagcgacttgttccaatcaaaatcaaaatatatgtaaaacctctggtttattagtattttgaaatcttattaatgaaatttgtactcattttgccg

SEQ ID NO: 1213 - DNA, 621 bp, Artificial
  Synthetic
aaaatccttcaaagatccaattactctttcatccaaatcctacaagacctaagtccctaatggctcgtacaaagcaaactgcccgaaaatccaccggagggaaagctccgagaaagcaattagccacaaaagctgccagaaagtcagctccggccaccgggggagtgaagaagcctcacagattcaggccagggactgttgcgcttcgtgaaatccgcaagtaccagaaatcaactgagcttttgatccgtaagctcccgttccagcgtttggttcgggagatagctcaggacttcaagaccgatctccgtttccagagttcggctgtggctgcgctccaggaagctgctgaggcttatctcgtcggtttgtttgaggacacaaacttgtgtgctattcatgctaagagggttactattatgcctaaggatattcagcttgctaggagaattaggggtgagagggcataagtgtgaacctacggtagctatgggagcttgtaactgagcatatggtagatgagtttctaggcttttactgtattttggtccaaaattttctcaattctggatatgtagtcgtattaaaagtattttaatgaaatatcagttcttctttgcc

SEQ ID NO: 1214 - DNA, 346 bp, Artificial
  Synthetic
cccacgcgtccgccgtacacgcgtgaagactgacaatattatctttttcgaattcggagctcaagtttgaaattcggagaagctagagagttttctgagatggctcgtactaagcaaacagctcgtaagtctactggaggaaaggctcctaggaagcagcttgctacaaaggctgcacgtaagtctgcaccaaccactggaggagtcaagaagccccatcgttaccgtccaggaactgttgcactacgtgaaattcgtaagtaccagaagagtaccgagttgctgatcaggaagctccctttccagaggctagttcgtgagattgcccaggatttcaagactgact

SEQ ID NO: 1215 - DNA, 736 bp, Artificial
  Synthetic
ctccacaaaagcagagagcagagagcagagagaagaaagaagaagaaggagaacaagaaaaaagagaagatggctcgtaccaagcaaactgctcgtaagtctactggaggaaaggcacctaggaagcaacttgctactaaggctgctcgtaagtctgctcctactactggtggagtaaagaaacctcacagataccgccctggtactgttgctcttcgtgaaatccgtaagtaccagaagagtactgagctcctgatcaggaagctcccattccagaggcttgttcgtgaaattgctcaggatttcaagactgatctgcgtttccagagtcatgctgtgttggctctgcaggaggctgctgaggcttacttggttggtctctttgaggacacaaatctttgtgccattcatgccaagcgtgtcactatcatgccaaaggacattcagctcgctaggcgtatcaggggcgagcgtgcttaatttgatcaagtgtggtagctttgttggtgctttagatccttttcttaaaagactgatggtattaaaaaatagtggtaggaacgatgttctatgttgatcttattttgtggtggatggaggtgtgctgtaattgttgttctgtttggggaagtggagaaacatagtacttgttgaatctttctaatgttttattgtcacaccactggtgttgaacaagtttcagaatttgcatctaatgtttagttcaactgtttgg

SEQ ID NO: 1216 - DNA, 641 bp, Artificial
  Synthetic
gccattacggccggggacactcaaatctgtaattaacatttgaaagcagaaaaccctacaagtccgaaagttctctgaatttttcaaatttctcaatggcacgtaccaagcaaactgctcgtaagtccactggtggcaaagcaccaaggaagcaactcgccacaaaagctgctcggaaatcagctccggcgaccggtggagtgaagaagccacacagattcaggcctggaactgttgcgcttcgtgaaatcagaaagtaccagaaatcaactgagctcctgatccgtaaacttccgttccagcgtttggttcgtgagatagctcaggattttaagaccgatctgaggttccagagctctgctgttgcagctcttcaagaggcggctgaagcataccttgttggtttgtttgaggacactaacctttgtgctatccacgctaagagggttaccattatgcctaaagacattcagcttgccagaagaattaggggcgagagagcttaaattagtttttgggtgtatagtggattgtttgttaagggttttgagccttttgtgttttggtgtagtactttctcagttctggctatgtagttcaatgaagtgcattttaatgaaatatcagtactattttatcca

SEQ ID NO: 1217 - DNA, 687 bp, Artificial
  Synthetic
cttcttcttcttcctcctcctcgcgctcccccgattcgaagcgtgaagagaggaacggcgcttgcgagaggagagagatggcccgtaccaagcagaccgctcgtaagtccacaggaggaaaggctcccaggaagcagcttgccaccaaggctgctcgtaagtctgctcccaccactggaggagttaagaagccccaccgttaccgccctggaactgttgccctccgtgagattcgcaagtaccagaagagtactgagcttttgatcaggaagctgcccttccagaggcttgttagggaaattgcacaggacttcaagaccgatctgcgtttccagagccatgctgtccttgccctccaggaggctgcggaggcataccttgttggtctcttcgaggacaccaacctgtgcgccattcatgccaagcgtgtgaccatcatgcctaaggacattcagctggctaggaggattcgtggtgagagggcttaaattcccctcggcgattcctttgacaaatgaagcatgcgtcgtagtgttagtagtgggttttaatcttttgcttataagaacaatctgagtagggtgtattttgtggaacaatatgtttctcatgatggtgctgtattcgtcttattggtggatctgtcaaaaatactcagcatattgtcagtgtgtctggtgactctta

SEQ ID NO: 1218 - DNA, 675 bp, Artificial
  Synthetic
gtttgcggagttcttctcttcttcccgccctttcgtatttctcagtctggttcaaagatggctcgtactaagcagaccgcccgtaaatccaccggagggaaggcccctaggaagcagcttgccacaaaggctgcaaggaagtctgcccctaccacaggtggagttaagaagcctcaccgatacaggcctggaactgttgctctgcgtgagatccgtaagtaccagaagagtactgagcttttgataaggaagttgccatttcagaggcttgttcgggagattgcacaggatttcaagactgatctaaggtttcagagccatgctgtcttggctctgcaagaggctgctgaggcctaccttgttggcctgtttgaggataccaatctctgtgctatccatgccaagagggttacaattatgcccaaggacatccaacttgcgaggaggatccgaggggagagggcttgatttcttcttttgctcctctttaaactaatatgaccttcattcgaacacttcttttgttttgaatctgaaagctctagcaatagacgctaattgcacccttttaacaatgtattgcttcaaatgcctataatagacctatgttgcccttttgtgttctgtaaataattggcagcttgattcaaatgtgggatgattttttctgactaa

SEQ ID NO: 1219 - DNA, 672 bp, Artificial
  Synthetic
ataaagttcctcttctccttctgtagtttcctctctaatttcaaggtttcctcacacccttcaaactcgagcaatcttaaggaactcagatggctcgtacgaagcaaacggctcgtaaatctactggaggcaaggctccaaggaagcaacttgcaacaaaggctgcccgtaagtctgccccaacaacaggaggagttaagaagcctcacagatacagacctggaaccgttgctcttcgtgaaattcgcaagtaccagaagagtactgagctgttgatcaggaaattgccattccaaaggcttgttcgtgaaattgcacaggacttcaagactgatttgcgtttccagagtcacgctgtattggctttgcaagaagcagctgaggcctaccttgttggattgtttgaggacacaaatctgtgcgccattcacgccaagcgtgtcactatcatgcccaaggatatccagttggcccgaagaattaggggagaaagagcttagaatgatctgttctgccgtatcgtgcttagattgttgattttttttttgaattgccgtctttctgcatttttcttcttctttggtcttcatataggtagtttttactagatatgaatggctgtggcatactggaaatttgatactctctattatatagtcgaattttattggt

SEQ ID NO: 1220 - DNA, 548 bp, Artificial
  Synthetic
gaagagaggagagagaggaggagagagaagaggggatatggctcgaacgaagcagacggctcacaaatcgacgggaggaaaggctccccgcaagcagctagctaccaaggttgctcgtaagtcggctccaacaaccggaggagtgaaaaagcctcatcgatatcgtcctgcaactgtggctcttcgtgagattcggaagtaccagaagagcacagaactgttaattcgcaaattgccgtttcaaaggctcgtacgtgagatagctcaagatttcaagacggatcttcgatttcagagtcacgctgttcttgctcttcaggaagcagctgaagcctacttggtaggtttgtttgaagatactaatctctgtgcaattcatgcaaaaagagtgacaatcatgcccaaggacattcaacttgcgagacgcattcgcggggagagagcttagacttgtgctagatgtcctcacaagattggaattcttagaaatacttctttgttaaaggatgttcaattcaacatgtgtcatatacattttaggtgatgga

SEQ ID NO: 1221 - DNA, 752 bp, Artificial
  Synthetic
cgacccacgcgtccgcggacgcgtgggcaaaactttctttctactatattaaagaagaaaatatgggtgtgaaaggcaagttgattgcttcagtagaggtgaagtgtggaggacacccaattcatgatatttttcacaccaatactcatcacatatgcaacataagtcctcgtaagatccaaaaatttgacattcacgaaggtgaaacagtaaaagttggttcggttgttaactggaaatataacgacgatggaaaagataagatctgtaagcaaaagattgaagccgtggatcatgtgaagaaatcaattacttggaaagtaattggaggagatctgttagagttgtacaattccttcacaattaccacatcccacgaccaccagtggactacatggacatttgtgtacgagaagaaaactgaagacaccccagagcctctcgttctcttgggttttgtcctacatgtgaccaaagatatagagggtcaccttctcaagtaatataatctatgctattcaatggcttatagccatttatacgtatgtcaatacacatatatatctatgtgtttgatgagtatttggcaatattggcaagctctagctagctacgtgtgaaataaagactgttgtgtttgaagatatatattatatatatgcactctccttctatggatgtatttctaatggtgaatatatgtaagatattttgaattttgagaaatagggttaataataaaaaaataaata

SEQ ID NO: 1222 - DNA, 430 bp, Artificial
  Synthetic
atggcggcttcgttctcactcacgagcttcatctccttcatctcaccattcaaatctcaaactaaacctacaccaccaccaaatctcactcttccttctccaacaatctcccaaaggcgaagaaatgatctcgctatcgaatcaatggcggtcgaagaaacttcctcaaccgcttattcactttcctctgagcttgcttccgtgattagtccctcgcttgcttactccaacacactcttcttcagttctggatacaatgtgcaagtgtttgttgaagataatgagtcagaggagaggcttgtgaatcgatttaggagagaagtgatgagaactggtgttatacaggaatgtaagaggagaagatactttgagaataaacaagatgagaagaaacgtaggactcgtgatgctgctaatcgtaataagaaaa

SEQ ID NO: 1223 - DNA, 250 bp, Artificial
  Synthetic
aatttctcaaatggcagtctcatccatagccaatctcttctccttcttcaccccctccaaacccccaccccccagagcttcccccctccaattctctcttcctgctgttgattccctctcttcttcaacacctatcaacaatcacaaatacccattatcactatcgtgttctaattctgatgttacggccgtcgtttacccctcacttgcaaatgcaaacactctttacttcaggtcgggatacaatgtt

SEQ ID NO: 1224 - DNA, 709 bp, Artificial
  Synthetic
gaattcccaactgcgcgctaacctagaacccacagagggtgttggtcgattaagacagcaggacggtggtcatggaagtcgaaaccctaaaaccaccatctcaactcgctcctccatcatcatcaatatcatcaccctctactttatcttatcaagaaaagaacagaaatgggtttgttccagtaatgtcatcgaattctgttgttaatgacgaattactatcagtagtatgcccatcactggcttattcaaatacccttttctttaaaactgcttataatgttcaagtagttgttgatgaggatgaacctgaagaagtttcactaagaaggttcaaaagagaagtatttagagctggtgttattaatgagtgcaaaagaagaaggttttttgaaaataagcaagaagaaaagaaaaggaagcataaagaagctgctaagaggaatcgaagaagacgtccttttgtacaaaggccagataaacaagaaatggcttctagcgaaaaggaaaagagggcgaaggaagatgatgaagataactgggaacttcctaaaggaaacattccgtactgataaaagaacatctgggaatgtaatgtaataccttttgttttcctctctgtagaagaaaggggatgtgatgtatttaatcagttgatgagtagtaagattttcaggctgggatcaatgggtgccttgaactgactaat

SEQ ID NO: 1225 - DNA, 600 bp, Artificial
  Synthetic
tcgcccactataatctcacctaagcagtacaaaaagaggtgtcgcaaggccatgaccacctattttctcatggtcccagatcaatggtcaccaccgtctatcattcccagtaaatcacagactgatttatgtgaagagaacatgcaagatggatgatctgccaagtgattttgtacatctgttcgtatattgagcacatatttgggtttctcgcattggttatcccaggttcatacatctcccatattttcgattcccattcttttggaacgcagttccggttgcattctccctaaagtgggagaacacatgatttcttgtcagagcacttggtaagaggtttgtatttcagtgaaagtctccattgcacagaatataggtggctctccgtggaaatatttttgtaaatctttttcttttaattacaattttctttgggtgtaaaatccaaggtatacatgagttccgaaggatcattggcaattttatacaatgcatgattttggagcaatttagctggtgtagtttcaagtgtatcgcgattctttcctctgtaatttttgtaattgtgattttgaaaggtgaatcttcttaccttta

SEQ ID NO: 1226 - DNA, 641 bp, Artificial
  Synthetic
  misc_feature (152)..(152): The residue at this position can be any nucleotide.
accttttgaacctgtaatgcctggagttaccttcctggagtatggcgatattcaagcagccacagagttaattcagagtggtaaaatagctgctgtgtttgttgaaccaatccaaggtgaaggtggaatatatagtgcaacaaaagaatttnttatttctctgcgaacttcctgtgatagtgttggttctcttcttgtctttgatgaggttcaatgtggcctaggacgaactggtcatctttgggcacatgatgcttatggcatatacccagatattatgactcttgcaaagccacttgcgggaggtctacctattggggcggtgttagtgactgaaagagttgctgctgccataaattatggagatcatggtagcacctttgctggcggtcctcttgtttgcaatgctgcagttgctgtgctgaacaagattgccgaaccaagtttccttgccagtgtcaccatgaaaggtcaatatttcagggaattgcttgttaagaaattaggaggaaactcacatgtgaaagaagtacgaggcgtggggcttattatcgggatagaccttgatgtaccagcatctccactggttgatgcatgtcaacaatctggccttcttgtattaacggctggaaaaggaaatg

SEQ ID NO: 1227 - DNA, 693 bp, Artificial
  Synthetic
ggaaaaaattgggaacacctgattcgattaggcaaagcaaaaatgcaaagggttgggaaggctcgccagctcgttagggttttgagaaactcgtcatctcctattctgctcaactcagtgtcacgaattcaatctcattgtacctatgaatctactgaatcatgcctcaatttttctttacggcgtggttactttacctctggtactgcaatttgtggaaattatattcaaacaaaacacaatattcagagaaatgtatgtcaatgtgaaaaatgctctatgatgctcaaggcatcattttctacagaagcagggacagttgaaagtagtgtggcaacagagtctgtgaaggaattgtatgataagatgctgaaatctgtcgtggaacaaagatctgctccgccaaatgcttggttgtggtccctaatacaaagttgtgcaaaccgtgaagatgttaattttttacacgacattttgcagagacttcggatatttagactttcaaatctccgtatccatgagaacttcaattgtgccctctgccaggacattacaaaggcttgtgtacgtgttggcgccattgacttgggtaagaaggtgttgtggaagcataatgtgtacggattgactcctaatattggatctgctcaccatttactgttgtttgctaaacagcataatgatgttaaactg

SEQ ID NO: 1228 - DNA, 672 bp, Artificial
  Synthetic
tctcaacattggaaaactatgcatgaagggtagagatcctctctttgttccttgtactcccaagggctgtattgaattactggttcagtcaggcattccaatagcggggaagaaagcggtggttgttgggcggagcaacatcgtaggtcttccagttgcaatgcttttgaataagcttgatgcaacagttacgattgcgcattcacggacgaaagatacaatgagtatggttaagcaggccgacattgttattgcagcttctggccaagcacaaatgatcaagggtgaatggattaagccaggggcagcagtgattgatgtgggaacgaatgcaatcccggatccaacaagaaaatctggcacccgacttgtgggcgatgttgattttgcggaagctaagaaggtggcaggctggataacccctgttccgggaggtgtcggacctatgacgatagcaatgctcttaaagaacactttggagggtgccaaacgcacattttcccaacatgacgaatagctgtatactccactttcaccttaactggtatgcatttcacatttgtggccacttgattaacattattcctctattggtgcatgctgttttctattctggaaagatacgtgtaaaatcgctggatctttctcaattcgaaaataattcaggaaccg

SEQ ID NO: 1229 - DNA, 602 bp, Artificial
  Synthetic
aagcatattaatgaggaaaagatattgaacgatatcagcttagagaaagatgttgatgggttccatcctctgaatattggcaagcttgcaatgaaaggcagaaacccactgttcctaccatgcacgccgaagggatgcatggagctcctaacacggatcggagttaccatcaatgggaaccgagcggtcgtggttggccggagcaacattgtcgggctacctgtatccctgcttctgctgaaggcggatgcgaccgtatccattgttcactcccggaccccaaaacctgaaagtattgtccgtgaagcatacattgtcattgcagcgggtggccagtctatgatgatcaaaggagagtggatcaaaccaggcgctgctgtcatcgacgtagggacgaactccatcagggagccaaccaggaaatcggggtacagactcgtcggtgatgtggatttcgcagaggtgagcaaggttgctggtcacctgactccaatcccaggtggggttggacccatgacggtggcgatgttgctgaagaacacggtggatggagcgaactgtggtatatttcactaaagtttccatcttgtatgctgtaactg

SEQ ID NO: 1230 - DNA, 356 bp, Artificial
  Synthetic
cccacgcgtccgcggatttcatccgctaaatattggacggcttgccatgcgtggaagagaacccttattcgttccttgtactccaaaaggatgcattgagttgttgcatagatacaacattgaaatcaaaggaaagagagcggttgttatcggaaggagtaacattgtcggtatgccagctgctcttttactgcagagggaggatgcaaccgttagcattatccattcaagaaccaagaaccctgaagaaatcacaagagaagctgatattataatctcagctgttggacagccaaacatggtcagaggaagctggataaaaccgggcgcagtcctcatcgatgttgggattaatc

SEQ ID NO: 1231 - DNA, 650 bp, Artificial
  Synthetic
gcgtcgatttgtttgaaggatgatgctcagggtggcactgttagggcgaggagacactctccccttcgtcttaccccgtcacgagttcaagtcctccctccgcctccggtgctccttcgcgacatcccttccatgccgctcgaaagcttctctcggatggggatcccacaagcctccgcatgctaccttgcagcagcagcaacaagaacaagtagacatgagtgagccaactgcagctattattgatgggaaggccatagcccagaaaattagattggaaatagcagaggaagttgcaaagatgaaagatgagactggaaaggttcctggcttggctgtggtgcttgtgggatgccgtaaagattctgaaacgtatgttagaagcaaaaagaaggcctgccaggaggctggaatcacttcattaggcacaactttgccggaagattcgagcgaagaggaagttttgacttgtgtgcagcaatttaacaatgatcctgcagttcatggagtgctcgtgcaactaccactacctaagcatataagcgaggagaagatccttgcagctgttagtgtggagaaggacgttgatggttttcatccaatcaacttggggaaattagccatgcgaggaagaaagcctctttttgtgc

SEQ ID NO: 1232 - DNA, 352 bp, Artificial
  Synthetic
cgtcccacgcgtcgcccacgcgtccgagtcttgcgaggagaagggcagcgaagaagatgaaagaagagtatcgatgcttcatcggcggcttggcctgagcaccaccgatcgcggcttggagaccgctttcgagccctatggatccatcgtcgaagccaaggtggtgtatgatcgagaacagagccggtcccggggcttcggctttgtgaccttcgttttcgaggaggcgatggaaaacgccatccggaagatgcacaaccaggagctggacggccgatccatcactgtcagcaaggcgcagccaaaaactggcggcggcggcggcggcggcggcggtggccgtggaggagac

SEQ ID NO: 1233 - DNA, 642 bp, Artificial
  Synthetic
gccttctcagttccggttcgtttcttggtctgttttttgtgttctgatactgcaatggccgctgccgtagagtatcgctgcttcgtcggaggtctgtcatggggcacagacgaccgcgccctcgagcgcgccttcagcacctttggggaggtcatcgattcgaaggttgttaacgatcgtgaatcggggagatctcgtgggttcggattcgtgacattcactcaagaacagtctatgcttgacgcgattgaggggatgaacgggaaagagctcgacgggaggaacatcactgtgaatcaagcacaagaacggaactccggaggtggtggaggcgggtttcgaaggtccgaaggccgttacggcgggggcgggggcggatacggcgggggcggttacagatccggcggtggaggcagtggcggatacggcggaggcagcggtggctatggcggtggtggccaaagaagggactccggcggctacaacggcggaggtggtggtggctatggcggtggaggccgctacgagtgagaacggataccagtcgggattcgaactaccggcctcgctgccagtgggaaattaactctgtcgggtctcgaactcccgaccggtttctttttcctgcctttttctttggac

SEQ ID NO: 1234 - DNA, 672 bp, Artificial
  Synthetic
gttccgtcggcaagagctcttggctcctatagtggtcgttcggttttagggttaagggttttggttttcggaaggctaacaacaatggcggaaggggagtaccgatgcttcgtgggaggtctggcctgggttacagatgatagggctctcgaagatgccttccggtcctacgggagggtcactgattccaaggtcatcagtgacagagagaccgggcgctcccgcggatttggattcgtgacgtttgaagacgaacagtcgatgcttgatgcgatcgaggggatgaatgggaaggagcttgacgggcggagcattactgtgaaccaagcgcaaagccgctcaggtggagggggtggtggcggcggtggctatcgcaggtctgagggtagatacgggggtgggggcggaggatatgatggagagaggaaaggatacgaaggaggagggggcagatctggtggcggttatgggggcggcggtggtgggcagaggtacagctctggctatggcgagggtgactacaatgcgggaggtggtggcggtggaagccgatggaggaattgagtagtgcttaaaaagttttcacacatttgttctatccatccttttaaagttcagttggttactctaatattatatattgttatcattattatattttagtttatcctt

SEQ ID NO: 1235 - DNA, 307 bp, Artificial
  Synthetic
cccacgcgtccgctctcttacattttgaaaccctaatttctcttcttttccccaaaaaaaaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggct

SEQ ID NO: 1236 - DNA, 318 bp, Artificial
  Synthetic
cagcttctcctcttctcagaaattagggttccgtctcaaattacgagcagatctcgtactctctgaagatgtctgaagatccggagtaccgttgcttcattggtgggcttgcttggacaacgtctgatcgtggtctcagagatgcctttgagaagtatggtcacctcgttgaggccaaggtggttcttgacaagttttctggtcgctcccgtggttttggattcatcactttcgatgagaaaaaagctatggatgaagctattgcagcaatgaatggaatggatttggatgggcgaactatcactgttgataaagctc

SEQ ID NO: 1237 - DNA, 701 bp, Artificial
  Synthetic
ttcgtttttagggtttcttcttattcttattaatcagaaaagaatggcagaagttgaatacaggtgcttcgtcggtgggctagcatgggctaccaccgaccaaacacttggggatgctttttctcagttcggcgaaattctcgactcgaagatcatcaatgacagagaaactggtagatctagaggatttggatttgttaccttcaaggatgagaaatccatgagggacgctattgaagggatgaacggtcaagaccttgacggccgtaacatcaccgtcaacgaagctcagtctcgcggtagcggcggaggcggtggtggtggtggcggttaccgtggtggtggcggtggaggctacggaggtggtggccgtcgtgaaggtggatacggtggtggtggtggttacggaggtggccgacgtgaaggtggttatggtggtggcggcggttatggaggtggtcgtcgtgaaggtggttacggtggtggttctgaaggaaactggaggagttagatttccgttgcctttagatttatttttttgtttgaaatttatggttctacgtttggttgaagttccgttatggtttactttggttcctgttactgtcctcgttttgaccgcgagattgttaccgtgatgttacttgtggatctgtatttacaaagttctctggaatgaagtgaattaagatttacagtct

SEQ ID NO: 1238 - DNA, 243 bp, Artificial
  Synthetic
gccattacggccgggggttacggtggtggttctgaaggagactggaggagttagatttccgttgcctttagatttatttttttgtttgaaatttatggttctacgtttggttgaagttccgttatggtttactttggttcctgttactgtcctcgttttgaccgcgagattgttaccgtgatgttacttgtggatctgtatttacaaagttctctggaatgaagtgaattaagatttacagtc

SEQ ID NO: 1239 - DNA, 462 bp, Artificial
  Synthetic
gggttttttttttttttttttttttttttttttttttttttttgggaaacgggaaattttaattcacttctttccaaaaaactttggaaatacagacccccaagaaacatcccgggaacaatttggggggcaaaacggggacggtaccgggaaccaaagtaaaccataacggaacttcaaccaaacggaaaaccataaatttcaaacaaaaaaataaatttaaggggacgggaaatttaactcctccagtttccttaaaaaccaccaccgaaaccacctttacgaagaccacctccataaccgccgccaccaccataacctccgccgttaccgggaaactgagctttgttgacggggatgttacggccgtaaagggcttgaccgttcatcccttcaatagcggccctaagggatttctcatcctggaagggaacaaatccaaatcctttaaatctaccagtt

SEQ ID NO: 1240 - DNA, 631 bp, Artificial
  Synthetic
cgagtatagtaaaatggctgctgaaggagaatacagttgtttcgtcggtgggctcgcatgggcaaccaccgacagaaccttagctgacgcattcggtacatacggcgaagttctcgactcgaaggtccgtttgcgcagagcagaaattgaatccgggcccattttttggctttgttgatgatcttctgttactgattactgtttattactctctggtttacttgattcatctgttactgttactgttattactgttatacccttgaaacggtacgttccgtcttttttctctttttgtcaagagatgaagatagatcgattaattattttgcttgtaaacgttgtagatatgttagatctgagattttttttgttttatttttatttttttcagatcattaacgacagagaaactggcagatctagaggatttggctttgttacctttaaggatgagaaatgcatgagggatgctatcgaagggatgaacggtcaggaacttgacggccgtaacattaccgttaacgaagctcaagctcgtggaagtggaggcggcggcggtggtggttacggaggtggccgacgtgaaggaggaggcggtggttacggaggtggtggtggtggttacggt

SEQ ID NO: 1241 - DNA, 544 bp, Artificial
  Synthetic
ccccccctgaagaagctggtgctgccgtcgaacaattcaatggatacacattccaaggaagacctctgagggtaaactcagggccgcctccgcctcgggatgatttcgcgccaagatcacctaggggtggtgggagcaactttgattcatccaacaagctctatgtagggaaccttgcttggggtgtcgacaactcgacactcgagaacctgttcagtgagcagggaaccgtgctcgatgccaaggtcatctacgacagggagagcggcaggtcgaggggttttggttttgtcacctatggctccgctgaagaagtcaacaatgccatatcaaatcttgacggcgttgacctggacggcaggcagatccgagttacagttgcagaatcaaagccaaggcgccaattttgagattttttttttggttatgttgatttagaggttgatgatgtgcttccaagatgttagtttgtagcttctactattgtacaccaatatggcgaaaaggaaaattgatgcggttgatgagagactgaaagtctgaa

SEQ ID NO: 1242 - DNA, 471 bp, Artificial
  Synthetic
cggcttgacaagcagtgcctcggccggctcttcccctgccatgtacaatgctgctcgtctgatgtccaccaagcttttcgttggtggtctttcttggaatactaatgacgattcgctgaaagaggcattcaccagcttcggggatgtgactgaagctcgggtgatcaatgacagagaatctggaaggtcaagagggtttggctttgttagctttgccaatggcgatgatgccaagagtgccatggatgccatggacggtaaggaacttgagggacggagtatccgcgtgaacttcgcgaatgagagacctccagggaaccgaggtggcggcgggtatggtggtggtggcggtggttatggcaaccaaggaggctatggtgatggcaaccgaggctatggagggcagtactaaagtgggcactgacttgcttaaataatgagcttaggacctgatgtggcttatgtgaagcc

SEQ ID NO: 1243 - DNA, 698 bp, Artificial
  Synthetic
cccggtggtctctcagaggtgggttggcttctcctccccctcccggttcggttcggttcggttcgggtccggttcgatttcggtttttccttcggttcgggggttggtgggaaagcatggcggcgccggatgttgagtaccgctgcttcgtcggcggcctcgcctgggccaccgacgaccgctccctcgaagccgccttctccacctacggcgagatcctcgagtccaagatcatcaacgatcgggagacggggaggtcgcgcgggttcgggttcgtgacgttctcgagcgagcaggccatgcgcgacgccatcgaggggatgaacggcaaggagctcgacggccgcaacatcaccgtcaacgaggcccagtcgcgccgctccggaggcggaggcggcggtggctacggccagcgcggcggaggcggaggctacggtggcggcggctacggtggtggtggcggcggcggtggctacggccagcgccgtgaaggcggctacggcggtggcggtggctacggtggcggccgtggtggcggcggctacggcggcggctacggcggcggctacggaagccgcggcggcggcaactccgacgggaactggaggaactgagcggtggggccctcatggccaagttatctatctatctaatcgagctaccatcatcatcatccgatcgttatcatcgttagtttt

SEQ ID NO: 1244 - DNA, 542 bp, Artificial
  Synthetic
cccccccggtgctctctttgaggtgggttggcttctcctccccctctttaccttttcctcctcctcggttcggttccgtggttcgtctagggtttagtgggttgagatggcggcgccggatgtcgagtaccgctgcttcgtcggcggcctcgcctgggccaccgacgaccgctccctcgaggccgccttctccacctacggcgagatcctcgactccaagatcatcaacgacagggagacggggaggtcacgtgggtttggcttcgtcaccttctcctccgagcagtcgatgcgcgacgccatcgagggcatgaacggcaaggagctcgacggccgcaacatcaccgtcaacgaggcccagtcccgccgctccggcggcggcggcggaggcgggggctacggcggcggcggtggcggctacggcggcggtcgtggaggcggcggctacggaggaggtggcggcggcggctacgggcgccgtgagggcggctacggtggcggcggcggctacggcggcggccgtggcggcggcggcggctacg

SEQ ID NO: 1245 - DNA, 612 bp, Artificial
  Synthetic
ttactaatccaatagaaatggctatattctcaatttccgagttttcacttctagtcctcttttctatcttcctcctggcctgcaccacattcgctcgcgatcattcgatcgtgggatattcttcagatgacttgacttgcattgataagctcattaatctttttgagcattggatggataaacatggcaagatttataagagcattgaagagaaattgcataggtttgagatttttaaggataatttgaagcatattgatgagacgaataagatagttagtaactattggcttggtctaaatgagcttgctgatttgagccatgatgaattcaagaaaatatatttaggactcaaagttgataatgaattgcttatcaaaaaagaaaaatcccaacaagaatttgcatacagagattttgtggatttgccgaagtctgttgattggagaaagaaaggtgctgtcactcctgtcaagaaccagggtcaatgtggtagttgttgggcattctcaacggtagctgcagtagagggaattaatcaaataaagacagggaatttgacatcgttgtcggaacaagagctcatagactgtgacacaacatacaacaatg

SEQ ID NO: 1246 - DNA, 610 bp, Artificial
  Synthetic
ccacaaagcaggaaaaacacccaatcatggcaaatcatagctccactctcaccatatccctacttctcctcctcttcttcttctccaccttatcttccgcttccgacatgtccatcttaacctacgacgaaaaccaacactttcgaacagacgctgaagtcatctccttgtacgagtcatggctagtcgaacatggaaaatcctacaacgccttagacgaaaaagacaagcggtttcagatctttaaagataacctaagatacatagatgaacaaaactctgttccaaacaagagttacaagcttggtttaacaaaatttgctgatctgactaacgacgagtacaggtccatgtacttaggtactaagaccactgatcgtcgcaggttgttgaaaaacaaaagcgatcggtatcttcctaaagttggggatagcttgcctgactcagttgactggagagagaaaggtgttcttgttggagttaaggatcaaggaagctgtgggagttgttgggcattctctgcaattgcttccgttgaagcagtgaactcgatagtcactggagatgtgatttcactatcggagcaagagctggttgattgtgatacttc

SEQ ID NO: 1247 - DNA, 764 bp, Artificial
  Synthetic
  misc_feature (677)..(677): The residue at this position can be any nucleotide.
cccacgcgtccgcaaaagaaaaacaaacgtactcaaatggctctttcttcaccttcaagaatcctctgttttgctcttgccttatccgctgcttctctctccctctctttcgcttcttcccacgattactccatcgttggatactcccccgaggatttggaatctcatgacaaactcatagaactcttcgaaaactggatctcaaattttgagaaagcttatgaaaccgttgaagagaagtttcttaggttcgaagttttcaaggataatctaaagcacatcgatgagactaacaagaaagggaaaagctactggctcgggctcaacgagtttgcggatttgagccatgaggagttcaagaaaatgtatttagggctcaagactgatatagtgagacgcgatgaagaaagatcttacgcagagttcgcttacagggacgtcgaagctgttcctaagtctgttgactggagaaagaaaggagctgtggcggaagttaagaaccagggctcttgtggaagttgttgggcgttttcgacagtagcagctgtcgaaggtataaacaagattgtgacaggaaacttgacaacattgtcagaacaagaactcatagactgtgacacgacctacaacaatggctgcaacggtggtctcatggactatgcctttgagtacattgntaagaacggaggtctacgcaaggaagaagattatccttactctatggaagaaggaacttgcgagatgcaaaaggatgaatctgaaac

SEQ ID NO: 1248 - DNA, 672 bp, Artificial
  Synthetic
ggcatcgcgcggaggtctggatcggcagcgctaatggcggcggggagagcgcgggcggactatgactacctcatcaaattgctgctcatcggcgacagcggtgtggggaagagctgccttttgctgcggttctcggacgattccttcacgacgagcttcatcacgacgataggcattgacttcaaaatcaggaccgttgacctggatggcaagaggatcaagcttcaaatttgggacactgctgggcaagaacgcttccggacgatcacaactgcatactaccgaggagctatgggcattcttctcgtctacgatgtgacggatgaatcatcgttcaacagtatcctctttccaacgagttttgtttagttgtttcactcctttcgttgttgtgtgtgcaatatccttgatcgagctccactaaagacatccggaactggatcaggaatatcgagcagcacgcgtcggacaatgtgaacaagatcctggtcggcaacaaggccgacatggacgaaagcaagagggccgtatcaacagaaagagggcaagctcttgcgaacgagtttggtatcaagttcttcgaaaccagcgcgaagacgaacatgaacgtggagaacgtcttcttcacaatcgcgggagacatcaagcggagactagcggaaacagactcca

SEQ ID NO: 1249 - DNA, 643 bp, Artificial
  Synthetic
tctctctcttctctctctcttccaaccccgtccccatgaagagacatgctttctctctcttctctctctattcctcgaagctaagaatagcatcgttttacctacttttcttggtcattctgaaagttaaaagtctaaattgacacaataaaccctttaatacaattattatacaaacaagtcataaacacccgacacttaattacccgattgatttttctaggatatgggttgcgcatcttcagttgcagataggaattcaggacgggctgctggccttaatccggataatggtggagcacttgaccctaaaaatcttaaagtgaagctggtactcttgggtgattctggtgttggtaaaagctgtattgttttgcgctttgaccgtggctaatttgatccaacatctaaggtgactgtaggagcttcttttttgtctcaaacaatagcgttgcaggactcaactacagttaaatttgaaatatgggatacagcgggtcaggagaggtacgcagctcttgcacccctgtactaccgaggtgctgaagttgcatttgttgtgtatgatattactaatcccgagtcttttgccaaagcgcaatactgggtcaaggaattacaaaaacatggaagccctgatatt

SEQ ID NO: 1250 - DNA, 574 bp, Artificial
  Synthetic
aatacaacatggccaccccaagaacgtcttgtcaagagcgatttgcacagttcaaactcgtgttattaggtgagtgagagagggtctatgctactctcttctggcttctttcagcgactccaccacaagaagaaaatgggaatggagcaaagcatctttggtgtgatctttgggtacaagaaagggtgcaagctaggtcagattcgtatcagaaccgctttgcctgtcacttgcttgatgttactaacacaggtgaatcgtttgtgggtaaatcctcgctggtgacccggttcgtcaaggacgagtttctcgagcagagagaatcaactatcggagcagccttcctgacccagactgtctctctggaagacaacaagacagtccggttcgagatttgggatactgccggacaggagcgatacaagtcgctggcccccatgtactaccggaacgccaattgtgctgtggtggtctatgacattacacaggcctcgtcattggagcgatctaaggcatgggtcaaggagctccagcaccgagctgctgacggaatcattattggccttgccggaaa

SEQ ID NO: 1251 - DNA, 317 bp, Artificial
  Synthetic
agctctggaaacaagaacatcaacgccaaattggtattactaggagatgttggagctggaaaatcaagtcttgtgctacggtttgtgaaagatcagtttgttgaatttcaggaatcaaccattggtgcagcttttttctctcaaacattggctgtgaatgatgcgactgtgaagtttgagatatgggatacagctggtcaggaacgataccacagtttggctccaatgtactacaggggtgcagctgctgctattattgtctttgacattactaatcaagcctcatttgagagggcgaagaaatgggttcaggaact

SEQ ID NO: 1252 - DNA, 501 bp, Artificial
  Synthetic
tggttcaacgcagagtggccattacggccgggggggattagagtaatttgtagtaaaatacctcaaaatatagtaacttttttaaaaagaattttgagtccaagtttacatcatttgggtttggactcgtttctcaaagaagataccttgcttaaatacgtctcctccagaaatctctaaacaaaatctggacgtcaccctttaaattactttagtgttatccatttgccctttatatttcttctgtatagtttctccggcgagataactcagttccggcgataatcatcttcatcggaaaatgtcttacgactatctcttcaagtacataatcatcggggatacaggagtggggaaatcgtgtttgctgctgcaattcactgacaagaggtttcaaccggtgcatgatctcactattggagtcgagttcggggctcgtatggtcaccattgatagccggccaattaaactccaaatttgggacactgctggacaggaatc

SEQ ID NO: 1253 - DNA, 314 bp, Artificial
  Synthetic
cccacgcgtccgcgtagatctcgagagagagccttaaggaaattaaaaaaggttggattttgatcgatgggttcttcgtcaggacaacccgaatttgattacttgtttaaggttttattgatcggagattctggtgttggaaagagctctcttttgttgagtttcacatctaatacctttgatgatctttctccaacgattggtgtggattttaaggttaagtatctgacaattggagaaaagaaactcaagcttgcgatttgggatacagctgggcaagagagatttaggacgctaacaagttcgtattacag

SEQ ID NO: 1254 - DNA, 279 bp, Artificial
  Synthetic
gccttgttgttgacgagaagaacaagaacaaggagaatgaggtggagagtaaggatcgatggccgcctctggagcatctcgagctcgtgaccatgactacctcgtcaagctgctcctcatcgtggatatgggcgtcggcaaaagttgctggcttctccgattttctgatgacacgttcactacaagttgcatcacgaccatagcaattgattttacgatcagaactatagagatggatggaaaatgactagagctccaaatatgggacactgccggaca

SEQ ID NO: 1255 - DNA, 662 bp, Artificial
  Synthetic
ccccccgcggcgtggggaagtcgaacctgctgtcgcggttcgcgcgggacgagttcagcctggagaccaggtccaccatcggcgtcgagttcgccaccaagaccgtccgcgtcgacgacaggctcgtcaaggcccagatctgggacaccgccggccaagagaggtaccgcgccatcacgagcgcctactaccgcggcgcggtgggctgctgctggtggtgtacgacgtgacgcgccgcatcacgttcgagaacgcggagcggtggctcaaggagctccgcgaccacacggacgccaacatcgtcgtcatgctcgtgggcaacaaggccgacctgcgccacctccgcgccgtccccgcggaggacgccagggcgttcgccgaggcgcacgggaccttctccatggagacgtcggcgctggaggccaccaacgtggagggcgccttcaccgaggtgctcgcgcagatctaccgcgtcgtcagccggaacgcgctcgacatcggcgacgaccccgccgcgccgccccgggggcggaccatcgacgtcagcgccaaggatgacgccgtcacccccgtgaacagctcagggtgctgctcgtcttgactttgactcgctcaaactcatcgtcgtcgagctatgcaaattgccaccgttcacagctttg

SEQ ID NO: 1256 - DNA, 551 bp, Artificial
  Synthetic
gtcttcctctctctcccccgtcttcgcctcgcgctcgcgtctccctccctccctccttccgtccagatccgcgtgggctcgaagaagcggcgggcgatccacggcgagcgtcccgcggtcactcccccccgtctccgtccggcatgaatcccgagtacgactaccttttcaaacttctcctcattggtgattctggtgttgggaaatcgtgcttgcttctcagatttgcggatgattcatacctggacagctacatcagcacaattggagttgattttaaaatacggacagtagagcaggatgggaagaccatcaagcttcaaatctgggatactgctggacaagaacgtttcaggacaattacaagcagctattaccggggagctcatggaattattattgtatatgatgtgacagaccaagaaagcttcaacaatgtgaagcagtggttgaatgaaattgatcgttatgcaagtgacaatgttaacaagctcctcgttgggaacaagagcgacctaactgccaacaaagttgtgtcatctgaaacagct

SEQ ID NO: 1257 - DNA, 683 bp, Artificial
  Synthetic
ggagggcaaaacaataaaggctcagatctgggacacagcaggacaggagagatatcgtgccatcacaagtgcttactaccgtggcgctgttggggctctccttgtttacgacatcacaaagaggcagagcttcgacaatgtccacaggtggcttcgtgagctccgcgaccatgccgactcgagcattgttatcatgatggtcggtaataagtctgatttgattcatctaagggctgtctccgaggatgaaggtaaggcattggctgaaaaggaggggctgttttttcttgagacatcagctatggaggccgtgaatgtggaggaagcctttcagactatcatcacagaggtctatggcattgttaacaggaaagcactggccgccaaagaagcagctgctgcttctgctccgctgccttcccagggtaaaactatcagcattgacagcgctgcaggaaacacaaagagggcatgctgctctgcttgatatgtacaatggagcgttcaacatcatattgtagagagccaggtgtgagattcgcgggtagactcggagcatagtgatcttaaatggtttggaggcaagtcctactttttttttttcagttgcgtgaacattccagagtgcctagctgcagttgcagtttgttcagtgtttcctaatcaaaagttagatgtgtgta

SEQ ID NO: 1258 - DNA, 916 bp, Artificial
  Synthetic
cacgcgtccgaaaagcaaattctcctctcaattttcctcgccatctttacgtgtcttcatcacacgtgctctctcattccatatccttttgcttcttaattcacccgcgaagattccgattcagatcccggtcaattttcgccggtaaatccctcagacaccggcgaatttcatcttccctcgatcgcaatgaatcccgagtatgactacctctttaagcttttgctcattggtgattctgtgcgtgggaaatcatgtcttcttctgaggtttacagacgacacatacctggaaagttacataagcactattggagttgattttaaaatccggacagtagagcaagatgggaagactataaaacttcagatttgggatacagctggacaagaacgctttaggaccatcactagtagctactatcgtggagcccatggcataatagttgtgtatgatgtgacagatcaagagagcttcaataatgtaaaacagtggctgagtgaaattgatcgttatgctagtgacaatgttaacaaaattcttgtcgggaacaagtccgatcttactgcaaatagagtcgtctcatatgaaacagctaaggcatttgctgatgaaattggtattccattcttggagaccagtgctaaagatgctacgaatgtagaacaggcttttatggctatgacttctgctatcaaaaataggatggcaagccaaccaaccaataattccgctaagcctccaacggtgaatatccgtggacagccggtgacacagagtggtggctgttgctcatcttagagtacaaaaaattgtttgctactgtaatatttgctttgctgtctcctccttgtcatgtctattgtggtctgattaaacattggtaaagtttgcttagttgcaatatttttttttt

SEQ ID NO: 1259 - DNA, 655 bp, Artificial
  Synthetic
aaagatccctccaaaaaaaaacgcctttttttttcttgagcacacaagagacgccaatcccaaagcaaagagaagcgcaaagatcatctctttgcttctcgccttctcctcctcctcctcttctccctcctcgtgctccgcccgatccgtccgccgcctccagatccgcgcccatggcgtcgcgcaggcgaatgctcctcaaggtcatcatcctcggtgacagcggggtcgggaagacgtctctgatgaaccagtacgtgaacaagaagttcagcaatcagtacaaagcgacgatcggcgcggatttcctgaccaaggaggtgcagatcgacgaccggctcttcacattgcagatttgggacacagcgggacaggagcgatttcagagtcttggtgtggcattttaccggggagctgactgctgtgttcttgtatatgatgtcaatgttaccaagtcatttgaaaggctcaacagctggcgtgaggaattcctaattcaagctagcccatcagatccagagaatttcccttttgttgtacttggaaacaaaattgatgttgatggtggtaatagccggactgtttctgagaagaaagctaaagcttggtgtgcttctaagggaaacatcccttattttgagacatctgctaaaga

SEQ ID NO: 1260 - DNA, 679 bp, Artificial
  Synthetic
gaattcagattctggtgttgggaaatcatgcctgcgtgctgagatttgctgacgattcatatcttgaaagttacatcagcactattggcgttgactttaaaatacgcactgtggagcaggacgggaagactattaaacttcagatttgggacactgccgggcaagagcgtttcaggacaatcactagcagctactaccgcggagcacatgggattattattgtttatgatgtcacagaccaagaaagctttaacaacgtgaagcagtggttgagcgagattgatcgttatgcgagtgataatgttaacaagcttctggttgggaacaagagtgatctcaccgcaaataaagtcgtgtcaactgaaactgctaaggcatttgctgatgagatagggatcccattccttgaaaccagtgcaaaaaatgcgactaatgttgagcaagcctttatggccatggctgctgaaataaaaaacaggatggcaagccaacctgctatgaacagcgctaagcctccaaccgttcagatccgaggacaacccgttactcagaatagtggttgctgctcctcttcttaaggataagactttagctcggactttttatctctctgacaatctttgtccctccatccttgtaaaactagtctctctctggcacacttattcatcagccatct

SEQ ID NO: 1261 - DNA, 653 bp, Artificial
  Synthetic
tctttttttagcgcgggtttggacgggatctctctcctctttcggcagaagaagaagaagaagaggaggagccatctcgcttccggggatccaagatcaacctttcttcttccaaaatgaatcctgaatatgattatcttttcaagcttctattgatcggggattctggtgttggcaagtcttcgcttcttctgcgatttgctgatgacacctatgtagagagctacataagcactattggggttgactttaaaattcgaactgtggaacttgatgggaagacaatcaagcttcaaatttgggatactgctggacaagagaggttcagaacaatcacaagtagctattaccgcggagcacatgggatcattattgtctatgatgtgactgatgaggagagcttcaacaatgtgaaacaatggttgaatgaaattgagagatatgcaggcgacaatgtgaataaacttcttgtgggtaataaatgtgacctcacagaaaagaaggtggttgaataccagactgtgaagtcatttgctgatgcaatgggaatccctttcctggagacaagtgccaagagtgcaactaatgtggagcaggcttttatgacaatgactgccgaaattaagaacaggatggtatctcagccagccatg

SEQ ID NO: 1262 - DNA, 1211 bp, Artificial
  Synthetic
cccacgcgtccgcccacgcgtccgtctgaattatatttatgctgtttagtatttttgagttttgtttgaataaatatggatggaaacaaggatgaagctaaaaaatgcttgaaaatagcggaagattcgatccaatctgggaatcaagaacgtgccttgaaattcttgaataaagcccgtcgtttagacccttcacttgaaattgatcatcttttatcccaaactgaatcatcccaatctgaaaaccctagttctaaggtaccaacacctgatttttcatctgaaaatgggccccgccatagggtttcgggtagtggtgggtcatcggtggcgtatagtgaggagcaagtgacagttgtgaaagaaattaagaggaaaaaggattactatgagattctcgggttggagaaaagtagttgtagtgttgaggatgtacgcaaggcgtataggaagttgtcgttgaaagtccatcctgataagaataaagcaccgggagctgaggatgcttttaagatggtgtctaaggcgtttcaatgtttgagcgacgaggagagtcgaagtaggtatgatcttgttggatctgaggaatctgtttacgaaagacgcgctcataggcatgcaggtggtgctagaatgaatacatttaatgggttctatgatgacggtaatgttgacgcggaagagattttcaggaatttcttctttggtggaatgcgtccggcaacgactactacacattttagctttggccctagagtggatgtgagatatcaaggaccgactgggtggctgaggactttgattcagttgttgcctgtgatattgattttgttgttgaactttctgccatcttcggacccggtctattccttttcgaagtcttttccatatgatcataggttaaccacgcaaagaggtgtgaattactatgtgaagactgggaaatttgagcaggagtatcctattaatagcccaaagcatgtggcgcttgaagaaaaggttgataatgattatcactcgatcctttctcacaattgcagacttgaattgcagcagcttcattggggttatcgaagagaaactccaaattgtgactctctgaagcagttccaagcagcagcctgattgattggttcaaggtccagttttctccttgtaataccttaaatttttggctttctggttgtaactacttatattcattttgttct

SEQ ID NO: 1263 - DNA, 758 bp, Artificial
  Synthetic
cccacgcgtccgaagatttgaggaaatcttatcggaaactctcggtgaaagttcatcctgataagaacaaagctcctggttctgaagaagcttttaaatccgtctctaaagcttttcaatgcctaagcaacgaagacactagaagaaagtacgacggcagtggttccgatgagcctgcttatcaaccacgccgagatgcgagaagaaacaacggattcaatggattctacgacgatgaatttgatgctgatgagattttcagaagcttctttggtggtggtgaaatgaatcctgctactactcagttccgatcattcaattttggtggaggaactagaacagctaatcaagcttctgatacaggattcaatcctcgtgtacttcttcaaatacttcctgttgtgttcatactactactcaactttttgccttctcctcaaccaatttactcgctttctcatcgtataactacgagctcaaattcaccacgcataggggcgtcacttactttgtgagatcagccaagttcgagcaggaatatccgataagtagcttcgagagacagagggttgaagagcaagttgatagagattacttgtctatacttggccagaattgtcgccatgagcttcagagacaacaatggggatatatccgcgaaacgccacgttgcgacatgatgaagaggtttgatgcagctgctgcataaaccatccaggtcagagagagactgaagcaccaagttagtaaactcaaat

SEQ ID NO: 1264 - DNA, 573 bp, Artificial
  Synthetic
aagtttgaggaagctggcatctggtacgagcatcgcctcattgatgacatggttgcgtatgctctcaagagcgacggcggatatgtctgggcatgcaaaaactacgatggagatgtccagagtgatttcctggcccaaggatttggttcccttggactgatgacttctgtactggtctgtccggatggaaagactattgaggcagaagctgctcatggaaccgtcacccggcactacagagtacaccagaaaggcggcgaaaccagcacgaactccatcgcctccatcttcgcttggtctcgaggacttgctcacagggccgacttggatggcaatgcgagactgagcgactacgcagagaagctcgaggcggcttgcgttggatgtgtggagtctggaaagatgacgaaggacctcgcattgctcatccacggaacaaaggtgtcaaagaaagattatctcaacactgaggagtttatcgatgcggtcgctgccgatctcaagcacaggctcacctcctcttccaaactgtaaagccggatcccgattcctcaggatgcgtgaagaacaccg

SEQ ID NO: 1265 - DNA, 1077 bp, Artificial
  Synthetic
ataccgggctactgatacagttattcaaggacctggaaaactcaagttggtgtttgtgccagaggggacagacgagaagactgaattcgaagtttacaactttactggtgctggtggagtagctttatccatgtacaacacagatgagtcagttcgctcatttgctgaggcttcaatgaacatggcataccaaaagaaatggccactctatcttagtacaaagaataccattcttaagaaatatgatgggaggttcaaggatattttccaagaagtttatgaagcaaattggaaatccaagtatgaggaagcaggaatttggtacgaacaccgtcttatcgacgatatggttgcttatgctttaaagagtgaaggtggttatgtatgggcctgcaagaactatgatggggatgtacagagtgatttcttagcacaaggttttggatcccttgggttgatgacatctgtcctggtgtgtcctgatggaaagaccattgaggctgaagcagcccatggaactgtcacccgccactacagggttcaccagaaaggaggtgaaaccagcacaaacagtattgcgtcaatctttgcctggactcgtggacttgcacacagggcaacgttagacaagaatgaaaggctgttggattttactgagaaactagaggcagcatgcattggtgcagtggaatctggaaagatgaccaaagatcttgcactcatcatccatggatccaagctctcaagagaacattatctcaacactgaagagttcatcgacactgtggcggatgagctcaaagcaagacttctgaaagccaaggcctaaatgtctgggatgacgagaggacagtcttttttctggggcagttgagggatattgaagagaaataaaaggattagggcctgatggtatactacatctcaagaggttttattttataggaggcagtgatgtttgaaccatttaaatctgaatttctatttgctgaaactgctgcaagttattttactgatttgcaattgtacacttggcttattgtttgatcagtttgctaaaagaagaccctcttcact

SEQ ID NO: 1266 - DNA, 642 bp, Artificial
  Synthetic
aggagtttaacctcaagcagatgtggctcgctcccaacggcaccatccgaaacgctctcggcggcaccgtcttccgcgagcccatcgtcatcccccgcgtcccccgtctcgtccccggctggaagcagcccatcatcatcggccgtcacgcctttggcgaccagtaccgcgccaaggaccgagtcatccccggcccgggcaagctgagcatggtcttcacccccgagggcggcaagcccgaggagattgaggtcttccagttcaaggagggcggcggcgtctcccagacccagtacaacactgacgagtccatcaccggcttcgcccacgcctcgttcaagctggccttggacaagaagctgcccctgtacatgagcaccaagaacaccatcctcaagaagtacgacggccgcttcaaggacatcttccaggagatttacgacaccaagtacaagtctgagttcgaggccaagggaatctggtacgagcaccgtctgattgacgacatggtcgcccagatgatcaagagctctggcggctacatcatggctctcaagaactacgacggtgatgtccagtccgacattgtcgcccagggcttcggctccctcggccttatgacctccgtcctcatcacccccg

SEQ ID NO: 1267 - DNA, 457 bp, Artificial
  Synthetic
tggtatcaacgcagagtggtcattcggccggggtggttatgtatgggcatgcaaaaactatgacggggatgtacagagtgatttcttatcacaaggatttggatcccttggattgatgacatcgattctgatatgtccagatggaaagaccatagagtcagaagcagcacatggaactgtgacacggcactacagggttcatcagaaaggtggtgaaaccagcacgaacagcatcgactcaatttttgcttggactcgtggacttgcacatagagcaaagttggacaacaatgctgcactcttggattttaccaagaaattagagggagcttgcatcggcgcggtggagaatgggaaaatgaccaaagacctggcacttatcgcccacggatccagggtcgctagacatcaatatgtgaacaccgaagagttcatcgacgctgtggctgatgagctg

SEQ ID NO: 1268 - DNA, 866 bp, Artificial
  Synthetic
cccacgcgtccgtgatgaggcaatccgagcttttgctgaagcttctatgacaactgcttatgagaagaaatggccgctttatcttagcaccaaaaacacaatcctgaagaaatatgatggaaggttcaaggatattttccaggaggtctatgaagctgggtggaaatccaagtttgaggctgccggaatatggtatgagcatcgtctcatcgatgacatggttgcttatgcacttaagagtgaagggggctatgtgtgggcttgcaagaattacgatggagatgtgcagagtgatttcttagctcaaggctttggttcattgggtttgatgacatcagtattggtgtgccctgatggaaaaacaattgaagctgaagctgcccatggcacggttacccgtcatttccgtgttcaccagaagggaggtgaaaccagcacaaacagcattgcttcaatctttgcttggaccagaggacttgcacacagggcaaagcttgacgacaatgctagacttcttgactttgcactaaaacttgaagctgcttgcgttggaaccgtggaatctgggaagatgaccaaagaccttgctcttcttattcacgggtcttcaaacgtcacaagaagccattacctgaacactgaagagttcattgatgcggttgctgcggagctccggtcaagactggcagccaactgagctttttacaagatactcttgccaacttcagtgcttcatttcccttcttttaaagtcattttggctgtatcaccattaccattcgagttctcattctggactgaatgaacatttacagcatcggtacaaattgttgtcgatccaagcagtccatagatgctgatatcac

SEQ ID NO: 1269 - DNA, 597 bp, Artificial
  Synthetic
gaattcaagaagtgtacgaagctcaatggaaatccaagtatgaagctgccgggatatggtatgaacaccgtctcattgatgatatggtagcctatgcactcaagagtgatggtggttacgtctgggcatgtaagaactatgatggtgatgtacagagtgatttcttagcccaaggtttcggatcccttggattgatgacgtcagtgttggtatgcccagatggaaagaccattgaagctgaagcagcccatggcacagtgacacgtcactaccgggttcaccagaaaggaggtgaaaccagtactaacagcatagcttcaatctttgcttggtcaagaggtcttgctcacagagcaaagttagacgacaatgctagacttttggatttcaccgagaagctggaagcagcttgtattggaactgttgaatcaggaaagatgaccaaagatcttgctcttctcattcatggatccaaggtttccagggaccagtatctcaacactgaagagttcattgatgccgtggcggaggagctgaaagcaagacttgctggcaaatcaaagcctgaataaagcaccatgaaaggctaaggggggg

SEQ ID NO: 1270 - DNA, 618 bp, Artificial
  Synthetic
caataatccgtcatgcagatcttcgtgaaaaccctaacgggaaagaccataaccctcgaagtcgagagcagcgacaccatcgacaatgtcaaggccaaaattcaggacaaagaagggatacctcctgatcagcagaggttgatttttgctggaaaacagttggaagatggtcgaactctggctgattacaatatccagaaagaatcaacacttcacctggttttgaggctcaggggaggaactatgattaaggtgaagactctcactggaaaggaaattgagattgatattgaacccacagacaccattgatcgaattaaggaacgagttgaggaaaaagaaggaatacctcctgtgcagcaaaggcttatttatgctggaaagcagctagctgatgacaagaccgctaaggattacaatattgaaggaggttctgttcttcatctcgttcttgcattgatgggtggtagtctttagaatgctccgaatttgggtaaaaatgtgcaacctttatccacgaatttatcatgacagttctcttttgttttctttttaccttttctcatgtaaaacatgaaaacttggttaaagctgactagctgagattgatttcccctc

SEQ ID NO: 1271 - DNA, 279 bp, Artificial
  Synthetic
cccacgcgtccgctcaaaatcttaaaaactttctctcaattctctctaccgtgatcaagatgcagatctttgttaagactctcaccggaaagacaatcaccctcgaggtggaaagctccgacaccatcgacaacgttaaggccaagatccaggataaggagggcattcctccggatcagcagaggcttattttcgccggcaagcagctagaggatggccgtacgttggctgattacaatatccagaaggaatccaccctccacttggtcctcaggctcc

SEQ ID NO: 1272 - DNA, 916 bp, Artificial
  Synthetic
cggcaagactatcaccctcgaggtggagtcctctgacaccatcgataatgtcaaggctaagatccaagataaggagggcatccccccggaccagcagcgtctcatcttcgctggcaagcagctggaggatggcaggacccttgctgactacaacatccagaaggagtcgacccttcaccttgtcctccgcctccgtggtggcatgcagatctttgtcaagactctgaccggcaagactatcacccttgaggtggagtcttctgacaccatcgacaacgtcaaggccaagatccaggacaaagagggcatccccccagaccagcagcgtctcatcttcgccggcaagcagctggaggatggcaggacccttgctgactacaacatccagaaggagtccaccctccaccttgtcctccgcctccgtggtggcatgcagatctttgtcaagacactgaccggcaagaccatcaccctcgaggtggaatcttctgacaccatcgacaacgtcaaggccaagatccaggacaaggagggcattcccccggaccagcagcgtctcatctttgccggcaagcagcttgaggacggcaggacccttgctgactacaacatccagaaggagtcaacgcttcaccttgtcctccgtctcaggggaggcatgcaaatcttcgtgaagactctgaccggcaagaccatcaccctcgaggtggagtcttctgataccatcgacaatgtcaaggccaagatccaggacaaggagggcattcccccggaccagcagcgcctcatctttgctggcaagcagctggaggatggcaggacccttgctgactacaacatccagaaggagtccaccctccaccttgtgctccgccttcgtggtggtatgcagatctttgtcaagaccctcacaggc

SEQ ID NO: 1273 - DNA, 280 bp, Artificial
  Synthetic
tggtatcaacgcagaggggccattacggcggggccagcaaaggttgatttttgctggtaagcaattggaagatggccgtaccctagctgattacaacattcaaaaggagtcgactttgcaccttgtgctccgtcttcgtggtgggatgcagattttcgtgaagacattgaccgggaaaaccatcactcttgaggtggaaagctctgacactattgacaacgttaaggccaaaatccaggataaggagggaatcccaccagaccagcagagattgattttt

SEQ ID NO: 1274 - DNA, 323 bp, Artificial
  Synthetic
cccacgcgtccgagaaaatgcagatcttcgtgaaaaccctaacggggaagacaataaccttagaggtagaatcatcagacacaatcgacaatgtgaaagcgaagatccaagacaaggaaggaatcccaccggatcagcaacggttgatcttcgccggaaaacaattggaagatggaagaacactagctgattacaacatccagaaagagtcgacgcttcatttggttctacgtctgagaggaggtgcgaagaagaggaagaagaagacgtacacgaaacctaagaagattaagcatacgcacaagaaagtgaagctagcagtt

SEQ ID NO: 1275 - DNA, 557 bp, Artificial
  Synthetic
cccagaccagcaaaggctgattttcgcagggaagcaactggaagatggacgtacattagctgattacaacattcagaaagagtcaacgctccatttggtcctgaggctcaggggtggaaccatgatcaaggtgaagacactcactgggaaggaaatcgagatcgacatcgagcccactgataccattgatagaatcaaggagcgtgttgaggagaaagagggtattccacctgttcagcagaggctcatttatgctgggaagcaacttgctgatgataaaactgccaaggattacaacattgaaggtggctcagtgctccatctcgtgcttgctctgaggggtggtcagtagatgtagtttccatgcccgcattatctctaaagggagaagcatatttgctattccatttctatctgtagttgctgcagacttatagctatatttggtaggattattgaagtactatgcgattggcgcattgtgtattggaatcaattgtcatctgtactggaaaggaaatattggaactaagttaagcagtagtttatcaattgcc

SEQ ID NO: 1276 - DNA, 640 bp, Artificial
  Synthetic
ccaccctccaccttgtgctcaggctcaggggaggtatgcagatcttcgtcaagaccctgaccggcaagaccatcaccctcgaggtcgagtcctcggacacgatcgacaacgtgaaggccaagatccaggacaaggagggcatccccccggaccagcagcgtctcatctttgctggcaagcagctggaggatggccgcacccttgccgactacaacatccagaaggagtccaccctccaccttgtgctcaggctcaggggtggtatgcagatcttcgtcaagaccctgaccggcaagaccatcacgcttgaggtcgagtcctcggacacgatcgacaatgtgaaggccaagatccaggacaaggagggtatccccccggaccagcagcgtctcatcttcgccggcaagcagctggaggatggccgcaccttggctgactacaacatccagaaggagtccacccttcacctggttctcaggctcaggggtgggatgcagatcttcgtgaacaccctgactggcaagaccattacccttgaggttgagtcgtccgacactattgacaacgtgaaggcgaagatccaggacaaggagggcatccccccggaccagcagcgtctgatctttgctggtaagcagct

SEQ ID NO: 1277 - DNA, 518 bp, Artificial
  Synthetic
gcagatcttcgtcaagaccttgactggcaagaccatcacccttgaggtcgagtcgtctgacaccattgacaatgtcaagggcaagatccaggacaaggagggcatccccccagaccagcagcgtctcatcttcgccggcaagcagctggaggatggccgcacccttggtgactacaacatccagaaggagtccaccctccaccttgtgctcaggctcaggggaggtatgcagatcttcgtcaagagcctgaccggcaagaccatcaccctcgaggtcgagtcctcggacacgatcgacaacgtgaagggcaagatccaggacaaggagggcatccccccggaccagcagcgtctcatcttcgccggcaagcagctggaggacggccgcacccttggcgactacaacatccagaaggaatccaccctccaccttgtgcttaggctcaggggaggtatgcagatcttcgtcaagaccctgactggcaagaccatcacacttgaggtcgagtcctcggaca

SEQ ID NO: 1278 - DNA, 1625 bp, Artificial
  Synthetic
cgcgaggctctcgtcgtcgaatcgaatcctctcgcgtcctcaagatgcagatctttgtgaagacattgaccggcaagactatcaccctcgaggtggagtcctctgacaccatcgataatgtcaaggctaagatccaagataaggagggcatccccccggaccagcagcgtctcatcttcgctggcaagcagctggaggatggcaggacccttgctgactacaacatccagaaggagtcgacccttcaccttgtcctccgcctccgtggtggcatgcagatctttgtcaagactctgaccggcaagactatcacccttgaggtggagtcttctgacaccatcgacaacgtcaaggccaagatccaggacaaagagggcatccccccagaccagcagcgtctcatcttcgccggcaagcagctggaggatggcaggacccttgctgactacaacatccagaaggagtccaccctccaccttgtcctccgcctccgtggtggcatgcagatctttgtcaagacactgaccggcaagaccatcaccctcgaggtggaatcttctgacaccatcgacaacgtcaaggccaagatccaggacaaggagggcattcccccggaccagcagcgtctcatctttgccggcaagcagcttgaggacggcaggacccttgctgactacaacatccagaaggagtcaacgcttcaccttgtcctccgtctcaggggaggcatgcaaatcttcgtgaagactctgaccggcaagaccatcaccctcgaggtggagtcttctgataccatcgacaatgtcaaggccaagatccaggacaaggagggcattcccccggaccagcagcgcctcatctttgctggcaagcagctggaggatggcaggacccttgctgactacaacatccagaaggagtccaccctccaccttgtgctccgccttcgtggtggtatgcagatctttgtcaagaccctcacaggcaagaccatcaccctggaggttgagagctcggacaccatcgacaacgtcaaggccaagatccaggacaaggagggcatccccccagaccagcagcgtctcatcttcgccggcaagcagctcgaggatggccgcaccctcgccgactacaacatccagaaggagtctaccctccacctggtgcttcgtctccgtggtggtatgcagatcttcgtgaagaccttgactgggaagaccatcactttggaggttgagagctccgacaccattgataatgtgaaggccaagatccaggacaaggaggggattcccccagaccagcagcgtctgatcttcgctggcaagcagctggaggatggacgcaccctcgccgactacaacatccagaaggagtccaccctccacctggtgctccgcctccgtggtggtcagtaatcagccagtttggtggagctgccgatgtgcctggtcgtcccgagcctctgttcgtcaagtatttgtggtgctgatgtctacttgtgtctggtttaatggaccatcgagtccgtatgatatgttagttttatgaaacagtttcctgtgggacagcagtatgctttatgaataagttggatttgaacctaaatatgtgctcaatttgct

SEQ ID NO: 1279 - DNA, 817 bp, Artificial
  Synthetic
ggacaaggaaggaatccctccggatcagcagagacttatctttgccggtaagcagcttgaagacggaagaactcttgctgactacaacattcaaaaggagtcgacccttcatttggtgcttcgtctcagaggtggtatgcaaatctttgtcaagaccctcactggtaaaacaatcacccttgaggttgagagttcagacaccattgacaatgtcaaagctaagatccaagataaagagggaattcctccggatcagcagaggcttatctttgccggtaagcagctcgaagatggacgcacccttgcagattacaacatccaaaaggagtcgacacttcatcttgtgcttcgtctccgtggtggtatgcagatctttgtgaagacccttaccggaaagaccattactctggaggttgaaagctcagacaccatcgataatgtcaaggctaagattcaggacaaggaagggatcccaccagaccaacagagactcatcttcgctggaaaacagcttgaggatggtcgcacacttgcagattacaacatccagaaggagtcgactcttcacttggttcttcgtcttcgtggtggaagcttctaagctttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgtttacc

SEQ ID NO: 1280 - DNA, 370 bp, Artificial
  Synthetic
gccattacggccgggaatcagaaaaagcaaagcgggtgggctgaagagtgcgccgcaaaaggcagatcttcgtgaaaaccctaaccgggaagacaatcacgctcgaggttgaatcgagcgacaccattgataatgtcaaggctaagattcaagacaaagaaggtattccaccggaccagcagcggttgatattcgccggaaagcagctcgaagatggacgtactcttgctgattataacatccagaaagagtcaactttgcatttggttttgaggcttcgtggagggattattgagccttctctgatggctttggctaggaagtacaaccaggataagatgatttgtcgcaagtgctatgctcgcctgca

SEQ ID NO: 1281 - DNA, 656 bp, Artificial
  Synthetic
gccattacggccggggatagaagaggagtagaagatcgctggtgaggggcggagaaaatgcagatcttcgtgaaaactctgacgggtaaaactataacccttgaggttgaatccagtgacacaattgacaatgtcaaggccaaaattcaagacaaggaaggaattccaccggaccaacaaaggctgatttttgctggtaagcagcttgaagatggccgcacccttgctgactataacattcagaaagagtcgactctgcatttggtactgaggcttcgtggtggaattattgaaccatctttgatggctttggctaggaagtacaatcaggacaaaatgatttgccgcaagtgctatgctcgtttgcatccccgtgctgtcaattgccgcaaaaagaagtgtggccacagcaatcagttgaggcccaagaagaagattaagtagatggtgattttgaagtcccggcaacatgtagctgctaatgttgagatccttaagaaattattagatatgttgttgggttgcctgttcaatttactctgaaacattgaaggatttgtgtttgagctacttcaatatttcttaatgagctagattctgttggttacattacataagttttgctcgatgtgtagttctatgtgcttttatccagc

SEQ ID NO: 1282 - DNA, 294 bp, Artificial
  Synthetic
aaaaagatgcagatcttcgtgaaaaccctaacggggaagacgatcactctcgaggtcgagtcctctgacaccatcgacaatgtcaaggccaagatccaagacaaggaaggaatcccaccggaccagcagcgattgattttcgccggaaagcagctcgaagacggacgtaccttagccgattacaacatccagaaggaatcaacgcttcaccttgtccttcgtctccgtggaggtgctaagaagaggaagaagaagacctacaccaagcctaagaagatcaagcacaagcacaag

SEQ ID NO: 1283 - DNA, 306 bp, Artificial
  Synthetic
cgcggtatgcagatcttcgtgaagactctcaccggaaagactatcactttggaggtagagagctctgacaccattgacaacgtgaaggccaagatccaggataaggaaggaatccctccggaccagcagaggttgatctttgccggaaaacaattggaggatggtcgtactttggcggattacaacatccagaaggagacgacccttcacttggtgttgcgtctgcgaggaggtatgcagaaattcgtcaagactttgaccggaaagaccatcacccttgaagtggaaagctccgacaccattgac

SEQ ID NO: 1284 - DNA, 865 bp, Artificial
  Synthetic
taacggaaacatagtcgatcaattatttatcagaggctgtacatggccccaaaacataaaccaccaaagtactagatgaaacgatacatgaacttggttcagtaaccataagagagagagacaaggtttagaaaccaccacggagacggaggaccaagtgaagagtagactccttctggatgttgtagtcggccaaagtacgtccatcctcaagctgctttccagcgaagatgagacgctgctggtccggaggaatgccttccttgtcctggatcttagccttcacgttatcaatggtgtcggagctctcaacttcaagagtgatggtctttccggtcaaagtctttacgaagatctgcatacctccacgcagacgcaagaccaaatgaagcgtagactccttctggatgttgtaatccgccaaagttctgccgtcctcaagttgctttccggcgaagatcaacctctgctggtccggaggaataccctccttatcttggatcttggccttgacgatgtcaatggtgtcagagctctccacctcaagagtaatcgtctttaccgttagggttttaacgaaaatctgcataccaccacggagcctgaggaccaagtggagggtggattccttctggatattgtaatcagccaacgtacggccatcctctagctgcttgccggcgaaaataagcctctgctgatccggaggaatgccctccttatcctggatcttggccttaacgttgtcgatggtgtcggagctttccacctcgagggtgattgtctttccggtgagagtcttaacaaagatctgcatcttgatcacggtagagagaattgagagaaactttttcaccattttgag

SEQ ID NO: 1285 - DNA, 198 bp, Artificial
  Synthetic
aaaagcttatccttctccggcaagcatcttgaggacggacgtactatcgcctgttacaacatccacaacgaatctactcttcacttggtcctccgcctccgaggtgggatgcatatcttagtcaaaaccctcaccggcaaaacaatcactcttgaggccgaaagctcccacaccattgatagatgtcaaggctcaaaa

SEQ ID NO: 1286 - DNA, 597 bp, Artificial
  Synthetic
ttgctttctctctctctgtctctctctttctgtctaccctttctctctctgtcctctgtttgagccaagaagaagatgcagatcttcgtgaagaccctgaccggcaagaccatcaccctcgaggtcgaaagctctgacaccatcgacaacgtcaaggccaagatccaggacaaggagggtatcccccctgaccagcagcgcctcatctttgctggtaaacagcttgaagatggccgcacccttgctgattacaacatacagaaggagtctaccctccaccttgtccttcgcctcaggggcggtatgcaaatcttcgtcaaaaccctcactggcaagaccattacccttgaagtcgagagttctgataccatcgataatgtgaaagccaagatccaagataaggagggaattccccctgaccagcagcgccttatctttgctggtaaacagcttgaagatggccgcaccctcgctgattacaacatacagaaggagtctaccctccaccttgtccttcgcctcaggggtggtatgcaaatcttcgtcaaaaccctcaccggcaagaccattactcttgaagtcgagagttctgacaca

SEQ ID NO: 1287 - DNA, 632 bp, Artificial
  Synthetic
agcgtccgaagacattgaccgggaaaacctcactcttgaggtggaaagctctgacactattgacaacgttaaggccaaaatccaggataaggagggaatcccaccagaccagcagagattgatttttgctggtaagcagctggaggatggccgaaccctcgctgattacaacattcagaaggagtctacccttcacttggttctccgtctccgcggtgggatgcagatcttcgtcaaaacactcactgggaagacaatcaccctcgaagttgaaagctccgatactatcgacaatgttaaggctaagattcaggacaaggaaggtattccaccggaccagcagagattgatttttgctggtaagcagttggaagatgggagaactttagctgattataatatccagaaggaatccacactgcatttggtgctccgtcttcgtggtgggatgcagatttttgtgaagacgttgaccgggaaaaccatcactttggaggtagagagttctgatacgatcgacaatgtgaaggctaagatttaggacaaggagggtatcccgccagatcagcagaggctgatttttgctgggaagcagttggaagatggaaggactctggctgattataatattc

SEQ ID NO: 1288 - DNA, 576 bp, Artificial
  Synthetic
gaggttttagggtttttccgggcgcgatgtatggtggagatgaggtatccgccattgtcgtcgatctgggatcgcattcttgtaaagcgggctatgccggagaggatgcgccaaaggcagtgtttccatcggttgtaggagctgtgggggaaaagcccaacagcacttactatgttggaaatcaggcaatacaatataggcgtgattttatggaggtttgccctgcattgaaagatggtctcgtagcagattgggacatagttgagggcatctgggatcacgctttcaaggaacggctcctgattgaccccaaagagcatccaatgcttctcgctgaggcatcattcaatcctcagcaacacagggaaaagactgtagagctcatgtttgacaaatatggtgtacctgcggtctttctcgctaagaatgctgtgcttacgtcgtttgcgtctggacgagctacatctctggttgccgactgtggtggtggctcaactactgttgctgcagtccatgatggctatgttttgcacaaggctgttttcaggtctcccatcggaggcgaagtcctcactg

SEQ ID NO: 1289 - DNA, 662 bp, Artificial
  Synthetic
aacaatgcaagacgaagttcaagctttagttattgacaatggatctggaatgtgcaaggctggatttgccggagatgatgctcctcgagctgtcttcccttccatcgttggacgacctcgacacactggagtcatggttggtatgggacagaaggattcatacgttggagatgaggctcaatccaagagaggtatcttgacccttaagtaccccattgagcacggaattgtcactaactgggatgatatggagaagatctggcatcacactttctataacgaacttcgagttgcccctgaggaacaccctgtccttttgactgaggctcctttgaaccctaaggctaaccgagagaagatgactcaaatcatgttcgagaccttcaacactcccgccatgtacgttgccatccaagctgtcctttccctctatgcttctggacgaaccaccggaattgttcttgactctggtgatggtgttacccacactgtccctatctatgaaggatatgcccttccccacgctattcttcgacttgacttggctggacgagatttgactgactacatgatgaagatcttgaccgagagaggatactctttcaccaccactgctgagcgtgaaatcgtccgagacatcaaggagaagctcgcttacgttg

SEQ ID NO: 1290 - DNA, 266 bp, Artificial
  Synthetic
tgccgctgttgattctcctccatttctctatctttctctctcgctgcttctcgaatcttctgtatcatcttcttcttcttcaagtgaaaaatggccgatggtgaggatattcagccacttgtctgtgacaatggaactggaatggtgaaggctggttttgctggtgatgatgccccgagagcagtgttcccaagtattgttggtcgtcctaggcacactggtgtcatggttggtatgggtcagaaagatgcttacgttggtgatga

SEQ ID NO: 1291 - DNA, 359 bp, Artificial
  Synthetic
cccacgcgtccgtatggaaaagatctggcatcacactttctacaatgagcttcgtattgctcctgaagagcaccctgttcttcttaccgaggctcctcttaacccaaaggccaacagagagaagatgactcaaatcatgtttgagacctttaactctcccgatatgtatgtcgccatccaagctgttctctccttgtacgccagtggtcgtacaaccggtattgtgctggattctggtgatggtgtgtctcacactgtgccaatctacgagggtttctctcttcctcatgccatcctccgtcttgaccttgctggacgtgaccttactgattacctcatgaagatccttacagagagag

SEQ ID NO: 1292 - DNA, 679 bp, Artificial
  Synthetic
gttgaaactctttctcacattctctacggttttcaaaagaaaagatcagcaacaaagaaaatggctgatgttgaggacattcaacctcttgtttgtgacaatggaactggaatggttaaggctggatttgcgggagatgatgcaccaagggctgtttttcctagcattgttggtcgtccccgtcacaccggggtaatggtaggcatgggacagaaggatgcatatgttggagatgaagcacagtcgaaacgtggtattctcacgctgaagtatcctattgaacatgggatagtaaataactgggatgatatggaaaagatttggcatcatactttctacaacgaacttcgagttgctcctgaagaacatcctgttctgctcactgaagcacctcttaacccgaaggctaatcgtgagaaaatgactcagataatgtttgaaacattcaatgcgccagcaatgtatgttgcaattcaagctgttctgtctttgtatgctagtggacgtacaactggtattgtcctggattctggagatggtgtcagccacacagttcctatttatgaaggttatgcacttcctcatgctatcctacgtctcgaccttgctggtcgtgatctcactgagtacatggcaaaaattctcactgaacgtggatattccttcactacaactgctg

SEQ ID NO: 1293 - DNA, 818 bp, Artificial
  Synthetic
tccttacagcgtttcaacagagtgttgtagagagagaaagcgagccggccttcgtctttggttggctttgcttctcggatcgatcttcctctcttttttcctcttttgttttcaggtgaattaagatggccgacggcgaggatattcagccccttgtttgtgacaatggaaccggaatggttaaggctggatttgctggtgatgatgctcctcgagcagtgtttcccagtattgtgggtcgtcctcggcacactggtgttatggtcggaatgggacagaaggatgcttatgtgggtgatgaagctcaatccaagagaggtatcttaaccttgaaatatcctattgagcatggtatagtcagcaactgggatgatatggagaaaatatggcatcatactttctacaatgagcttcgagttgctcctgaagaacaccctgttctcctgactgaggcaccccttaatcctaaggccaacagagagaagatgacccagattatgtttgagacatttaacgttccagctatgtatgttgctattcaggccgtgctctcattgtatgctagtggtcgtaccactggtattgtgttggactctggtgatggtgtgagtcacactgtccctatctatgaaggttatgctttgccccatgccattcttcgtttggatcttgctggccgagaccttactgatagcctgatgaagatcctcaccgagagaggatacatgttcaccaccaccgctgaacgggaaattgtccgtgatatgaaagaaaagcttgcctatgtggctcttgactacgagcaggaacttgaaact

SEQ ID NO: 1294 - DNA, 683 bp, Artificial
  Synthetic
tttcactcgtacgcaaattctaggagcaaagttgtaagaaatggcagacgttgatgacattcaaccacttgtttgtgataatggaaccgggatggtcaaggctggttttgctggagatgatgccccaagggctgtttttccgagcattgttgtttttatctcgtcacactggagtgatggttgggatggggcagaaggatgcctatgttggggacgaggcccagtcaaaacgtggtattctgtcgttgaagtatcctattgaacatggtatagtgaataactgggatgacatggagaagatttggcaccacaccttctacaatgagcttcgagttgctccagaagagcatcctgttctgctcactgaagcacctctcaacccaaaggccaatcgtgagaagatgactcaaataatgttcgaaaccttcaactgtcctgcaatgtatgttgcaattcaagctgttctgtctttatatgctagtggtcgtactactggtattgttttggattccggagatggtgttagccacacagttcctatctatgaaggttatgcacttccacatgcgatcctacgtcttgaccttgctggccgtgacctcacagagcatttggcaaaaatcctcactgaacgtggatactcattcaccaccagtgctgagaaggaaattgttagggacatg

SEQ ID NO: 1295 - DNA, 678 bp, Artificial
  Synthetic
aaatctctttgctaccaacaaccacacaaattaaaaatggaagacgaaactgttgccctcgttatcgataacggatccggtatgtgcaaggccggtttcgccggtgatgacgctccccgagctgttttcccctccatcgtcggtcgaccccgacatcagggtgtcatggtcggcatgggccagaaggactcctatgttggtgatgaggcccagtccaagcgaggtatcctgaccctccgataccccatcgagcacggtattgttaccaactgggatgacatggagaagatctggcaccacaccttctacaacgagctccgagttgctcctgaggagcaccccgtcctgctcaccgaggcccccatcaaccccaagtccaaccgagagaagatgacccagatcttcttcgagactttcaacgctcccgctttctacgtctctatccaggccgtcctctccctgtacgcctctggtcgagtcaccggtatcgttcttgactctggtgatggtgtcacccacgttgtgcccatctactctggtttctctctcccccacgccatcatgcgactcgatatggctggccgagatcttaccgactacctcatgaagattctctccgagcgaggttactctttcaccaactccgccgagcgagaaatcgtccgagacatcaaggag

SEQ ID NO: 1296 - DNA, 746 bp, Artificial
  Synthetic
ggccattcgttggtttgccttcctcctcctcctattcgccttcgccttcttcttcttccaccaaggttaacctgccatcgatttcatcaatctcttccctggtgaatacaattgataaatcatggcagatgttgaggaagtgtcaccacttgtctgcgacaatggaaccggaatggtgaaggctgggtttgctggagatgatgcgccacgtgcggttttccccagcattgttggaaggcctaggcataccggtgtcatggtgggcatgggacagaaggatgcttatgttggggatgaggcacaatccaaacgtggtattctcaccttgaagtatcccatcgaacatggtattgtcaccaattgggatgacatggaaaagatttggcaccacacattttacaatgagttgcgagttgctccagaagagcaccctgtgctccttacagaggcccccatgaacccaaaggctaaccgtgaaaaaatgacccaaattatgtttgacaccttcaacgtgccggccatgtatgttgccatccaggctgttctctccttgtatgctagtggaaggaccaccggtatcgtgcttgactctggtgatggtgtctcccacactgtgcccatttatgaaggttatgctttgccccatgccattcttaggctggatctggctgggcgtgatttgactgatgccctcatgaagatcctcacggaacgcggttattccttcaccactactgctgagcgag

SEQ ID NO: 1297 - DNA, 630 bp, Artificial
  Synthetic
ctcttcctccgtcgcggaaggccatcgctcatcagtctcatagcgagctatggcggacggggaagaggtccagccccttgtttgtgacaatggaaccggaatggtgaaggctgggtttgcgggagatgatgcaccccgtgccgtgttcccgagcatagtggggcggcctaggcatacgggggtcatggtgggcatggggcaaaaggatgcttacgtcggcgatgaggcccaatcgaaacgtggtatcttgactctgaagtatccgatcgagcacggcattgtgaccaactgggatgacatggagaagatatggcaccacactttctacaatgagctccgagtagcacctgaggaacaccccgtgcttctcacagaggcacccatgaaccccaaggccaatcgagagaagatgacccagatcatgtttgatacctttaacgttccggccatgtatgtcgctattcaagctgttctttctctctatgctagcggaagaacaaccggtatagtgatggattcgggtgatggtgtcactcatacggtccccatctatgaaggctacgcgcttccgcatgcgattctccgtcttgaccttgcggggcgagacctaactgacgctctaatgaagat

SEQ ID NO: 1298 - DNA, 625 bp, Artificial
  Synthetic
gcgtggacagggcgcaagggcggcggcggtcatcgcgcggcggcccggatctttaccgaaatccattctttctccgcgctaagaggcagccatgtcggaaaccgaggatgtccagccgctcgtctgcgacaatggatccggaatggtcaaggccggatttgccggagacgatgccccccgtgcggtgtttccaagcatcgtgggtcgcccacggcacactggggtcatggttggaatgggtcagaaggatgcctatgttggagacgaggcccagtccaagcgtggaatcttgaccctaaagtacccgatcgagcatggcattgttaccaactgggacgatatggagaagatatggcaccataccttctacaatgagctccgtgtcgcccccgaggagcacccggttctcctcaccgaggcaccgctcaaccccaaggccaaccgcgagaagatgacgcagatcatgttcgagaccttcaacgttcccgcaatgtacgttgcgatccaggcggtgttgtcgctctacgccagcggtcggacaactggtattgtgctcgattctggtgatggtgttacgcacactgtgcctatctacgagggatatgctttgccgcatgccatttta

SEQ ID NO: 1299 - DNA, 715 bp, Artificial
  Synthetic
gggcgagagcaagctcttgatcgacgagagtcttgagcgatcggtcaaagaaggcggcgtcttcctcgcgaatcgatcgaggcatggcggaggaagaaatccagccgctggtgtgcgacaatggatccgggatggtcaaggctggattcgccggcgacgatgccccaagggccgtgtttccaagcatcgtggggcggccgaagcacacaggggtcatggttggaatggggcagaaggatgcgtacgtgggggacgaggcgcagtccaagcgaggaattctagcgctgaagtacccgatcgagcacgggatcgtgaccaactgggatgatatggagaagatttggcaccacaccttctacaacgagcttcgaatcaccccggaagaacaccctgttcttctcacagaggcgccgctcaacccaaaggccaatcgcgagaagatgacccagatcatgtttgagacgttcaatgtcccggccatgtatgtatcgatccaagccgtgttgtcgctctacgccagtggacgcaccacaggtatcgttctggattcgggtgatggtgtcacgcacactgtcccaatctacgaaggatatgcactgccgcatgcaatcctccggctggatcttgccggccgcgacttgaccgactctctcatgaagatcctgaccgaaagaggtacactttcaccaccacggccgagcgcgagatcgtgaga

SEQ ID NO: 1300 - DNA, 624 bp, Artificial
  Synthetic
gttcttcttcttctctgttttgtcctgcaggaagagaagaagatcttggtgagctctatcctcactcacctctacacagtacaggaactacctggtgagcaatatatactggtttcgtcatggcagatgttgaagaagtaacacccctcgtctgtgacaatggatctggaatggtcaaggctggatttgctggagatgatgctccacgtgcggtattccctagtatcgttggacggccccgacatactggggttatggttggtatggggcaaaaggatgcttatgttggggatgaggcacagtcgaaacgtggcatacttaccttgaagtatccgatagaacatggtattgtgacaaattgggatgacatggaaaagatatggcaccacaccttctacaatgaacttcgtatcgctcctgaggagcatcccgttctcctcactgaagcacctatgaacccaaaggccaaccgtgagaaaatgacccaaatcatgttcgacaccttcaatgtccctggcatgtatgttgccatacaagctgtcctctctctctatgctagtggtagaactactggtatagtgctcgattcgggtgatggtgtcacccacactgtgcccatctatg

SEQ ID NO: 1301 - DNA, 639 bp, Artificial
  Synthetic
accatcgccattgccaccacctctcctatatctcgccctcccccaatttcccaccaccatcgccattgccaccacctctcctatatctcgccctccccctcctccctcccacgccattcgcctccttcttgctgcagccgccatccccggttcggttctctcctcttctttagatcagttaaaataaatggctgacgcagaggacattcagccccttgtctgtgacaatggaaccggaatggtcaaggctgggtttgctggagatgatgctccccgtgctgttttcccgagtattgttggccgtccgcgacatacaggcgttatggttgggatgggacaaaaagatgcttatgtcggtgatgaggcccaatccaagaggggtatcctaaccttgaaataccccattgagcatggaattgtaagcaactgggatgacatggagaaaatttggcaccacacattctacaatgagcttcgtgtagcaccagaagagcatccaattcttcttacggaggctccacttaaccctaaggccaacagggagaagatgacacaaattatgtttgagacattcagcgttccagccatgtatgtcgctattcaagccgtgctttccctctatgctagtggacgtactac

SEQ ID NO: 1302 - DNA, 609 bp, Artificial
  Synthetic
cccacgcgtccgccactctcgcctcctcgcgactcggagttcaccgccgccaccgcctccgccgccgatctccccgtcccgccgcgccgccgccaccgtcctccctcctccggccgcatccccggaattcagaaccagtaggaggaaatggctgacggcgaggacatccagccccttgtgtgtgacaatggaactggcatggtcaaggctgggtttgctggggacgattcgcccagggctgttttccctagtatcgtggggcgcccccgtcacaccggtgtgatggttggtatggggcagaaggatgcctatgttggtgatgaggcgcagtccaagagaggtatcctcaccttgaagtacccgatcgagcatggtattgttagcaactgggatgacatggagaagatctggcatcacaccttctacaacgagctccgtgtcgcgcccgaggagcaccctgtgttgctgactgaggccccgctcaaccccaaggctaacagggagaagatgacccagatcatgtttgagactttcaatgtgccagctatgtatgtcgccatccaggccgtgctctccctgtatgccagtggacgtacaactggtatcgtg

SEQ ID NO: 1303 - DNA, 686 bp, Artificial
  Synthetic
  misc_feature (630)..(630): The residue at this position can be any nucleotide.
gaattcggttacagactcacaaacgcacaatctagggtttcgttgcaggctatagaagatggcagactctgaggatattcagcccctcgtctgtgataatggaacaggaatggttaaggccggatttgctggagatgacgctccaagggctgttttccctagtattgtgggtcgccctcgccacaccggtgtgatggttggtgtgggacagaaagatgcgtatgttggggatgaagctcaatcaaagaggggtatcttaactttaaaatacccaattgagcacggtattgtgagcaactgggatgacatggagaaaatctggcatcacactttctacaatgagctccgtgtggccccagaagagcacccagttctcctcactgaagcacctctcaacccaaaggctaatcgtgagaagatgactcaaatcatgttcgagaccttcaacactcctgccatgtatgttgccatccaggctgttctgtccctatatgccagtggtcgtactactggtattgtcttggattccggggatggtgtcagccatacagttcccatctatgaaggttacgccctaccacacgccatcctgcgtcttgacctcgcaggacgtgatctcactgatgcgtngatgaaaatcttgacggagcgcggttactctttcaccaccacagccgagcgggaaa

SEQ ID NO: 1304 - DNA, 594 bp, Artificial
  Synthetic
gaattcgaccaaaccttttcactctatatggtcttgtgtttcttcttctctttcagtagagagaagagaaaacccagtggagaaatcacaatttcagtctctcactctataactctaaaaggcgcgcattaagcaatggcagatggtgaggatatccagccccttgtatgtgacaatggaacaggaatggtgaaggctggatttgctggagatgatgctccaagagccgtattccctagtatcgttggtcgacctagacatactggtgttatggttggaatgggacagaaagatgcatatgttggtgacgaggctcagtctaaaagaggtattcttacgttaaaatacccaattgagcatggtattgtaagcaactgggatgatatggaaaagatctggcatcacaccttttacaacgagcttcgggtggctcccgaagaacatccagttctccttactgaagcccctctcaatcctaaagccaacagagagaagatgacacagattatgtttgaaactttcaatgtccctgccatgtacgttgccattcaagctgtgctttctctttatgccagtggtcgtaccacaggtatt

SEQ ID NO: 1305 - DNA, 1132 bp, Artificial
  Synthetic
atgataaccaacgaattcctcctcaacagaaattgaatttgaggctcatttaagctcatattcatttcctgtttagaggagttatactttcaaagcaagaacgcggctagcacaataggccatcaccaacaataaccatattggcaaaatccatttaagcacataaaagatggcagaaggtgaggaaattcagcctcttgtctgtgataatggaactggaatggttaaggctggattcgctggagatgatgctccaagagctgtgttccctagcattgttggacgccctcgtcacactggtgtgatggttggcatgggccagaaggatgcttatgttggtgatgaggctcaatccaaaaggggtattttgactttgaagtatccaattgaacacggaatcgttagcaattgggatgatatggagaaaatttggcatcacaccttctacaatgaacttcgtgtggctccagaagaacaccctgttctcctcacagaagctcctcttaatccaaaggccaatcgagaaaagatgactcagatcatgtttgagaccttcaacgcccctgccatgtatgtcgccattcaggctgttctttccctctatgccagtggacgtacaactggtattgtgctggactctggtgatggtgtcagccacacagttcccatctatgaaggttatgctctcccacacgcaatcctgcgtcttgatctggcagggcgtgatctcacagatcacctcatgaagattctcacagaaagaggctactcttttaccaccacggccgagcgggaaattgttagggatgtgaaggagaagttggcttacattgctcttgactatgaacaagaacttgaaacagcaaagaccagctcatccgtggagaagagctacgagctgcctgatggacaagtcatcaccattggtgctgagagattccgctgcccagaagttctgttccaaccatcaatgatcggaatggaagctgctggcattcatgaaaccacatacaattccatcatgaagtgtgacgttgacatcagaaaggatctgtacggaaacattgtcctcagtggtggtaccaccatgttcccgggcattgctgataggatgagcaaggaaattactgca

SEQ ID NO: 1306 - DNA, 807 bp, Artificial
  Synthetic
ctaaactctttttctctctacaatttcgaaggaagtagcatgagatggcagatggagaggatattcagccacttgtctgtcacaatggaacaggaatggtcaaggctgggtttgctggagatgatgctccacgagctgtattccctagtattgttggccggccccgccatactggtgtgatggtgggtatgggtcagaaagatgcctacgtgggagatgaagctcaatcaaaaagaggtattttaactcttaaatacccaattgagcatggaattgtcagcaactgggatgatatggagaagatctggcatcatactttctacaatgagcttcgtgttgcgcccgaggagcatccagtcctcttaactgaagcgcctcttaacccaaaggctaatcgtgaaaagatgacccagattatgtttgagacttttaataccccagctatgtatgttgctattcaggctgtcctctcactgtatgccagtggtcgtaccaccggtattgtgttggactctggtgatggtgtcagccacaccgtcccaatttatgaggggtatgccctcccacatgccattctccgtcttgacttggcaggccgtgacctcactgatagtttgatgaagatccttaccgagcgtggttacatgttcaccacctcagctgagcgggaaattgtcagggacgtgaaagaaaagcttgcttacatagctcttgaatatgaacaggaactcgagactgcaaagaccagctcttctgtagagaagaactatgagctaccggatgggcaggtgatcaccattggtgctg

SEQ ID NO: 1307 - DNA, 615 bp, Artificial
  Synthetic
cccggtcgactccactctcgcctcctcgcgggtcggagttcaccgccgccaccgccgatctccccgtcccgcgccgcccgccgccgccgtcctccctcctcccgccgcatcccggaattcagaaccagtaggaggaaatggctgacggcgaggacatccagccccttgtgtgtgacaatggaactggcatggtcaaggctgggtttgctggggacgatgcgcccagggctgttttccctagtatcgtggggcgcccccgtcacaccggtgtgatggttggtatggggcagaaggatgcctatgttggtgatgaggcgcagtccaagagaggtatcctcaccttgaagtacccgatcgagcatggtattgttagcaactgggatgacatggagaagatctggcatcacaccttctacaacgagctccgtgtcgcgcccgaggagcaccctgtgttgctgactgaggccccgctcaaccccaaggctaacagggagaagatgacccagatcatgtttgagactttcaatgtgccagctatgtatgtcgccatccaggccgtgctctccctgtatgccagtggacgtacaactggtatcgtgttggactctggtgatg

SEQ ID NO: 1308 - DNA, 980 bp, Artificial
  Synthetic
ttcacccgctattcagtcaaacagcaaaaagggtttgatttcaatcaagtccttagaagatggctgaaggtgaggacattcaaccactcgttgttgacaatggaactggaatggttaaggctggctttgctggagacgatgctccaagggctgtatttcctagtatagttggtcgtcctagacaccaaggagtaatggtcgggatggggcaaaaagatgcctatgttggtgatgaagctcagtctaaaagaggtattctgactttgaaatatccgattgaacatggtattgtcagcaactgggatgacatggagaaaatttggcatcatacattttacaatgagcttcgtgttgctcccgaggagcatcctgttcttcttactgaggcaccacttaaccccaaggcaaaccgagagaaaatgacccagatcatgtttgagaccttcaatgtgccagccatgtatgttgcaatccaggccgttctttctctgtatgctagtggtcgtactactggtattgtgcttgattctggtgatggtgtgagccacactgtccccatctatgagggatatgcacttccccatgccatcttgaggttagatcttgctggtcgtgatcttactgattatctcatgaagattctcactgagagaggttatatgtttaccacatctgctgaacgggaaatcgttcgtgatgtgaaggagaagcttgcctatgtcgcattggattttgaacaggagcttgagacagcaaagagtagctcatcagttgagaagagctatgagcttcctgatggacaagtaattactattggtgctgagaggttccgttgccctgaagtcctcttccagccatcattgattggaatggaagcagcaggaattcatgaaacaacctataactcaatcatgaaatgtgatgtggacattaggaaggatttatatggaaatattgtactcagtggtggatcaactatg

SEQ ID NO: 1309 - DNA, 1204 bp, Artificial
  Synthetic
cggacgcgtgggtttccaaatactctcgagaaagccgccggccatcatctccggttgctttgctactttccggtgtcttctttccgatctcctcttagttttggttgaatagaaaatggctgacggtgaggatattcagccccttgtttgtgacaatggaactggaatggtgaaggctggatttgctggtgatgatgctcctagagctgtgtttcctagcattgtgggtcgtccccgccacactggtgttatggttggaatgggacagaaagatgcctatgtgggtgacgaagctcaatccaagaggggtatcttgaccctgaagtacccaattgagcacggtattgtcagcaactgggatgacatggagaagatatggcatcataccttctacaacgagcttcgtgttgcccccgaggagcaccctgttcttctcactgaagcacctctcaacccaaaggccaacagagagaaaatgacccagattatgtttgagacattcaacgttccggctatgtatgttgctattcaggctgtcctttccttgtatgctagtggtcgtacaactggtattgtgttggattctggtgatggtgtgagccacactgtccccatctacgagggttatgctttgcctcatgccattcttcgtttggaccttgctggccgtgacctaactgataacctgatgaagatcctcactgagagaggttacatgttcaccaccactgctgaacgggaaattgtccgtgacatgaaggagaagcttgcttatgtggctcttgactacgagcaggagcttgacactgccaagagcagctcctccgtcgagaagaactatgaattgcctgatggacaagttattaccattggtgctgagaggttccgttgcccagaagtcctcttccagccatccatgatcggaatggaagctgcaggtatccatgagactacctacaactccattatgaagtgtgatgttgatatcaggaaggacctctacggtaacattgtgctcagtggtggctcaaccatgttccccggcattgctgatcgtatgagcaaggaaatcactgctttggctcctagcagcatgaagattaaggttgttgctccaccggagagaaagtacagtgtctggataggaggatccatcctcgcatcccttagcacattccagcagatgtggatttcaaagggtgag

SEQ ID NO: 1310 - DNA, 728 bp, Artificial
  Synthetic
tggtatcaacgcagagtggccgttacggccgggggggtttcatttgaatttttcttgtttttgcatttggaactcatagccaaccgtggacaccactaatttactcctcctaaagctccctcttttttacacaaagtagataaaacatggcagacggtgaggatattcagccactcgtctgcgataatgggactggaatggtcaaggcagggtttgctggagatgatgctccaagagcagtatttccgagtattgttggtcgcccacgccacacaggtgtgatggttggcatggggcaaaaagatgcatatgttggtgatgaagctcaatccaaacgtggtattctaactttgaaatatccaattgaacatggtattgttagcaactgggatgatatggagaaaatctggcatcacacgttctacaacgaacttcgtgttgcaccagaggagcatcctgtactactcactgaagcacctcttaacccgaaggctaatcgcgaaaaaatgactcaaatcatgtttgagacatttaatgctccttctatgtatgtcgccattcaagccgttctgtccctttatgctagtggtcgtacaacaggtattgtcctcgattctggtgatggtgttagccacactgttccaatctatgagggatatgctttgccacatgctatccttcgtcttgatttagccggtcgtgacttgaccgatcacctaatgaaaatc

SEQ ID NO: 1311 - DNA, 657 bp, Artificial
  Synthetic
gctctcttcctccgtcgcggaaggccatcgctcatcagtctcatagcgagctatggcggacggggaagaggtccagccccttgtttgtgacaatggaaccggaatggtgaaggctgggtttgcgggagatgatgcaccccgtgccgtgttcccgagcatagtggggcggcctaggcatacgggggtcatggtgggcatggggcaaaaggatgcttacgtcggcgatgaggcccaatcgaaacgtggtatcttgactctgaagtatccgatcgagcacggcattgtgaccaactgggatgacatggagaagatatggcaccacactttctacaatgagctccgagtagcacctgaggaacaccccgtgcttctcacagaggcacccatgaaccccaaggccaatcgagagaagatgacccagatcatgtttgatacctttaacgttccggccatgtatgtcgctattcaagctgttctttctctctatgctagcggaagaacaaccggtatagtgatggattcgggtgatggtgtcactcatacggtccccatctatgaaggctacgcgcttccgcatgcgattctccgtcttgaccttgcggggcgagacctaactgacgctctaatgaagatcttgactgagcgtgggtacgcctt

SEQ ID NO: 1312 - DNA, 702 bp, Artificial
  Synthetic
tcgagctcaagcagatccaacaagccatacctctccctggtgaacacttgacaaatcatggcggatctcgaggaagtgtcaccccttgtctgtgataatggaactgggatggtgaaggctgggtttgctggcgatgatgcgcctcgtgcagtttttccaagtattgttggaaggccacggcatacaggtgttatggttggtatggggcagaaggatgcatatgttggggatgaggcacaatctaagcgtggtattcttactttgaagtatcctattgaacatggaattgtgaccaattgggatgacatggagaaaatttggcaccacactttttacaatgagctccgcgttgctccagaggagcaccctgtacttcttactgaggctcctatgaaccccaaggccaaccgcgaaaaaatgactcaaatcatgtttgataccttcaacgtaccagctatgtacgtggccattcaggcagttctctccttgtatgccagtggaagaactaccggcattgtgcttgattctggtgatggtgtctctcatactgtgccaatttatgagggctatgcattgccacacgccattcttcggctggatctggctgggcgtgatttgacggatgcactcatgaaaatcctaacagagcgtggctattccttcacaacaaccgcagaaagagaaattgtgagggacatgaag

SEQ ID NO: 1313 - DNA, 1016 bp, Artificial
  Synthetic
cctcattctccctcagcttttccttttctggttctataatatgggaataagttccagcctgctgtcccaggacctccacctaagcccccaaaaactgttttaggaaaaaatggcagatggtgaggatatccagccacttgtctgtgataatgggactggaatggttaaggctggatttgctggagatgatgctccaagagcagtgttccctagcattgtcggtcgccctcgtcacacaggagtaatggtaggaatgggacagaaagatgcatatgtaggagatgaagctcaatccaaacgtggtattctcacattaaaatacccaattgagcatggtatcgttagcaattgggatgacatggagaaaatttggcatcatactttttacaacgaacttcgtgtagctccagaggagcaccctgttctactcactgaagcacctcttaacccgaaggctaatcgcgaaaagatgactcaaatcatgtttgagacatttaatactcctgctatgtatgtcgccattcaagccgttctatccctctatgccagtggtcgtacaacaggtattgtcctggattctggtgatggtgttagccacactgtcccaatctatgagggatatgctttgccacatgctatcctccgtcttgatttagccggtcgtgacctgaccgatcacctaatgaaaatcttaacagagcgcggttactcgttcactactagtgctgaacgagaaattgtgagggatgtgaaggaaaaactctcctacattgcgcttgactttgagcaggaaatggacacgtcgaaaactagctcttctgttgagaagagctacgagttgcccgatggtcaagtgattaccatcggtgctgagcgtttccgatgccctgaagtccttttccaaccttcaatgattggaatggaagctgcaggcattcacgaaacgacttacaactcgatcatgaagtgcgacgtggatatcagaaaggatctgtatgggaacattgtactcagtg

SEQ ID NO: 1314 - DNA, 1158 bp, Artificial
  Synthetic
cccttcctcttctctacttctccttccttagctccaccgtaatgtttaactggttttaagagatggctgattcagaagatattcaaccccttgtctgtgataacggaacaggaatggttaaggctggatttgctggtgatgatgctccgagggctgtttttcctagtattgttggtcgacctcgacacaccggtgttatggttggtatgggtcaaaaggatgcatatgttggtgacgaagctcagtccaaaaggggtattctcaccttgaagtatcccattgagcatggaatagtaagcaactgggacgatatggagaagatctggcatcataccttttacaatgagttacgtgttgctcctgatgagcatcctgtgctacttactgaagcacccttgaatccaaaggccaatagagagaagatgacgcagatcatgtttgagactttcaatgtgcctgccatgtatgttgctattcaagctgtgttgtctctatacgccagtggccgtacaacaggtattgtgttggattctggcgatggtgtctcacatactgtaccaatttatgaaggttacgcccttcctcatgcaattcttcggttggatcttgctggtcgtgatcttactgattgtttgatgaaaatcttgacggaaagaggttattcattcaccactagtgctgaacgggaaattgtccgcgatgttaaagagaaactggcatatgttgcacttgactatgagcaagagttggagactgcaaagagtagctcttctgttgagaaaagctatgagttaccagatgggcaggtgattaccattggctcagagaggttcagatgtccggaagttttattccagccatcacttgttggaatggaagctgctggaattcacgaaacaacttacaattccatcatgaaatgtgatgtagatataagaaaagatctttatggaaacatcgtccttagtggtggaacaacaatgtttcctggtattgcagatcgtatgagcaaggaaattactgctctcgctcccagcagcatgaagatcaaggtggtggcgcctccagaacgcaagtacagtgtctggattggaggatctatcttagcttccctcagcaccttccaacagatgtggataacaaaaggtgaatatgatg

SEQ ID NO: 1315 - DNA, 700 bp, Artificial
  Synthetic
ctcgagcttgcggccgcaggagatgatgctcccagggctgtttttcccagtgttgttggtaggccaagacatcatggtgtcatggttgggatgaaccagaaggatgcatatgttggtgatgaagcacaatccaagagaggtattcttaccttgaagtatcctattgagcatggtgttgttagcaactgggatgatatggaaaagatctggcatcacactttctacaatgagcttcgtattgctcctgaagagcaccctgttcttcttaccgaggctcctcttaacccaaaggccaacagagagaagatgactcaaatcatgtttgagacctttaactctcccgctatgtatgtcgccatccaagctgttctctccttgtacgccagtggtcgtacaaccggtattgtgctggattctggtgatggtgtgtctcacactgtgccaatctacgagggtttctctcttcctcatgccatcctccgtcttgaccttgctggacgtgaccttactgattacctcatgaagatccttacagagagaggttacatgttcaccacaacagcagagcgggaaattgtaagagacatcaaggagaagctctcctttgttgctgttgactacgagcaggagatggaaacctcaaagaccagctcttccatcgagaagaactatgaattacccgatgggcaagtcatcacga

SEQ ID NO: 1316 - DNA, 612 bp, Artificial
  Synthetic
agagcatccaattcttcttacggaggctccacttaaccctaaggccaacagggagaagatgacacaaattatgtttgagacattcagcgttccagccatgtatgtcgctattcaagccgtgctttccctctatgctagtggacgtactactggtattgtcttggattctggagatggtgtcagtcacacagtcccaatctacgaaggttatgcccttccgcatgccattctccgtcttgatcttgctggtagggatctgactgattccctcatgaagatcctgactgagaggggttactcattcaccacctctgccgagcgggaaattgtccgtgacatcaaggaaaagcttgcatacgtcgctcttgactacgagcaggagcttgagactgcaaagagcagctcatcagttgagaagagctatgagctgcccgatggacaggtgatcaccattggcgcggagcgcttcagatgcccagaggtcatgttccagccttctctcatcggcatggaagctccaggcatccacgagacgacatacaactccatcatgaagtgcgatgttgatatcagaaaggacctgtatggtaacattgttctcagtggtggatc

SEQ ID NO: 1317 - DNA, 606 bp, Artificial
  Synthetic
attccgaaaaacagaaagagcgccgccctcagatccgcagaatacatacagatacagataatacagataatacagatatactcataatacagattgagctacaggtacaggcaaggttttctcatagcaagtgatggcggattcagaagaggtgcagcctcttgtctgcgacaatggaactggaatggttaaggcagggtttgcgggagatgatgcacctcgtgctgtatttcctagtattgtgggccgtccaagacacacgggtgttatggttggtatggggcagaaggatgcatatgtcggggatgaggctcaatcaaagcgtgggattcttaccttgaagtaccccatcgaacacggcgttgtcaccaactgggatgacatggagaagatttggcaccacacattctacaatgagcttcgtgtctccccagatgagcatcctgtcctcctcacagaagcccccatgaaccctaaggccaatcgtgaaaaaatgactcagataatgtttgacactttcaatgtgcctggcatgtacgttgccattcaggccgttctctccctttatgccagtggaagaactactggtatagtacttgattccgg

SEQ ID NO: 1318 - DNA, 429 bp, Artificial
  Synthetic
cccccccccgaagccgagcagagcagatgggtagcgcagcgcagcccagcaagcagcctcgctagctctcgcaaaccttcgccaccaagaacccggaaaccccctcttccagaagcttctggaatcaatctccggtcgagcaacatgcaggagttccaccccgtccccgggctggccggccggctgttcggcggcgcggcggcggcggcggcggtggcggcggtggaggaggtgcggtgcccgcggtgcgactcgtcgaacaccaagttctgctactacaacaactacaacctctcccagccccgccacttctgcaaggcgtgccgccgctactggaccaagggcgggctcctccgcaacgtccccgtcggcggcggctgccgcaagcccaagcgcccggcgccgccgccgtcgtcctccttcaccggc

SEQ ID NO: 1319 - DNA, 485 bp, Artificial
  Synthetic
gtcgcctgcacggcaccgacgagagagcgcgcgcgcgtgttcgtccgagcttttctgcggtcgcgcggtgcaggaggcggggcgacggccggcgccgcagttcgcgggcgtggacctccgccggccgaaggggtacccggcggcggggcagctgacgccggcggcggaggaggcggtagccggggtgggcgacccgtgcccgcggtgcgagtcgcgggacaccaagttctgctactacaacaactacaacacgtcgcagccgcggcacttctgcaagtcgtgccgccgctactggaccaagggcggctccctccgcaacgtccccgtcggcggcgggtcccgcaagagctcgacttcctcctcctccgccggcgccgccgccgcctcatcgtcgtcgtcgccttcttcgccaggcaatagccccaagcgctccaagaactccaagcgccggcgcgtctctccgccccctcaggccgggcctgcgc

SEQ ID NO: 1320 - DNA, 620 bp, Artificial
  Synthetic
aaaacatgtaaatttaatttcttttaagttcaaatatccgtacgaacattctagctaggtatttcaaattttgtttactagtgattaggagtatatatatgtagtgttgtaagggttcatcggaaattaattagttttacgataatttgttaacctactacagtcctccttatatttttagttaagcttgcgatcaacaatgtaagtaagtttaattagactctaatctctcttttttatttgtgattttacaggaaatgtcatcccaaacactagaaagcatgttggtatgcacaaagcaagatcaagaaaagaaaacaagaccagctgcagaacaagcacaaaaatgtccaagatgtgactcaaccaacacaaaattctgctactacaacaactacagtctaactcaacctagatacttttgcaaatcatgtagaaggtattggaccaaaggtggtacactaagaaatgttccagttggtggtggctgtagaaaaaacaaaagaatatcctcaaagagaagtcaagatcagtctttgactaatagccctaataatgctatatcttctatcacaccaacttcttatgattcttcaagtgatttaagtctagcatttgct

SEQ ID NO: 1321 - DNA, 414 bp, Artificial
  Synthetic
atttgaggaggctgttcttcccggctgtgaaggcgctgcttctcaaaggcaatcgaagatgcgtgagattctccacatccagggtggacaatgcggcaaccagatcggtgccaagttctgggaggtgatctgcgacgagcacgggatcgatcccaccgggaactaccacggtgactcggatctccagctcgagaggatcaatgtctactacaatgaggccactggtgggcgcttcgttccccgcgccgtgctcatggatctggagccgggcaccatggacagcgtgagatctggggtttttgggcagatcttccggccggataacttcgtgtttggtcaaaccggggctggcaacaactgggccacggggcattacactgaaggggccgagctcatcgattccgtgctggatgt

SEQ ID NO: 1322 - DNA, 1308 bp, Artificial
  Synthetic
gggcggacgcgtgggctgagaaccacattcacaattcgaatttcgaaaactcatctctttctgtttaaacggcgtcttgataaacgccgctttttctcctctttgaaatttgaatttttagggtttcggtgaaaatgagagagtgcatttcgatccacattggtcaggctggtattcaggtcggaaatgcctgctgggaactttactgcctggagcacggcattcagcctgatggccagatgccaggtgacaagactgttggagggggtgatgatgcattcaacaccttcttcagtgaaactggagctggaaagcatgtccctcgggctgtctttgtagatcttgagcccactgtcattgatgaagtgaggacaggaacataccgacagctctttcaccctgaacagctcataagtggcaaggaagatgcagccaataactttgcccgtggtcactataccattgggaaagagattgttgatctttgcttggatcgcatccgaaagcttgcagacaactgtactggtcttcaagggttcctggttttcaatgctgttggtggtggtactggttcaggtctggggtcgcttcttctggagcgtctctctgttgactacggaaagaagtcaaaacttggtttcacaatttacccttcaccacaggtctcaacttctgttgttgagccttacaacagtgtcctgtcaactcattccctccttgagcacactgatgtttccattcttctggacaatgaagccatttatgacatttgcaggcgctctctggacattgagcgccctacttacaccaaccttaaccgccttatctcacaggttatctcttcactcacagcgtctttgaggtttgatggtgctttgaatgttgatgtgaatgaattccagaccaatcttgtgccatatcccaggatccattttatgctttcctcatatgctcctgtcatttctgctgagaaggcctaccatgagcagctctcagttgcagagatcaccaacagtgcttttgagccatcttccatgatggttaagtgtgaccctcgtcatggcaagtacatggcttgctgtctcatgttccgtggtgatgtggtgcccaaggatgttaatgctgctgtggccaccatcaagactaagcgcaccatccaatttgttgactggtgccctactggattcaagtgtggtattaactatcagccaccaactgttgttcctggtggcgaccttgctaaggtgcagagggctgtttgcatgatttccaactcaaccagtgttgctgaggtcttctcacgcattg

SEQ ID NO: 1323 - DNA, 666 bp, Artificial
  Synthetic
ctcttctctgccgcctctcatttctgagatctacgcatttttcttcaaatttctgcatcttcttttccagatctcagtttaaaaaatgcgtgaaatccttcacattcaaggtggacaatgcggcaaccaaatcggtgccaagttctgggaagttgtttgtgccgaacacggcattgactccaccggccgttacaacggcgattcagatctccagcttgagagaatcaatgtctattacaatgaggcaacctgtggaaggtttgttcctagggctgttcttatggatctggaacctggtactatggatagcatcagatctggtccgtacggtcagatctttaggcctgataacttcgtgtttggtcagtctggtgctggcaacaattgggctaaaggacattacactgaaggcgctgaattgattgatgctgtccttgatgttgttcgtaaggaagctgaaaattgtgactgccttcaaggatttcaagtgtgccactcattgggtggaggtacgggatctggaatgggaacccttctgatatcaaagatcagagaagaatatcccgatagaatgatgcttacgttctcagttttcccgtctcctaaggtttctgacactgttgttgagccttataatgctactttgtcggtgcatcagttggttga

SEQ ID NO: 1324 - DNA, 373 bp, Artificial
  Synthetic
aattcggcacgagatctctttctgtttaaacggcgtcttgataaacgccgctttttctcctctttgaaatttgaatttttagggtttcggtgaaaatgagagagtgcatttcgatccacattggtcaggctggtattcaggtcggaaatgcctgctgggaactttactgcctcgagcacggcattcagcccgatggccagatgccaggtgacaagactgttggagggggtgatgatgcattcaacaccttcttcagtgaaactggagctggaaagcatgtccctcgggctgtctttgtagatcttgagcccactgtcattgatgaagtgaggacaggaacataccgacagctctttcaccctgaacagctcat

SEQ ID NO: 1325 - DNA, 441 bp, Artificial
  Synthetic
gacccacgcgtccgcccaatctcgccgggattctcctctgcaccataaaatagaagatgagagaaatccttcacattcaaggtggtcaatgtgggaaccagattggttccaagttctgggaagttgtatgtgatgagcatggtattgatcccactggtcgttacgttggaaactctgatctgcagttggagcgtgtcaatgtttactataacgaggcatcctgcggaagatatgttccccgtgcaattctcatggatcttgagcctggtactatggacagtgtcagaactggaccttatggtcaaatcttcaagcctgacaactttgttttcgggcaatctggtgctggaaacaactgggctaaagggcattacactgaaggagctgagcttattgatgctgtactcgatgttgtacgcaaagaggctgagaattgcgact

SEQ ID NO: 1326 - DNA, 747 bp, Artificial
  Synthetic
aaatatctcaaatccccacccctctaaattcacacattctgtttctctcttaccctagttccatttgccatttcagtttttcaaattcctccaaaaaagagagaaaatgagagaaatcttacacattcaaggcggccaatgcggtaaccaaatcggttccaaattctgggaagttatctgtgatgagcacggcgttgatcctacaggccgttacaaaggcaccgccgctgagtcggatcttcaacttgaacgtattaatgtgtatttcaacgaagcttctggtggacgttatgttcctagggctgttcttatggatctggagcctggtactatggatagtatcagatctggtccgtatggtcagatctttcgacctgataacttcgtttttggtcagtccggtgctggtaataattgggctaaaggtcattacactgaaggagcggagttgattgatgctgttctcgatgttgttcgtaaagaggctgagaattgtgattgcttgcaaggattccaggtttgtcactcactcggtggtgggactggatctggcatgggaactctattgatttccaagataagggaggagtatccagacagaatgatgctcacattctctgttttcccatctccaaaggtgtctgacactgttgtagaaccatacaatgctacactgtctgtgcatcaactggtggagaacgctgatgagtgtatggtccttgataatgaagccttatatgatatttg

SEQ ID NO: 1327 - DNA, 621 bp, Artificial
  Synthetic
aaaaccttcactttcctcactcctattaaattttagcacagaaaaattcaaaatcacttaaaaaatgcgtgagattttgcacattcaaggaggccaatgcgggaaccaaatcggagccaagttttgggaagttatctgtgccgaacatggcattgattccactggaaggtatgcaggagacaatgatcttcaactggagcggttgaatgtttactataacgaagcgagttgtggaaggtttgttccacgcgctgtcctcatggatttggagcctggaactatggatagtgtcagatctgggccatatggtcagattttccggcccgataattttgtttttggacagtctggtgctggtaataactgggccaagggtcactacactgagggagccgagcttattgattcggttctcgatgttgtgaggaaggaggctgaaaactgtgactgtctacaaggtttccaggtttgtcactctttgggaggtggaactggatcaggaatgggaactctccttatttcaaagatcagggaggagtacccagatagaatgatgcttaccttctctgttttcccttcccccaaggtttcagacacagttgttgagccctataatgctac

SEQ ID NO: 1328 - DNA, 637 bp, Artificial
  Synthetic
ggttggggtttggaatcgagggcgtcttcgcaaacgctctagggtttcatcgatcaagctctagattctcgtcgattgtctcgcgccgctccatccacgatgagggaatgcatctcgatccacatcggccaggccgggatccaggtcgggaacgcttgctgggagctctactgcctcgagcatggcatccagcccgatgggcaaatgcccagtgacaagacggtcggaggaggagacgatgcgttcaacaccttctttagcgagactggcgctgggaagcacgtcccccgtgccgtcttcttggatctggaacccaccgtcatcgacgaggtccggactgggacctatcgccagctcttccaccctgagcagctcatcagcggaaaagaagacgctgctaacaactttgctcgcggccactataccatcgggaaggagatcgtggacctttgcctttgatcgcatcaggaagttggcggacaattgtaccggcttgcaaggcttcctcgtcttccatgctgtgggcggtgggcaccggctcgggtcttggttccttactgctagagaggctgtccgtggactacgggaagaagtccaagctcggcttcactgtctatccctctccccaggtgtcgac

SEQ ID NO: 1329 - DNA, 442 bp, Artificial
  Synthetic
agccaacacacaatgagagaaattgtacacatccaagcaggtcaatgtggtaaccaaatcggagccaagttctgggaggtcatctctgacgagcacggcattgaccccaccggttcttaccacggtgatagcgaccttcaactcgaaagaattaatgtatactacaatgaggcaaccggaggaaaatatgtaccccgcgctgtccttgttgatctcgagcctggtacaatggactctgtgagagccggacctttcggacaaatcttcagacctgacaacttcgtctttggtcagactggtgctggtaacaactgggccaagggtcactacacagagggtgctgaattaatcgactctgttttggatgttgttagaaaagaggcagagagctgcgactgccttcaaggtttccaaattgcacactccctcggaggaggtacag

SEQ ID NO: 1330 - DNA, 669 bp, Artificial
  Synthetic
ttttcctctctcattctcctttctctccgttcattttctccgctcctattttcaaaatgcgtgaaatccttcacattcaaggtggacaatgtggcaaccaaatcggtgccaagttttgggaagttgtctgtgccgaacacggcattgattctaccggccgatatgacggagatgcagatctccaacttgagagaatcaatgtctattacaatgaggcaacatgtggaaggtttgttcctagggctgttcttatggatctggaacctggtaccatggacagtatcagatctggtccctacggtcagatctttaggcctgataactttgtttttggccaatctggtgccggtaataactgggctaaaggtcactacactgagggcgcggaattaattgattccgttcttgatgtcgttcgtaaggaagctgaaaactgtgattgcctacaaggatttcaagtgtgccattcattgggtggaggaacagggtcgggtatgggaacccttttgatttcaaaaatcagagaggaatacccagatcgaatgatgctgacgttctcggttttcccttcccctaaagtttctgacactgttgttgaaccatacaatgctactctgtcagttcatcaactagttgaaaatgcagatgaatgtatggtccttgacaatg

SEQ ID NO: 1331 - DNA, 973 bp, Artificial
  Synthetic
cgttatttattatgcatcttgactacccctcgaccacgcgtccgcccacgcgtccgcccacgcgtccgcccacgcgtccgaaaagaggctggttgttcattaggtttttattgtgaagagaattattgaaattggggacaatgagagaaataataagcatacacatagggcaagctgggattcaggtgggaaattcatgttgggagctctattgccttgaacatgacatccaccctgatggcatgatgcctagtgacaactctcctggtgtaggacatgatgctttcaataccttctttagtgaaaccagtgcagggaaacatgtcccaagagctatatttgtcgatctcgaacccactgttattgatgaggtgagaactgggacttatcgccagcttttccatcccgagcagctcatttcaggaaaggaagatgctgcaaataattttgcgagagggcattatacagttgggaaggagattgtcgatctatgccttgatcgggtaaggaaattggctgacaattgcacgggtttgcaagggtttttggtgtttaatgccgttggtggtggtactggttctggattggggtcattgttgctggaacgtctatctgtggattatggaaaaaagtctaagcttggatttactatctatccttctccccaggtatctactgctgttgttgagccttataacagtgttctttcaactcattcccttcttgaacacaccgatgttgttgtcatgttggacaatgaagccatttatgatatctgtaggagatccctagacattgagaggcctacatataccaatttgaatagactgatctctcaaatcatttcatccttgaccacttcattacggtttgatggagccattaatgtggatattactgagttccagacaaacctggtaccatatcctcgcatccactttatgctttcatcctatgccccagtgatctcagc

SEQ ID NO: 1332 - DNA, 531 bp, Artificial
  Synthetic
ggagagggtttctcttcctcatcttcgagagagagagagagagctcgccggattatcgccagctccacagcgtcatcgcctcgatctacaagcgaagatgagagaaatcttgcacatccagggcggacagtgcggcaaccagatcggcgccaagttctgggaggtgatctgcgacgagcatgggatcgatcccaccgggacgtatcacggcgactcggatcttcagctggagaggatcaacgtctactacaacgaggccagcggtggccgctttgttccgcgggcggtcctcatggatctggagccgggcaccatggacagcgtgagggccggcccgtttgggcagattttccggccggacaacttcgtgtttggccagactggcgccggcaacaactgggccaagggacactacaccgaaggtgccgagctcatcgattccgtccttgatgtcgttcgcaaagaggccgagagctgtgactgcctacaaggtttccaagtctgccattcccttggtggtggcaccggatc

SEQ ID NO: 1333 - DNA, 633 bp, Artificial
  Synthetic
aaggaaaaaaaccaaacaaggaaggaaaaaaagaaaaaaaaggctttcttcttcttcttcttcttctgcttcttccctctgcttgtggtgtccttgatacccctcaacgcagagcttaggagagagagagagagagagaaagacaggcagagacagagagacagagagcagtaactagaagagatacagagacagagagagagagagagtgggctgcttgtgtagacagacagagagagaaaatgagggaaatcattagtatccacatcggtcaggccggtatccaggtcggtaactcgtgctgggaactctattgcctcgagcatggaatccagcctgacggccgcatgcccagtgacaagactgtaggagaggggaatgatgcgttcaacacgttcttcagcgagacaggtgctggcaagcacgtgccgagggccatctttgtggatcttgagccaactgttattgatgaggtccgaacaggaaaatacaggcaactttttcacccggagcagctcatctcaggaaaagaggatgctgccaacaactttgcccgtggtcattacaccgtggggaaggagattgtggacctctgcctcgaccgagtgaggaagctggcggataactgtacgg

SEQ ID NO: 1334 - DNA, 619 bp, Artificial
  Synthetic
gaatttccagctatagagctagatttcctggcgatcgatcgaccgattgggcgccatagcaaggagaatgagagagatcatcagcatccacgtcgggcaggcggggatccagctagggaattcgtgctgggagctcttctgcctggagcacggcatccagccggatgggaagtcgatcgatcgcggggatgatcaagaagccatggccggggctgggaaggaatcgtttggcaccttctttagcgaggcagcgtcggcgacaaagcacgtcccaagggcggtgatgctggatttagagccgacggtgatcgacgagattagaagtggtcggtacagggcgctcttccatccggagcagctcatcgcggggaaagaggacgctgccaataactttgccagaggtcactatactgttggaagggagatcttggagcaatgcctggatagaatacgaaggctggcagacaattgctcaggacttcagggattcttggttttcaatgctgtgggaggcggaaccggctcaggattgggatcattgctcttggagagactgacttgtgactatggccgaaaatccaagctcggcttttctatatatccatccccaaagatctct

SEQ ID NO: 1335 - DNA, 601 bp, Artificial
  Synthetic
gcgaattgcagagcggaatctggaacctcgaactctcgacctcggacctttcagagcagaagaagaaaaatgagggagataatcagcatacacatcgggcaggccgggatccaggtcggcaatgcctgctgggagctctactgcctcgagcatggtatccagcccgatggccgcatgcctagtgataaatcggtgggggtggcggatgatgctttcaacacgttcttcagtgagacgggggcaggaaagcatgtccctcgggccatctttgtggatctggagccgacagtgattgacgaggtccgcacaggcacctacaggcagctcttccacccggagcaactcatctccggcaaggaggatgctgccaacaactttgcccgtggccattacaccgtgggcaaagagattgtggatctgtgcctggatcgagtgaggaagcttgcagataattgcacgggtctgcagggtttccttgtgttcaatgcggtgggaggcggtaccggatccggtcttggctccctcttgcttgaacgactctctgttgactacggcaagaaatcaaagctcggtttcaccatctacccttctcctcaagtct

SEQ ID NO: 1336 - DNA, 592 bp, Artificial
  Synthetic
gcgtcttcgttaacgccatcgctaaagctcccaagctttgtccgatccccttcttcttctcttcccttcttcgccttctcaagcagatatgagggagtgcatttccgtccacattggccaggctggtatccaggtcggcaatgcctgctgggagctttactgcttagaacatggcatcaagcctgatggacaaatgcccagtgacaagacggtcggtggtggagatgatgccttcaacaccttcttcagtgagactggagccgggaagcatgtcccgagggctgttttcgtcgatctggagcctactgtcatcgacgaggttcgaactggaacctaccgtcagctcttccaccctgagcagctcatcagcggcaaggaagatgctgctaacaatttcgcaagggggcactatacaattggtaaagagatagtggacctctgcctggaccggatccggaagcttgcggataactgcacgggcctgcagggttttctggttttccacgctgtaggtggaggcactggatctggtcttggatccctgctccttgagcgcctttctgttgattatgggaagaagtccaagctcgga

SEQ ID NO: 1337 - DNA, 673 bp, Artificial
  Synthetic
gtcggcaaagataaaaccaagacccccccctagtagtagtactactgcccatcactctccctcctttccttgttgtttgtagtgcttgtgttggggcaccataaaccctaggaatttgctgagccttgtgggaagcaaagatgagggagataatcagtgtgcacatagggcaggccggaatccaggtggggaatgcatgctgggagctgtattggctcgaacacgggatccagcctgatggtcgtatgcccagtgacaagtccgtgggggttgcggatgacgcgttcaacacgttcttcagtgagacgggaggcgggaagcacgtgcccagtgccatctttgtggatctggagcccaccgtgattgatgaagtccgcactgggacttaccgccagctctttcacccggagcagctcatctccggcaaggaggatgctgccaacaacttttgcccggggccattacacggtgggcaaagagattgttgatctatgcctggaccgagttgaggaagctggcggacaatttgtactggcttgcaaggcttcttggtcttcaatgctgtgggaggcggcactggatccggtcttggttccctcttactagaacgcctctctgttgactatggcaaaaaatcgaagcttggattcacaatctatccctcccctcaagt

SEQ ID NO: 1338 - DNA, 659 bp, Artificial
  Synthetic
cccacgcgtccgcgtcttcgtactcgcctctctccgcgccctcctccgccgccgctcgccgccgttcgtctccgccgccaccgccgccgccatgagggagtgcatctcgatccacatcgggcaggccggtatccaggtcgggaacgcgtgctgggagctctattgcctcgagcatggcatccagcctgatggacagatgcccggtgacaagaccgttgggggaggtgatgatgcttttaacaccttcttcagtgagactggtgctgggaagcatgtcccccgtgctgtcttcgtcgatcttgagcctaccgtgattgatgaggtgaggactggtgactaccgccagctcttccaccctgagcagctcatcagtggcaaggaggatgcagccaacaactttgcccgtggtcactacaccattggcaaggagattgttgatctgtgccttgaccgcatcaggaagcttgccgacaactgcactggtctccagggcttccttgtgttcaacgctgttggaggaggaacgggctccggtctcggttcccttctccttgagcgtctctctgtggactatggcaagaagtccaagctcgggttcaccgtgtacccgtcccctcaggtctccacctctgtggttgagccatacaacagtgtcctct

SEQ ID NO: 1339 - DNA, 1025 bp, Artificial
  Synthetic
aactactctctcgatcgagtgagtagttctacttctctctcgatcaatttctagatttcttcagttgccttcccgattttaaagaaaaaatgagagaaatccttcacattcaaggtggacaatgtggaaaccagatcggatcaaagttctgggaagttgtctgtgatgaacacggaattgatcctactggacgctatgttggaacctcagatctgcagttggaacgtgttaatgtgtattacaatgaagcgtcatgtgggaggtttgttccccgtgcagtgctcatggatcttgagcctggcacgatggacagcgtgaggactggtccttatggccagatctttaggcctgataactttgttttcggtcaatccggtgctggaaacaattgggctaaggggcattacactgagggtgctgagcttattgattctgttttagatgttgtcaggaaggaggctgagaattgcgactgtcttcaaggattccaggtgtgtcactcacttggtggaggaacaggttctggaatgggaaccttgctgatctcaaagatcagggaggaataccctgaccgcatgatgctcacattctctgtgttcccatcaccgaaggtttcagatacagtggttgagccatataatgctaccctttcagtgcatcagcttgttgaaaatgctgatgagtgtatggttcttgacaatgaagctttatatgacatctgtttcaggactctcaagcttaccacacccagctttggagatttgaaccacttgatttctgctactatgagtggggtcacttgctgcctcaggttcccgggtcaattgaactctgatcttcggaagctagctgttaacctgatccccttccctcgtttacacttcttcatggttggatttgctcctctcacttctcgtggttcacagcaataccgtgcactaacagtcccggagctgactcagcaaatgtgggatgccaagaacatgatgtgtgctgctgatccacgccatggtcgttacctcact

SEQ ID NO: 1340 - DNA, 691 bp, Artificial
  Synthetic
cccccagagagagagaaagagagagagaggccgcttctctagtctagaccaaaggaaggaaaccaaccgagaggcgaggcgaggagaggagaggagaggagaggagaggcggaggaggagggaggagaagatgagagagatcatcagcatccacatcggccaggccgggatccaggtcggcaacgcgtgctgggagctctactgcctcgagcacggcatcgagcccgatggcaccatgcccagtgatacaacggttggcgtcgcacacgatgcgttcaacactttcttcagcgagacgggcgctggcaagcatgtgcccagggccatctttgtcgacctggagcccactgtcatcgacgaggtgcgcactgggtcgtaccgtcagctcttccaccctgagcagctcatctctgggaaggaggatgccgctaacaactttgcccgtggccattacactgttggaaaggagatcgtagatctatgcctggaccgtgtgcgcaagttggcagacaactgcactgggctgcagggattcttggtgttcaatgctgttggtggtggaactggatcaggacttggttctcttctgttggagcgtctctctgttgattatggaaagaagtccaagcttggcttcacaatttacccttccccccaggtctcaacagctgttgtagaaccatacaacagt

SEQ ID NO: 1341 - DNA, 466 bp, Artificial
  Synthetic
aactatcctttttctttctcctccctccctcgaacgaaaccctaataaaatgcgtgaaatcctacatatccaaggtggccaatgtggcaaccaaattggggccaagttctgggaggttgtgtgcgcggagcacgggatcgattccaccggcgcgtaccatggggaatcggatattcaacttgagagggtaaatgtttattataatgatgcgagttgcgggcgtttcgtacctcgtgctgctcttatggatttagagcctggtactatggacagtgttacatctggtccttatggacatatttttatgcctgataactgtgtttttggccagtctggtgcggtgaataattgggccaagggatcattacaccgagggcgctgagttgattgattcggttctagatgttgttcttaaagaagctgagaattgagattgcctacaagggtttcaggtgtgccattccct

SEQ ID NO: 1342 - DNA, 682 bp, Artificial
  Synthetic
cggacgcgtgggccaatcccgaactctgaactctgaaggctgcagagacaggcagagagatatgagggagataataagcatccacatagggcaggcgggcatccaggtggggaattcttgctgggaactatactgcctcgagcatggcatccagccggacggcctcatgcccagcgacacaactcctggaattgcaagggatgcattcaacacgttcttcagcgagacgagttcaggcaagcacgtcccaagggcgttgttcgtcgacctggagcccacggtgattgatgaggtgaagaccgggccataccgccagctcttccacccagagcagctcatctcctacaaggaagacgctgctaacaactttgctcgtgggcactacacagttggaagagaggtggtagatctttgccttgatcgactaagaaaactggcagataactgcactggtctccaaggttttctggttttcaatgctgttggtggaggaaccggctctggacttggttcattacttttggagcgcctatcagtagattacggtaggaagtcgaagctcgggttcacaatatatccttcaccacagatctcaacggccgtggtggagccttacaacagcgtgctctcgacccactccctgatcgagcacaccgacgtcgtcgtccctcctggacaacga

SEQ ID NO: 1343 - DNA, 626 bp, Artificial
  Synthetic
ctaagccgagacaacgcagagaaaggcgtcttcgtactcgcctctctccgcgcctccgcgcttttcctcctctcccctctctcccttctccgccgccgtcgcagcatcaacccaatccgccgccatgagggagtgcatctcgatccacatcggccaggccggtatccaggtcgggaacgcgtgctgggagctctactgcctcgagcatggcatccaggctgatggtcagatgcccagtgacaggactgttggtggaggtgatgatgctttcaacaccttcttcagtgagactggtgctgggaagcatgttccccgtgctgtatttgttgatcttgagcctactgtgattgatgaggtgaggactggttgctaccgccagctcttccaccctgagcagctcatcaatggcaaggaggatgcagctaacaactttgcccgtggtcactacaccattggcaaggagattgttgatctgtgccttgaccgcatcaggaagcttgctgacaactgcactggtctccaaggtttccttgtgttcaacgctgttggaggtggaacgggctctggtcttggttcccttctcctggagcgcctttctgtggactatggcaagaagtccaagcttg

SEQ ID NO: 1344 - DNA, 413 bp, Artificial
  Synthetic
gcattctcaacaagctggtgcacagagagggtagcattgtagggctcgacgacagtgtcggacaccttgggcgatgggaagaccgagaacgtgagcatcatccggtcagggtactcctccctgatcttggagatgagcagggttcccatcccggagccagttcctcctcccagcgagtggcaaacctggaacccttggaggcagtcgcagttctcggcctccttgcggacgacgtcgaggacggagtcgatgagctcggcgccctcggtgtagtggcccttggcccagttgttgccggcgccggactggccgaagacgaagttgtcggggcggaagatctggccataggggccggagcggacggagtccatggtgccgggctcgaggtccatgagcacggcgcggggcacgta

SEQ ID NO: 1345 - DNA, 612 bp, Artificial
  Synthetic
gaattcataaacgctcatctttcttctagttggcttcttcaatcttgttcttcatttttgttcaattttcgtttgataatcttcgaaaatgagagagtgcatttcaattcacattggtcaagctggtattcaagttggaaatgcgtgctgggaactttactgcctcgagcatggcatccagcctgatggccagatgcctagtgacaagactgttggtggaggagatgatgcattcaacacctttttcagtgaaactggtgctggaaagcatgtccctcgtgcaatttttgtagatcttgaacccactgtcattgatgaagtaagaactggaacataccgtcaactcttccaccctgaacaactcattagcggcaaagaagatgctgccaacaactttgcccgtggacactacacaattgggaaagagattgttgatctctgcttggaccgtattcgtaagctcgctgacaactgcaccggtcttcaaggtttcctagtctttaatgcagttggtggaggtactggttctggattgggatcacttcttttggaacgtctttcagttgattatggaaagaagtcaaagcttggtttcactgtctacccatcacc

SEQ ID NO: 1346 - DNA, 1081 bp, Artificial
  Synthetic
cccccgctaccacaccgcagagaaaggcggggtcgtactcgcctctctccgcgccctcctccgccgccgctcgccgccgttcgtctccgccgccaccgccgccgccatgagggagtgcatctcgatccacatcgggcaggccggtatccaggtcgggaacgcgtgctgggagctctattgcctcgagcatggcatccagcctgatggacagatgcctggtgacaagaccgttgggggaggtgatgatgcttttaacaccttcttcagtgagactggtgctgggaagcatgtcccccgtgctgtcttcgtcgatcttgagcctaccgtgattgatgaggtgaggactggtgactaccgccagctcttccaccctgagcagctcatcagtggcaaggaggatgcagccaacaactttgcccgtggtcactacaccattggcaaggagattgttgatctgtgccttgaccgcatcaggaagcttgccgacaactgcactggtctccagggcttccttgtgttcaacgctgttggaggaggaacgggctccggtctcggttcccttctccttgagcgtctctctgtggactatggcaagaagtccaagctcgggttcaccgtgtacccgtcccctcaggtctccacctctgtggttgagccatacaacagtgtcctctccacccactccctccttgagcacaccgatgtcgctgtcctgctcgacaatgaggccatctatgacatctgccgccgctccctcgacattgagcgcccaacctacaccaacctcaacaggcttgtgtcccaggtcatctcctcactgactgcctccctgaggttcgatggtgctctgaatgtggatgtcaacgagttccagaccaacctggtgccctacccgaggatccacttcatgctttcctcctacgccccggtgatctcggccgagaaggcctaccacgagcagctctccgtggcggagatcaccaacagcgccttcgagccgtcctccatgatggccaagtgcgacccgcgccacggcaagtacatggcgtgctgcctgatgtaccgcggcgacgtggtcccc

SEQ ID NO: 1347 - DNA, 790 bp, Artificial
  Synthetic
cgcctctttattcaattcactcctgtcatgaattttcatctattataatcactattctacaacggtctctgcaatttctttgaaaaataaaaaatgagagagtgcatctcgatccacattggtcaggcaggaatccaagtcggaaacgcttgttgggagctttactgcctcgaacatggcattaagccggatggacaaatgcctggtgatgtaactgttggcggaggagacgacgccttcaatactttctttagcgaaactggtgctggaaagcacgtacctcgtgctgttttcgtagatctggaacccactgtcattgatgaggtgagaactggaacttaccgacagttgttccatcctgagcagctcattagcggcaaagaagacgctgcaaacaactttgctagaggccattatacaattggtaaggagatagtggatctgtgtcttgataggatcaggaagttagcggacaactgcactgggcttcaaggatttttggtgttccatgctgttggtggtggaactggttcagggcttggttctctgcttcttgagaggctttctgttgactacggaaagaaatccaagcttggatttaccatttacccttcacctcaagtctctactgctgttgttgaaccctacaactccgtgctttcgacacactcccttcttgagcacactgatgttgctatcctgttggacaatgaagcaatctatgacatttgccgaaagtctctggatatcgagagaccaacatacaccaatctcaacaggctcatctctc

SEQ ID NO: 1348 - DNA, 638 bp, Artificial
  Synthetic
ggagggcacatagtcagagttctgtcggctcgccgctattttatctgagtgttgttgaaagcttatcagcgaggatgagggaaattcttcacatccagggaggccaatgcggcaaccagatcggtgccaagttttgggaggtagtctgcgctgagcatgggatcgacccgactggcaactacgagggaaactctgatctccaattggagcgggttaatgtatactacaatgaggctagtggaggtcggtatgtccccagggcagtgctcatggaccttgagcccggaaccatggacagtgtaaggagtggatcctatgggcagatattcaggcctgacaactttgtcttcgggcagagtggtgcagggaacaactgggccaaggggcattacacagagggggctgagttaattgactctgttctcgatgttgttagaaaggaagctgagaattgtgattgccttcaaggtttccaagtgtgtcactctcttggaggcggtaccggctcaggcatgggtacgctcttgatctcgaagatccgggaggagtatcctgaccggatgatgctcaccttctctgtgttcccttcgccgaaggtgtcggacacagttgtggagccctacaatgctactctctct

SEQ ID NO: 1349 - DNA, 646 bp, Artificial
  Synthetic
cggacgcgtgggtgaacaaactacaagagaaaatgagggagtgcatttccattcacattggccaggccggtattcaggtcggcaatgcttgctgggaactttactgcctcgaacatggcattcagcctgatgggcagatgccaagtgataagactgttgggggaggtgatgatgccttcaatacatttttcagcgaaaccagttcagggaagcacgttcctcgagccgtctttgttgatcttgagcccactgttattgatgaagtgagaactggagcatatcgccagttatttcaccctgaacaattgatcagtggcaaagaagatgctgccaacaactttgcccgaggccactatacaattggaagggagatagttgatctttgcttggatcgtatcagaaagctcacagacaactgcactggtctgcagggttttctggtctttaatgccgttggtggaggcactggttctggtttgggttcacttctgttagaacgcttgtcagtggactacggaaaaaaatccaagcttggctttactgtgtatccctctcctcaggtttcaacctctgtggtggagccatacaatagtgttctctcaacccactccctccttgaacacacagatgtttctatcttgcttga

SEQ ID NO: 1350 - DNA, 683 bp, Artificial
  Synthetic
gatcatgcttagttccttctactcctgaaatttccatcaattttcaagataatcacaatattccttccacctctcctaaagtttttccttctccttgtaatattcctcatcaagacttcaatggtatatcatcaatgttaatgaggagatcgatgtcgttttcgggtgtggagaggtgcgataatcatcaagatttgagagtggacgataatgaaatgtctgatgatgatggatcttcgcaattgctaggggagaagaagcggaggcttaatttggagcaagtgaaagcactggagagaagttttgaagtggctaacaagcttgaacctgagaggaaaattcagttggctagagctttagggttgcagcctagacagattgcaatttggtttcagaatagaagagcaaggtggaagactaagcaattggagagagattatgagatcttgaagagacaatatgatgcacttaagtctgataatgatgcactcaagactcaaaataataatcttcattcagagctacagtcattaactctgaggaacagagaatcaggcggcggaggtgcaccaatgattaatctaaacaaagaaaacgagggatcttggagtaatggaagtgaagagaataacagtatcgacgtaaattttggaaccaccacagcaacaaggacatcatcaggt

SEQ ID NO: 1351 - DNA, 572 bp, Artificial
  Synthetic
gccttgcatggctcaaccccacctctactacgatagccgggagctatggcttcacccgccctcttgcaaggaccatcgcttcgagcctggaacgatcaagagggcgttcgatttttaccgtggcggtggcaccggtttcgaggacgccgcaactgaatacaaagaatacgaagaagggtatggggatggagaagaggaagatgaaatgatggtgcagctagtaggagaagaaggagaagaaggtgctgccggtgggaagtcgaggaagaaggcgaggaggctcagctcgcagcaggtcaaagctttggaaatggccttcgatgccaacaacaagctcgaagcggagcggaaggtggcgctagctggcaaggttggattagaaccgcgccaagttgccgtctggtttcagaataggcgtgctcgttggaagaccaaacagatggaaggagacttcaccgccttgaagacccgattccaatccttgaaggccgaacgcgatgctcttctcaaagacaaacaactacttgaagatcaggtggcttgcttaaagaaccagagcggcagtaaaaagc

SEQ ID NO: 1352 - DNA, 895 bp, Artificial
  Synthetic
cgaccaatattcacacacttctatcttacatatttagccaaagcatcgttaaaatggcgtacattaagcaagcttttctcttgattgctctctttgttgcaattacagttaatctctctggatctcctaagttgcaagtgatggctttacgagacttacccgaagaggttgcaatgatgaaagataaattacttccattaggtgatatagtaacttgcttgaaatactgcaatgtcgaaagcgattgcagtgatggttggatttgctccaattgtgttccatctgcatttcagggatggagatctcaatgtgactcgcttactgctactggtgaaggttattttggaactatactccgcgctaagcacaacaaaatataaattatattgctgcaatatatgaactatttataaatgcttgatctcgtgttatattcaagcattttaaataatataatgttgtgtttcctacttgtccaagtttatgtaagaaaatgaatatgtaaccatgtttcttgttgttgtcatcttatatgcagttattatgaaatatatgttctctattatcccaattaaagtggcacgaaacttaatgggagataatatttactatatatgatatgaatagtgtcattaacaactggtttggatggttgttatgttgtattgttattttaaatacaatgtttgttttaattgttatttaaatattgttgtatcgtatcgtaacgataaaaagtgtcactttatagaacaatagatttggtgtgggtctcgttactttgctttaatttattctctcgttttgcactttttattattaaataattatattttatcctttaccctacttttatgtatagtattttctactatgtatcctattttttcttagt

SEQ ID NO: 1353 - DNA, 693 bp, Artificial
  Synthetic
acatttttagtctgaataaaatggccaaggctactgtatcatccattgtcctcctcctcactttgaacattctcttcttcgcaatggttagttcaacttacatcccatgcccaccaaaaacaaagaatcaaccccatcccactaccccatcatccaagggttataagaagtgccaaaaggacacactaaaattgaaggtgtgtgccaatttattgaatgacttggtgcatgttgttattggaagctcatcaaagagttcatgctgctctctcattgagaatcttgctgatgttgatgctgcagtttgcctttgcactgccattaaagctaagctcttgggaactaaccttgataccgctctttccctcagcttattgctcaacaattgtggaaagactgtccctaaagacttccagtgtgcataaatggccatcatctattttcatcctatcccgacttgtttgggaatgaggcgtagttgtctgtttgtgttgtttgttttctctacaagatattcgttggagaaatactatcagtaataagtgtgtgtatgcatggttgcttattttcaatgtgttgtatcccatatttatttgtaatatgatggttatcttctcattaaggaattatatgatgttttatctcgggaaatcaattattgacaaggtattgatattaagttgttttttttcc

SEQ ID NO: 1354 - DNA, 219 bp, Artificial
  Synthetic
cccacgcgtccgcggttttctaaggatacagaatcaagggataacgatccttggagatttggttcttaaagacaagacctttgtctatgatctggacggtcagagaatcggatgggcgaactacgactgctctaactctgtaaatgtctcaacgactagcatcagcggaagaagcgaatatgtgaacgcaggacagtttactgagaatgctgcagcacc

SEQ ID NO: 1355 - DNA, 574 bp, Artificial
  Synthetic
aaagaggaagagctgatgagcgacgccggggatgacggcgacgactacggccccgccgccgccggcggcagtggcgagaccgacatcgacgagctggagaagcggatatggatggacaagctccgcctcaagcagctcaaggctagggctgctgccgccgctgccgccgccgccggcaatggcagggatcgatccaagcaccagaagcaatctccagagcaggcgagaaggaagaagatggcgagggcacaagatgggattctaaagtatatgctcaagatggtggaggtatgccatgcacagggattcgtctatggcattgttccagagaagggcaagccggtgagtggatcgtcggacaatctacgtgcatggtggaaggacaaggtaaggttcgataagaatggtcccgtggccatctccaagttccagatggagaactttggagacgaggacgaggacgaggagaggtctggaaagttggtgagtttcacggggaagaactggagtgttcctcgggcacttctagagctccaggacacgacgctgggatcgctgttgtcggcgttgatgc

SEQ ID NO: 1356 - DNA, 668 bp, Artificial
  Synthetic
gatgaagctgaaaaggctgaaggaaatgactaaaagtaagggaggtgtcgatcctgcaaaacatcgtcagtcgcaggagcaggcgaggaggaagaagatgtcaagggcacaggacgggatcttgaagtacatgttgaaaatgatggaagtatgtaaagctcagggctttgtttatggaatcattccggaaaaaggcaaaccggtcggtggggcatctgataatcttagggagtggtggaaggataaggtgaggtttgatcgaaatggccctgcggccatagccaaataccaagctgatcatggcatcccagggatgcaggaggaatctaatccagtgggtcctacccctcacaccttgcaagggctgcaagataccacccttggttcgttattgtcagctctgatgcagcactgtgatcctcctcagagaagattcccactggagaaaggtgtttcacccccatggtggcccactggtcaggaggattggtggcctcagttgggtttgcagaaggaacaaggtcctccgccttataagaagcctcatgatctgaaaaaggcgtggaaggttggtgtcctcacagcggtgatcaagcacatgttccccgatattgctaaaatccgtaagctggtaaggcagtcgaagtgcttgcaggataagatggcag

SEQ ID NO: 1357 - DNA, 745 bp, Artificial
  Synthetic
ggttatgtccttgttgtttgtgctctcgctagagggcggctgctcatctgtgcatcgtcgcggcggattcgcgatggccttgcccggtcaagtgacacctggagatgtggtttcgttcaagcttgtcatcgtcggcgatggcggcacggggaagacgacgtttgtgaagcgccacttgactggtgaattcgagaagaaatacgaaccgactatgggtgtcgaggttcatcctctcgatttctttacgaactgtggccgtctacgcttttattgctgggacacggccggtcaagagaagtttggtggtcttcgcgacggctactatatccatgggcagtgcgctatcatcatgtttgatgttactgcccgcctgacgtacaagaacgtcccaacctggcaccgggacctttgcagggtttgcgagaacatccccattgttctgtgcggcaacaaggtcgacgtgaagaacaggcaggtcaaggccaagcaggtcaccttccatagaaagaagaacctgcagtactacgagatctctgccaagagcaactacaacttcgaaaagcccttcctttacctcgccaggaagcttgccggagacccgaatctccactttgtcgagacccctgcgctggcaccgcccgaggtgcacatcgatcttgctgctcagcaactgaatgagcaggagatgcacaatgcggctgctcagcctctaccagacgacgaggacgacgcattcgattaaatc

SEQ ID NO: 1358 - DNA, 694 bp, Artificial
  Synthetic
ggttttcactttcatagcgacagttaaaaacttaaaaatgaaaattactaatgtcatcgattcatttcaaagtacggacacataaaaatagcaccatgaacaaaaaaaagttcagacaagccctaacgggtaatcagtgacagatcacatctctctttctctactcgaaggtgtcatcatcgtcatcaggaagtggctgacttgctgctgctgcaagctccgcctcatgctgctgctgagcagccaagtcgatttgaacttccgggggagcaagggcaggtgattccacaaagtgaagattagcgtccccggcgagctttctagcaaggtacaagaatggcttctcgaagttgtagttgctcttggcagatatctcgtaatactggaggttcttcttcctgtggaatgttacctgcttggccttgacttgcctgttcttcacatcaactttattcccacaaagaacaattgggatgttttcacaaaccctgcaaagatcacggtgccatgttggaacattcttgtatgtcagtcgtgctgtgacatcaaacatgatgatagcacattgtccatggatgtagtaaccatccctaagaccaccaaatttctcttggccagcagtatcccaacagtagaaacggatcttgccacagttagtgaagaaatcaagaggatgaacctcaacaccaatagt

SEQ ID NO: 1359 - DNA, 614 bp, Artificial
  Synthetic
gctattcatggcactccctggtcagcagcaggcagattgccctagcttcaagttggtcattgttggggatggaggaacaggaaagacgaccttcgtgaaacgacacttgacaggagaattcgagaagaaatatgagcccactattggggttgaagttcatcctctggatttcttcaccaactgcgggaaaatccgcttctattgctgggatactgctggacaagagaagtttggtgggcttcgtgatggctattacattcatgggcaatgtgctataatcatgtttgatgtgacgtcgcggctgacttacaaaaatgtcccaacttggcaccgagatctctgcagggtttgtgaaaacataccgatcgtgctctgtggaaacaaggttgatgtgaagaaccggcaagtgaaagcgaagcaggtgacattccaccggaagaagaatctccaatactacgagatctctgcgaagagcaattacaattttgagaagccatatctataccttgcaaggaaactggctggagatcaaaatcttcattttgtggagtcccctgcccttgcacccccggaagtccagatcgacttggtacaacagcaacagtatgaagcag

SEQ ID NO: 1360 - DNA, 783 bp, Artificial
  Synthetic
acggtctcaacccatagtggccattacggccgggggcaaaattctcctaaaaacacacatggctcttccaggacaggaagccgtggattatcccagttttaaacttgttattgttggcgatggtgggactggaaaaactacatttgtgaagaggcatcttactggtgaatttgaaaagaaatatgaacccaccattggagtggaggtgcatccattggatttcttcacaaattgtgggaagattaggttttactgctgggatacagctggtcaggagaaatttggtggccttagggatggatactacattcatggtcagtgtgctatcatcatgtttgatgtgacagctcgattgacatataagaatgtccccacatggcatagggatctttgccgtgtctgtgaaaatattcccattgttctttgcggaaacaaggttgatgtgaagaaccgtcaagttaaggctaagcaggttactttccaccggaagaagaatctgcaatactatgagatatcagcaaagagtaactacaactttgagaagcctttcctttaccttgccaggaaacttgctggggatccgaacttgcactttgtggagtctcctgcccttgctcctcctgaagtacagatcgacttggctgcacaacaacaacatgaagctgagcttgctgctgctgccagtcaacccctcccagatgatgatgatgagacctttgattaagagagtaatcagccttctcggacagcatttgtggatgctatgatttttcttttttccta

SEQ ID NO: 1361 - DNA, 651 bp, Artificial
  Synthetic
ctgtggtaagatccgcttctactgctgggacactggtggacaagagaagtttggtggacttagggatggatactatatccatggtcaatgtgcgataattatgtttgatgtcacttcaaggctgacttacaagaatgttccaacatggcatagggacttgtgcagggtgtgtgaaaacatccccattgtcctgtgtggtaacaaggttgatgtgaagaacaggcaggttaaagccaagcaggtcacattccacaggaagaagaatctgcagtactatgaaatttctgccaagagcaactacaactttgagaagcccttcctttatcttgcaaggaagcttgctggtgacccgaacctgcatttcgttgaagctgttgctcttaaacctccggaagttcccattgacctggcaatgcagcaacagcatgaggctgagcttgcggctgcagcagcacaacctctcccagatgacgatgacgatctgatcgagtagagaggatcatgagtctatcatgcttcagcctgagtctcttcataagagtctgaattaggccaatgcatgctagtgttagcttgtctgtggaatgtggacgtttcctgcgtgcctgatgggttgaaaacttttgatgtgtggtgttacatgttgctgcc

SEQ ID NO: 1362 - DNA, 718 bp, Artificial
  Synthetic
attctcctcaaatcaaacatggctcttccaggtcagcaagccgtggattatcccagttttaaacttgttattgttggcgatggtggaactggaaaaactacatttgtgaagaggcatcttactggtgaatttgaaaagaaatatgaacctaccattggagtggaggtgcatccattggatttcttcacaaattgtgggaagattaggttttactgctgggatacagctggtcaagagaaatttggtggccttagggatggatactacattcatggtcaatgtgctatcatcatgtttgatgtgacagctcgattgacatacaaaaatgtccccacatggcatagggatctttgccgtgtctgtgaaaatattcccattgttctttgcggaaacaaggttgatgtgaagaaccgtcaagttaaggctaagcaggttactttccaccggaagaagaatctgcaatactatgagatatcagcaaagagtaactacaactttgagaagcctttcctttaccttgccaggaaacttgctggggatccgaacttgcactttgtggagtctcctgccctcgctcctcctgaagtacagatcgacttggctgcacaacaacaacatgaagctgagcttgctgctgctgccagtcaacccctcccagatgatgatgatgagacctttgattaagagagtaatcaggcttctcggacagcatttgtgg

SEQ ID NO: 1363 - DNA, 792 bp, Artificial
  Synthetic
atttagtcttttctgacagaaaaagtacaacatttactaatggcatcatcggagattgtggattccggtaggttcgcggcctccgccggtggtcagaaatcacatttctcacagacatgtaatttgttgagccaatacttgaaagagaagaaaggttcatttggagatctcagccttggtattcaccgcgccggtactactactactatggatttattcccaatgattgagaaatctggtgagtcaaatcctcagaaaccaatgaatctgtttcctcaaactgaagcaaaatctgaaccggagaaagcacagatgacgatattctatggcggtcaagttattgtgtttaacgattttccggcagataaagctaaggaaatcatgcttatggctacttgtaccaaaggaaacaacaacagtactactcagattcaaaaaacagctgaatctgcttcagatttggtacctcagcctattatttctggagatttaccaattgcgagacgagcttcacttactaggtttttggagaaaagaaaagataggctgactgcaaaagcaccgtatcaattaagcaacccaaataaacaagcagcagtttctgaaaacaaggcgtggcttggattgggtgctcaatttccagtgaaagctgagcaattctagtactctacttaattgttttggctttcattacttgttattaggcctaaatataatactactactacttaatcctttatctaaaccaaaaacttattagatctgactactctggattcattactagtagta

SEQ ID NO: 1364 - DNA, 584 bp, Artificial
  Synthetic
gtagaggaaggagggtagaaaggaggagaaggagatggcgccaaaagcaccgaaatcaggcattgcagcgggtctcaaccgaggccatgtcgttaccaacagggacctcgcccctaagccttctgctaggaaagggaagcttggaaagaggacggccttagtgcgaagcttgatcagggaagtagtagggtttgctccttacgagaagagaatcactgagctgctgaaggttggaaaagacaagagggcattgaaagtggccaagagaaagcttggcacccacttgcgagccaagaagaagagagaagaaatggccaatgtcttgcggaagatgaggtctgggggaggagcagagaagaaaaagtgacaggctcgtatgatttaccagattttgtctcaatctttggattatatggtggctctatttatatctttggttctttgctaagcataggttaatatcagcaagacattctcaagtagaattgaattcttacatacaaattcccaacggaaattttcttataatggatcttggtgttatgtgaaccgttggatatcaaaatcttatcaaattttacatc

SEQ ID NO: 1365 - DNA, 484 bp, Artificial
  Synthetic
ctaattgaagaggtgatggctccgaagcagcctaatacaggctatccgttgggctaaacaaaggacatgttgtaaccaagaaggaattagctccacgtccttctgacagaaaagggaaaacaagcaaaagagtccactttgtgaggagccttatcagagaagtcgctggatttgctccatatgagaaaaggattactgagcttcttaaagttggaaaggacaagcgtgccttgaaggtagccaagaggaagttgggcactcacaagagggcaaagaagaagagagaagagatgtctagtgttctccgtaagatgagggctactggaggtggtgaaaagaagaaatgaaacctgtatggttgatgattgaagaacccagttagttaattcacttgcttttatgtttgcaatgtattttggttttcaagaaagaagacttgtgattaaaagctcccggtttatgtcccatgaagaatttgaaatta

SEQ ID NO: 1366 - DNA, 536 bp, Artificial
  Synthetic
aactttttcttccaaaggaatggctccgaagcagccaaatacaggcctttctgtgggccttaacaaaggacatgtcgttactaagaaagagttagcgccccgtccttctgataggaaagggaaaaccagcaaaagagtacattttgttagaagccttatcagggaggtagctggttttgcaccgtatgagaagagaattaccgaacttcttaaagttggaaaggacaaacgtgctcttaaagtagccaagaggaagctgggcactcacaagagagcaaagaagaagcgtgaagagatgtctaatgttctccgtaaaatgaggtctgctggaggtggtgaaaagaagaaatgagttgcatgttaagacctcttcattaaattttaggtccaaaaaactgcttggcaaagatttattttagtttctcttttgaactgaaaattttgatttgatccttttttttaattggatgttgaagcacctaactctgtgctttttgtaatttgttgtttcagaaagagaatggttcgaaatttcc

SEQ ID NO: 1367 - DNA, 378 bp, Artificial
  Synthetic
ggtatcaacgcagagtggccattacggccgggggtcaagctccctatgagaagaggatcactgagcttttgaaggttggtaaagacaagagagctcttaaagttgccaagcgaaagttgggaactcacaagagagctaaacgaaagagagaggagatgtccagtgttctccgcaagatgaggtctggtggtgctggtgcatccgagaagaagaagtgatgcgctgactctggttcagcgctctgttttttctaaaccagttttctgttttttgaattttttgcagtaccttgtgtttcctttggatattttgtagcagagataattaaatgttaaaacgaaaccattatgacttttgagccagttgtcttcgggtgtg

SEQ ID NO: 1368 - DNA, 425 bp, Artificial
  Synthetic
  misc_feature (425)..(425): The residue at this position can be any nucleotide.
accaagagggtgacctttgtcaggaacttgatcagggaggttgctggatttgctccctatgagaagcgtatcactgagcttctcaaagttggcaaggacaagcgtgcactgaaggtggcaaagagaaagcttggcacccacaagagggccaagaagaagagagaggagatggctggtgtcctcaggaagatgaggtctggtggcggtcacgctcacaccgagaagaagaaatagagtatctccaagttcatgaagtccatggcaatattgtcttgttgagtttactcttgtagaaccctactactagaattggactctattatccagctaaacatcatggtgttagttctgtgttaaaaacctcctgtcttgtgtttttgatcctttcaatgcatggtttgccaccttaaatttgcttgattaan

SEQ ID NO: 1369 - DNA, 740 bp, Artificial
  Synthetic
tcgatcagtcgacaattcattcaagatgggtaaggaaacgcctgcaaagaccggtctggccgttggcctgaacaagggccacgtacgtcaatacaactcgcgatctcacctcgtggaggatctctgcccccaaccttgatctcggcagacgatggacgctgacgttttatggtttgtgtttgcctgaatatagaagaccactgctcgtgtcgtcaagccccgtgtttctcgcaccaagggccacctgagcaagcgaaccgctttcgtgcgtgaggtcgtcaaggaggttgctggcctcgccccctacgagcgtcgtgtcatcgaactgctccgaaacagcaaggacaagcgtgcccgtaagctggccaagaagaggctcggtacctttggccgtgccaagagaaaggtcgatgagctccagcgcgtcatcgccgagtctcgtcgtgctcactaaacgatttcttctttaagcgagcgggagagattcatcttggtaatggggaaaaacaaaaattatttcaacagggaaatgaattaaaaaaacactacgggtttcgcatggatttggcgtggtcatgaattttgattgaattcaaatggggctctttgatgcgggcgcagcagcgtttatatagctgcgatttcgttcatcgaatttcttaaactcttcaagacatgccgtctttatgacccaacctagaaaattttcttcttctaggaaaaaaaaaaggaaaaaggaa

SEQ ID NO: 1370 - DNA, 372 bp, Artificial
  Synthetic
gggcgcccaacgttgcgagcagcgggatcgcgatcgggctcaacaaggggcatgtcgtcaccaagcggacgccggcgaagcggccgatcgccatgaaagggaaagggcagaagaggacgctattcgtgaggaagctgatccgggaggtggtgggattcgcaccctacgagaagaggatcactgagctgctcaaggttgggaaagacaagcgcgcgctcaaggttgccaagcgaaggctcgggactcatcttagagccaagaagaaacgcgaggagatgtctacggttctaaggaagatgaggtctgcgaagtaggataagctcttttgtattggttcttttaaaatcaaattgatacgtatttcaacccttt

SEQ ID NO: 1371 - DNA, 667 bp, Artificial
  Synthetic
cccttggtgagcccaatttgtatactgatttgtgtacaatcccatctttgagttttaaccctatgggccatgtagctgaaacaggttcaattggacttaaccatcttaccccttctcagatcttccaaatccaagcccagatcgaattccaaaaccaacaacaacaacaacaacaacttttactacaacaacaacagagcttaggtttattaccaacaactccaacatattctaagaatttgaattcaatgaactatcttggtcttaaaccagtcccaatgaagcaaagtggtggtgctatacagaaggctacaaagctttatagaggagtgagacaacgtcattggggtaaatgggtagctgaaattagacttcctaagaatagaactaggctttggcttggcacttttgatacagctgaagaagctgctttggcttatgacaaagctgcttataagctaagaggagagtttgctaggcttaattttccacatctaaggcatcaattaaacaatgaattatctgattttaagcctttgcattcctctgttgatgctaaacttcaagccatttgccaaaacctagcaaattctgatggcttgtcttgtaataataatactgattccaagccaagaaagtccaaaaaagcagcatccaaattggatgc

SEQ ID NO: 1372 - DNA, 237 bp, Artificial
  Synthetic
gggattatgagtgctgatgccgaaatttggaatggaagatttgccatgctgggattagttgctttagcgtttactgaatatgttaaaggaggtggcatcttccaagtctgaaatgtaacttttatactagtacgttcttttatatctgatgtaaacaatgttatattgccatgtaaccacagcttataatttcaattataacttatatgatataaaaatatgtctgttaatctggtt

SEQ ID NO: 1373 - DNA, 661 bp, Artificial
  Synthetic
gtacgaaaagaggagagccatatcccagcataaagagcctcaagcatctgctagatctcaacatattgtcccccgatcagaaggaaggcgcagccgttctggaaagaaagggaaaaagagacctgctcgccgcagatctcaacagaaaacagatgaattatctgctgtagagagtggcagtaattattcctcacgcagagatgatgatactgcaatgagtggaagggaccaggtattgagttccagttcacgatttgcgtctcctgaggactcaaaatacaagcagaaatctcctgctgaatccccaatggaaataacttctgagacgaagttgcctacagttctcagaaggaaatatcctgatacactcaaagatggttttgttgtagccttgagaacaaaagataattcagggttccatgttgcaagacagagacttgctggtggtggtggttggatccttgatatcgtgtcaaatgctacaaacagggaccctgctgctcagttcctagtcactttcaaaaacaaggataccatgggattacgttccttcgtcgctggtggtaaactattgcagattaataggaggatggagtttgtgtttgcaagtcatacatttgatgtttgggagagctggatgctggaggggtccttgttggag

SEQ ID NO: 1374 - DNA, 1007 bp, Artificial
  Synthetic
cgacagtggccatggctactcaacgaagggcaaaccctagctctctccatctaattactgtattctctctgcttgtcgctgtcgtctccgctgaggtcttcttcgaggagagtttcaacgatggttgggaaagcaggtgggtgaaatctgaatggaagaaagatgaaaacatggctggagagtggaatcacacatctggcaagtggaatggagacgctaatgacaaaggtatccaaaccagtgaggactacaggttctatgccatttcagctgagttccctgaatttagcaacaagggaaaaaacttagtgttccagttctctgtgaagcatgagcagaagcttgactgtggtggtgggtacatgaagttgcttagtggggatgttgaccaaaagaaattcggtggtgacactccctacagcatcatgtttggcccagacatctgtggctacagcaccaagaaggtccatgctattctcacttataatgacacaaaccacttgatcaagaaggaagtaccttgtgagactgatcaactgacccatgtttacactttcatcctccaccctgatgctacatacagcattctcattgataatgtggagaaacagtctggtagcttgtactctgactgggaccttctcccaccaaagacaatcaaggatccaagtgccaagaagcctgaagattgggatgagaaggaattcattgatgatcctgaggataagaagccagagggctatgatgacattccagaagagataactgatcctgatgccaagaagccagaggactgggatgatgaagaagatggtgaatggacagccccaaccattcccaaccccgagtacaagggcccatggaagccaaagaaaattaagaaccccaactacaaggggaagtggaaggctcctttgattgacaacccagacttcaaggatgacccagatctctatgttttcccaaatctgaagtatgtgggagttgaactgtggcaagtgaaatct

SEQ ID NO: 1375 - DNA, 1043 bp, Artificial
  Synthetic
cgcgcttccgccgctgcagccgatacgggagattggatcggaagcttctagaagtttccgtgggcgatggcgatccgcgcgaggtcctcctcctacgccgccgcggcggtcgcgctggcgctcgcgctggcgtccgtcgccgctgtcgccggcgaggtcttcttccaggagaagttcgaagatggatgggaaagtcggtgggtcaagtcagaatggaagaaggatgagaacatggctggtgaatggaaccacacatctgggaagtggaatggagatcctgaggacaaaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacagcattatgtttggaccagacatctgtgggtacagcaccaagaaggtccatactatctttactaagaatgacaagaaccatttgatcaagaaggatgtcccctgcgagactgatcagctgtcccatgtgtacactttgatcatccatcctgatgctacatacaccatacttattgacaatgttgagaagcaatctggcagcatctacgagcactgggatattctgcctccgaagcaaatcaaggacccagaagctaagaagccagaggactgggatgacaaggagtacattcctgaccctgaggacaagaagcctgagggatacgatgatattcccaaggaaatccctgaccctgatgctaagaagcctgaggactgggatgatgaggaacatggtgagtggactgcaccaaccattcctaaccctgagtacaagggaccatggaagcaaaagaaaatcaagaaccctaactaccaaggcaaatggaaggcaccgatgatcgacaacccagacttcaaggatgatccatacatctatgcttttgacagcctgaagtacattgg

SEQ ID NO: 1376 - DNA, 571 bp, Artificial
  Synthetic
cgagggaggggggggtcggcggggaacaagttccggatgtcgctgggtctgccggtggcggcgacggtgaactgcgcggacaacaccggggccaagaacctctacatcatctccgtgaagggcatcaagggccgcctcaaccgcctcccgtccgcctgcgtcggcgacatggtcatggccaccgtcaagaagggcaagcccgatctccgtaagaaggtcatgcccgccgtcatcgtccgccagcgcaagccgtggcgccgcaaggacggtgtgtacatgtacttcgaagataatgctggagtgattgtgaatcctaagggtgagatgaaaggttctgctatcactggacccatcgggaaggagtgtgctgacctttggcctaggatagctagtgcagcaaatgctattgtctgagcttgtttgaatgaattgtaagacagctatatgacctcaggatcgtctgcaaatggtttactaggacaactgtggaactttgtgatgctatcgtttgtttgcccgtttcagttttgtagtgaacagaagttgccatccatatgatattttatttgcc

SEQ ID NO: 1377 - DNA, 638 bp, Artificial
  Synthetic
ccccccggggtcctcgtctcctcgcgccgccgccgccgccgcggacgccgccatgtcgaagcgagggaggggtgggtcggcggggaacaagttccggatgtcgctgggtctgccggtggcggcgacggtgaactgcgccgacaacaccggcgccaagaacctctacatcatctccgtgaagggcatcaagggccgcctcaacctcctcccgtccgcctgcgtcggcgacatggtcatggccaccgtcaagaagggcaagcccgatctccggaagaaggtcatgcccgccgtcatcgtccgccagcgcaagccgtggcgccgcaaggacggtgtctacatgtacttcgaagataatgctggggtgattgtgaatcctaagggtgagatgaaaggttctgctatcactggacccatcgggaaggagtgtgctgacctttggcctaggatagctagtgcagcaaatgctattgtctgagcttgtttgaatgaattgtaagacagctatatgacctcaggatcgtctgcaaatggtttactaggacaactgtggaactttgtgatgctatcgtttgtttgcccgttgcagttttgtagtgaacagaagttgccatccatatgatattttatttgccatctaa

SEQ ID NO: 1378 - DNA, 268 bp, Artificial
  Synthetic
tcgggcagcggcggcgatgtcgaaccgagcgagaggagcggcgtcgggcaacaagttccggatgtccctgggtctccccgtgggcgccgtcgtcaactgcgccgacaataccggggccaagaacctgtacatcatctccgtcaagggcgtcaaggggcggctgaaccgcctcccggcggcggcgattggcgacatggtgatggcaacggtcaagaagggcaagcccgacctgaggaacaaggtgatgccggctgtgatcgtgcggcag

SEQ ID NO: 1379 - DNA, 532 bp, Artificial
  Synthetic
acgcgtcgatccgtcgggacgcgaagaagttctgaagccatgtcgaagcgaggacgaggagggtcctccgggaacaagttccggatgtctctggctcttccagtggccgctgttatgaactgcgcggacaacaccggagccaagaatctctacatcatctcggtcaagggcgttaagggaagactcaaccgtctccctgcggcttgcgttggtgatatggtcatggccaccgtcaagaagggaaagcctgacctcaggaagaaggttatgccggctgtcgtcgttaggcagcgcaaaccctggaggcgaaaggacggcgtcttcatgtacttcgaagacaatgccggagtcatagtgaatcccaagggggaaatgaaaggctcggccattacaggacccattgggaaagagtgcgctgatttgtggcccaggattgctagcgcagccaatgcaatagtctaaccctgcacttgcgcatcagtttttgtcattagggtcaatgcggatctttagtaatacaaagtgggctact

SEQ ID NO: 1380 - DNA, 364 bp, Artificial
  Synthetic
cgcttgtcaaaatagccaaatcatttgaatgtcagatacatattgtcagaaaataaaaatatcttgctaccaaaattctcaaatttgtatctagacatatccatcaaatacaagcaattgattgatctgatcattagacaatggcattggcagcactagcaatccttggccaaagatcagcacactctttcccaataggaccagtaattgcagaacctttcatttctcccttggggttgacaatgactccagcattatcttcgaagtacatgaaaacaccatcctttcggcgccatggtttgcgttgcctaacgatgacggcaggaagaacctttttcctgagatcaggcttaccctttttgac

SEQ ID NO: 1381 - DNA, 146 bp, Artificial
  Synthetic
tgtctaatcgaggacgaggcggttcccctgggaacaagttcataatgtccttgggtctgccggtggcgtcgacggtgatctgcgccgataacacaggtgctaagaacctgtgcatcatttcagggaaagggatcaaaggaaggctt

SEQ ID NO: 1382 - DNA, 650 bp, Artificial
  Synthetic
agagagggagcagcagagcaagaccgtcaacaatgtcgaagagaggtcgcggaggttccgcgggtaacaaattcaggatgtcactaggtttgccggtggcagctaccattaactgcgccgataacactggtgcaaagaacctttacatcatttcggtgaaaggtatcaaaggaaggcttaacaggttgccatcagcttgtgtgggtgacatggtcatggccacagtgaagaagggtaagcctgatctcaggaaaaaggttatgccagctgtcgttgttcgtcagcgcaagccgtggcgccgaaaggacggtgtcttcatgtacttcgaagataatgctggtgtaattgtgaatcccaaaggcgaaatgaaaggatctgcaattacagggccaatcgggaaagagtgtgctgatctgtggcctaggattgcaagtgctgctaatgctatcgtataggagagcctttgaatagtttgagattctcgttttgatggttgatttaagtttttggatatcagatagctgtcttattaagagttacagagtattagttttgctagctgtaagaattttgcatcaagaatacagaactagtatctgtttctactgtttgttatttactttttcaggtgaatgctttgaccaaaaaaa

SEQ ID NO: 1383 - DNA, 560 bp, Artificial
  Synthetic
gcaaaaaaggtgtctcgagaggtcgccaagacaaggaagcccggcggaggaggagcagcagcagcattagcagcaacaggagggacaggaggaagctcaatggggaccgtcgcaaacaactggaagctggaagcccatccaaacatgcctaaagggaagattgtggctttgattgttttggatggatggggcgagcagatcaaggacgagtacaacgccatccatgtcgcccctaccccctgcatggactcgttccgagagactgcccccgacaggtggagacttgtcaaagcccacggacctgccgtcggacttccaaccgaggacgatatgggaaatagtgaggttggtcacaatgctttgggagcgggacgtatttttgctcaaggtgcgaagctggtcgatgcggctattgcatccgggaagttgtttaaaggagagggatttaattacatcaaggaggcttttggtactggcactctccaccttattggattgtcgagtgatggtggtgtccattcgagatacgaccagcttcagggtttcatgaaaggagctgt

SEQ ID NO: 1384 - DNA, 1270 bp, Artificial
  Synthetic
  misc_feature (586)..(586): The residue at this position can be any nucleotide.
atttgttcaacaagtgtaggcttccgatttttcagctcaggaatccaataaaccccccccccccccccaatcactcgttcattagtttctccactacaacactttttgctccctcttctcctctactatatcgcctcatctgtattaaggtgaagaaaattttaagatctgagatatgggaagttcaggagatgcatggaaattgaaagaccaccctaaacttccaaagggaaagacagtagctgtgattgttttggatggttggggtgaggctaaacctaatgagtttaatgctatccacgttgctgaaactcctgttatggactccctcaagaatggtgctcctgaaaaatggagattgattaaggcacatggtaatgctgtgggactgcccacagaggatgatatgggtaacagtgaggttggtcacaatgctcttggtgctggaaggatctttgctcaaggtgcaaagcttgttgatctggcccttgcctctggtaaaatatatgagggagcaggtttcaagtacgttaaagaatgctttgaaaaaggaactttacaccttattgggctcttgagtgatggngggtgtccactccaggcttgaccaagtgcagttgttgctgaaaggtgctgctgagcatggtgccaaaagaattcgtgtccatgccctcactgatggacgtgatgttctagatggttctagtgtgggcttcatggagactcttgagaattctcttgcacaattacgtgaaaaaggtattgatgcccaggttgcatctggcggaggtcgtatgtatgttaccatggatcgatatgagaatgactgggatgtcgtaaaaagaggttgggatgctcaagttcttggtgaggctccacacaagttcaaggatcccgttgaagcagttaaaaagttgaggcaggaacccaacgccaatgaccagtacttagccccttttgttattgttgacgataatggaaagcccgttgggcctattttagacggtgatgctgttgtgactttcaacttcagagcagatcgtatggtcatgcttgcaaaggcccttgaatacgagaactttgataaatttgatcgtgtacgagtccctaaaatccgttatgctggtatgctccaatatgatggtgagttgcagcttccaagacactaccttgtttctcctccagaaattgacaggacatctggggagtatctagtgcgcaatggtgttaggacttttgcttgcagtgagactgttaaatttggtcatgt

SEQ ID NO: 1385 - DNA, 612 bp, Artificial
  Synthetic
ccccacaactgcatccatgtcgcccagacgcccgtcatggattcgctcaagaatggtggtcccgagaggtggagattagtgaaggctcatggaacagctgttggtcttcctagcgaagatgacatgggcaacagcgaagtgggtcacaatgctcttggtgctggtcgcatttttgctcagggtgctaagcttgtggaccttgctcttgcctctgggaaaatttatgatggagaggggttcaattacatcaaagaatgttttgacaagggtaccctgcaccttattggtttgttgagtgatggaggcgttcactcccgtcttgatcaagtgcagctgcttctgaaaggtgccagtgagaggggagcaaaaagaattcgtgttcacattcttactgatggacgcgatgttttggatggcagcagtgttggttttgtagagacactagagagtgatctttctcagcttcgtgacaagggtattgatgcacagattgcatctggtggtggaaggatgtatgttaccatggaccgctatgagaatgactgggatgtggtcaaacgtgggtgggatgcccaggtgcttggcgaagcaccctacaaattccaaaatgca

SEQ ID NO: 1386 - DNA, 466 bp, Artificial
  Synthetic
  misc_feature (208)..(208): The residue at this position can be any nucleotide.
gaattcgcgaaaactcaaacaccaacaaacaaagatgggaagtgctgaagtttcattcaaattggcggatcatccaaagcttcctaaagggaaggtagtagctcagattgtattggatggatggggagaagctagtcctgaccagtttaactgtatccatgttgctcaaacaccaaccatggattctctaaaacagggtgcacctganaagtggagattggtaagagctcatggtaaggcagttggtctcccaactgaagatgacatgggtaacagtgaagttggacataatgcccttggtgctggaagaatttttgctcaaggtgccaagcttgttgacattgcacttgcctcgggaaagatctttgatggagaaggctttcagtacatcaaggaatcctttaaggatggcaccctccacctaattgggttattgagtgatggaggtgtccactctcgaattgat

SEQ ID NO: 1387 - DNA, 550 bp, Artificial
  Synthetic
gaatgttgggagtagtgtgattgaaaaaggtggtggtggtattgggtttcagcttgactacggtgaaaaagatagtagctacaaccgtatcaagagtcttgtcaacgaggaactcaagcagtatttcagaccagagtttttgaatcgtcttgatgagattattgtcttcaggcaattgacgaagattgaggttaaggatattgctgatattatgttgaaagaggtgtttgagcgtttaatgaagaaatctatcgaccttcaagtaactgagcgctttagagacagagttgtggatgaggggtacagtccgagctatggtgcaaggccgctacggagggctattatgcgtctattaaaagacagtatggcagagaagatgctggcaggtgaaatcaaggaaggcgattctgctatcattgatgttgattctgatggaaatgtgactgttctaaatggaactactggaaccatgtcaagtaaggagattgaagccccagctggaattgcttgattggtaattataactggttgaaggtcttgtttgggttgc

SEQ ID NO: 1388 - DNA, 506 bp, Artificial
  Synthetic
gaattcagaacacacttctcataatgacttctaatgtcggaggcgatgtgattgacaagggaggtacgacaattggttttgatttacactatgatgataaagacagcagctacaacaggatcaacagtctcgtgcaacaggagctgaaacagtattttagaccacaattcttgactacattagatgagatgattgttttcagacagctgacgaagttggaagtcaaggagattgcagacataatgctcaaggaggtgtttgaaagactgcgtaacaaggaaatagagcttcaggttactgaaaggtttagagacagagtggttgatgaaggatacaacccaagctatggtgcgaggccgctgaggagagcgattatgagacttttggaggacagcatggcagagaagatgctgggaggagagattaaagagggagattcagtcatcgtagacgtagatggtgatggaaatgtcacagtgctcaacggtacatcaccacaactggtg

SEQ ID NO: 1389 - DNA, 232 bp, Artificial
  Synthetic
ggagatagggtggttgactaatgatacaacccaagctacgggcacggcctctgagaagagctatcatgatactgctagaggacagcagggccgagaaaatgcttgcaggtgagatcaaagaaggcgactccgttattgtggacgtggattcaaacggcaatgtgactgctctcaatggcagtagggatactccctcaaaccccactccggagcctatccctgtgtagatcaa

SEQ ID NO: 1390 - DNA, 488 bp, Artificial
  Synthetic
gcaagggcagaactgtggacttcaagaatacacttctcatcatgacatcgaatgtcggaagcagtgtgatagagaaaggaggccgtcgtataggttttgatctagattatgacgagaaggatagcagttacaaccgtatcaaaagcttggtgactgaggagttgaaacagtacttcaggccagagttcttgaacagattggatgagatgattgtattccgtcagctaactaagttagaggtgaaggagatagctgatatcatgcttaaggaggtctttgagaggttgaaaaataaggagatagaacttcaagtgacagagaggtttagagacagggtggttgatgaagggtacaacccaagctacggagcaagaccgttgaggagagctattatgagactgctggaagacagcatggctgagaagatgcttgccggtgagatcaaagaaggtgattcagtaattgtggacgtggactctgatggtaat

SEQ ID NO: 1391 - DNA, 320 bp, Artificial
  Synthetic
gagagagagagagaaagaaatggccgaggtcgatgtggagtaccgttgcttcgtcggcggcctcgcttgggcgacggacgacatgagcctcggcaacgcattcaaatccttcggcgatgtcgtcgaatccaaggtgatcaacgaccgcgagacgggcagatcccgcggctttggattcgtcactttccgggacgagaaatccatgaacgacgccatcgaatcgatgaacggcaaggatctggatggccgcaacatcaccgtccaccaggcacagcaaaggccgaccatgaccagcccgctatagtggatctaaccaagac

SEQ ID NO: 1392 - DNA, 671 bp, Artificial
  Synthetic
ttttttagggtttcttcttattaatcagaaaaaaatggcagaaggtgaatacaggtgcttcgtcggtgggttagcatgggctactaccgaccaaacacttggggaggctttttctcagttcggcgaaattcttgactcgaaggtctgtggcaaaacagagcagagatcggattcgagccgatttgaatcggcttcgttgaccctctgttactggaaaaattgatctgttactactctctctgttactgttactactctctggtttatctgttactgttactatttgatactaatattccactttccccgaaacggtacgttccgtcttcctctgtttatacaagagatgaagatagatcgattttatgtttctcccctattttttttgatttttgattttatggattttccccattttggatgttacgttgtagatccgtttagatctgatgtggtttttatgatatttgaaaatttcagattatcaatgacagagaaactggtcgatctagagggtttggatttgttacattcaaggacgagaaatctatgagggacgctattgaagggatgaacggccaggaccttgacggtcgtaacatcaccgtcaacgaagctcaatctcgcggaagcggtggaggcggtggcggttaccgtggtggtggcggtgg

SEQ ID NO: 1393 - DNA, 701 bp, Artificial
  Synthetic
aaaaaaatcaatggctgaagttgaataccgttgcttcgtcggtgggctcgcatgggctaccactgatcgaaccctaggcgaagctttctctcagtatggcgaggtgcttgaatcgaagatcatcaacgaccgtgaaaccggtagatctagaggatttggctttgttacttttggcgatgagaaatccatgagggacgctatcgaagggatgaacggccaagaccttgatggtcgtaacataaccgttaacgaagctcaatcacgcggaagcggtggaggcggcggcggcggcggtggtttccgcggtggacgtcgtgagggaggcggcggatacggagggggaggatatggaggtggaagacgcgagggcggcggcggcggttacggcggaggcggcggcggttatggcggtggccgtgaccgtggatatggcggtggtggtgaccgtggatacggtggtgatggaggatcacgctactcaaggggtggtggtgactctgatggaaactggaggaattagataattgagaagatgtggattttagttattttgatcgcagtttaagttggttatatcttaatgttagtgtgactcttttttgaccgttatttggctcgttacgttactgtgtttttctattaactgagttcttatggaatgaattaaattaaggtctacaaattaaatctttcttttgcat

SEQ ID NO: 1394 - DNA, 576 bp, Artificial
  Synthetic
tggttcttaaggaggagactcctccgacattttccccttcgttctggttcgtttttctctgtttggtttctctgttcggggttcggaaacatggggtctgagtaccgttgcttcgtcgggggtctggcttggtccactaatgaccaggctttggaatccgctttcagtcaattcggaactgtcatcgaatcgaaggttatcaatgaccgtgagactggaaggtctcgtggattcgggtttgttacattcgaggatgagcaagccatgagggatgcaattgaagggatgaatggaaaggatctagatggcaggaacattactgtaaatcaggctcaggacaggtcatcaagtggtggtggtggtggcggctaccgaggaggtggtggtggtggtggtggttaccgtggtggtggtggcggtggttacagtggcggtggcagtggataccgctcaggtggtggtggatatggtggtggtggccaacgtagggattctgggtacggtggagaaggtggtggctactctggcggtgggggctacggtggtggtggtggtggatacggtggaagtggtggt

SEQ ID NO: 1395 - DNA, 701 bp, Artificial
  Synthetic
cccccctggtggtctctcagaggtgggttgggttctcctccccctcccggttcggttcgggtccggttcgatttcggttttttcttcggttcgggggttggtgggaaagcatggcggcgccggatgttgagtaccgctgcttcgtcggcggcctcgcctgggccaccgacgaccgctccctcgaagccgccttctccacctacggcgagatcctcgagtccaagatcatcaacgatcgggagacggggaggtcgcgcgggttcgggttcgtgacgttctcgagcgagcaggccatgcgcgacgccatcgaggggatgaacggcaaggagctcgacggccgcaacatcaccgttaacgaggcccagtcgcgccgctccggaggcggaggcggcggtggctacggccagcgcggcggaggcggaggctacggtggcggcggctacggtggtggtggcggcggcggtggctacggccagcgccgtgaaggcggctacggcggtggcggtggctacggtggcggccgtggtggcggcagctacggtggtggctacggcagccgcggcggcggcaactccgacgggaactggaggaactgagcggtggggccctcatggccaagttatctatctatctaatcgagctaccatcatcatcatccgatcgttatcatcgttagttttgtgtggaactatctagtttgt

SEQ ID NO: 1396 - DNA, 682 bp, Artificial
  Synthetic
gcgtccgttcttttttagggtttcttcttattaatcagaaaaaaatggcagaaggtgaatcaggtgcttcgtcggtgggttagcatgggctactaccgaccaaacacttggggaggctttttctcagttcggcgaaattcttgactcgaagattatcaatgacagagaaactggtcgatctagagggtttggatttgttacattcaaggacgagaaatctatgagggacgctattgaagggatgaacggccaggaccttgacggtcgtaacatcaccgtcaacgaagctcagtctcgcggaagcggtggaggcggtggcggttaccgtggtggtggcggtggaggctacggaggcggtggccgtcgtgaaggtggttatggcggcggtggtggttacggaggtggccgtcgtgaaggtggttatggcggcggtggcggctatggaggtggccgccgtgaaggtggttacggtggtggctctgaaggaaactggaggagttagattttccggttcctttagatttaattttttgtttgaattttatggttctaagtttggttgaagttccgttatggtttactgtggttcctgttactgttcttgtttttgaccgcgagattgttaccgtgatgttacctagtggatctgtatttacaaagttctctggaatcaagtgaatta

SEQ ID NO: 1397 - DNA, 602 bp, Artificial
  Synthetic
ctttttctcagttcggcgaaattcttgactcgaaggtctgtgggaaaacagagcagagatcggattcgagccgatttgaatcggcttcgttgaccctctgttactggaaaaattgatctgttactactctctctgttactgttactactctctggtttatctgttactgttactatttgatactaatattccactttccccgaaacgattatcaatgacagagaaactggtcgatctagagggtttggatttgttacattcaaggacgagaaatctatgagggacgctattgaagggatgaacggccaggaccttgacggtcgtaacatcaccgtcaacgaagctcagtctcgcggaagcggtggaggcggtggcggttaccgtggtggtggcggtggaggctacggaggcggtggccgtcgtgaaggtggttatggcggcggtggtggttacggaggtggccgtcgtgaaggtggttatggcggcggtggcggctatggaggtggccgccgtgaaggtggttacggtggtggctctgaaggaaactggaggagttagattttccggttcctttagatttaattttttgtttgaattttatg

SEQ ID NO: 1398 - DNA, 627 bp, Artificial
  Synthetic
gtttccatctctcttataaattaaaaaaataatggctgaagttgaataccggtgcttcgtcggtgggctcgcatgggctaccactgatcgaaccctaggcgaagctttctctcagtacggcgaggtgcttgaatcgaagatcatcaatgaccgtgaaaccggtagatctagaggatttggctttgttaccttcggtgacgagaaatccatgagggacgctattgaggggatgaacggccaagaccttgacggtcgtaacatcaccgttaacgaagctcaatcacgcggaagcggcggcagcggtggcggcggcggcggtttccgcggtggacgtcgtgagggaggcggcggatacggtggtggaggatatggaggtggaagacgcgagggaggcggcggtggttacggtggcggcggcggtggttacggtggtggccgtgaccgtggatatggcggtggtggtgaccgtggatatggtggtgatggaggatcacgctactcaaggggtggtggtgactccgatggaaactggaggaattagataattgagaagatgtggattttagttatttgatcgcattttaagttggttatatcttaatgttagtgtgactgtcttttttgacc

SEQ ID NO: 1399 - DNA, 543 bp, Artificial
  Synthetic
gtttctctacttgcttagatcgtggacaatgggaggagtacgcggcggatcatcgtcgctgccatcctctccttcgagttcggcgtcttcgccatccaattcttgcacttgctgcgctgaatcgcagctgcggcgggggccatggacgtcggaggaggatgcgctgctgctgcggcatatgagagtgcatggggatcgagggaattggcgcaaggtcccaaaggcagcaggcctgatgcgctgcgggaagagctgccggttgcgatggctcaattatcttcgtcctgatctcaagcgaggaggtttcaccgaggatgaggacgcgttgatcatcaagctgcattctctgctaggaaacaggtggtcgcttatagcgggtcgaattcccggtcgcagcgacaacgagatcaagaactactggaatttccatctgggaaagaagctcctgaaggtgggcatcaatccaaagacacacaagccactgagcagcagcccagtgcctgccaagaccgagatgccatccaggagaacttccaagttctg

SEQ ID NO: 1400 - DNA, 889 bp, Artificial
  Synthetic
ggagaaagagggtcatggcggcggcccggcgctctctcttctatcgtcttcttggggcgcgttctacgctactggcacaggatggctcagctgccgcgagcaggagcgctggggttctagcgtcgtcctcccaggtcaaggacgaagaaagaggccataatctccggaatggcctggcgatgctgggagctgcggcgacgaccgtgttcgccactgccggctatgtctatgccgacgaggccgaccacgggctacctccgccttcgtacccgtggccttacaatggaatcttcgaggctgccgatcacgcagcaattcgtcgcggccatcaagtctacacacaagtttgcgctgcatgccacagcatgcaatacttgtcgttccgccaccttgtcggtgtggcctacaccgaagaggaggtaaaggctatggcggcggagatcgaggtggaggatggtcccaatgacgaaggcgagaagtttactcgccccggacgaatgaatgacttcttcccggctccatatgcgaatgaacaagctgctcgagctgcaaatggaggggcgtatcctccagacttgagcctgataactaaggcaaggcatcatggagatgattatgtcttctccttgctcaccggctatcgcgaccctccggctggcgtgaaaatcagagaagggctgtactacaatccatacttccccggcggtgccattgggatgccgcaggttataatggacggggccgtagagtacgaggatggaactcctgccactgcctctcagatggcgaaagatgctgtgtgcttcctggcctgggcagcggaaccagaaatggacgaacgcaaactgcacggagctaacgccgttgctttgcatcgtcctgatggggt

SEQ ID NO: 1401 - DNA, 648 bp, Artificial
  Synthetic
ctccactattcatctgcaccgcgttgcctctctctctctcgccttgaataatgagtttgggaaagaagatcgggatagggctcgcaggattcggaagaattaatcgttttattacgagggcagctcgccacagagacgaaaccaagctttcgaatgcccctgatgtgcttaagacctcaactactaagtatgactcggatgggtttggatccgctggcttaaagtctttcagagcattagcagtcattggtgctggagtctctgggctccttagcttcacaagtgttgcttattctgatgaagcagaacatgggttagagtgtcccagctatccttggcctcacgaaggcatcctcagttcttatgatcatgcttcgatacgtcgaggtcaccaggtttaccagcaagtgtgtgcgtcgtgccactcgatgtcactaatttcataccgtgatcttgtcggtgtggcatacactgaagaagaaactaaggccatggcagcagaaattgaggtggttgatggacctaatgacgagggtgagatgttcacccgccctgggaagttgagtgatcgttttccacagccttatgcaaatgaagcagctgcaaggtttgctaatggtggagcctatcctcctgatctaagtctta

SEQ ID NO: 1402 - DNA, 477 bp, Artificial
  Synthetic
cccacgcgtccgcgaaggccatggcagctgaaatcgaggttgttgatggaccaaatgatgagggtgagatgttcacccgacctggtaaactcagtgatcggcttcctgaaccatactcaaatgaatcggctgctaggttcgccaatggaggagcgtatccaccggatctaagtcttgtaactaaggcacgtcacaatggccaaaattatgtctttgctctgttgactggttatcgtgatcctcctgctggaatttcagtaaatttctctcctatttttgctttagacttgttattacaacttcaaattgttggaagttagaaataatcctgtgactaacgggtacagatcagagaggggctacactacaatccttatttccctggtggagcaatcgctatgccaaaaatgctcaacgatgaagctgtggaatatgaagatggaactcctgcaacagaagcacagatgggtaaagatg

SEQ ID NO: 1403 - DNA, 747 bp, Artificial
  Synthetic
tggttttccggatctcgcaggacctgttgtcctatcgccgtcgatcaattctctctacaatccctgtccgagggcttgactaaaaatgttgggaggtagagcaatccatcggttattaggcaggaaatttcaatctgaatcctcggcctctccaattttatcatccattgtttccaaacaagcccaagaagaatttggatcttttggcatgaagtccctcagatcattggcactcattggagcaggtgtatctggactcttaggttttgcgacagtagcatctgctgatgaagctgaacacggattggaatgtccaagctatccttggcctcacgcaggcattcttagttcatatgatcacgcttcgattcgtcgtggtcaccaggtttatcaacaagtatgtgcttcttgtcattcaatgtcacttgtttcatatcgtgacttggttggggtagcatatacagaggaggaagtaaaggccatggcagctgagattgaggtggttgatgggcctaatgatgagggtgaaatgttcactcgtcctggtaaactgagtgatcgttttcctcagccatattcaaatgaagcagctgctagatttgctaatgggggagcctaccctccggatttaagtcttgttacaaaagcacgtcataatggtcaaaactatgtgtttgcccttctaactggctatcgtgatcctcctgctggtgtttcgattcgcgaaggacttcactacaatcctta

SEQ ID NO: 1404 - DNA, 585 bp, Artificial
  Synthetic
gcacgcagagcgataggtgtggtgtggagaggtagatggccatgttgagtcgggtgctgaggcgagtgcctgcttccttcactgggagatctccgcggcagcctctcgaggaggtttctaagcgcctcgaggaggccctagacgcccagactccgtccaaggctgcctccattgtggggtcacaaagccgggactattcaagagaaacagcagggtcaaagagtatcagagctttggcattagctggagctggtgttaccggtttacttgggttgacaggcttagcgtatgccgatgaagctgagcacggattagcttgtccagattatccttggcctcattctggagtcctcagctcttatgatcatgcatcaattcgacggggccatcaagtgtatcagcaagtttgtgctgcttgccacagcatgcagtatgtgaaatatcgggatttgattggtgtttcgtacacagaagaagaggtgaaggctctggcagccgaaattgaagtcgaagatggacccaacgacgaaggggaaatgtactcacgcccaggcaagcccagcgatgccttcccgagcccctata

SEQ ID NO: 1405 - DNA, 934 bp, Artificial
  Synthetic
ggctccccctgcggcttcgctacagcttgccaattatgttggcaaggtcgtctttgcgcccggcgcgcctcctcaatgggcttcgaaatggcgccgtcaacgtccccaagcgtgctgcctcgacgagctcggaagctcccaccgcgcgcatgaacctcgccgctattgcttccaccaccctcgccgccggctccatggcctggtactaccatctctacggacccgtcgcttttgcttcgtcccctgctgaggagggtctccacgctactcagtacccttgggttcaccagcagttcttcaagacttttgaccaccaggctctccgacgtggtttccaggtctaccgtgaggtctgcgccagctgccactccctgtcccgagtcccctaccgagctctcgtcggtactgtcctgaccgtcgacgaggccaaggccctggctgaggagaacgaataccccgatgagcccgatgagcagggtgagatccccatgcgacccggaaagctggccgactacattcctcctccctacaagaacgacgaggctgctcgatttgccaacaacggtgctcttcccccggatctgagcttgatcgttaaggctcgccacggtggctgcgactacatcttcagcttgttgactggttaccctgaggagcccccggctggtgtccaggtcgcccccggcatgaacttcaacccctacttccccggcactggtattggtatggctcgtgttctgtacgacggcctcgtcgagtatgaggatggcactcccgccagcacctcccagatggccaaggacgttgtcgagttcctcaactgggccgccgagcccgagatggacgaccgcaagaagatgggcatgaaggtcttggttgccaccaccgctctgtgggccatcagcgtctacgtaaagcgatacaagtgggcttg

SEQ ID NO: 1406 - DNA, 500 bp, Artificial
  Synthetic
gcaatttgccaatcgccggagtttgctctaatttcatccactggttgcatcatggcagcggctactggtcttgcatcactgcaatctctctctctcagttctgtaggactaagagagaagaagattgtgtcacttcctgcatccacctctgcatttctcggccatcagattggaagctttgctttatcagctacgaagcccatttcgaagggtattagagcccagactgtagcagctccacccccagcagcaccagtggaggttgccgagtcttctgaggctaaaaagatttccacaaagagcatcgtggtgatcactggagcatcatctggtcttgggctggccacagccaaggcattagcggatagtggtgagtggtatgttgtaatggcatgcagggacttcttgaaggcggagagggcagccagatccgtgggattaccaaaggacagctaccgggtcatgcatttagacttggcatcccttgaaagtgtcagaca

SEQ ID NO: 1407 - DNA, 652 bp, Artificial
  Synthetic
aggacaccagaaacatagtacacttgagctcactccaaactcaaacactcacaccaatggctctccaagttcaggccgcactcctgccctctgctctctctgtccccaagaagggtaacttgagcgcggtggtgaaggagccggggttccttagcgtgagccagaaggccaagaagccgtcgctggtggtgagggcggtggcgacgccggcggcgccggtggcgagccccggcgcgggcacgtcgaaggcggacgggaagaagacgctgcggcagggggtggtggtgatcaccggcgcgtcgtcggggctcgggctcgcggcggcgaaggcgctggcggagacggggaagtggcacgtggtgatggcgtgccgcgacttcctgaaggcggcgacggcggcgaaggcggcggggatggcggcggggagctacaccgtcatgcacctggacctcgcctccctcgacagcgtccgccagttcgtggacaacttccggcgctccggcatgccgctcgacgcgctggtgtgcaacgccgccatctaccggccgacggcgcggcagccgacgttcaccgccgacgggtacgagatgagcgtcggggtgaaccacctgggccacttcctcctcgcccgcctcatgctcgacgacctcaa

SEQ ID NO: 1408 - DNA, 573 bp, Artificial
  Synthetic
cccccccccgggtcaccaacacgaagcaaaaggacaccagaaacatagtacacttgagctcactccaaactcaaacactcacaccaatggctctccaagttcaggccgcactcctgccctctgctctctctgtccccaagaagggtaacttgagcgcggtggtgaaggagccggggttccttagcgtgagcacacaaggccaagaagccgtccctggtggtgagggcggtggcgacgccggcggcgccggtggcgagccccggcgcgggcacgtccaaggcggacgggaaaaaaacgctgcggcagggggtggtggtgatcaccggcgcgtcgtcggggctcgggctcgcggcggcgaaggcgctggcggagacggggaaatggcacgtggtgatggcgtgccgcgacttcctgaaggcggcgacggcggcgaaggcggcggggatggcggcggggagctacaccgtcatgcacctggacctcgcctccctcgacagcgtccggcagttcgtggacaacttccggcgctccggcatgccgctcgacgcgctggtgtgcaacgccgccatctac

SEQ ID NO: 1409 - DNA, 1062 bp, Artificial
  Synthetic
attatttaattctttagctgacaatttagatagtaaaactcaattccttatattcatggctcttcaggctgctgcactacttccttctgctttctctattcccaaggagggcaaagctggtgcaattttgaaggattctaatctctttggaatttccctctcagaccatattaaatctgattttcgctcctcttcatttaaagtgaagagccaaagaaggttgtcccatggatctattagagccgagacaatggttgcaactccaggtgttaccaacgccacagtatcaggaaagaaaactttaagaaaagggtgtgtagtagttactggagcctcttcaggattaggcctagccacagcaaaagctctagctgagacaggaaaatggcatgtgattatggcatgtagagactttctaaaaactgaaagagcagcaaaatccgcaggcatgcctaaggagaactacacaataatgcacttagaccttgcgtcgctcgacagtgttcgccagtttgtcgataacttccggagatcaggtcgccctcttgatgtattggtttgcaatgcagcagtttatcaaccaactgctaaagagccttctttcactgctgatggatttgagctcagtgttgggactaaccaccttggtcatttccttctttcaagattgttgcttgatgatttgaagcagtctgattacccttcaaagagactcatcattgttggttccattacaggaaacacaaatactttggccggaaatgtgcctccaaaagcaaaccttggggacttgaggggcttggcaaggggactcgacgggctgaacagctcggccatgatcgatggtggagactttgatggtgcaaaagcatacaaagacagcaaagtttgcaatatgctcactatgcaggagttccacaggcgataccacgaggaaactggcattacatttgcctctttataccctggctgcatagcaacaacagggcttttcagggagcatatcccattgtttagactccttttccctccattccagaagtatattaccaagggattcgt

SEQ ID NO: 1410 - DNA, 1280 bp, Artificial
  Synthetic
tcaaactacaaaaatcaacgcccccccccccccccccagcgcacacacgcacaccaacaccttcataatagagttgtaacaagtgaaaaaacattgaatagtaggttcgaaaatggctctccaagcagcatctctgcttccttctgcattatctatccacaaagatgtaggctgcacattttccagctctttaacacttagctcttttaaatactcacctgaaattttaacaagatcgtccaattgtggcagggtaaatcatgtgctactctcaaggacagtagcctctttggagttgcattatcttacagtcaaaaatctaagttcattcctccagctgcatggaacaaggaattgacaaagaaaatagcagctgtacctgttagagcacaaacagctgctgccacaccagcagtcaaccagtctaccttagaacagaagaaaaccctcaggaaaggcaatgtaataattaccggagcctcctctggtttaggactagctactgcaaaggctataggtgaaacaggagagtggcacgttataatggcctgcagggacttccttaaggctgagaaagcagcaaaatctgtgggcattccaaaggaaaactacacagtcatgcatctggatctcgcttcccttgaaagtgtccgccaatttgtagatactttccgacgttcagggaggccacttgatgcgctagtctgcaatgctgcagtgtacttgccgactgctaaagagccaacttttactgctgacgggtttgagcttagtgtgggtaccaaccatcttggacatttcctgctttcaaggttgctgctagatgacctcaagcaatcggattacccacaaaagcgccttataattgttggctccattacaggaaacacaaacactttggctggaaacgtaccgccaaaggctaatcttggagatctacgaggactatcaggaggattgaatagtttaaactgctcacccatgattgatggaggagaatttgacggcgccaagcctacaaagacagcaaagtctgtaacatgcttaccatgcaagagttccataggcgtttccacgaggagaatggcattgcctttgcgtccctctatcccggctgcattgctgaaactggtttgtttaggaatcacattcccttgttcagggctctcttcccaccatttcagaagtacattaccaaaggctatgtatctgaagcagaagcaggaaaaagacttgcacaggttgtacgtgatccaagcctttcaaaatctggtgtctac

SEQ ID NO: 1411 - DNA, 689 bp, Artificial
  Synthetic
agagattcttcttccttcttcccggggagctggctatggctgccatcgtcgcagcagcagcatcgtcctcgggcctcgcggcgaagaaagagattctagccacatcctcgagcaatgcgggtgtttcttcttcttttctcgggtccaagctgcgctgtagcccagcaatccagggtgtaaggcaatgcaatgcttcgaccacgacgacgagcatcagagctgttgctgcgccggtggagacggcccgagcgaaggaggggaagaagacggccaggcagtcgacggtggtgatcaccggtgcctcttccggcctcggactcgccacggccaaagtcctggccgacaccggggagtggcacgtcgtcatggcttgtagagactttctcaaggccgagaaggctgcccggtcggctggaattcccaaaggaagctacaccgtcatgcacctcgacctggcttcgttcgacagcgtgaggcagttcgcggagaacttccggcgatccgggaggcctctcgattgcctggtctgcaatgcggcggtctacttcccgacagcgaaagagcccacgtatagcgcggaggggttcgagctcagcgtggcgacgaatcacttgggacacttcctgctgtcccggttgcttctcgaggatatggagaagtcagatcatgcgtcgagacgcatgataatc

SEQ ID NO: 1412 - DNA, 899 bp, Artificial
  Synthetic
attttttgctgactttagaccaaccccttttcttttcttgaacattttcatggctcttcaggctgttgctttggttccttctgctttatccatttccaaagaggtaatattttccgtccagaaaatatattgctcgtgagacaaaaagggttgctacgatggtaagcaaactccacttccaaccaagaggtggtgagtttaccaagaggtggtgagtttgagtaacagcctccctaccttaggggcaaagctagtgcaaacttgaagaattctagtctttttggagtctctctctctgactatactaaatctgatttccgctcctcttcattcaaagtcaagagccaaagaagattgtccaatggagcagtaagggcaacaatggttgcatctccagatgtaaccactaattctccagcaggaaagaaaactttaagaaaagggtgtgtaatagtcactggagcctcttcaggattaggcctagccacagcaaaagcactatccgagaccggaaaatggcatgtaattatggcttgtagggactttctaaaagctgagaaagctgcaaaatcagtaggcatgcctaaggagaattacaccatcatgcatttagacctcgcgtcgcttgacagtgttcgccagtttgtcgataacttcaggaggtccggtcgccctcttgatgtgttggttgctaatgcagctgtgtatcaacctactgctaaagagccttcatttacagctgaaggatttgagcttagtgttggcacaaatcatcttggacatttccttctttcaagattgttgcttgatgacttgaagcaatctgattacccttctaaaagactcataattgttggttcaattacagggaacacaaatactttggctggaaatgtacc

SEQ ID NO: 1413 - DNA, 554 bp, Artificial
  Synthetic
aaaaggacaccagaaacatagtacacttgggctcactccaaactcaaacactcacaccaatggctctccaatttcaggccgcactcctgccctctgctctctctgtccccaagaagggtaacttgagcgcggtggtgaaggagccggggttccttagcgtgagccagaaggccaagaagccgtcgctggtggtgagggcggtggcgacgccggcggcgccggtggcgagccccggcgcgggcacgtcgaaggcggacgggaagaagacgctgcggcagggggtggtggtgatcaccggcgcgtcgtcggggctcgggctcgcggcggcgaaggcgctggcggagacggggaagtggcacgtggtgatggcgtgccgcgacttcctgaaggcggcgacggcggcgaaggcggcggggatggcggcggggagctacaccgtcatgcacctggacctcgcctccctcgacagcgtccgccagttcgtggacaacttccggcgctccggccatgccgctcgacgcgctggtgtgcaacgccgccatctaccggccgac

SEQ ID NO: 1414 - DNA, 661 bp, Artificial
  Synthetic
  misc_feature (294)..(294): The residue at this position can be any nucleotide.
cacatgtttggggtgcaaactagtctaaagagatcttaaatgtcattcaacggcataaataggcccttcgattgatgcaattatgaccaagatggcattggataacagagctcttaccgctcttgcttcttttttgatctacttggtcttgagtctcgatgtttgctgtgctgttcaaagcgacattgactgtctgaaatctgtaaaagagtcattagaagatccattaaattacttggggtcaacatggaacttcgaaaatcagaccgaaggtttcatctgcaaatttactgngattcagtgttggcatccggatgaaagcaaggttctgagtatcactcttcctgacatgggtcttaagggcaggtttccacgtggtattcagaattgtacctctatgacatcattagatctttcgagtaacgagctcaatggaagtattccacgtgatatctccaaaattataagttttgtggtaatcctggatctctcatccaacaacctatcaggggaaatcccagtggatctcgcaaactgctcttttttgaatgacattaaacttgacaacaacctgttgacgggtcaaattcctccacaaattggcctgcttggtcggctcaagacttttaatgtagcaaacaatcgattgaccggaccagtt

SEQ ID NO: 1415 - DNA, 732 bp, Artificial
  Synthetic
attcgctagctgtttcggtatctcttgagcttctcactaccaatcccagccgaagccatgtcgaggagaaagactagggagccaaaggaagagactgtaacacttggaccagctacaagggagggtgaattggtgttcggtgttgctcacatttttgcctctttcaacgatacttttattcatgtgactgatttgtctggaagagaaactatggttcgcattactggtggaatgaaggtgaaggctgatagagatgaatcttctccatatgctgccatgcttgcagctcaggatgtgtcacagcgatgcaaggaacttggaattaatgctcttcacattaagcttcgggctacaggaggcaacaagactaagactcctggtcctggtgcccagtctgctcttagggccttagctcgatctggcatgaaaatcggacgtatagaggatgtgactccaattcccacagatagcactcgcagaaagggtggtagaaggggaaggaggctgtgaagatggttcgtttctgcagcataatgcaccttggaggattttgttgttgaggatgctcctttcaatttctttttacaattgatatctaaatactttgtagctgagacttttggtttcaaaccactttcattttgatctggccagctttgcgacataatgaagttttcttgaatttggcttcgttgatgttagtaggtcgaatggtcaaacatatcctttctt

SEQ ID NO: 1416 - DNA, 667 bp, Artificial
  Synthetic
agattgcgtttttcaagcttcagtagcagctcagccgtctcatcagcaattcaaccgaagccatgtctaagagaaggaccagggagcccaaggaagagactgtaaccctaggaccagctaccagggagggtgaattggtctttggtgttgcccacattttcgcctctttcaacgatactttcattcatgtgactgatttgtctggacgggaaacaatggtccgcattactggtggtatgaaggtgaaggccgacagagatgaatcttctccttatgctgctatgcttgctgcacaagatgtttctcaacgatgcaaggagcttggaattaatgctcttcacattaagcttcgggctactggagggaacaaaactaagactcctggtcctggtgcccagtctgctcttcgagcccttgctcgatctggaatgaaaattggacgcatagaggatgttactcctattcccacagacagcactcgcagaaagggtggtagaaggggaaggaggctgtgaattcttctcagcaacatacttgctgcatggcaagaatattttggtttcgggtcgcatctttcattgtgtttttacatgttagatttaaacatttagtagactcagtacaaggtcattttgacttatgatcagttggagttttgcaagcttgt

SEQ ID NO: 1417 - DNA, 288 bp, Artificial
  Synthetic
cccacgcgtccgaaaaggcggaacaacaaaagaaaccctagcttccctttgtacctctctctgttccaaaccatgtcgaagagaaagaccaaagagccaaaggttgagaatgtgactcttggaccagctgttcgtgaaggagagcaagtctttggagttgttcacgtctttgcttcattcaacgacactttcattcacgtgactgatttgtctggacgggaaacacttgttcgcatcactggtggaatgaaggtgaaagccgacagagatgagtcctcaccttatgct

SEQ ID NO: 1418 - DNA, 515 bp, Artificial
  Synthetic
aagatggcccccaagtcagacaacgttagcctcggcccccaggcccgagagggagagctcgttttcggcgttgcccgaatctttgcatccttcaacgatactttcgtccacatcaccgatctgaccggccgagagaccatctctcgagtcaccggcggtatgaaggtcaaggctgaccgagacgagaacaccccctacgccgccatgctggctgcccaggatgccgtcgagaaggctaaggaggttggtatcaacgctctgcacatccgaatccgagccaccggaggtacttccaccaagacccccggccccggctgccagtctgccgtccgagctcttgcccgagccggtatgcgaattggtcgaatcgaggacgtgacccccgttccctccgactctacccgacgaaagggtggtcgacgaggtcgacgactgtaagcggtttctttggggacttgctggcagtatttatgccgtgttttcatggtgtatgtaaaaatataaaagcgtaagcg

SEQ ID NO: 1419 - DNA, 702 bp, Artificial
  Synthetic
gagaaggaagcgagcgtgatggcgggactgctactccatgcgaatcccggcaacaagaatgcgctcaaatcgctcatcgcggcggagattgtgggcgtcaaggtcgatcttgtgcccgatttccagatgggcgtcagcaataagacgcccgagttcttgaagctgaatccgatgggaaaggttccagtgcttgagacaccagacgggccaatctccgagagcaatgccattgccagatacgtggcgaatctcaaaggaaaactgaccggatcgacattgtacgagactgccctgatcgatcagtggattgacttcgccaccactgagatcgacgcctctctgggaaggtggatctatccgcgcttcggttatattccgtacgcaccagaggttgaagagcatgcaattcaggtgctccagcgtgctttcggcgctctcaacgcttacctcgcctctcggacgtacctcgcggggcacttcgtcacgctggccgacgtgatcacaatctgcaacatgtccttcggctaccggactggagccttctcggaggagttcatgtccgcattccctcacgtcgagagatacttctggacgctctgcaaccagccagcattcaagaagcacttgggagaggtcgtccggggctcggtcgaagtccctggccccggtgccaagccagcagctgctcaggcgccccgggca

SEQ ID NO: 1420 - DNA, 1317 bp, Artificial
  Synthetic
cacatatatagatacccccactaccaaaccctaaacctcttttctcgcatctactgaagaggctctcacttctctctctcttctttgctcagagcttatcgccgttacaagcttggagggagcaagttccaactgtgcagccatggctctggttttgcactctggaagtaacaacaaaaatgcctcaaaggcactcattgctgctgagtacacaggtgtaaaggttgaacttgcaaagaatttcgagatgggtgtatcaaacaaggcacctgagtttatcaagatgaatccaattggaaaggttcctgtgcttgaaacacctgatggacctgtttttgagagcaatgctattgcacgatatgtaactaaattgaagcccgacaatcctctctttggctcttcgttgattgaatatgctcaaatcgagcaatggaatgatttttctgctactgagattgatgcaaacattgcacgatggctgtacccgcgccttggctatggtgcatatattcctccagccgaggaagctgcagtagctgcattaaagagagctcttgatgctttgaacacccatctggcatctaacacttacttggttggacaatcaattacattggctgacatcataatgggctgcaacttgagcattggttttaggatgataatgactaagagctttaccgaggaattcccacatgtagagcgatacttctggactgtggttaatcagccaaatttctgcaagatattgggtgaggtgaaacaagctgaatctgtcccagctccctcatccaagaagcctgcaccggcaaaggaagctgcgaaacccaaagcgaaggaggagccaaagaaagagcttaagaaggaagaaccaaagtttgaagaggaggaagaagcacccaagcctaaggcaaagaatcctcttgatctcttgcctccaagtaagatgattctggatgagtggaagaggctctactccaacaccaagaccaacttccgcgaggttgccattaaaggtttctgggacatgtatgatcccgaaggatattctctctggttctgtgattacaagtaccaggacgagaacacagtttcctttgtaaccttgaacaaggttggtggttttctgcagagaatggatctggcacgcaagtatgcttttggtaagatgttggtaattggttctgaggcaccgtacaaggtgaagggcttgtggcttttccgtggaaaagaaattcccaagtttgttatggatgaatgctatgacatggagctctatgaatggaaggaagtagacatcaacgatgaagcacagaa

SEQ ID NO: 1421 - DNA, 636 bp, Artificial
  Synthetic
cgcttgaaggacaacagctctctttgtggttcttctcttatcgactattctcacattgaacaatggatggacttctcagcaacagaggttgatgccaatattggaaggtggttgtacccaaggcttggttttggcccttatgttcctgcacttgaggaatttgctattacttcattgaagaggtcattgggtgctctgaacacacaccttgcttcaaacacataccttgttgggcattcagttactctagctgatattgtgatgacatgtaacctatattatgggtttgttcggatcttgatcaagagtttcacctccgagttccctcatgttgagcggtacttctggacaatggttaaccagcccaacttcaagaaggtcattggtgatttcaagcaagcagagtctgtgcctcccgttcagaaaaaggctgctccccctaaggaatcaaaagcaaaggaggccaagaaggaggctccgaaggaggcccctaaaccaaaggttgaggcttcagaggaagaggaggcaccaaagccaaagccaaagaatcctcttgatctactgccaccaagcaagatgattcttgatgagtggaagaggctatactcaaacacaaaaaccaacttccgtgaaatt

SEQ ID NO: 1422 - DNA, 923 bp, Artificial
  Synthetic
ttcactcgccgatcccggcgaactcgactcggtggcgccgccaccgagttttgatgacttccagcgccaaacttccttaatgacaagctgcactctcctctggaaagagctctccgatcacttcaattcactcgaacaagacatcctcaagaaatccgaagccttaaaagctaaaatccaaaccctagattccgaaaccaaagcttccctcgacgccctcgaaaaacgcgagatttcaatgaatgtttcactctcaatttctcttcagaaggttctcgaaaacaagcaagctgctattttagctctagatgagggtgcagaacaacccgaagtcgatgactctactggattgtatctaaaattgaagagcttttgtgttaagatggattctagaagcttctggaggtttttaattgtgaaaaagaaggatttggattcacttagggttgagataccgaaagcattaggagactgcgtggatccgccgaggttcgtgttggaatcgatatccgaggtgtttccagaggataaaaggcccaacccaacccttgatttgggctgggcctgtgttttgatgttggagtctttgattccagttatgatggaccctgttttgggaaatgagaggaaattggtgacgccgagtgttaaggataaggccaatgatatagcggagatatggaagaggagcttggatgaaagaggagggattgagaatgtgaagacgccagatgtgcatactttcttgcagcatttggtaacttttgggatagtgaaggatgaggattttgatttgtacaggaaacttgttgttgggtctgcttggaggaaacagatgcctaaattggctgtctctcttggacttggtgataaaatgcctgaaatgattgaagaattaatcagccgaggacagcaagttgatg

SEQ ID NO: 1423 - DNA, 637 bp, Artificial
  Synthetic
atcccacctactatatttgtataatatggaagttgccaaagttcttcacctgaatgaaggaattggaaaggctagctatgccaaaaattctctgtttcagcaaaaggtgatcctaatgacaaagtcaataagagatgaagccatatatgcactataccgcagcctttccccagaagccatttgtattgcagacttaggatgttcctctggacctaatactttccttactatttccgaactcattaaaactatttatgaagaaagcaaaatcaatggcaaaaaacagtcgccggaattccaagttttcttgaatgatcttcccggaaatgatttcaataccattttccggtcgttgccagagttctacgaagatttgaggaaacatatgggagatggatttggtacaaattgctttgttgcaggagttgctggttcattttataatagacttttcccttccaacagtgtgcactttgtccactcctcatacagtctccactggctttctcgagtacctcatggaatagagaataacaaaggaaatattcacgtggcaagtacaagcccacaagatgtggttgaagcatactacgagcaatatgaaagagattttgtgaattttctcaagttacgctca

SEQ ID NO: 1424 - DNA, 800 bp, Artificial
  Synthetic
tttctattttatatcaaagaaaagaaaggaaaatgacttctacattttctcttaagttgattattagtgttgtcactttgctttgcttaattcagttttccagtatttgtaatgctaaaaggatgcttagggagtctaatataggaaaggaaaatgagaatatatttaaggagaaaaaggatgattcaacaaacattggtggatttccttttccattcaattttccaccattttctgatggaattccaaatatacccttcaattttccatttcctgactttggatcgtcaggaggattgcctggttttggaattcctgggaccggtggtagtggtactggtgataataatccattttcgtttccgatccctggagttcctaatgttgctgttccacccccagctgccgccccttaaattcctatacaagtttctctctgttattagcagtttagccttttggctggggtcatgtaaaacattaaaaaaaaaatgataaagaagaaggaaatcaaggagtaagttttagagccataggctcaaatgaattactatttcttggccttggttctgatgtaattaattagaaaatgggaaatgacatggatgtcaagtaaaaaagaactcgtatttttctacccgattaacaagggtatcaccttcaaacttgacttcagcacgcgtgttgtagttcccgtcatctttgaaagatatagtgcgttcctgtacataaccttcgggcatggcactcttgaaaaagtcatgccgtttcatatgatccggataacgggaaaagcattg

SEQ ID NO: 1425 - DNA, 1011 bp, Artificial
  Synthetic
agaaaatatcatgaatttcctctcatctttggctaagagcgccggcggtcaatccgacgacgagcccaagaaaaccgccggtgaggaagcttcaactactgatcttttttctagtgcaaaagttgttagcagaagcagctcaaagtcaattcaacaaagattccagcgaggtcgataacaaaaaggtggctgctgctgctgctgatgttcttgatgctgcacagaaatacggaaagttagatgaaactcaaggtgttggacagtatgttgaaaaagctgaaacttatctccaccagtacggttctgctaacccatccaccaccaccgatgccgccgctgcaaaggccccggcagccacaccagataccaaagatacaaaggcacctacaccggctccggcggcagcagatactgatgaaacaaaggcaccggcaccggctcctgcggcagcagatactgaagaaacaaaggcatcggctccggcaccggcggcagcagatactgaggaaacaaaggcaccggcaaccgcagataccgaagaaccaccggcaccggcaccagcaccggcgccggcaccggaagagaagggagaagggtatgggcaatacgtgaaaatggcagaaggatttctgaaatcaggagatgatgaatcagcgaaagcatctgaaggaggatcagattatcttaagatggccggtgacttcttaggcaagaagtgattagtttaatcagattctttttaataatgactgttattttccaagtttttcttctttcattttctttgccactgttcagtgttcattaccggcggcgaacttcttcagtagccgtcgccggagctggtttttacttggcatgtatgtaatttgtgtgtgtgtgtgtgtttttccagtatgatttttagagtgtaatggaatttgtgttatatggataaagtgatcctttatgatgttattggtgtatatgatatggtcgtgattcttaattatattcgtcttccttctattc

SEQ ID NO: 1426 - DNA, 980 bp, Artificial
  Synthetic
tggtatcaacgcagagtggccattacggccgggggagatagagagggtgccttttttgtttctttaatctcaatatcaaagcaggttagatataagaaggcagaagagctttgttcataaaagtaaatttttctctgccatatttctaactctgactagttattgagattgaagattttcaggcttctgtaagtaataataataataataaggagaaaaaaagtaaataaaagataaaaatggcattcacaggaactttggataaatgctcagcttgtgataagactgtttattttgttgatttgttgtctgcggatggtgttacttatcataaatcctgcttcaaatgtagccattgcaaaggcactcttgtgatgagcaactactcttccatggaaggagtcctctactgcaaggctcatttcgaacagctttttaaggaatctggaaactttaccaagaattttcagaattctaaggctgagaggcaaaattcactgacaagggctccaagcaaactatctgctatgttttctggaacccaagataaatgtgctgcttgcgacaaaactgtttatccacttgaaaaggtgacaatggaaggagaatcattccacaagtcatgtttcaagtgtgcacatggagggtgtccacttacccatgcaacatatgcttcccttgatggaaatctctattgcaaacaccattttgctcagctcttcatggaaaaaggaaattaccaacatgtcctcaaagctgctaataataagaagactagtgctgctgtgacaccaataaatgacactgaagaaaatgcagctgaagaagagaacaataataaggagcccgaaaatgcagaggaaccacaacaacaatcataaaacaaacgtcccctcgatttctccccttatgtatatcaaacaattgatcctttctatctattttgatccaatatctttgtgtttctgctatgttttttc

SEQ ID NO: 1427 - DNA, 681 bp, Artificial
  Synthetic
attagaaaagtatgtcttttattgggacacaacagaaatgcaaggcctgtgaaaagacagtttacccggtggagctgttgtcagctgatggggttaattatcacaagtcttgtttcaaatgcagccattgcaaaggaacacttaagctgagcaatttctcctcaatggaaggtgttctgtattgcaagtcccattttgagcagcttttcaaggagtcgggcaacttcagtaagaactttcagtcacctgcgaagtcagctgagaagttaactcctgagctgacaaggtcgcctagtaaagctgctggcatgttttctggcacgcaggaaaaatgtgcaacttgtggtaaaacagcttacccacttgagaaggtgacagtggagaaccaaagttatcataagacatgtttcaagtgttctcatggtggatgctctttatctccttcgaattatgccgccctaaatgggattttatactgcaaacctcatttttcacagcttttcaaggaaaaaggcagctacaatcatttgatcaagtctgcctcgatgaaacgtccagctgctgcaaccgttccagattcttaaactccatgtttcagtcaactactgtatccattcacatggacttgatatttcttgagtgtgtttcttgctttttctctgttcattggctggtaacctc

SEQ ID NO: 1428 - DNA, 718 bp, Artificial
  Synthetic
taccctcgaccacgcgtccgtcactctctactcttactctccaacaatctttcctccattttcttgttctgaagcttgtgtgtcagcagttcagaattctaactcagttctctacaaagtacactatcttgttttttgtattttaggggaaaagaatcccattttgatcaagaatgatagaaacagattcataaagtttgagtctttgactaacttcaacaacatattctgccctgtttcttttttgttcacttttacaggtactttttatactgatgtagaagcctaagaaaagaacatatatagcataagcaattcgaatggcagattcggacaatgaatcaggagggcagagagagagcgagagttcactaagagagcaagacaggttccttccaatagcaaatgtgagcagaatcatgaagaaagctttaccagcaaacgcgaaaatatcaaaggacgctaaagagatagttcaagaatgtgtttctgaattcatcagtttcattactggggaagcatcagataagtgtcagcgtgagaagaggaagaccatcaacggtgatgatttgttgtgggcaatgacaacacttggttttgaagaatacattgagccccttaagatttatctgcagaggttcagggacttagaagggcaaaagagcaccatgactggacgacaagacaaagagaatagtggatcaatgaatatgggtag

SEQ ID NO: 1429 - DNA, 558 bp, Artificial
  Synthetic
gggacaaatgaatgataaccaggaaccccactcggccggagggactggctatgagtttgaaggtgtcaaagagcaagaccggtggttacctatagccaatgtcgcccgaatcatgaagaatgcactacctgacaatgccaagatagcgaaggaggctaaggagtgcatgcaagagtgtgtgagcgagttcatctccttcataactagcgaagcctcggagaaatgccagcaagagaaacgcaagacagtcaacggagaagacattttgtttgccatgacttcactgggtttcgagaactatgcagaggccctcaaggtctatctctcaaagtaccgtgagcaacaaaatcagtcgaaccgtgatcgcgtcctagagaacaacaactggggcggccaaatgataccgggtgctgaaaagactgagccgggcacaacgagtgccgattatgcaccccccgaaggaacgaatcctgctgaagggggggccgatccgaactacatgtatacttctcatgctggccacaacggaactggtgctggagagggttattaagaggg

SEQ ID NO: 1430 - DNA, 621 bp, Artificial
  Synthetic
ggttaccctagtctcggcgaggcgatgcgccatagctcgtcttcgtcttccccctggcgattcctcgacgatgccttggttgccttggccagcgagagaggggagagggggcgagaggggggagaatcttgtctggattctccatggttatagctggaatgccttgggcccgtgggcaatgcgggttctacttgtggagtttgagcttgagctttgaggagaaaagatggcggacgttggaagtcccaggagccaagacagtccacacccggacgaggctggtggccatggggagcgcgacaacgccaatgtaagggagcaggacaggttcctccccatcgccaacatcagccggataatgaagaaggcgctgccggccaatgcgaagatcgccaaggacgccaaagaaacggtgcaagaatgcgtctcagagttcatcagcttcatcaccagcgaagccagtgataaatgccaaagggagaagagaaagacgatcaacggcgacgacttgctatgggcgatgagcacgctaggtttcgaggagtacctggaacctttgaagatctacttgcaaaagtatagagaggtggagggtgacaaaggctcggctgccaaaggaga

SEQ ID NO: 1431 - DNA, 495 bp, Artificial
  Synthetic
gcagcatggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaataaa

SEQ ID NO: 1432 - DNA, 547 bp, Artificial
  Synthetic
  misc_feature (473)..(473): The residue at this position can be any nucleotide.
gttgcagagagacaacactgtctatagttagatagctcaagagatggataatcttgggggaggaaatggtaatggaggatttcatggctaccgcagattccctcaaccaacccctgctacggacatgagcatgggactgtctgctcatctcaaccaggccattgctgccaatacaaacaataatgccaccaacaactcagaacaagattctgaatgcaccattcgggagcaagaccgattcatgccaatagcaaacgtgatcagaatcatgcgcagaatccttcctccgcatgccaagatatcggatgactctaaagagaccatccaagaatgtgtatctgagttcataagcttcatcacgggcgaagccaacgagcgttgccaacgtgagcagcggaagaccatcactgctgaggacgttctttgggccatgagcaagcttggttttgatgactacattgagcccttgactntatacttgcatcgttatcgtgagtttgacggtggtgagcgtggatctttgagaggggagcctttgctgatgaag

SEQ ID NO: 1433 - DNA, 403 bp, Artificial
  Synthetic
tctacatccatcgcgcacttgatggaagccttcaggactacgtgtttgaggagagcgtttgccttctccttagggcatcatggtttaaacctttgattgtggaggaaagggcggaggttgatgatgatatggatgacttatacatgtatgattacgaagaagaagatttagcagaagattatttcgttagtagttcatcaagactccgtatcggcaatagacgatggggtgataatggatatgttagtgcaggaaggcaagaagcaaggcctgtttatcgacctaactctcaggaatctggtgctggcccctctcgtgagccgaagaagaaggaggatgctgttcctaaagaacttgttggccggcgtgcaaagagggcactgaagcgtgaagctgctgataa

SEQ ID NO: 1434 - DNA, 644 bp, Artificial
  Synthetic
ggcatggcgggagcggcggcagtggaatggcatctccggcagcagaatgcgaagaacccaatcgtgttcttcgacgtgacaatcgggaccctccctgccggaagaatcaaaatggaactctttgccgacattgcccctcgcactgctgaaaacttcagacagttttgcactggagaatacaggaagtctggcattcctattggatacaagggtagtgcatttcatagggtcatcaaagatttcatgattcaagctggtgactttgtaaagggagatggaagtggatgtactagcatatatggaagcaagtttgacgatgaaaattttattgccaagcatactggacctgggcttctttcaatggctaacagtggaccgagtacaaatggttgtcagttctttatcacctgtgccaagtgcgattggttggatggaaagcatgtcgtttttgggagagtgctaggagatagccttttggttgtaaggaagatagagaatgtccagacgggtcccaacaatcgacctaagctcccctgtattgtctctgaatgtggtgaaatgtgacaggattaaaaggtgttccctttttcttcaacatatggtttcatatttcttttcttttccatattacatagaaaagggag

SEQ ID NO: 1435 - DNA, 640 bp, Artificial
  Synthetic
tccgacgtagacagcggttctctaacagtgaatgcgaacaaagatggcaaagaattcatttgttttgctgctcttcagtttagtcattttcggaactctaacgtctgctcagggcaaaaagtcccaggaaagtctaaaagaaataactcacaaggttttctttgatgttgagattgatggtaaacctgcaggtcgtattgttatgggtctctttggtaaaacagttcctaaaacagcagaaaatttcagagcattgtgcacaggggagaaaggtatcggaaagagtggcaagcctcttcattacaaggggagcacattccatagaataatccccagcttcatgcttcaaggtggtgatttcactcttggtgacgggcgtggaggtgaatctatttatggtgaaaaatttgctgatgaaaatttcaagatcaagcacactggaccagggcttttgtcaatggcaaatgctggtcccgacaccaatggttcacaattcttcatcacaaccgtcacaactagctggttggatggccggcatgttgtctttgggaaggtgttgtctggaatggatgtcgtttacaagattgaagctgaaggaagacaaagtggaacaccaaaaagcaaagttgtcattgcagac

SEQ ID NO: 1436 - DNA, 373 bp, Artificial
  Synthetic
cccacgcgtccgatcttcttcatcgatttctctcttccaaatctcccaaaagatgtcgaaccctagagttttcttcgacatgagtctcagcggtactcccatcggacggatcgagatggagcttttcgctgatacaaccccaaacacggcggagaatttccgtgctctctgtaccggcgagaaaggaatgggaaagctaggtaagccacttcacttcaaaggatcgatcttccaccgtgtgattcccggattcatgtgtcaaggaggtgatttcaccgccaagaacggaaccggtggtgaatcgatctacggtgctaagttcaaggacgagaactttatcaagaagcatacaggagctgggattctctcaatg

SEQ ID NO: 1437 - DNA, 583 bp, Artificial
  Synthetic
cccaaccccccccgagtcagctctaatagggccaaagactctagcagcaaaacatgtcagtgacgcttcatacaaacctaggcgacatcaagtgcgaaatcttctgtgacgaagtccctagaactgctgagaacttcttggcattatgcgcaagtggttattatgatgggacaatatttcacagaaacataaagggtttcatgatccaagggggtgacccaacaggtacaggaaaaggcgggacaagtattaggggaaaaaaattcaatgacgagataagggagtctctcaagcacaatgcaagaggaatattgtcaatggccaacagtggccctaataccaacgggagccagtttttcatgacatatgccaagcaaccacatcttaatggattgtacaccattttcggaaaagtgatacatggatttgaggttcttgatatcatggaaaagactccaacaggaccaggtgataggccccttgccgaaatcagactcaaccgggtgacaatacatgctaatccacttgctggttgacgttatttcgaactcatgctacggcagtatgtttaatctcattattg

SEQ ID NO: 1438 - DNA, 704 bp, Artificial
  Synthetic
ggatcttcgtctttggaattggctatggcaatggcttcgcttcccttgcttctcctggctgcccttttcctcatttcttctgctactgtccaggcaaagaaaaaggatctagaggagataactcacaaggtttacttcgatatagaaattggtggcaaaccggctggtcgagtagttattggtctttttggaaagactgtgccgaagactgtagaaaattttcgggctctttgcacaggtgaaaagggtgttggcaagagtggaaaaccacttcattacaagggctccaagtttcatcgcataatcccaagctttatgattcaaggtggggatttcactttgggagatggacgaggcggagaatctatttatggggtgaaatttgcagatgaaaacttcaaaatcaagcataccggagcaggtatactttcgatggcaaatgcgggccaagacaccaatggctctcagttttttatcactaccgttcaaacaagctggttggatggaaagcatgttgtttttggcaaggttatcagtggaatggatctcatctacaaggtggaagccgaaggtacccaaagtggtactccaaagaaaactgtctccgttgttgatagtggggagcttcccttgtagtaagcctttactagagtagcactcacactggaaacatacactaaagagatggggaaaaaaagggtctc

SEQ ID NO: 1439 - DNA, 652 bp, Artificial
  Synthetic
gggaaaaattccacagaaatttctagaagagagtgagagatggcaaatcctaaggttttcttcgaccttaccatcggcggtcaaccgaccggccgtgtggtgatggagttgttcaacgatgtagttccgaaaaccgcggataacttccgagcactctgtaccggagagaaaggcgtcggaaagtccggcaagccgttacactacaaaggatcatcatttcaccgtgtgattcctggatttatgtgtcaaggaggtgatttcactgctggaaacggtaccggcggtgaatcgatctacggcgccaaattcgccgacgaaaatttcgttaaaaagcatactggaccgggaattctctccatggctaatgctggccctggaactaacggatcgcagtttttcatttgtacggccaaaaccgagtggctcgatggaaaacacgtggtttttggtcaagttattgaaggaatggacgtgattaagaaagtggaagctgttggatctagctccggcaggtgctcgaagcccgttgtgattgctgactgtggtcaactctcttagattattaatggtatcaactaatgttaatgatgatctaaactagttaactatgggatcgcagtgtactgatctgctggttttcgtttttttattt

SEQ ID NO: 1440 - DNA, 380 bp, Artificial
  Synthetic
tcgatttctctcttccaaatctcccaaaagatgtcgaaccctagagttttcttcgacatgagtctcagcggtactcccatcggacggatcgagatggagcttttcgctgatacaaccccaaacacggcggagaatttccgtgctctctgtaccggcgagaaaggaatgggaaagctaggtaagccacttcacttcaaaggatcgatcttccaccgtgtgattcccggattcatgtgtcaaggaggtgatttcaccgccaagaacggaaccggtggtgaatcgatctacggtgctaagttcaaggacgagaactttatcaagaagcatacaggagctgggattctctcaatggctaactctggtcctaacactaacggatc

SEQ ID NO: 1441 - DNA, 348 bp, Artificial
  Synthetic
aggtttactttgatgtggaaattggtggtgaagttgctggcagaattgtgatgggtctctttggagaagttgtgcctaaaaccgttgaaaacttccgtgccttgtgtactggtgagaagaaatacgggtacaagggttcctctttccatcgtattattaaggatttcatgatccaaggaggtgatttcaccgagggaaatggtactggaggtattagtatttacggtgccaagttcgaagatgaaaactttaccctgaagcatactggacctggaatcttgagcatggcaaacgctggtcctaatactaatggaagccagtttttcatttgtaccgtcaagacttcat

SEQ ID NO: 1442 - DNA, 618 bp, Artificial
  Synthetic
gcgaatcctagaaacaaattgtctccttaccttcttatcggggtcttggttttattcggaaccctaattttcattctgaaccgattgggtgataccggagtcacgtcggataaagacattaaaatcgagcaaaatgatgaggcgaaaccatcagaggatttggagcacgtgacgcataaagtgtactttgatgtcgaaattaatggaaagcctacaggtcgtattgtcatgggcctctttggaaaaattgtcccgaagacagcagaaaacttcagagctctttgcacgggggaaaaaggaactgggaaggctggaaagcctctccattacaaaggtagcactttccacaggatcataccgagcttcatgatccagggaggcgatttcactcgtggtgatgggcgaggtggagaatctatatatggtgaaagctttgcagatgaaaacttttatctaaaacacactgtacctggtattctgtcaatggcaaatgctggaccggacaccaatgggtctcaattctttatcacaactgtaaccactggctggttggatgggcatcatgttgtctttggcaaggtgctgtctggcatggatgttgtctacaaaatcgaagca

SEQ ID NO: 1443 - DNA, 596 bp, Artificial
  Synthetic
  misc_feature (536)..(536): The residue at this position can be any nucleotide.
gccaaaatgcctaacaccaaggttttcttcgacattgcctggaagggccccgtcttcaaggacggccgtcctacctccgagatcaaggagcagaccggtcgcatcaacttcaacctctatgacgacgttgtccccaagaccgctgagaacttccgtgctctctgcaccggcgagaagggcttcggctaccagggctcttctttccaccgaatcatccccaacttcatgctccagggtggtgacttcacccgcggtaacggcactggcggcaagtccatctacggcgagaagtttgccgatgagaacttccagctgaagcacgaccgccccggtctgctgtccatggccaacgccggccccaacaccaacggctctcagttcttcatcaccaccgtcgtcacctcttggttgaacggccgccacgtcgtcttcggcgaggtcgctgaccaggagtccatggccattgttgctgctcttgaggccaccggccgtgatgacggcaaggtcaagtacgagccccgccccaccatcaccgnctccggtgtcctgtaaacttgttgaaaagaagcaacatgctctgcatgtccatttggtgg

SEQ ID NO: 1444 - DNA, 641 bp, Artificial
  Synthetic
  misc_feature (298)..(298): The residue at this position can be any nucleotide.
gcggacgcgtggggggagattttagggcgaattccggggcgcgatggcggcatctatcgcggcattcacggccgctccatcttcttgctgcgtggcggcggcggcgtcggcatcggcctcgtcgtcatcgattcggccgcttccactgaaaagatcggtcctcatgctccacagcgcggcaatgccggggtctttgaagttctctccgctcacagtgatggctacgacctcgtccgaggagaagacgactgggacgacgacgtcgacggaagacgtgagcaagcaagtggaggacatngtgtcggatttgaaggaaaagtgggatggtgtggagaacaagactactgtcttgatttacggtggtggagcgctggtcacgctatggttctcggcaacaatcgttggagctatcaactcggttccattgcttccaaaggtaatggagcttattggactgggatacactggctggttcgtctaccggtatcttctcttcaagtcgagtagaaaggagctgctggaagacgtggaagagctcaagaagaagatcacgggcgcaaccgagtaagaagacgagtagagcgagctgtttgatgatgtccgaaagaagaaactctgacgtgcctggatggaaccaggcc

SEQ ID NO: 1445 - DNA, 537 bp, Artificial
  Synthetic
gacagaagagagagagagatagagagagagagaagcgatggccgccactgccgccctctctctgcatgcacccccttcgttggcgaatgccgccccctccccttcttctctctctctctcctctgcccctttccccagaatggccttctccgctagaccttccctccgcctctcaggtaacctaagattttcacctctgcccatcaaggcgatatcaaccgaggaaaaacaagcatccgtagaaactgaagccccagtagaagatgtattggcggacttgaaggaaaagtgggacaagattgagaacaagtcaactgtgttcatttatggtggaggtgctctggcttccatttgggtgtcatcaatagtcgtgggagctattaacacagttccattgcttcctaaggtaatggaactggttggactaggctacactgtatggtttgtgtacaggtacctcctttttaaggaacagcaggaaagagctagtctctgatattgaggatatcaaggcaaagatagtcggtgtcggtaagg

SEQ ID NO: 1446 - DNA, 554 bp, Artificial
  Synthetic
ggagggagacagaagagagagagagatagagagagagagaagcgatggccgccactgccgccctctctctgcatgcacccccttcgttggcgaatgccgccccctccccttcttctctctctctctcctctgcccctttccccagaatggccttctccgctagaccttccctccgcctctcaggtaacctaagattttcacctctgcccatcaaggcaatatcaaccgaggaaaaacaagcatccgtagaaactgaagccccagtagaagatgtattggcggacttgaaggaaaagtgggacaaaattgagaacaagtcaactgtgttcatttatggtggaggtgctctggcttccatttgggtgtcatcaatagtcgtgggagctattaacacagttccattgcttcctaaggtaatggaactggttggactaggctacactgtttggtttgtgtacaggtacctcctttttaaggaaagcaggaaagagctagtctctgatattgaggatatcaaggcaaagatagtcggtgttggtaacgaacagtgaact

SEQ ID NO: 1447 - DNA, 652 bp, Artificial
  Synthetic
ccccgagctgctgcctctagcttacttggtgataaggaggaggaggaggagggcaccgacatggccgcagccacggcgtacaccgtggcgctcctcggcgccaccggcgcgcgcgtccccgccgctccacgctccgccgcacttctgccgcgccgcggcggcgtgctccaaccgctgcgcctccaggacgcgccgcgactgtccctgctccgcgtcagggccgcctccgacgacacctccacctcggccagcggcgacgagctcgtcgccgacctcaaggcaaagtgggaggcgatcgaggacaagccgacgttcctcctctacagcggcggcgccgtcgtcgccctctggctcaccaccgtcgtcgtcggcgccatcaactccgtgccgctgctccccaagatcctggagctcgtcggcctcggctacaccggctggttcgtctaccgctacctcctcttcaaggagagcaggaaagagttggcgaccgacatcgagaccttgaagaagaagatcgctggaacggagtaattaagcagctgcatttgtccggggaagttttggggggtgactctctagagtgcttgctgctgcttcctctatgtgatgtttgtatatctctacgagaatatgttctgctcccatgtgcagt

SEQ ID NO: 1448 - DNA, 620 bp, Artificial
  Synthetic
gaattcaagagaaaaacaagtacagagagagtgagtttagtgaagaagtaatggcaactatgtatgcagcagcaagtgcatcttcaatgctagtggcaagacctcgtttgccaaaaaccattagctgctcagcaggtttaccttatcttccacctcgtccatccgtttcttcattctctacctccatcaaaaactacccagtgtcaagcagcagattttcaactctccgagtcaaagctgaggagacatcatctgttgaggttaatgatataattgaagacttaaaagagaagtgggatggacttgaaaacaagtctaccgttcttatctacggtggtggtggtttggttgcactttggctatctacagttgtggttggcgccatcaattcagttcctttgcttccaaagatcatggaactagtaggactcggttacactggatggtttgtctaccgataccttctcttcaagtcaagcagaaaagaactagcaagtgatatcgaatccttgaagaaaaagattgcaggaaccaccgaatagagtcagacataagatggtcttgcagtggggctgtcttgtctattgtccttagatttatttgagaatcattatatggct

SEQ ID NO: 1449 - DNA, 602 bp, Artificial
  Synthetic
ccccccccccctccggtagccaaggaaaagaaagcagaggcggagggaagagccacgtaaagccgaagagggtccacgactgacatggccgccacggcgtgctccacggcgcctcttctcggtggagctcgcctccccgccgtcggcgccgccttgccgccgccctccgttctcctcctcccccagcgcaatttcccctctcctctccgcctccatgacgcaccgaggctatctctgctccgggcgagggcgtcgtccgacgacacctcgtcctccgccgggaccggcgacgagctcatcgaagacctgaaagctaagtgggacgccgttgagaacaagtccaccgtcctcacgtacgccggcggcgccatcatcgccctctggctgtcgtccgtcatcgtcggcgccgtcaactccgtgcctctgcttcccaagttcatggagctcgtcgggctcgggtacacaggctggtttgtgtaccgctacctcctcttcaaggaaagcaggaaggaattggccgacgacgtcgattctttgaagaagaggattgctgggacagagtaaaaaatgccgtcgtctgcaccaattttttggaacgattc

SEQ ID NO: 1450 - DNA, 466 bp, Artificial
  Synthetic
gacgagctcatcgaagacctgaaagctaagtgggacgccgttgagaacaagtccaccgtcctcacgtacgccggcggcgccatcgtcgccctctggctgtcgtccgtcatcgtcggcgccgtcaattccgtgcctctgcttcccaagttcatggagctcgtcgggctcgggtacacaggctggtttgtgtaccgctacctcctcttcaaggaaagcaggaaggaattggccgacgacgtcgattctttgaagaagaggattgctgggacagagtaaaaaatgccgtcgtctgcaccaattttttggaacgattctttggatcgcacattgcagagaccaaaacccgttgtttagagtactagtgtttggtaccgcgaagctttgttttgttcctttccttgatgggcaataacagtgtcttcacgtgtagatcgaattaataataattacgaattgcgtctcgact

SEQ ID NO: 1451 - DNA, 735 bp, Artificial
  Synthetic
agctgaaaaaaaaagagaggccacgaagagagctcagctgctgcctctagcttacttggtgataaggaggaggaggaggaggagggcaccgacatggccgcagccacggcgtacaccgtggcgctcctcggcgccaccggcgcgcgcgtccccgccgctccacgctccgccgcgcttctgccgcgccgcggcggcgtgctccaaccgctgcgcctccaggacgcgccgcgactgtccctgctccgcgtcagggccgcctccgacgacacctccacctcggccagcggcgacgagctcgtcgccgacctcaaggcaaagtgggaggcgatcgaggacaagccgacgttcctcctctacagcggcggcgccgtcgtcgccctctggctcaccaccgtcgtcgtcggcgccatcaactccgtgccgctgctccccaagatcctggagctcgtcggcctcggctacaccggctggttcgtctaccgctacctcctcttcaaggagagcaggaaagagttggcgaccgacatcgagaccttgaagaagaagatcgctggaacggagtaattaagcagctgcatttgtccggggaagttttggggggtgactctctagagtgcttgctgctgcttcctctgtgtgatgtttgtatatctctacgagaatatgttctgctcccatgtgcagtaacagcgtagtgcaaaaactgtatcaaacctactatcagttgtttcttcg

SEQ ID NO: 1452 - DNA, 601 bp, Artificial
  Synthetic
ggcggcggcagtagcagtagcagcctcttcctccctctctctttcccggcactctgccgccacggcaccagtgtcgcccctgcgtagggccctccccccgtcgctgcctttccccgcctcccaagctctcaagctctctacttcgcctttcgtcccagccactctaagatttttgcccttatctgtcaatgcggtttcaactgaggaaaaaacgtcatcatcggttgaagccgaagtaccggccgaggatttagtggccgacttaaaggaaaagtgggataagctggagaacaagtcgacagtcttaacctacggcggaggtgctttgcttgccatttggttctcttcgatagttgtttctgccattaacgcagttcccctgcttccgaagcttatggagtttgtgggccttggatatactggttggtttgtctataggtaccttcttttcaaggaaagtaggaaagagctagtcttggatattgaggatttgaagtcaaagataaccgggtctggaaaggaagattaggcaaggagggacttattctatccatggcaagtaaggtggtttgtctgtgtgtgttttaggtaggataaattt

SEQ ID NO: 1453 - DNA, 837 bp, Artificial
  Synthetic
cccacgcgtccggaagaaaatatactactttttggggatatcaagaaaccaaaaaaggagatttgagatagacaagaaagagaggccaaagttaagcaataagcatacaccgccagccccaaaaatctaagcatcggccaaatggcagcagcagcttctacttcaatggcagctactgccgtctttgcttctcgtttcccactttcctccaccaccaaagccgcccctgttcgctgctccgccttgccttacctcccaccctgtctttctgctactgccttctcatcttctctcaagtttgctgaacccaagagggcttcgctactccaggtcaaagcctcttcatcagaagaatccggtgctgttgataccagtgaattgttgacagatctaaaagaaaagtgggatgctgttgaaaacaagtctacagttatagtatatggaggtggggcaattgttgcagtttggctgtcttcaattgttgttggtgctatcaactcagttcctttgctcccgaaaataatggagctggtgggccttggatacaccgggtggtttgtctaccgctatcttctattcaagtcaagtagaaaagaattggcagaagacattgagcaattgaagaagaagattgcaggaactgaataaatgcacataaatggcaatgccagttcagactgttaaattttctgtacaagaggcatctgctcgtgtgaagtagagtagattttgttgtaattttcttctattctgagcaaatcttcaaataaaataatgtatttaccttacagttcattgtgcttataaattatatagcagtatccactctgtttctac

SEQ ID NO: 1454 - DNA, 763 bp, Artificial
  Synthetic
ccccccccccgaaaatcaaagcaatggcctcaactagctccccttcactttctctttcctcttcatcgacttttgtcgatggcaagacaactcgtaagtcagctgctgctgcgtcctcccaatgtgtcaccctacccaccctccctccccctccagccgtccaaagccgcgctgccagaaccactgcctactgtcgtaagattgcaaggaacgtggtcgcaatggcaacgtctactggagaggttgcaactaccacagaggcttcatcagctgatatggcaaccactgagctaccatctgagcttctccaaaaaattcaagaagcttgggacaaacttgacgataagtacgcagtcagctcactcggtgttgctgcactacttctactatggagctccactggagttatctcggcaattgacaggcttcctctgattcctggtgttcttgagcttgtaggaattggttacaccggttggtttgcttacaagaacttggtcttcaaaccagacagagaagctttgatatcaaagatcaaagacttgtacaaggaagtaattgggagcagctgaaaagaaatagagggtcctgatgctgccgcagagacatgatcgaaatagatttcagttgagcaatcttgcagctttgctcttcgaaatgtaaactctgctttgttcttttgctgtctaaatattctaacagaataaaactcaaaatgaactatctatatattgcttatttgtacatcgccctttattctctc

SEQ ID NO: 1455 - DNA, 625 bp, Artificial
  Synthetic
  misc_feature (568)..(568): The residue at this position can be any nucleotide.
actcgcacggagagagagagagagaaaggaagaggagatagatagatagatagatagatagagagagagagaagagccatggccacagcttccatggtttcattgcaggccacagccatggccttccccttttcaccttcaacatctcgccactcccactcccattccccttcacttgccttcacaagaatgcccccccccgccaaccctctcaagccctccctcttcatcccgtcaggcagtgtaagatttttaccgctatctataaaagcggtatcgacggaggaaaaacagtcaatgtcggaaactacagccccagcagaggattttttggcggacttacaagaaaagtgggataaattggagaacaagtcgactgcttttatctatggcggaggtgctttggccaccatatggatatcatcaatagtcactagtgctgttaattcggttccattgcttcctaaggtccttgaactcgttggtcttggctacactgcatggtttgtgtataagtaccttctgtttaaggaaaacaggaaagagctagtctctgacattgaggatntgaagtcaaaaataatcggtgggtcccgtaaagaggagtaagccgaaaagatttagt

SEQ ID NO: 1456 - DNA, 564 bp, Artificial
  Synthetic
cggacgcgtgggcggacgcgtgggatttcagggacgagtcaaggaagcggcgagtatttctcacgaattggcatcggtcacccgccgagtcaagtttacatggtgctcgatactggaagtgacgtgaattggatccaatgtgcgccttgtgccgattgttaccagcaagccgatccgatttttgagccggcttcgtcttctacattctcgccgctcacttgtgaaacgcaacagtgtaaatcgcttgatgtttctgaatgtaggaacggcacatgcctttatgaggtctcctacggcgatggctcgtataccgtcggcgattttgtgacggagagagttacccttggaggctcttcttcggttgagaatgtagctatcggatgtggacataataacgaaggtttattcgtcggcgccgctggattgctaggtctgggcggcggcgcgttatcatttccttcacaaattaatgcttcttctttctcctattgcctcgtggatcgtgactcggactcgacatcaactctcgagtttggcggagtgatatcgcctgacgccattact

SEQ ID NO: 1457 - DNA, 621 bp, Artificial
  Synthetic
cggacgcgtgggccggcgcagaggggcatctccctcggcaccggcaactacgtcgtgtccgtcgggctcgggacgccggcgaagcagtacgccgtgatcttcgacaccggcagcgacctgtcgtgggtgcagtgcaagccctgcgccgactgctacgagcagcaggacccgctgttcgacccgtcgctgtcgtcgacgtacgccgccgtggcgtgcggcgcgccggagtgccaggagctcgacgcgtcgggctgctcgtcggacagcaggtgccggtacgaggtccagtacggcgaccagtcgcagaccgacggcaacctcgtgcgcgacacgctgacgctctcggcgtcggacacgctcccgggcttcgtcttcgggtgcggcgaccagaacgccgggctgttcggccaggtcgacgggctgttcggcctcggcagggagaaggtgtcgctgccgtcgcagggcgcgccgagctacggccccggattcacctactgcctaccgtcgtcgtcgagcggcaggggctacctgtccctcggcggcgccccgccggcgaacgcgcagttcacggcgctggccgacggcgcgacgccgtcgttctactacatcgacctcgtcggc

SEQ ID NO: 1458 - DNA, 742 bp, Artificial
  Synthetic
gaattcggtcaatggcgaaatcagctttttggttttgtgttcttttcttcgtttcgtttgctacctgtgtttgctgtagagttattttaccggaaaatgaaaaccatgaagttacagttcttgatatctcggcttcaattcagaaaactctcgacattctctcttttgatcctgatgaaattctcttagaagaagaaagtgtttctgatgattgctcatcattatcttcatcttctttcactgtcaaacttcaatctagagataccattctgaaatcgacacacaaagattacaaagctttaactcttgacagactcaaacgtgattcagctcgagttgattcaatcgttactaaattagatctcgccacgaaaggaatttcgaaatcagatcttaaacctttatcagttgagaaagagtttgatacattgaaatcacaagatcaaaataatatagtaggtccaattacatcaggactgagtcatggaagtggtgagtatttctcacgagtcggagtcggtcatcctcctaaaccgcaatacttagttctcgacacaggaagtgatgtcacttgggtacagtgcgcgccttgtcaggagtgttaccaacaaaccgatccgatattcgaaccgtcttcttcttcgtcgtttgcacacatttcatgcggcgcacaacagtgcaaatcccttgatatttcggcttgtgctaacgaatcgtgcctttatcaagtttcttatggtga

SEQ ID NO: 1459 - DNA, 585 bp, Artificial
  Synthetic
gttaagccacgtcataaggactatgcatcactcactctctctcgactcgaacgtgactcggcccgagtttcctcactgaccatgaagctcaccctctcactctccaactttacccattcggatctcaagccggttcaaaccattttgcaaccctgattacctccaaactcctattacttcaggagctagtcaggggagcggcgagtatttcactcggctcgggttgggccaaccgcctaaagaattctacatggttttagacactggtagtgacatcacgtggcttcaatgtgagccgtgttcggattgttatcagcagtcggatccagttttcaacccgtcgggttcttccacttacagtcgggtctcttgtgatgatgctcactgctcggctcttgacgtctccgcttgtggtactaacgcgtgtctctaccaggtctcgtacggtgacggctcgttcactgtaggagagtttgctactgaaacggtgtcgtttggaaactctggttcgttctctaaagttgctataggctgtggccatgataatgaaggactcttcgtcggcgctgctggtttgattgctct

SEQ ID NO: 1460 - DNA, 280 bp, Artificial
  Synthetic
ggacaagaagaagcgcaagatgaagaagagcgtggagacgtacaagatgtacatctacaaggtgctcaagcaggtgcacccggagacgggcatctcgtccaaggccatgggcatcatgaacagcttcatcaacgacatcttcgagaagctggcgcaggaggcgtccaggtaggcccgctacaacaagaagcccaccatcacgtcgcgggagatccagacggccgtccgcctcatcctccccggggagctcgacaagcacgccgtgtccgagggcaccaag

SEQ ID NO: 1461 - DNA, 638 bp, Artificial
  Synthetic
ccctcgaccacgcgtccgctttttcgctctaaaaagctccttgtattttctccatcttactaacaatggcaccaaaagctgagaaaaagcccgccgagaagaaaccagcagcagaaaaaatccccgccgcagagaaagctccgaagccaaaggccggcaaaaaactacctaaggacggcggagctgccgctgccggagacaaaaagaagaagagagccaaaaaatcggttgaaacttacaagatctacatcttcaaggtgctgaaacaagtacatcctgatataggtatctcaagtaaagctatgggtataatgaacagtttcatcaacgatatcttcgagaagcttgctcaagaatcttccagacttgccaggtacaacaagaagccaaccattacttctcgggaaattcagactgctgtgagacttgtacttcctggtgaattggctaagcacgccgtttctgaaggcactaaggctgttacgaaattcactagctcttgaatgttgttagggtttgcgttctcttttcatgtcttaatcaagggttttatggatgtaaaaatagtttaattagtttgttttaagtaaatcttttgtattcgactgccagttatgaatggaattgccaagttttct

SEQ ID NO: 1462 - DNA, 634 bp, Artificial
  Synthetic
cccacgcgtccgcagcaaaaaaaactcactccctagaaaagtttgaaaatggcgaaggcagataagaaaccagcggagaagaaaccggcagagaaaactccggcagccgaaccagcagcagcggcagagaagaaaccaaaagccggaaagaaactcccgaaggaaccagccggcgccggagacaagaagaagaagagatcaaagaagaacgttgagacatacaagatctacatcttcaaggtgttgaagcaagttcatccagatatcggaatctccagcaaagccatgggaatcatgaacagtttcatcaatgatatctttgagaaacttgctggtgagtcttcgaagcttgcgaggtacaacaagaagccgacgattacttctagggagattcagactgcggtgagacttgtgttgcctggagagttggcgaaacatgctgtttctgaagggactaaggcggttacgaagtttacgagttcttagatttggaatgtggttttgtaatggaggagaagtagtagtagtagttggaatgtgaaatagggtttatgcttttgggtatctttgagggttatgtaatatgggaattagggttttaatttatggcacggctatgaaatctacttaattt

SEQ ID NO: 1463 - DNA, 644 bp, Artificial
  Synthetic
caaatctctaaattttactctttctctttaaaattttcaatggctcctaaggcagagaagaagcccaccgagaagaagccggctgaggagaaagctccggcggagaagaagccaaaggccgggaagaagcttccggcgaaggatggcgccagtggtgcagacaagaagaaaaagaaggctaaaaagagtgttgaaacctacaagatctatatctttaaggtgctcaagcaagttcatccagacattgggatctcgagcaaggctatggggattatgaacagttttatcaatgatatttttgagaaattggctcaggaatcttctagacttgctaggtataataagaagccgactattacttccagggaaattcagaccgcggtcagattggtgctgcccggtgaattggctaagcatgctgtttctgaaggaaccaaggctgtgactaagtttaccagttcttaatttttttagcttatgttgggtaattcgaaaaattagggttatttttgggaaattagagtaagggttatctggtgaaattccgaaagctagtttctttctttcttttgtgttctgattttctattgtaactaaactgttgttgctaagtgaatgaacaaatctacctctgggaaaaaaaa

SEQ ID NO: 1464 - DNA, 676 bp, Artificial
  Synthetic
cccacgcgtccgccaagagccgagaagaagcccgccgagaaaaaaaccgccgctgagaaaccggtggaagagaacaaggctgctgaaaaggctccggcggagaagaaacccaaggcggggaagaaattgccaccaaaggaagccggtgacaagaagaagaagcgatctaagaaaaacgtcgaaacctacaagatctacatcttcaaggttctgaagcaggttcatccagatatcggaatttcaagcaaagccatggggattatgaacagtttcatcaacgacatattcgagaagctagctcaggaatcttcgaaactcgctaggtacaacaagaagccgaccattacatctcgcgagatccagacggctgtgagactcgtcctccccggtgaactcgctaaacacgccgtctctgaaggtaccaaggcggttaccaagtttactagctcttgaagagacccggttagggtttttagggatttcaatttcggtttggtttttagtacttgtaggaaattagatgcattattcgcttaacttcgtattttgtggctttgtaactctaggaagtagagaagattgttccttccttttatgaatttcaatgttggattatatatttttaacgatttttttttccatttcaatttcatttacctaatcactatattgaaat

SEQ ID NO: 1465 - DNA, 473 bp, Artificial
  Synthetic
gcaccctgacaccggtatttccaaccgtgccatgtccatcctcaactcgttcgtcaacgatatcttcgagcgcgttgctaccgaggcttccaagctggctgcctacaacaagaagtccacaatctcttcccgagagatccagacatctgtccgattgatcctgccgggtgaattggccaagcacgccgtctctgagggcaccaaggccgtcaccaagtactcttcatccacgaaataaagggtcaagatggctggttctgatttcaaatctgaaaacttgggtttttgtttgcgtgactttagtgtctttactcgagacgatgggtgactgtgtttcgcctttgggatctcttaatgcgttacggatggtttgctttatgggggcaatgtcttcacggtcaatggggttcgcggttgtacaatagctatcgaggatatctcgaagcaatggtttctgcacattatgctattat

SEQ ID NO: 1466 - DNA, 716 bp, Artificial
  Synthetic
gccattacggccggggacacaaattcacattcaagtcctcacatttctcctactctctctcatatttcatttctctctctagtgtttccacaatggcaccaaaagccgagaagaaacccgccgagaagaagccagcagctgagaaggcaccagtagcagcagctgcagcggagaagaagccaaaggctgggaagaagcttcccaaggacggcgccggagcagctgcaggagacaagaagaagaagaggttaaagaagtctgttgaaactaacaagatctacatcttcaaggtgttgaaacaggttcatcctgatattggtatctctagtaaggctatggggatcatgaacagttttattaatgacattttcgagaagctggctcaggaatcttctagattggcccgttacaacaagaagcctactatcacttctcgggagattcagactgctgtgaggcttgtgcttcctggtgaattggctaagcatgctgtttctgagggtaccaaggctgttactaaatttactagctcttaatcaattttagagtttgtgttttgattagggtttgtagatgtaaagaattgtccaattagggttgcatttgacatttgtggcatgtaatggacatctatattatgaatgaagagttttctgttttctctgacaaaaaagaaacaagaaagaaaaaaaaaaaccatgtcggccgccttggcc

SEQ ID NO: 1467 - DNA, 650 bp, Artificial
  Synthetic
ttcaaaattactccaaaccttctcttaacctaaaatctccatttctctcctcaaatggcaccaaaagctgagaagaaacacgccgagaaaaagccggccgctgagaaaaccccggtcgccgagaaagcaccagcagagaagaagcccaaggccggaaagaagctcccaaaggacgctggtgctgccggagacaagaagaagaagagggcaaagaagtcagttgagacctacaagatttacatcttcaaggttctgaagcaggttcaccccgatatcggtatttcaagcaaagccatgggtatcatgaacagtttcatcaacgatatctttgagaagcttgctcaggaatcttctagactcgctcggtacaacaagaagccaactatcacttctcgggagattcagactgctgtgagacttgtacttcctggtgaattggctaagcatgctgtctctgaaggaactaaggctgttaccaaattcactagctcttgaacaattttatggtttcaatgtttaattttactgtctttagggtttgtgttaggtgtaaaaacagttgcttttaattaattagtgtctagtttcctttgatctgtaacgcttgttatgtaatcgatagctaaacatctatgaaattcataagcttt

SEQ ID NO: 1468 - DNA, 646 bp, Artificial
  Synthetic
aaaatctttaaatcttctttttctccattactaaacccggatttcggttgtaaaattcagtttcaatggcaccaaaatcagagaaaaagccagcggagaagaaaccagtagcagcggaggagaaaaaggccgaaaaagcaccagcagagaagaaaccaaaggcaggaaagaagcttccagaagcaggcgcatctggtgctgacaaaaagaagaagatattaaagaagagtgttgagacttacaagatctacattttcaaggtgctgaaacaagttcaccctgatattgggatttcaagtaaggcaatggggataatgaatagttttattaatgacatatttgagaaacttgctcaggaatcttctagattggctaggtataataagaagccgacaattacatctagggaaattcagactgcggttaggcttgttttgcctggtgagttggctaaacatgctgtttctgaaggtactaaggctgtcaccaagtttactagttcttagatttgggatttgggcgtctttagggaatgtaaaggttgggtactgttgtgggggttgaaaaatgttaggttgttaagtttttgcttgttcaatgatgtattgaatatgaatatgaatgaaccgttttgatgaaatttctg

SEQ ID NO: 1469 - DNA, 607 bp, Artificial
  Synthetic
tttctcatactcaagtatctaatccactttctgtgaaatctcacaacaatggcaccaaaggcagagaaaaagccagctgagaaaaaaccagtagcaacagaagagaaaaaggcagagaaagccccagcagagaagaaggccaaagccgggaagaagctcccaaaggaaggcggagcagcaggagctgacaagaagaaaaagaggggaaagaagagcgttgaaacctacaagatttacatcttcaaagtgctgaagcaagtgcaccctgatattggtatttctagtaaggcaatggggataatgaacagttttattaacgatatttttgagaaacttgctcaagaatcatctaaattggctaggtataataagaagcctactattacttcaagggaaattcagactgctgtgaggcttgtgttgcctggggagttagctaaacatgctgtttctgaagggactaaggctgttacaaagtttactagctcttaggttctcattttgggaattttggatgattgtaaagcttcttttaatgatgtgtctgatttgtgtttgtccttgtacgaatgaagtaatgcaaatgaatgaatggttttgtccaact

SEQ ID NO: 1470 - DNA, 698 bp, Artificial
  Synthetic
aaaaagcagcattcaaatttccttcacatttttctctttgtaaacacattttgtttcaatggcaccaaaggcagagaagaagccagcagaaaagaagccggtggaggagaagaaaaccaccgtcgccgagaaaactccggcggagaagaagccaaaggccgggaagaaactcccaaaggacggcggtgccgctgccggagataagaagaagaagaaggccaagaagagcgttgagacttacaagatctacattttcaaggtgctcaaacaggttcatcctgacattgggatttcaagcaaggccatgggtatcatgaacagtttcattaacgatatctttgagaagttggcccaggaatcttctagattggcccgttacaacaaaaagcccacaatcacttctcgggagatccagactgctgtgagacttgtacttcctggagaattggctaagcatgctgtttctgagggtactaaggctgttaccaagttcactagctcttgaaattcgtcctgatgggttgttgtgagagtagattatgagtttatggttatttttgccaaggattaaggttcagttaaatcgggtggtactttactgtattttcttttgtttttgcggggttcccatggatcttctcgatccagtttgtagttcatatttggaatacaatcctattaaagttatttcaatttcg

SEQ ID NO: 1471 - DNA, 680 bp, Artificial
  Synthetic
tctgcactatattccatggctccaaaggcagaaaagaaacccgccgagaagaatccggcaccggaaaaacctgaagttccggcggagaagaagcaaaaagccggtaaaaaactccctaaagacgtcggtcccatagccggtgaaaagaagaagaaaaaggtgaagaagagttcggagacgtacaagatctatatattcaaagtgctaaaacaagtgcatcctgatataggaatttcgagcaaagcgatgggaataatgaacagttttattaacgatatatttgagaaacttgctcaagaagcttctaaattagcgcgatacaataagaagcctacaattacgtctagggaaattcagacggcggttagattggtgttacctggtgaattagcgaagcatgctgtttctgaagggactaaagctgttaccaagtttactagctcttgaattttttaaggattgattaggttgtattgggaattgggaattgagaattggggttaggggtttcgttcaatagtattagtcggttaatttttgttggttgatttcatgtatgttggcgtttcgatgggataatgtaaagtacaatgctgttgcttagcaatgaaatctactttttatgtattcttattgattctgtttattattcatgaatgcgatattgattactgtttcca

SEQ ID NO: 1472 - DNA, 365 bp, Artificial
  Synthetic
atcatatctctaatttttactctttctcttcaaaattgacaatggctcctagggcagagaacagtcccagcgagtctaagccggctgacgagaaagctccgtcggagatgaagccataggccgggaataagcttccggcgaaggatggcgccagtggtgcagacgataggaatgagaacggtaaaaaaagtgttgaaacctacaggatctatatctttaacgtgctcaagcaagtgcatccagacgttggtatctctggcaatgctatggggattatggacagttatatcaatgatatttctgagaaattggctcatgaatcttctacacttgctaggtataataagaatccgaatattacttcc

SEQ ID NO: 1473 - DNA, 691 bp, Artificial
  Synthetic
ccccccgaactccacgcgaagggaaaagggcttcctcctcctcacgaatcccgcctctctctctctctctctctctctctctctctctctctctccatttgagccgatccctcgagaggcagctccgatggcgcccaaggcagagaagaagccggcggagaagaagcccgcagccggcgaggagaagtcggcggagaaggcgccggcggggaagaagcccaaggcggagaagcggctgccggcgtcgaaggcgtcgtccaaggagggcggcgccggcgacaagaaggggaggaagaaggcgaagaagagcgtcgagacctacaagatctacatcttcaaggtcctgaagcaggtgcacccggacatcggaatctcctccaaggccatgtcgatcatgaactccttcatcaacgacatcttcgagaagctcgcgcaggaggccgcccgcctcgcccgctacaacaagaagcccaccatcacctcccgcgagatccagacctccgtccgcctcgtcctccccggcgagctcgccaagcacgccgtctccgagggcaccaaggccgtcaccaagttcaccagctcttaggcgctctagtgtagtaggtgtttggtgattttctcttcgtcttcgtcgtagcgagtccatggcagcggtggtagttgccctgtcgatctctgatttctttctctt

SEQ ID NO: 1474 - DNA, 642 bp, Artificial
  Synthetic
atttctcctactctctctcatatttcatttctctctctagtgtttccacaatggcaccaaaagccgagaagaaacccgccgagaagaagccagcagctgagaaggcaccagttgcagcaggtgcagcggagaagaagccaaaggctgggaagaagcttcccaaggacggtgccggagcagctgcaggagacaagaagaagaagaggttaaagaagtctgttgaaacttacaagatctacatcttcaaggtgttgaaacaggttcatcctgatattggtatctctagtaaggctatggggatcatgaacagttttattaatgacattttcgagaagctggctcaggaatcttctagattggcccgttacaacaagaagcctactatcacttctcgggagattcagactgctgtgaggcttgtgcttcctggtgaattggctaagcatgctgtttctgagggtaccaaggctgttactaaatttactagctcttaatcaattttagagtttgtgttttgattagggtttgtagatgtaaagaattgtccaattagggttgcatttgacatttgtggcatgtaatggacatctatattatgaatgaagagttttctgttttctttgttaaatttgcttggttatg

SEQ ID NO: 1475 - DNA, 594 bp, Artificial
  Synthetic
gaattcagcagagaagaaaccagcagagaaggggccagcagagaagaagcccgccgaagagaagaaggcagaaaaaacaccagcagcgaagaaacccagagctgagaagaaattaccaagcaaagatgcttcaacagcagacaagaagaagaagaaatcaaagaaatcagttgagacttacaagatctacatcttcaaggttttgaaacaagttcatcctgatatcgggatctctagcaaagctatgggtatcatgaacagtttcattaatgatatctttgagaaacttgctgctgaatcgtctagattggcaaggtacaataagaagcctactatcacttcacgagagattcagactgctgttcgtcttgttcttcccggtgaattggccaagcatgctgtttctgagggtaccaaagctgttactaaatttaccagttcttagggtttctttgtggaactgaaatttcagaaatttgtgttttggtttgttgcttttggggatttgggtgttttcagatatgtgtaatatagatgctttgaaatctatccagtttccgattgaaaaaccaattgaatgctattttgaaattg

SEQ ID NO: 1476 - DNA, 546 bp, Artificial
  Synthetic
cccccccgaactccacgcgaagggaaaagggcttcctcctcctcacgaatcccgcctctctctctctctctctctctctctctctctctctctctccatttgagccgatccctcgagaggcagctccgatggcgcccaaggcagagaagaagccggcggagaagaagcccgcagccggcgaggagaagtcggcggagaaggcgccggcggggaagaagcccaaggcggagaagcggctgccggcgtcgaaggcgtcgtccaaggagggcggcgccggcgacaagaaggggaggaagaaggcgaagaagagcgtcgagacctacaagatctacatcttcaaggtgctcaagcaggtccaccccgacatcggcatctcctccaaggccatgtccatcatgaactccttcatcaacgacatcttcgagaagctcgcgcaggaggccgcccgcctcgcccgctacaacaagaagcccaccatcacctcccgcgagatccagacctccgtccgcctcgtcctccccggcgagctcgccaagcacgccgtct

SEQ ID NO: 1477 - DNA, 548 bp, Artificial
  Synthetic
gtgtcatctctatttttctgcatccgacggaattgtcctcgattagctgtagtagctatggcgcccaaagctcccgcagcggctgagcccgagaaggcggccccgtcgaaggccgagaagaagcccgccgagaagaagcccaagatcgagaagaagccaaagcctgcagggaagaagcccaaggattccacccctaaagacaaggacccgtcaaagaagaagcataagaagaagaagagcactgagacctacaagatctacatcttcaaggtcctgaagcaggtccatcctgacactggcatctcctccaaggccatgggcatcatgaactctttcatcaatgacatctttgagaagattgcgcaggagtctgcgcgccttgcccgttacaacaagaagcctacaattacatcccgggaaattcaaacagcagtgaggttaatcctgcctggagaattggccaaacatgctgtctctgagggcaccaaggctgtcaccaaattcactagtgcctagggtacccccctgccttctgcttacatgcgatg

SEQ ID NO: 1478 - DNA, 584 bp, Artificial
  Synthetic
cctcctcatccccctcgcgattacctctcctctcctctcctcccccattcatcgtccccctccgccgccgccgctgcaggcccgccgctccgctgctggtcctgctgctgccatgatgggggcaaagcttttgctcttactggtggcctcatctctatgtctatctgctgcgatcgctacgcagcaaacctgtccggccgacctcgatagcaagtgtggtgatgctgcttcaggggattgggaaggggagttcttccctggcatccccaagatcaagtatgagggtccaagcagcaagaacccgcttgcttacaagtggtacaatgctgaggaagtgattcttgggaagaagatgaaggattggatgcggttcagcgtggccttttggcatacgttccgtggtactggaggagatccttttggtgcccctacaaagtcttggccttgggaggatggcacaaattcgttggacatggctaacagaagaatgagagctcactttgagttcatggagaagcttggagttgacaggtggtgcttccatgacagggatattgcccctgatggcaaaacactcacggaaa

SEQ ID NO: 1479 - DNA, 1144 bp, Artificial
  Synthetic
  misc_feature (1083)..(1083): The residue at this position can be any nucleotide.
aaacctttaccccatctctaaatctatatttgtttgacaaagatgatagaaaggaatcttggaaaatgtttgttgctccttctttgtttaaacgttgtctcaaatatagtggctgctggggctccaccaacttgtcctgctgatattggtagtgattgtggaagtgattcaggtgaatgggaaggggagttcttccctggaattccaaaaattaagtatgagggtccatctagtaagaatccactttccttcaaatggtacaatgctgaagaggaaattcttggcaaaaagatgaaggattggatgcgatttaccgttgcgttctggcatacgttccgtggcacaggagctgatccatttggtgctcctacaaagttgtggccgtgggaagatggtaccaattccctggctatggccaagacaagattgagagcaaactttgagttcctggagaaacttggagtagatagatggtgtttccatgatcgggacattgctccggagggcaaaacccttgaggaaacaaatgcaaacttggacgaagtggtggctcttgccaaagagcttcagggaaataaaattcatcttttgtggggtaccgctcagttgttcctccaacctcggtacatgcatggtgctgccactagccctgaattaggtgtatatgcatatgctgccgctcaggtcaagaaagctctggaggttacacattatcttgggggagaaaattatgtgttttggggtggtcgagaaggttaccaaagcctcctaaacacagatatggaaagagagcttgaccatatggcaagattcatggaagttgctgtcgcttacaaaaagaagattggcttcaatggaacattacttattgaaccaaagcctcaggagccaacaaaacaccagtatgattgggatgctgcaacatctgctaatttcttgcgcaaatatggacttataggagagttcaaattaaacatcgagtgcaaccatgctactttggctggtcacagctgtcatcatgagcttgaaacagcaagaattaatggtttgcttggaaacattgatgcaaatactggcgatccncaagtcggttgggacacagatcagtttttgatggatgttgctgaagcaacactggtgatgc

SEQ ID NO: 1480 - DNA, 664 bp, Artificial
  Synthetic
agtgttgttcttggagaagaatggccgcggcggcagcagcagcagcagcagcgacgagcttcgtccaggcgccatccagcgccaggcaatgcggcggatctccagcgacctccaccaggccggcgttccagagcttcgtcggcatgaaatccggcggagagtgccgccaggccgcattcttccggggcgatctgacgctgcgggatggcaagccccttgctagagctgcgaggaacggcgatgttcgtccgcgggctgcggcgagctacaaggcggctatgcttggagctgccggggggattgggcagccgctgtcgctgctgctcaagatgtcgccgctgctctcgcacctaaatctctacgatattgccaacgtcaagggtgtggctgccgatctgagtcactgtaacaccccatcactggtgacaccttataccggagctgaggagcttgccgagtcacttaaaggcgtcgatcttattatcattcctgctggagttcctcggaagccaggaatgacaagggatgatcttttcaacatcaatgccggtatcgtcaagacacttgtcgaggcagcagcggattatgcaccaaaagcatggattaacatcatcagcaatcccgtcaactccaccgtgccaattgcggccgaggtcctcaagaa

SEQ ID NO: 1481 - DNA, 250 bp, Artificial
  Synthetic
tccatttcaattcattaactattccgaatgactttatccatgttgagatctgtcgtccggaggaccacaacttcaggcgcgtctcgcctcacgcgccgccaattctcatcgagggccgcaccggagaggaaagtcgcaattttgggagcagcgggaggaatcggacagcctctttcacttctgatgaagttgaatcctttggtatcaacgctttcactctacgatattgccggcactcctggtgttgccg

SEQ ID NO: 1482 - DNA, 594 bp, Artificial
  Synthetic
cactaacaaatcaaaatggttaaagctgtcgttgccggagccgctggtggtattggccagcccctttctcttctcctcaaactctctccttacgtgaccgagcttgctctctacgatgtcgtcaactcccccggtgttgccgctgacctctcccacatctccaccaaggctaaggtcactggctaccttcccaaggatgacggtctcaagaacgctctgaccggcgccaacattgtcgttatccccgccggtatcccccgaaagcccggtatgacccgagacgatctgttcaagatcaacgctggtatcgtccgagatctcgtcaccggtgtcgcccagtacgcccctgatgcctttgtgctcatcatctccaaccccgtcaactctaccgtccctattgctgccgaggtcctcaagaagcacaacgtcttcaaccctaagaagctcttcggtgtcaccacccttgacgttgtccgagcccagaccttcaccgccgctgttgttggcgagtctgaccccaccaagctcaacatccccgtcgttggtggccactccggagacaccattgtccctctcctgtctctgaccaagcct

SEQ ID NO: 1483 - DNA, 594 bp, Artificial
  Synthetic
tgatccaccgtcacgtgctcttcctgaaaataatgagcctatattgccattgccgaaacaaacacctcaaaagtacaatggagctggttcacacagcaatcaccactacaggggccgtggaagaggtagaggcagcgcgttttcgcagtcagtaacaaattttactgaagaatttgatttcatggccatgaatgagaagtttaacaaagatgaagtctggggtcatcttggtaagaaatcccattcaagggacaaagatggtgagctgggcgatgatgtgtttgatgaagacctggaggatgaggaaacagaaaatcctgagctagctgctaagcctgtttatgtcaaggatgacttttttgattccctcactagtggaacatttggacgtggagggcaaaacgggaggtcaagattttccgaacagcgcaaactagatacagagacttttggtgatttcccaaggcatcgccagccctatcgtggtggggggcgtggttaccgtggcggcggtcgcgcccgtgggtcatactacggtggcagagggtatggaagcatgggagcaaggggtgggcagggtaattcttaccctca

SEQ ID NO: 1484 - DNA, 681 bp, Artificial
  Synthetic
ccaattgatgttccatcaactcaatctacacagacagctcaaaaagatgttgaagtggtacaagtattgcctgcaccatcttcagaaactccagctccggttaaaacagaagctcagccaccaatattaccattaccacctcagacacgtgtgcagaagacaaatggagctccatatcaggcacgttacaacaactacagagggcgcggtggaagaggaatgggggtttcaagaccggtaacaaaattcgaagaggattttgattttatggccatgaatgagaagttcaagaaagacgaagtgtggggtcatcttggcaaaagtaacagagaaggagatggaaatggcagcgacgaagatgtctctttcaatgaatatgatgatgttcttcctaagattgatgtcaaggtggttatttaaattctctttgacctcaattcttatgcatacccttgtccacgtatcttggacctagctttgtatttatgtcagtgttgtcaaaagcgcgcataaagcgcactcaagccccgattcgaggtccaaaacatgttgagcgctttgcttcgctttgtgtgcgctgtagtgtcacatcaaagctctaaagcatacttttcctcgtcaatgagtgtaatcctgaaaaggctacattaaacaattaatatttcactctcgtaaattttt

SEQ ID NO: 1485 - DNA, 568 bp, Artificial
  Synthetic
gaattctcgagttttttttcatttccattgtggagattttcttagggttttagaaacaatcaagattattggagaaagatgcagagatttgcaagaagtagagcccctaaacaagctattaattggctatgttcatcactcaaccaatcgagatctttccaaacaccatcatttgctaccgtagatgctgaagggatctcaggctcccaacctgctgaagtaagcaatttggtccagggtagctggacaaagacatctaattggagtacagtattggatccgctaaatggagaaccattcattaaagtttcagatgtagatgaaactgggctgcagccatttgtggagagcttatccaagtgtgcgaaacatggccttcacaatccatttaaatctccagaaagatatcttatgtttggagacatatcaacaaaagtggctcacatgctttcacaacctgatgtttcgaatttcttcataaggttgatacaacgggtttctccaaagagctatcaccaagcccatggcgggggtttcgtaacccagaaattctttgagaacttttgtg

SEQ ID NO: 1486 - DNA, 587 bp, Artificial
  Synthetic
gaagcttagggcgatcgatcaatcagcaatcgagcatggcagggagaatgcggcggcttctttctcgcgaatttgcaatccatgcgagagcattctctgctcgatcgtctgtgccggctatggatgcatcgtctccggagctggcggcgcttgcatttgcgacggtcgaccccgatgatctctccaaggctcatccttatcaagtccaaaaccttgtgcgtgggaaatggagcaagagcgtgagatccagcatgttgccggaccctctcaatgggggagaatttatcacagtgccagagacaacaggagacgagttgccggactatatccaaagcttgcggtcgtgtccaaagtctgggctccacaaccctttgaaggatcccgagagatatctcttgtatggcgatatatcagccaaggcagcgtctatgttgaggcagcgagaggttgcacatttcttcaccaggttgattcacagagtttctccgaagagctaccaacaagctcagacggaagtgaccgtgacacaaaagtttttcgagaatttctccagtgaccaggtccgctttctcgcgaagtcatttgct

SEQ ID NO: 1487 - DNA, 1199 bp, Artificial
  Synthetic
ccttctccctcttctctctgtcacgtgctcggtctcggtcctttgagcttctctctctgtctctctccgattctcgctccctgctccgatgcctcgacgacctttccctttccttatctctatctctatctctctccttatccttttcgccgtcgccgcgagaccttttgctgctacgacgatctctattgtcgtcctcggcggcgtattcctcgctcccgtctctctcccttcggcgataggctttctcgctcttctccttctcggcgctgctgttgttgttgtctttgctctttgtagaaggaccaccgttgggctcttctacagtcttctccagataatcgtactcatcgaagtccatttgaggtgactttctctgccggacggccgaaggttcgttgttccgcctgtgaagaagtgctggttaggttttgacagaaaccttagatcaaaaaatcagtgtattcctctcagaaaaaaactaagcagcaaaaacatttcaagaaaatagcctaagccatggccaacatgatcatggcttcctccaaagccctaatcacttcttccattccttcatcaccaagaaccaaactttccctgccgcaaatcccaattccaaaactacccatccccaaattacccaaatccccactaaccctttccctcccatcaaatctcaagtccatttcagtcattcttgctagctcattagcctttgcacctccttcacttgctgaagaaattgaaaaagcttcactctttgacttcaatttaactctccctatcataatggctgagttccttttcctcatgtttgctttagacaaactttacttttccccattagggaaattcatggatgaaagagattctgccattaaagagaaattaaacagtgtgaaggacacttcagctgaagtgaagcaattggaagatcaagcagcagcaataatgaaagctgcaagagctgaggtatccgctgcattgaacaaaatgaagaaagagactcagttggaagtggaacagaagattgctgaaggaaggaagaaagttgaagttgagttgcaagacgctttagctagtttggacaagcaaaaggaggagactattaagtctcttgattctcagattgctgctcttagtgatgaaattgtcaagaaggttcttcctgttagtaactaatgtatttcttgaaattt

SEQ ID NO: 1488 - DNA, 421 bp, Artificial
  Synthetic
ccccccgttcacttcaagctctgcaagagggacaacactaagcagttccacaactcgaatatcaagttcccgctcgtgtaccgcaaggtcaggccgcccaccaggaagctgaagaccaccttcaaggcatctaggccgaacttgttcatgtgatctaccagtgtgtacccatgttctgcaatttagcccaagaatcaaaagattttgtctgtggaagttttggtgccctgctggttaggcatttccagtttcatatccaaatgatgcttaggcatttccagttacccttccaaatgatgctttgcaaacccttgaatttcctcgtattagtaatcagcagacttcttgttacttcaacctggctcacttggaagtgttgatccctgatgtgctattatttatctctgtaatttgtgatggc

SEQ ID NO: 1489 - DNA, 793 bp, Artificial
  Synthetic
  misc_feature (736)..(736): The residue at this position can be any nucleotide.
agatccatacacaaatactcgataaaactctccttgtatctgaatctaatcaacttctcagatccaaactccgatcggaacaatgtcctcgactttcagcggcgatgaaactgctcctttcttcggcttcctcggcgccgctgcggctctcgtcttctcctgcatgggagcagcgtacggaacagcaaagagcggtgtaggagtggcgtctatgggagtgatgagaccagagctggtgatgaaatccattgttccggtggttatggctggtgtgttgggtatttatggtctgattattgctgttattattagtactggtattaatcccaaaacaaagtcgtattacctgtttgatggatatgctcatctctcctctggtctcgcttgtggtcttgctggactttctgctggaatggctattggtattgttggtgatgccggtgttagggctaatgctcaacagccaaagctttttgttgggatgatcctcattctcatttttgctgaagctttggctctttatgggcttattgttggaattatattgtcttcacgagctgggcagtccagagcagagtgaagttggcttattaatactattcttactatgatgtatgtgagactcagtaaaccctggcaaaacttgatccttgctaaagtcaaaaagttatctatgtctatgtttgttattcatgttggcacggttgctactggtgctgctatgtgctgtttgtanaaaaataggagtgagtatttattttaataataacttaagaagttttcgtatttgacc

SEQ ID NO: 1490 - DNA, 859 bp, Artificial
  Synthetic
agcaatccaatacattagagtgaagggatgaacataatatattgtaatgattttattttgctacaatgccgtgttttttattcaccacgaatgagattaaatccgtttgctcaggagcagcaaatccagcctaacccaaaaaactttgcatgaaccaccacaaaagaaacaaaaaggactggaagtgccaccttccttaagctacaaatcgatcttttaatacattaaactagagctcccaagtaagtttcaggttttctcaagaatatagccagtggaataacagcggtatggtaccgcaaagtgcctaatctgcacgagattggccggcacgggatgagaggatgatgcccacaatgagaccatacagggcaagcgcttctgcgaaaatgaggatgaggatcatgcccacgaaaagctttggttgctgtgcatttgccctgacaccagcatcaccgacgatgccgatggccattccggcagcgagaccggcgaggccacaggcgagcccggacgacagatgcgcgtagccgtcaaagaggtagtacggcttagccttggggttgatccctgtactgatgatgacggcgatgatgaggccgtagataccgagcacaccagccatgaccacgggcacgatggacttcatcacgagctccgggcgcatcacgcccatggacgccacgccgacgccgctcttcgccgtcccgtacgccgcacccatgcatgagaagatgagggcggaggcggcgccgaggaagccgaagaagggcgccgtctcatcgccgctgaacaccgacgacatctttgctcctcttccttctccggcgagatcggttgatcgatcgatcgatctctt

SEQ ID NO: 1491 - DNA, 479 bp, Artificial
  Synthetic
cccacgcgtccgccaagggcaagccctacttcctcttcgacggttacgcccacctctcctccggtctcgcctgcggcctcgccggtctcgccgccggcatggccatcggcatcgtcggcgacgccggagtcagggccaatgcgcagcagccaaagttgttcgtgggcatgatcctcatccttatctttgcagaagctcttgctctgtatggcctgattgttggtatcatcctctcgtctcgtgcgggccaatctcgagcggattagagggttttggaagaacaagacacggttcaccattgtattctattccaagtgttaatttcttcttatagactgcttggtcttgtctgtgtttatactcattgtctgtattcaagctattgtgggttgttgtatttattatttgaatttttgaagtaataatcggtaccaggccgtccgagatgtgattaataatgaatgaataaataaataagc

SEQ ID NO: 1492 - DNA, 714 bp, Artificial
  Synthetic
agcgaaaggctacaataatctctctctctctttctctctctctctagaagattttgagaagtatctcagatccaaatcaataacacacttctgagatccaatcagaaacaatgtcttcgactttcagcggcgatgaaactgctcccttcttcggctttctcggcgctgctgcggccttggtcttctcctgtatgggagcagcttatggtacagcaaagagtggcgtaggggtggcatcaatgggtgtgatgaggccggagttggtgatgaagtcaattgtgccggttgttatggctggtgttttgggtatttatggattgattatagctgtgattattagtacagggattaacccgaaaaccaagtcttactatctttttgatggatatgctcacctttcttctggtcttgcttgtggtcttgctggcctttctgctggtatggccattggaatcgttggtgacgctggtgtgagagccaatgcacaacagccaaagctttttgtcgggatgattttgattcttatttttgctgaagccctggctttgtatggccttattgttggaatcatcctctcttctcgtgctggtcagtctagggcagagtagaagaagagaatgttgtgcaccattactgtgaattatctttgtgtttttcatgggtgagtctggctgctgaattacattttcctttttctgtgggctccaagattct

SEQ ID NO: 1493 - DNA, 322 bp, Artificial
  Synthetic
cccacgcgtccgcagatacaaaactccgacatgtctacgttcagcggcgatgaaacagctcccttcttcggcttcctcggcgctgcagccgcactcgttttctcctgtatgggagctgcttatggaaccgcaaagagtggtgttggtgtggcttctatgggagttatgagacctgagttggtgatgaaatctattgtccctgttgttatggctggagtgttgggtatctatggattgatcattgctgttatcatcagtaccgggattaaccccaaggctaagtcttactacctctttgatggatacgcacatctctcgtctg

SEQ ID NO: 1494 - DNA, 590 bp, Artificial
  Synthetic
atttgtgtggatcgatctgatcgaaggacaacaatggccgactcagacttcaatggcgacaccactgcccccttcttcggcttcttgggagccgcctttgccctcatcttctcttgtatgggtgcggcatatggaacagcaaagagtggagttggggttgcttcaatgggtgttatgaggcctgagcttgtgatgaagtccatagttccagtggttatggctggtgtcttgggtatttatggtttgatcatagctgtcattatcagcacaggaatcaaccccaaaagcaaggcatattacttgtttgatggatacgcccatctctcgtcaggcctagcttgtgggctttctggtctttcagctggaatggcaatcgggattgttggtgatgccggtgtcagggcaaatgcacagcagccaaagctttttgttggcatgattctgattcttatttttgcggaggctcttgctttgtacggcttgatcgtcggcattattctctcttctcgtgcaggtcaatcaagggaatgattcttccatgccctttgattctacccattccaactatccaaattatattgtcctatggt

SEQ ID NO: 1495 - DNA, 213 bp, Artificial
  Synthetic
tcggcataatccggaacatcatacggataagcggccgcccttttttctttttctttagtgaacaaaacactctcatgctcccattgcattacgaatcatttgcttatccaccaccatcacatcacctgtctagccagacccacaaaaaccgtgcataaataatattcagaccgccgccagcaccaccatagcgaaaaagaatggccccacaag

SEQ ID NO: 1496 - DNA, 437 bp, Artificial
  Synthetic
cccacgcgtccgatccatttactccacagagaaagattcagagaaaacagaagaaactatggcaactcaagccgccggaatcttcagccccgccataacaaccactacttccgccgtcaagaaactccacctcttctcatcaagccaccgtcccaagtctctctccttcaccaaaaccgccatccgcgccgagaaaacagagtcctcctctgctgccccagccgtgaaagaagctccagttggattcactcccccgcagctagacccaaacacaccatcaccaatcttcgccggaagcacaggaggtctcctccgtaaagcacaagtagaggaattttacgtgatcacatggaactcaccgaaagaacaaatctttgagatgccaacaggaggagctgcgataatgagagaaggaccgaatctattgaaactggcga

SEQ ID NO: 1497 - DNA, 718 bp, Artificial
  Synthetic
ggacttcgattttcagtggttgtttctcaggcccagcatttgatacatcaaagatgcaggccttggcaatgcaagcgtctccaatgagcctgcgctccacgagcagcgccggcagcagcaccagcagcttcttccaaggtcagtccaagatctccatggcggcggctcctgcgcgagtgagcatgatggcgacggcagataaggcagataaggcagataaggcagctaaggcagataaggcagataaagcagcacctgcacccgcgggatttaccccaccagagctcaaggccgataccccgtccccaatctttggtggcagcacgggcggactgctgcgcaaggcacagatcgaggagttctacgtcatcacctgggaatcacccaaggagcagatatttgagatgccaaccggaggtgctgcaatcatgcgctccggcccgaacttgctcaagctggctcgtaaggagcagtgcatggcgctgggcacgcagctgcgctccaagctcaagatcaactaccagttctatagggtgttccccaacggtgaggtgcaatacttgcatcccaaggacggagtctaccccgagaaggttaaccccgggcggaagggcgtgggtgtcactctcaggtccattggcaagaattgcaaccccgtcgatctcaagttcacaggcaaggctgcatatgatgtgtaacgcttttgcgcctttggtga

SEQ ID NO: 1498 - DNA, 532 bp, Artificial
  Synthetic
tcccacttttctaagccaataattcttcaatggccatggcaactcaagcttctctcttcactccagctctctctgccccaaaatcctcttccccatggaaacaatccctcgcttccttctctcctaagcaactcaaatccactgtttccacacaccgtcccattagggccatggccgaagaagcagccgccgccacaaaagaagcagaggctccagtgggcttcaccccaccacaattggacccaaacacaccttccccaatcttcggcgggagcaccggtgggcttctccgcaaggcccaagttgaggaattctacgtaatcacttgggaatcacctaaagaacagatctttgagatgccaactggtggtgcggctattatgagggaaggtgctaatttgctgaaattggcgaggaaagagcagtgtttggcacttggtactaggctgaggtcaaagtacaagattaactacaggttttacagggtgtttcctaatggtgaagttcaatacttgcatcctaaggatggtgt

SEQ ID NO: 1499 - DNA, 304 bp, Artificial
  Synthetic
ataacaaccgccgcaacctccggcgtcaagaaactccactttttctcaacaacccaccgtcccaaatccctctccttcaccaaaaccgcaatccgcgccgagaaaacagattcctccgccgccgctgctgcagcccccgccacgaaagaagctcccgtgggattcacgccaccgcagctagacccaaacacaccgtctccgatcttcgctggaagcaccggtggtcttctacgtaaagcgcaagtggaagagttctacgttatcacgtggaactcaccgaaagaacagatctttgagatgccga

SEQ ID NO: 1500 - DNA, 732 bp, Artificial
  Synthetic
gctctcagagcagtgtgctcgcgtgtgcccaccacgagcctgtagcgattccctcagcagcagcagcgatggccatgtctgcgcacgcctcccaggcggcagtcattgcagcaaccgccaaagcagtgccatcagcatcagcttaccccgcctctactgccacggtatcccttcgccaatcctcgatgcgcggcatgaagcttgttaccccttctctcttgtcgttgtcttcttcctctcctcgcatccgcatggcagcagctgatgctcctgctgcgccagcagaggaggcacctgctgggttcaccccccccgagctcaaagccgacaccccatcccccatcttcggcggtagcactgggggcctcctccgcaaggcgcaggtggaggagttctacgtcatcacctgggaatccccaaaggagcagatcttcgagatgcccacggggggcgctgccatcatgcggcagggcccgaacctcctgaagctggctcgcaaggagcagtgtctcgcactgggatccaggctgcggtccaagttcaagatccagtatcagttctaccgtgtgttcccgaatggggaggttcaatacctgcacccaaaggatggcgtgtacccggagaaggtgaatgctggcaggaagggcgtcggggtgaacttacggtcgatcggcaagaacaagaatccggtggaggtcaagttcactgggaattctgccttcaatctctgag

SEQ ID NO: 1501 - DNA, 671 bp, Artificial
  Synthetic
actcgaatcgaatccaccacacggtaccctcctctctcctcctccgaccaccatggccatggccacgcaagcctccgccgccaagtgccacctcctcgccgcggcggcgacggaggagaagaagccagcccccgcggggttcgtgccgccgcagctggaccccaacacgccgtccccgatcttcggcgggagcacggggggactcctccggaaggcgcaggtggaggagttctacgtcatcacatggacgtcgcccaaggagcaggtgttcgagatgcccacgggcggcgccgccatcatgcgcgagggccccaacctgctgaagctggccaggaaggagcagtgcctggccctgggcaccaggctccgctccaagtacaagatcaactaccagttctaccgcgtcttccccaatggcgaggtgcagtacctccaccccaaggacggcgtctacccggagaaggtcaacgccggcaggcagggcgtcggccagaacttccgcagcatcggcaagaacgtcagccccatcgaggtcaagttcaccggcaagaacgtcttcgacatctagacttcttcttcttcttcttcttctctcataatcgacctattaattacttgtgttttgggtggatggacatgtaattttaatcatctgtcaggctgctctccaa

SEQ ID NO: 1502 - DNA, 705 bp, Artificial
  Synthetic
accctagttcgaggtctctcagagcagtgtgctcgcgtgtgcccaccacgagcctgtagcgattccctcagcagcagcagcgatggccatgtctgcgcacgcctcccaggcggcagtcattgcagcaaccgccaaagcagtgccatcagcatcagcttaccccgcctctactgccacggtatcccttcgccaatcctcgatgcgcggcatgaagcttgttaccccttctctcttgtcgttgtcttcttcctctcctcgcatccgcatggcagcagctgatgctcctgctgcgccagcagaggaggcacctgctgggttcaccccccccgagctcaaagccgacaccccatcccccatcttcggcggtagcactgggggcctcctccgcaaggcgcaggtggaggagttctacgtcatcacctgggaatccccaaaggagcagatcttcgagatgcccacggggggcgctgccatcatgcggcagggcccgaacctcctgaagctggctcgcaaggagcagtgtctcgcactgggatccaggctgcggtccaagttcaagatccagtatcagttctaccgtgtgttcccgaatggggaggttcaatacctgcacccaaaggatggcgtgtacccggagaaggtgaatgctggcaggaagggcgtcggggtgaacttacggtcgatcggcaagaacaagaatccggt

SEQ ID NO: 1503 - DNA, 568 bp, Artificial
  Synthetic
aactattattactactactcttcatctctactgattgatagaggaacctcagctatggccatccaggcatcctcccagtcagtcatggcaagagcagtagccccgtccatggcctccaccctccccctctcgcccccctctgtgcgcttgtcggcgtggagtagctccgccgtccatggcatccagctccgcctcccccgccctgcttgccgtgtccgcatggcttctgaaatccctgccccggcacccaaagaagaggagaaagatgaggcgcccaaaggtttcaccccgcctactctcaacccggagacgccctcgccaatcttcgggggtagcacaggtggcctcctccgtaaggcccaagtcgaggaattctacgtgatcacgtgggagtccccgaaagagcagatatttgagatgcccaccggcggcgccgccatcatgagggagggacctaacctcctcaagctcgcgcgcaaggagcaatgccttgcacttggctcccgcctccgatccaagttcaaaatcacctaccaattctaccgcgtcttcccgaatggggaagtgc

SEQ ID NO: 1504 - DNA, 424 bp, Artificial
  Synthetic
cccacgcgtccgatccatttactccacagagaaagattcagagaaaacagaagaaactatggcaactcaagccgccggaatcttcagccccgccataacaaccactacttccgccgtcaagaaactccacctcttctcatcaagccaccgtcccaagtctctctccttcaccaaaaccgccatccgcgccgagaaaacagagtcctcctctgctgccccagccgtgaaagaagctccagttggattcactcccccgcagctagacccaaacacaccatcaccaatcttcgccggaagcacaggaggtctcctccgtaaagcacaagtagaggaattttacgtgatcacatggaactcaccgaaagaacaaatctttgagatgccaacaggaggagctgcgataatgagagaaggaccgaatcta

SEQ ID NO: 1505 - DNA, 475 bp, Artificial
  Synthetic
ggtatcaacgcagagtgccattacggccggggtaaagcgcaagtggaagagttctacgttatcacgtggaactcaccgaaagaacagatctttgagatgccgacaggaggagcagcgatcatgagagaaggtccgaatcttctgaagctagcgaggaaagagcagtgtttagctttggggacaaggcttagatccaagtacaagatcacttaccagttttacagagtgtttcctaacggtgaggttcaatatcttcatcctaaagatggtgtttatccagagaaggcgaatccaggaagagaaggtgttggtctcaacatgagatctattgggaaaaatgttagtcccattgaagttaagtttactggcaaacaaagttatgatttgtaagatctgtaaactaaaaaaaccaaaaactatgtgcatgtggtgatgattatgactatgtttcatgttaatttttaatggattttgt

SEQ ID NO: 1506 - DNA, 782 bp, Artificial
  Synthetic
attctgcacaaatacatctccatttcctccacttttgtaagccaataattctacaatggccatggcaactcaagcttctctcttcactccagctctctctgcctcaaaatcttcagccccatggaaacaatcccttgcttccttctctcctaagcaactcaaatccactgcttccactccccgtcccattagagccatggccgaagaagccgccgccgccgccacaacaaaagcagaggctccagtgggctttaccccaccacaattggacccaaacacaccttccccaatcttcggtggcagcaccggcgggcttctccgcaaggcccaagttgaggagttttacgtaattacttgggaatcacctaaagaacagatctttgagatgccaactggtggtgcagctattatgagggaaggtgctaatttgctgaaattggcgaggaaagagcagtgtttagcacttggtactaggcttaggtcaaagtacaagattaactacaggttttacagggtgtttcctaatggtgaggttcaatacctgcaccctaaggatggtgtgtacccagaaaaggtgaacgctggccgtgaaggagttggacagaacttcagatccattggtaggaacaagagcccaattgaggtcaagttcactggcaaacaagtgtatgatttgtaagctcattatgttgtgcctttttatgtaatgattttgtgattattcaggccatcgtttcatgtaattttatttgccactacaaaatacagcacgggattctatc

SEQ ID NO: 1507 - DNA, 887 bp, Artificial
  Synthetic
ccccccgatctctctcctccacaccacaccactcgaatcgaatccaccacacggtaccctcctctctcctcctccgaccaccatggccatggccacgcaagcctccgccgccaagtgccacctcctcgccgcctgggcaccggcgaagccgcgctcatccaccctctccatgcccacctcgagggcacccacctccctcagagcggcggcggaggatcagcccgccgcggcggcgacggaggagaagaagccagcccccgcggggttcgtgccgccgcagctggaccccaacacgccgtccccgatcttcggcgggagcacggggggactcctccggaaggcgcaggtggaggagttctacgtcatcacatggacgtcgcccaaggagcaggtgttcgagatgcccacgggcggcgccgccatcatgcgcgagggccccaacctgctgaagctggccaggaaggagcagtgcctggccctgggcaccaggctccgctccaagtacaagatcaactaccagttctaccgcgtcttccccaatggcgaggtgcagtacctccaccccaaggacggcgtctacccggagaaggtcaacgccggcaggcagggcgtcggccagaacttccgcagcatcggcaagaacgtcagccccatcgaggtcaagttcaccggcaagaacgtcttcgacatctagacttcttcttcttcttcttcttctctcataatcgacctattaattacttgtgttttgggtggatggacatgtaattttaatcatctgtcaggctgctcttcagttattgatgatggtgtaatcgatcgatggtgggatataatctcttcttataatattgtagtatatgtttggtgaattttgatgcgtgttc

SEQ ID NO: 1508 - DNA, 150 bp, Artificial
  Synthetic
tggaggatcagcccgccgcgggggcgacggaggaaaaaaacccaccccccgcggggttcgtgccgccgcaattggaccccaacacgccgtccccgatttttggtggaagcacggggggacttttccggaaggcgcaggtggaggagtttt

SEQ ID NO: 1509 - DNA, 652 bp, Artificial
  Synthetic
tttttttttttggggggaaattatacagtaatccacatgtttaatggtacctttggaacaggaaaatacaaattaagttcaaacaataatttcattacataaccacacaacctactgcagctcgaggaaatcaactaccccttgaatattccatggctatggcaactcaagcagctctttttaccccaactctttccacctcaaaatcaagcaatttagcatggaaacaatcctcaactgtgtcattcgccagccctaaaccattcaactttgctgcaccacaacgttccattaaggcctcagctgctgaaggaaagacagaagctccagcgaaagaagccccagcaggtttcaccccaccagaattggacccaaacacaccatctccaatattcggaggtagtactggtggattgttgcgtaaagctcaagtagaggagttttacgtgatcacttgggattctcctaaagaacaagtatttgaaatgccaactggaggtgcagctatcatgagacaaggacctaacttgcttaagttggcaaggaaagaacagtgtttagctcttggaaccagattgaggtccaagtacaagatcaagtaccagttttacagggttttcccaaatggtgaagttcaatatcttcatcctaa

SEQ ID NO: 1510 - DNA, 745 bp, Artificial
  Synthetic
cggaatcgaatccaccacacggtaccctcctctctcctcctccgaccaccatggccatggccacgcaagcctccgccgccaagtgccacctcctcgccgcctgggcaccggcgaagccgcgctcatccaccctctccatgcccacctcgagggcacccacctccctcagagcggcggcggaggatcagcccgccgcggcggcgacggaggagaagaagccagcccccgcggggttcgtgccgccgcagctggaccccaacacgccgtccccgatcttcggcgggagcacggggggactcctccggaaggcgcaggtggaggagttctacgtcatcacatggacgtcgcccaaggagcaggtgttcgagatgcccacgggcggcgccgccatcatgcgcgagggccccaacctgctgaagctggccaggaaggagcagtgcctggccctgggcaccaggctccgctccaagtacaagatcaactaccagttctaccgcgtcttccccaatggcgaggtgcagtacctccaccccaaggacggcgtctacccggagaaggtcaacgccggcaggcagggcgtcggccagaacttccgcagcatcggcaagaacgtcagccccatcgaggtcaagttcaccggcaagaacgtcttcgacatctagacttcttcttcttcttcttctctcataatcgacctattaattacttgtgttttgggtggatggacatgtaattttaatcatct

SEQ ID NO: 1511 - DNA, 643 bp, Artificial
  Synthetic
aaattttgctctcgagcttttacatttccacatctaaaaatggctgcaaatggcatcaattccttcttccgcgtcaaaaagctctcagataatgctgttttgccctccagaggctcctctctttctgctggctatgatctgtccagtgcaacgaagactaaagtgcctgctaggggaaaggctttagtgcccacagatcttagtattgccgttcctgaaggaacctatgcccgtatagctccaagatcaggattgacatggaagcattcaatagatgttggggcaggtgtgattgatgcagactataggggtccagttggggttattcttttcaaccattctgatgttgattttgaagtgaaaattggtgacagaatagctcaattgatcatagagaaaatcatagtgccggatgtcgaggaggttgatgatctggactcgacagttaggggctctggaggctttggatcaacaggagtttgaaatctatggcttgaattagaacttttgatgcgtaaatttttgttgcttagtacgtttagtcatgataatttggtcacgtttttagagattggaacattttggaaactgcaagatgaagtaagtttttatgcttcggcaatgttgagcactgtgtttttat

SEQ ID NO: 1512 - DNA, 448 bp, Artificial
  Synthetic
cccacggcggcgacgcggcggcggccgacgatgacgggagcaacgacgccgaggccgcgtcgtggctcctccccgagcccgaccacgggcagaaagatggcgccgtcggtgcaaccgacgagctctacgccgactccgacccttacctcgacctcgacttcgcgcgctccatggacgacatcaaggccatcggcgtccagaacggtccgcccgagctcgacatcaccggcggcaagctcttctactccgaccactccatgaaccacagcgtatcatcctcggaggcggcggtggtgccggacgcggcggcgggcggcggcgctccgatgccggtggtgagcagggggcgggagcgggaggcgcggctgatgcggtacagggagaagcgcaagagtcggcggttcgagaagaccatccggtacgcgtcccgcaaggcgtacgcggagac

SEQ ID NO: 1513 - DNA, 388 bp, Artificial
  Synthetic
cgacttcacgaggccgaagcctcaaccctacatgccgtacacggcgactcctcctccgagccacagcgtagtaagcgcgcagatgtcgtcgtcggtggtcgacgtgggcgtggtgccggagcgggcggcggcgatgggggaagggagggaggcgacgctgatgaggtacagggagaagcggaagaaccggcggttctagaagacgatccggtacgcgtcgcgcaaggcctacgccgagacgcgcccccggatcaagggccgcttctccaagcgcgccgaccacgacgccgacgactccgacgccgacgccgacgaccccggcggcgtcccatcctcctacatgctcgacttcggctacggggtcgtcccgtccttctgatcgccgccc

SEQ ID NO: 1514 - DNA, 551 bp, Artificial
  Synthetic
atcagtgccccagccgccccagtggtttgtccgcgattcaagcttccatcgatcgatcgagagatgtctgatgacgagagcaaggaggagaaagagctggatttgtcgtcgcctgatgtggtgaccaagtataagctcgccgcggagattgccaacaaggctttgcaagctgtggtgactgagtgtaagtcgggagctaaagttgcggacctttgctccataggtgacacatacatcaagacccacaccgcgaacgtctacaagaatgccaagaagaagatcgacaaaggagtggcatttccgacatgcgtctccgtaaacaacactgtgtgccatttctcgccgctgaatggagacaagacggctctcgttgacggggacatcgtaaagatcgatctcggctgtcatatcgacggctttgcggccgtagtcgctcacacacacgtccttcagacgggtccggtgactggaagagcagcggacgtcctggcagctgcaaacaccgcagcagaagttgcgctcaggctcgtgagaccaggaaagaagagcag

SEQ ID NO: 1515 - DNA, 656 bp, Artificial
  Synthetic
atccatcagtgccccagccgccccagtggtttgtccgcgattcaagcttccatcgatcgatcgagagatgtctgatgacgagagcaaggaggagaaagagctggatttgtcgtcgcctgatgtggtgaccaagtataagctcgccgcggagattgccaacaaggctttgcaagctgtggtgactgagtgtaagtcgggagctaaagttgcggacctttgctccataggtgacacatacatcaagacccacaccgcgaacgtctacaagaatgccaagaagaagatcgacaaaggcgtggcatttccgacatgcgtctccgtaaacaacactgtgtgccatttctcgccgctgactggagacaagacggctctcgttgacggggacatcgtaaagattcgtttggcagcgatctcggctgtcatatcgacggctttgcggccgtagtcgctcacacacacgtccttcagacgggtccggtaactggaagagcagcagacgtcctggcagctgcaaacaccgcagcagaagttgcgctcaggctcgtgagaccaggaaagaagagcagggatgtttccgaagcgatccaaaaggttgctgcggcttacgactgcaagatcgccgaaggcgttttgagccaccagatgaagcaattcgt

SEQ ID NO: 1516 - DNA, 557 bp, Artificial
  Synthetic
ttcagcatgcgagtcaagttggcactcacactcaaaggcatcgagcatgaagatcttccacaggatctcagcaacaagagcaagctgctgctcgactccaatcccatccacaagaagatcccggtcctcatccacaaggggaggccactgctcgagtcagtcatcattgtccagtacattgacgaggtatggcccggaaagtccccgctgctgcctcaggatccattccttcgtgccgagcaccgcttctgggccgacttcatcgacaagaagatcggcgactgcttgatccgcttcctgaaaactgaggataatgccgacatcaacgaagaattcgtcgagaatcggatgcatctcgaggggccgctagagaagctcggacgcgaggaggggccgttcttcggcggcgagagcatgtcgttcctggacgtgattcttgcccctttcatcgtctggattcctgccgttggcaatgtcctgggcctcaagacgccacatgagaaatgctcgcatctacgcaagtggtttgctgccatctctgagcatcccgacgctaa

SEQ ID NO: 1517 - DNA, 574 bp, Artificial
  Synthetic
gccattacggccggggaaaacatagcacatatactacggtagtattatcttgcaattgtgtataacaatccttaattgttcatctataatggcgatgaagggtccttctggatacctatgtaaccatgattgggatgatagttaggtgagccttggctgagactggcatacagtatgaatacaaggagcaggatttgctgaacaaaacccctcttctcctacaaatgaacccaattcacatgaaaatcccagtcttgattcacaatggaaaaccaatatgtgaatctctcattattgttcattacataaatgaagtttggaaggacaactcccctttgatgccttctgatccttatgagagagctcatgctagggtctgggctgattatgttgataaaaagatttatgatactggaaggataatgtggacatcaaaaaaggaggatcaagaagcagccaataaggaattcatagaatgcttgaagttattggaagaggagttaggagacaagccatactttggaggggaaagttttgggtttgaggatatggcccttattccttactatacatg

SEQ ID NO: 1518 - DNA, 316 bp, Artificial
  Synthetic
cccacgcgtccggggaaagccaaaccggtatattttctttaaacaggatatatagatgaaccaagaagagcacgtaaagcttctgggcttatggggaagtccttttagcaaaagagtagagatggtcctaaaacttaagggcataccttatgagtacattgaagaagatgtttatggaaacaggagccctatgcttctcaagtacaaccctatacacaagaaggtccctgtcctcatccacaatggtagatcgatagccgaatcattggtgattgtcgaatacatcgaagatacgtggaagacaactcacacgatc

SEQ ID NO: 1519 - DNA, 685 bp, Artificial
  Synthetic
atggcggatcaggtgactctcctctcgctgcccgcgagcccgttcgcaatgagcgttaagatggcgctgattgagaagggtgtcgacttcaagacggtggaggagaactacagggcaaacggcaagagcgagatgctgctcaaggtgaatcccgtgactaaacaggtgcctgttctgctccacggtgacaaacccgtctacgagtcgctcgtcattctcgagtacattgaggacatttggaagggtcagggcactcggctcctgcccgaggatggataccagcggtcgcttgctcggttctgggccaactttggcaacaccaagttttgggagactggactgctgataatgaagaggatcggagaggggcagatgaaagctagagatgacgtcgtcgagatgatccatctgatggaacaggagtggagcaaacctgagtatggaaagccgttcctgtttggtgacaagctcagcctggctgacttggttttggctcctattgcgtcgtggaagctgacattcgagaccctggggaagttcaagtttccggacgctcagacatgtccacggatggcccagtggctggatgcaattgagaatcaccccacggtgaagtcggccatcctggcaccggatatgaatctggataatgccaatttctaccaggacttcataaaacgcagca

SEQ ID NO: 1520 - DNA, 685 bp, Artificial
  Synthetic
ggtgattctgttggatttctggcctagtatgtttgggatgaggctgaggattgcattagctgaaaaggagataaagtatgagtacaaagaagaggacttgaggaacaaaagccctttgcttttacaaatgaatcctatccacaagaaaatcccatttttgattcacaatggaaaacccatttgtgagtctattattgcagttgagtacattgaagaagtttggaaagacaaagcccctaatttgcttccttctgatccttatgacagagctcaagctaggttctgggctgactacattgacaagaagttgtatgatgttgggaggaagttatgggcaacaaaaggagaagagcaggaggcagctaagaaagatttcatagaatgcctcaaggtgctggagggagcattaggagacaagccttactttggaggggaaagttttgggtttgtggatattgctctgattggatactacagctggttttatgcctatgagacttttggcaacttcagcacagaggccgagtgcccaaagtttgtggcttgggccaaaaggtgcatgcagagggagagtgttgctaagtctttacctgaccaatctaaagtccttgagtttgtaaaagttcttaggcagaagtttggacttgagtaaacatatgcatatttggttatgcaccataatgta

SEQ ID NO: 1521 - DNA, 658 bp, Artificial
  Synthetic
agagagagagagtgtggtggaagcagcagctgagactgaaagagagtgagtggtggtagcagcagttaagagagagagagagagagtagtagtagtagtaggcaaggaagaaggtatggcaactgtgactgaaagtgaaagtgaggtgaaggtgctgtccacatgggctagcatgttcggcatgcgcgtgctcatcgccctcaacgagaagggcgtcccttatgagctcacccaggaggaccttcgcaacaagggccagctcttgcttcagtccaatcccatccacaagaaggtacccgtcctcctccaccatgggaaacccatctgtgaatccaacatcattgtccaatacatcgacgaaacgtgggcttcccctcccttctttcaaccccctaccccttataaccgtgccatgcacctcttctgggctgacttcgtcgataaaaagttttatgcagagacgggctcgaaggttctaagaagcatgcctggggaagaccgcgacaaagcagtggaggagtttcagaacagctacaaaatgatggaaaaggcattgggggatatggcatgtgggaagcctttctttggtggagactccattggctttcttgacattgcctttgctcctttcgtttgttggttcaaggcttttgagaca

SEQ ID NO: 1522 - DNA, 719 bp, Artificial
  Synthetic
gaggacacgccaagcatggaggagggacaacagagggcggggtgaagtgaaggtgttggggaattgggccagcatgttttctatgcgagtctgcattgctctcgatgagaaggccgtcccatacgaagccacaaacgaggacctacgaaacaagggccagctcttgctacaatccaaccctgtccacaagagtgtccccgtcctccttcacaatggcaaccccatctgtgagtcttccatcatcgtcgaatacatcgatcagacatggccttcccctccccttttcaaccccgccaccccttacaaccgagccatgcatcgcttctgggttgatttcattgacaaaaagtttagtgaagcgggtgcaaggatttttagaagtccaccaggagaagttcaagatggtggatcaaaggacttggttgagagttacaagacgctagagaaggcattgaaggagatggcttgtgggaagcctttctttggtggagaatccattgggtttgtggatgttgccttagctccatttatatcttggttcaagacatatgagacactgggaaaattcaagttaccaggggaagaagaatgccctttgttaagtgcatgggtgaagaaagtgtccgaagtgcctagtgtgaaaaaaaccttgccagaccccgacaaggtccttgactttgtctatggcctcagaagcatacttcttcagtagtgaatgc

SEQ ID NO: 1523 - DNA, 673 bp, Artificial
  Synthetic
gagagagagatagagagagagagagagagagcgagagtggtggtagcagcagcagctgagagtgaaagagagagagagagcgtgggggtagcagcagttgagagagagagagagagacagagagtagtagtagtagtaggcaaggaagaaggtatggcaactgtgagtgaaagtgaaagtgaggtgaaggtgctgtccacatgggctagcatgttcggcatgcgcgtgctcatcgccctcaacgagaagggcgtcccctatgagctcacggaggaggaccttcgcaacaagggccagctcttgcttcagtccaatcccatccacaagaaggtacccgtcctcctccaccatgggaaacccatctgtgaatccaacatcattgttcaatacatcgacgaaacgtggccttcccctcccttctttcaaccccctaccccttataaccgtgccatgcacctcttctgggccgacttcgttgacaaaaagttttatgcagagacgggcttgaaggttctaggaagcatgcctggggaagaccgcgacaaagcggtggaggagtttcagaacaactacaaaatgatggaaaaggcattgggggatatggcatgtgggaagcctttctttggtggagactccattggctttcttgacattgcctttgctcctttcgttt

SEQ ID NO: 1524 - DNA, 675 bp, Artificial
  Synthetic
ggcaaagaattgagaaccaaggttgtgagatggcagaagtgaagttgctaggttgggggtatagcccatttagtcgcagagttgagtgggctctaaagataaagggcgtgaaatatgaatatatagaagaagatcgagctaacaagagctctctacttcttcaatccaatcctgtttacaaaaaagtccctgttttcatgcacaatggaaaacccgttgttgagtcaatggtcattcttgaatacattgatgagacttttgaaggcccttccattttgcctaaagacccttatgatcgatctttagctcgtttctgggctaagttccttgacgataaggtgcctgcagtagtgaagactttcttgcgcaaaggggaggatcaagagaaagataaagaggaagtttgtgagatgctgaaagttcttgacaatgagctcaagaataagttgttctttgtgggtgacaaatttgggtttgctgatattgctgcaaatttggtggcattttggctaggagtttttgaagaagcctctggagttgttttagtgacaagtgagaaatttccaaatttttgtaggtggagagatgagtatattaactgcagccaaatcaaggaatctctacctccaagagatgagttgcttgctttttaccaagctcgctgtcaagctgctg

SEQ ID NO: 1525 - DNA, 770 bp, Artificial
  Synthetic
accctattcgagcgagcgacgcagagaactccggagaaaaatgtcgcacttcggaagaactggacctccggacatcaccgatacttactctcttctcgtcctcaacattacattccgtaccacagccgatgatctgtatcctcttttcgacaagtacgggaaggttgtcgatatcttcattccgcgagacagaaggactggtgagtcacgtgggtttgcatttgttcgttacaagtatgcagatgaagcacagaaggctgtggataggctggatggaagagtggttgatggacgggaaatggcagttcaatttgccaagtatgggccaaatgcagaacggattcagcaagggaggatcattgagaaggtttcaagaatcaaaggaagctcgagaagcagaagccctgggagaagataccgggatgatcactatagagatagagaatacaggagaagtaggagcagaagtgttgatcgttatgagcgtgataggtataagaggagagaacgggattatcgccgtcgaagtaggagccgcagcttaagtccagactatgatcgagatcgtggcaggggacgtgacaaaaaacaccataggaggagtccatttgacagtgcctctcacctcggcgtagccccagtccttacaggaaagagtctcctcgcggaagcttatcacctaaaaaaggaagctctgagaagcgcagtcacattgaacgctctccaactcctcgaagccaatcccctcctgttcgagcaatggattcacg

SEQ ID NO: 1526 - DNA, 635 bp, Artificial
  Synthetic
gcaatgtcgcactttgggcgatcggggccgccggacatccgcgacacctattcgctcctcgtcctcaacatcacctttcggaccagtgccgacgatttgtttcccttgttcgatagatatggaaaagtggttgatatttttattcccagggaccgaagaactggtgactcgcggggatttgcttttgtgcgctacaagcatgccgatgaagctcaaaaggcaatcgagaggcttgacggtaagaatgtagatggaagaaatatcgttgtgcaatttgccaaatatggtcggaacgatgagtcaattcagcgtgggaaaataacatcttccagtcctatctggcgcagccgatctaggagccggagtcctaggagaggaagaagagattatgacgaccaccgagagagagatagagaccgacgacgtagccgaagccgagagagatacgagcgtgaaagataccgcgggcgtgacagtagagattaccgcaggcgtagccttagccgcagtcgcagtcgcagcagaagcagaggccgtggcggccatgactatcccgctcgtgacggccgagatggtcgtgatgctcgcgatggacgcgatgtccgcgacgggcgaaggcgatctcggagcaaatc

SEQ ID NO: 1527 - DNA, 681 bp, Artificial
  Synthetic
agaaccggtcggataagcgaggccgaggttctactcggggccatgccggacccggacacttacgcatacaactgctgcatgaacggtctctccaaggtcggggacgtctcgagagctctccagatctatgacaggatgctggagctaaagctggtcccggacaaggtgactttcaacatcctcattgccggggcttgcaaggccggcaacttcgagcaggcggccaagctcttcgaggagatggtggccaagaacttccaccccgacgtcatgacttacgggtcgctcattgatggcctgtgcaaggccggacaagttgacgctgcccgggacatcctggaactcatgaggaagcttggagttcctccaaacgtggtgacttacaacgctctcgttcatggcctctgcaagtcgggccggatcgacgaagcttgcgagttcttggaggagatggtgacctctggatgtgttccggactcgatcacgtatggatcgcttgtttatgcgctgtgccgggcttcgaggaccgacgacgctctccagctcgtgtccgagctcacgggctttggctgggatccggacactgtcacgtataatatactcgtggacgggctctggaaggcggggaagaacgaccaggccatcggtgttcttgaggagatggtcgggaagggacaccag

SEQ ID NO: 1528 - DNA, 512 bp, Artificial
  Synthetic
agtcaccccaaaattagggcacatcgagatagagaagagctgactcatcctcagccaaattgaagatgactgacaaatcctcttctgcgttactcttccaatggtatttcctttgctctttcccgtactgcttcggcatttactaccagaaattattcttcttctcataccaatattgagaatgtcaagtgtttggatgatgctcttagcctcttccgtcggatgatcagaacgcagcctcttccttctgttattagcttctccaaattattaaagactatggtaaatatgaagcattactcttctgttgtttccctttttcgacaaatgctgaaatctaatatcccaattgatggtttcatcttgagtattgcgatcaacagtttttgcctaatgcatcgttctgactgcggattttcagtgttagccatttacttgaagagtggcattccatttaatgttgtcacctttagcaccttactaaggggactctttgctgaaaataaaatcaa

SEQ ID NO: 1529 - DNA, 590 bp, Artificial
  Synthetic
cggaaaaaaagagcaaaagcttcattcataatcaatggcttccaccattaagaaagggaacatgattactcaaatcgtaaggctaaaacaagtcgtcaaacgctggaaaaacaagtcccttacgcgccgcggtgtcgtctcgtactcctcatcctatttatatgaaccggcattatccggttcggaccgtcgtacgccctcaggatcgttggcggtttacgtggggccagaacgccgccggttcgttatcccgacccggttcctgaaccttcccgtgttcatctcgctgctcgataaggcagaggaggaatttgggtaccagaggacaggtgggttagttttgccctgtgaagtcgagtacttttcggagattttaaggttactggaccgggatgaggagcgattcggtcatttggctttggatgagcttgttaagctgatttctgaagtaggttttgaatccttagatcagtcttgcaaagaagctgcttcccgtggctttgctcctcttctgcagaatgctagggtttaaacggtttttactgacaatgcccggttcagttcgtttttcttcccggttcggttcctga

SEQ ID NO: 1530 - DNA, 648 bp, Artificial
  Synthetic
ttcttttaaagtagcacaggtccttcgtcttttcggtttcgtcctattttctttcagctcatcgctatggtgaaggaaaagtcagctggtaggcagaaaaggcaggtcaagaaagacccgaacaagccgaagaggccggcttctgcattcttcgtcttcatggaagatttccggaaaacttacaaggaggctcaccctgatgtgaagggtgtttccgagattggtaaagcgtgcggtgagaaatggagggaaatgaccgatcaggagaaagtacctttcgttaccaaagcggcacagaggaaagctgattacgacaaagcaatgacggccttcactaacggcgtgcaggctaagtcagcgggatcaaacggaagcgcagagagcggcgaggaggaatctgaatagggagcccggggaggaaatcatgttggcgtctctgatagagtctgtcttgaatctaatggtagtttttccttcgttagtaccacccctctggcgtggaggagtctctgtccagttttgccccatccaatgaatttcttctcattgctggttttgtcccagactacgtcttgttgacatgtaggcgttgtacaggactatcccttgtggattctctttaattcaactctgtttctatttcgaaaa

SEQ ID NO: 1531 - DNA, 704 bp, Artificial
  Synthetic
cccacgcgtccggacccacgcgtccgctctactccctctttcatcctcagcagccctttccctaacttgccttcttccccaacactaatcaaagcgttgatatggcaaaggagaagtctgggggaaggcaaaagaggcaacaagcgaagaaagatccaaataagcccaagaggcctgcatctgcattcttcatctttatggaggatttcaggaaatcatataaggaagcccatcctgacgtcaaaggggtttcagagataggaagagcatgtggcgagaaatggagagagatgacagacgaggaaaaggctccatatgcaactaaagctgcttcaaggaaggccgattatgatagagcaatgtcagctttcaacaatggagaggtggcaggcaagagcaatggggcaagtgctcttgctgagagtgagggggagtctgagtagaccaaatgatggaataagtgaggctctaccagaacccaggaaatgttgaatggttggttgtgccttttttactcccttcaaaactgtcctctttcatgtatcacacaccatcccttgcttaatttgctttggcaatctttacaacctcctagaaaatccatgtttctcctctttagagaggattagtttggacttcatgtatttctctgggaaacaattgcagcagctcataatctgtgggaaactatcttgtgatcattc

SEQ ID NO: 1532 - DNA, 862 bp, Artificial
  Synthetic
cccacgcgtccgcagtccctcacttggaaccttcttatcggtcgccccttcgcttaccgaattcatcacaacgcaccaaaggaatatacatctctttgttttctctctctagaggtttcgctatgaaaggagttaaatctaaggctggagctgattccaagcttggagtaaggaagaaggctacggagacgaagaaagcgaaaaaagccacgaaggatccaaacaagcctaagaggcctccaagtgcattcttcgttttcatggaggagttcaggaagacgtacaaggaaaagcacccaagcaacagatctgttgccactgttggtaaagctggcggagatgcgtggaaaaaattgtcagatgctgagaaagcactttaccaggaaaaggctgataaaagaaaggcggaataccaaaagaacatggatgcctataacagaaaacaggctggtgatgctgaagaggaggaatcagacaagtcaaagtctgaggttcatgatgatgacgaggatgatgatggaagtgaagaggaggaggatgatgattaaaaactgaatagctgttgaattgccgaaaattatggcaaagttgatgtagggaatccctttcagccctttccttgataaatagatgccctctttttgatgtttcctttctttttgttttggtatttttcggggtttagttgggacgggataagggaaatttagatgagctgacttgatagctcgaatggcttatgtatttttattttggtggtgtttaatgaaaaattcagctacggattaccctttgttggtagtattatgaatttcatctaatccgtttcgtgatgatgcaagtttgatgccagatatatttt

SEQ ID NO: 1533 - DNA, 745 bp, Artificial
  Synthetic
ttcttttttctactcgaatccaagcttttttttatctccgttcttctccggcagacagacatttcctccgttgttctccgtcgtcctcgacatttccacctctcgtctcgcttaatcggtaaaacaagagaacaaagaaaagggaagtatggcgaaggagaaatctaccggtaagcagaaacgccaggcgaagaaggacaccaataagcctaaacggcctgcctctgcttttttttgtattcatggaggagttcaggaaatcatacaaggaagctcatcctgatgtcaaaggagtttccgagattggaagagcctgtggtgaaaagtggagagagatgacagatgaggaaaaagttccttatgtatctcgggctgctgtgagaaaggcggactatgacaaggcaatgtcagcttacaacaacgaagagatgaataggtctgcccaagcgaagaccagtgcatcaaatgggcacgctgggagtgaggatgagtccgaatagcctgcctaagggagtaaatgcaggcgatactctatatatgctgtctcactgttgaccagctaatgtgcttgtggatatagtttacttaactcgttttttagttctctcaaaagatttctgctgttaaacacaaaaaactgtcaagcctcagattttcgagcaaagtttgagtagcctttttaacattttgaaacagctccacttttcttgcctgcccaagaaaattgacatggaaaagaggtaca

SEQ ID NO: 1534 - DNA, 482 bp, Artificial
  Synthetic
agtagtagcagtactggttaacagttcttgtttataatttgaacgactttgcagggaagggatggggaatatagctattacacctaatcacttaccttcaacggggcttgccatctcccggaggcacagtgaagggagcaaaatggtcagctcttcctgccaagaaggacaacaaaggcctgtcaaagaaggctgaagaaactaacttgaagagaaagaagtcagttgcaacagaagggaaagtcgaagaggcagtccaagaaacctgccaaggatcccaacatgcctaggagagctcctggtgctttcttcgtcttcatggaggagtctaggaagacctacatggctgatcatcctggaactaaatccgtgtctgcggtgggcgaggctgctggggacaagtggaagtcattgtctgaagcggagaaagccccgtactctggcatggcttggaagaacaagggcgagtacgataagtccat

SEQ ID NO: 1535 - DNA, 622 bp, Artificial
  Synthetic
tggtgtgggtgtgtccctgtctcccctccttcctcctctcctttcccctcctctcttcccccctctcacaagagagagagagcgccagactctccccaggtgaggattcagccatgaagggggccaaatccaagggcgccgccaagcccgacgccaagttggctgtgaagagtaagggcgcggagaagcccgccgccaagggcaggaaggggaaggccggcaaggaccccaacaagcccaagagggctccctccgctttcttcgtttttatggaggagttccgtaaggagttcaaggagaagaaccccaagaataaatctgtcgctgctgtaggaaaagcagccggtgataggtggaaatccctgaccgaagcggacaaggctccctatgtagccaaggccaacaagctcaaggccgagtacaacaaggccattgctgcctacaacaagggcgagagcactgccaagaaggcacccgccaaggaggaagaggaggacgacgaggaggaatctgacaagtccaagtccgaggtcaatgatgaggatgacgacgagggcagcgaagaggatgaagacgatgacgagtgagccttccagtggacaagatgggagcagcaagacgc

SEQ ID NO: 1536 - DNA, 651 bp, Artificial
  Synthetic
ttcgttgtgttgtgtgctggggtctttctctctctctctctctctctctctttcttcgtatttctcgtaatacgaagggaaactctctatagtttttagtagttacgtttttattactaacaactagtagtactactactacaacgaggcgaagctcgccatctttacgacgatctccaggcacaatgaagggagcaaaaggatctgccatacctgccaagaaagataacaaaagcctctcaaagaaggctgaagaaacgaacctgaagaagaagaaatcagtggccaaggaagcaaagccaaagaggcagtcaaagaaagctgccaaagaccctgacatgcctaagaggccgcctagtgctttctttgtctttatggagggctttcggaagacatacatggccgaacaccctggtgttaaatctgtctcaatagtgggtaaggctgctggagacaagtggaagtcactatctgaagcggagaaagccccatatgcttccaaggctctgaaaaagaaggctgaatatgagaagttgatgcaagcgtataaacaaaaaaaggttgcaactgaagctaacaagtctgcggtccatgaagatgatgaggaagaggaggaggaagaggaagaggaagaggaagaggaagatgatg

SEQ ID NO: 1537 - DNA, 595 bp, Artificial
  Synthetic
gtggtgtgggtgtgtccctgtctcccctccttcctcctctcctttcccctcctctcttcccccctctcacaagagagagagagcgccagactctccccaggtgaggattcagccatgaagggggccaaatccaagggcgccgccaagcccgacgccaagttggctgtgaagagtaagggcgcggagaagcccgccgccaagggcaggaaggggaaggccggcaaggaccccaacaagcccaagagggctccctccgctttcttcgtttttatggaggagttccgtaaggagttcaaggagaagaaccccaagaataaatctgtcgctgctgtaggaaaagcagccggtgataggtggaaatccctgaccgaagcggacaaggctccctatgtagccaaggccaacaagctcaaggccgagtacaacaaggccattgctgcctacaacaagggcgagagcactgccaagaaggcacccgccaaggaggaagaggaggacgacgaggaggaatctgacaagtccaagtccgaggtcaatgatgaggatgacgacgagggcagcgaagaggatgaagacgatgacgagtgagccttcc

SEQ ID NO: 1538 - DNA, 836 bp, Artificial
  Synthetic
gctaaccaaagccccttcttatctcttcccctttcagcccacaacacacacacacaaccacccaacgggcatataactctgttttttcctctcttgttgtcaataccatattattattctcaaccctaaaggtttaatcatgaaaggaggtaaatcaaaggctaaatctgacaataagctcggcgttaagaaggctgctcctcagactaaaaaggagaagcaggctgccaaggatcccaacaagcctaagaggccagcaagtgctttctttgttttcatggaggacttcaggaagcagtataaggaaaaacacccaaacaacaaatctgttgctgctgttggtaaagctggcggtgacaagtggaaacatttgtcagaggctgagaaagctccatatatagcaaaggcagagaaaaggaaggctgaatatgaaaagaacatggatgcttataacaggcgacaggctggtgaggctgaagaggaggaatctgacaagtcaaagtctgaggttgacgaggaagacggaagtgacgaggaggaagaggatgactaaatgaagtcttaggggatgaagaaaatgtggaggaattgtgtaatatcttagagatttccatatgacttcctctttttcctattaaatacttgtcttttggtttatcttttgggggtatcttggggcatggaaaaagatgaaattagaaaagtgctgcctttaaagctcaaatgactattgtactttataatttgatgctgcagcttattgttaattccgatgggcctcagttctttctaggccagtatatggaagtcatgtgttttgctaaatgtagctagct

SEQ ID NO: 1539 - DNA, 736 bp, Artificial
  Synthetic
ctcttgttttttcctcttgttgtctataccatatcattattctcaaccctaaaggttctatcatgaaaggaggtaaatcaaaggctaaatctgataacaagctcggcgttaagaaggctgctcctcagactaaaaaggagaagcaggctgccaaggatcccaacaagcctaagaggccagcaagtgctttctttgttttcatggaggacttcaggaagcagtataaggaaaaacacccaaacaacaaatctgtagctgctgttggtaaagctggtggtgacaagtggaaacatttgtcagatgctgagaaagctccttacatagcgaaggcagagaaaaggaaggctgaatacgaaaagaacatggatgcttataacaggcgacaggctggtgaagctgaagaggaggaatctgacaagtcaaagtctgaggttgacgatgaagaagaaagtgacgaggaggaggaagatgatgactaaatgaagtgttagaggatgaagaaaatggtggaggagctgtgtaatatcttagagatttccatataatgacttcctcttttccctatttaatacttgtcttttgtttatcttttggggtatcttagggtatggaaaaagatgaaattagaaaagtgctgtcttaaagcccaagtgactgtgcttttcaatttgatactgcaacttaatgttaattcggataggccttagttctttcttggccagtatatggaaatcag

SEQ ID NO: 1540 - DNA, 625 bp, Artificial
  Synthetic
ttctcttttggcttttgctctgttttcttcactttcccttcagcccattacttcttagcttcctggcagttctaagttacaatgaagggtggaaaaggaaaaggggcgttgagaaaagaaacaaggtctgcactgaagcctgttgaggaccgaaagatggggaagagaaaggccgcattgaaggatgataaacggaaggccaagaaggacaaaaaggccaagaaagatcctaataagcctaagaggcctcccagtgccttcttcgtatttcttgaagaattcaggaagacatttaaaaaggaaaatcctaacgtgaaggccgtatcagctgtagggaaagctggaggagagaagtggaaatctatgagcgcagctgaaaaagcaccatatgaagccaaagcagcaaaaaggaagtccgagtatgaaaagctcatgcatgcgtacaacaacaagcagccggaaagctcagacgatgatggcgaagaagaatctgagaggtcaaaatctgaggtacatgatgatgatgcagagtgcagtggacagggtgaagaagaagaggaagaggaagaggaagatgatgaaaacgaggacgatgattgaagctatgtgcttcaatcacttggtt

SEQ ID NO: 1541 - DNA, 734 bp, Artificial
  Synthetic
tctctctcattttctaatacaaagaaagagagagagagagaagtgtaataacgagattactactactacaacataaaagaaagagagagagagagagatttgcaagctttttttacgacgattgccaacccacccaggtttcttcgtcctcaggcagcacaatgaagggagcaaaaggatcagttgcagcactgccaccacctaccaagaaagacaacaaaggcatatcaaagaaagcggaagaaacaaatttaaagaaaaggaaatccgcagcgaaggaagtgaagcccaagagacagcctgtaaaagctgtgaaggacccaaataggcccaagaagcctgctactgctttctttgtctttttggaggagttcaggaagaccttcatggctgagcaccctgcggtcaaagctgtctctgtagttggcaaagctggtggagaaaagtggaagtcgctaacagaggcggaaaaaactccatatgtcgccaaggcagcaaaaagaaagactgattatgagaaaactatgcaggcatataaccagaaaaaggatgtagcagaagccgagaagcccaagatagaaacccacaaagaggaagaagaggaagatgatgacgattacgaagaggatgatgagaatgaagatgatgagtaacaggatcaattccagattcctagcaagatggtaccatatttaaggtaacaaactaagaagatggatgctatggactatctc

SEQ ID NO: 1542 - DNA, 477 bp, Artificial
  Synthetic
ttcccgggtcgacccacgcgtccgtattttacaagcctttctccactaagcccttctctcttcttctcttggcctctcacttgaatctcccacaaagcgatcaatcacaaattccttcttctctctctttcttttcgtccccaagaatcaattatgaaaggagctaaatcaaagactgaaaccaggagctccaagctctctgtgaccaagaagccggctaaaggagcaggacgtggcaaagccgctgcgaaggaccccaacaaaccaaagaggccagccagtgctttcttcgtgttcatggaagatttccgtgagactttcaagaaggaaaaccccaagaacaagtctgtagctactgttggaaaagctgcaggagacaagtggaagtccttgtctgattctgagaaagctccatatgttgctaaggctgagaaacgcaaggttgaatatgagaagaacattaaagcttacaacaag

SEQ ID NO: 1543 - DNA, 567 bp, Artificial
  Synthetic
tccggacagagataaaaagtaagagaaaattatcccttctcttccaataataataaacaaataaatccaatcacaaaattcacaaaacaaaagttgtaagaaggaattttctctgtttgttttttctctttctctgtccaaaaccttaaaactcatggcggataaaggtcgtccacttccaaaatttggagagtgggatgtcaacgacccagcttctgctgagggtttcacggtcatctttaacaaagctcgaaatgagaagagaagcggaggcaatacaaactcaccaccaaagggtgaccctgcatataataagcatggagcaactcttggaaagcctcaatcaaaaaaatggttctgctgtatgcattctgctgctgcggaatcatgaattcgctttgctcctatacgtcacattggggagtgtttgatctgaaatgtaaagtgttcctcaagtcttgagctgtagtcaagcctggaatttgttctattgtgttttagaatttactcaaaatttcgccattgaaagatattctgctatctatttatttatttattttttgatct

SEQ ID NO: 1544 - DNA, 256 bp, Artificial
  Synthetic
tctctcttgctgcacagcaccagtcatattctctgaagaacatttctgacttattcccggattcatgtcggaaaagggtcaaccattgcctaagtttggtgaatgggatgtcaatgacccagcgtcggcagagggattcacggtgatcttcaacaaggcccgaaatgagaaaaaaacaggtggcaatccagaatcaccttcaaaggctgattccaatgcaaagcaagcagcagagttcaagcctcaagctaaaaaa

SEQ ID NO: 1545 - DNA, 546 bp, Artificial
  Synthetic
cccccttcctccctctcctctcctctccgccgctgccggtgctgctgcgtgctcctctcatccccgtctcttccccctccgcgcgcgccgcccactcgctgggaggaggaggaagaggagaccttccccggaattcgtgctcgccggatcgggctcgccgcaatccatgtcggaggaagcaggtcgacccttgcccaagtttggtgaatgggatgtcaacgacccagcttctgctgatggattcacagtgatattcaacaaagccagagatgagaaaaagggtgggaatgggcaagatactgattcaccctgcaaagagactaggactgagagggtggaatcatatgcccccaaaacaaactcgaacaaatggttttgctgtgtgacatccagtcctacacaatcttgatgaaaacgagttccatgggttgcaaaattactatcctttaattttgctatatacatactatccataagaccttgtagagatgcccacactctgctgtggtgcttgattgggcatctcttaaaactctgaggtgtgtg

SEQ ID NO: 1546 - DNA, 634 bp, Artificial
  Synthetic
cttccactcctctccatatctgctaaaattcataattcagaggggggaaggaggtagaaaaagagagggtcaagcatggaggtgaacggtgaaacaacaagatggaattttaaagagaacgagaatttcttggctgcgtctggtatttccataagaggggttcttaacaagttaatgcagagccttgacccgtctgatacccgacccgttatccctctcggacacggcgatccttctgctttcccctgctttcggaccactcccgttgctgtagacgctatttctgattccgttcgctctgctaagttcaatggttattcatccaccgtcggcattcttcctgctagaaaggctgtagcggaatacttatcccaagatcttccaaacaagctgtcccctgatgatgtttacctgacaattggatgtactcaagcaattgaagtaattttgaatgttcttgctcgcccaactgcaaatattctacttccgaggcctggttttccttattatgaagcacgtgctgtttttagcaatcttgaaatgcgtcactttgatcttctcccagaaagtgagtgggaggtggaccttaatgcagttgagtctttggcagatgaaaatactgtggctattgtca

SEQ ID NO: 1547 - DNA, 692 bp, Artificial
  Synthetic
aaacagggcaattgcagattatttgtcgcgtgaccttccagaggaattatgtgcagatgatgtttatgtcacagctggttgcactcaagccattgaaatagccttgtcaattctggctcgcccctctgctaacatattactaccaaggcctggtttcccaatttatgcactttgtgctgcctttagacacatcgaagttcgatactttgatcttgttccggacaaaggctgggagattgatctcaatgctgtcgaagctctagctgatcgtaacactattggcatagttgttataaatccggggaatccttgtggaaacgtttatagttaccagcatcttcaagaggttactcttagtactctttttaaatgcaacgattacttcctcagttttatttcatgccttagtttgcccgagcatgaagtttaagaatgcaaagaaattttctgcagcttatcgtcttaaactaaaggtgtgtataacataccaaaataccctttgaattttgtggtcttagacatagtagtgtcattagggtaaaatgagaatgttgaaattaagagtctactaaatatagaaaggcgacattccttttgaaacagattaaaaaaggaaagtaagacatagaaattaaaacgtgtggaatactattcttttcctttctttttgcagtttgcattagttctaagaa

SEQ ID NO: 1548 - DNA, 687 bp, Artificial
  Synthetic
aggaaaaaaaggagagaaaatgccgtgcttactcacagttcgatgcgagatcgccactcacagtccgcatgaatccgctgttccagctgtgaaccagaagcgatggccgactcgattgaatccggcagcattgcgctccatcaatccgatccggagagcgatggagtccatgcctgatcttcgcggccgtggaaagcagccaatctcgctcaccctcggcgatccctccgccttcaacgagatcaaagctccacaggtagctgtccaagcaatcaccgatgccatcgccagcttccattacaatggctacagccaagccgctggaatcctcgactgccgcagagcggtggccgagtatctctccaaggatctatcgtactccctgtcggccgacgatatcttcatgacggccgggtgctcacaggcaatccagttctgcatcgcggtcctggccaggaagtcgtccaacatcctgctcccgcggccgggattcccgttgtatcaatccttttgcagcttctacggcgttgaagtccgagagtatgatctgctcccgagcaacgactggcaagttgatctcgagtgcgttgagaagctggcggattcggatactgttgccatagtcgtgtgcaatcccggtaacccctgcggatccgtgtactcgcagcatcatctgacgcaggttgc

SEQ ID NO: 1549 - DNA, 625 bp, Artificial
  Synthetic
  misc_feature (281)..(281): The residue at this position can be any nucleotide.
ggaaattttctgcccttgcaagcgctcgtctttctccgtcgtcgttttccggtgaacagctgtttaggaatggcgaacccccgtgtgttttttgacatcaccatcggcggcaaccctgcaggccgcatcataatggagttgtatgcggacaaggttccaaggacagcggagaacttccgtgccctctgcacaggggagaagggaattggaaagagtgggaagccactccactacaagggtagctccttccacagggttatcaacgacttcatgtgccaggntggtgatttcacgcggggggatggaacaggtggagagtccatctacggggccaagtttgccgatgagaacttttcgtgcaagcacactggtccaggcatcctctccatggccaatgcaggaccaaacaccaatggctcccagttcttcctttgcaccgtcccctgtgcatggcttgatggaaagcatgttgtcttcggcaaggtcgaaaatggaatggacgttgtcaagactattgagaaatacggatctgggagcggcaagacgaaagcccctgttgtcgttgctgactgtggccagctctcttgaagtatggttggtggctccccttagaagaataactctt

SEQ ID NO: 1550 - DNA, 502 bp, Artificial
  Synthetic
ttctggtagttaatattaaaggggcaagtttatatatgggcccatgagaacacacaccaaacttatgactacaaattttaaaacgactccataacaaaagcaaaagcataaagagacaccacaatgacgacgatgatgctaaattaaggatgatgataggaagatcctaagagagctgaccacaatcggcaacaaccacaggcttcgtcggctttccagatgatgatccaaccttctcgatggcctttaccacgtctaagccttccacgacctgcccaaacaccacgtgcttcccatcaagccaatcggtcttcacggtgcagatgaagaactgagatccgttcgtgtttgcaccggcgttcgccatcgacaggatccccggtccggtgtgcttcctctcgaaattctcgtcctcgaacttgctcccgtagatcgactcaccgcctgttccgttcccggcggtgaaatctcctccctggcacatgaagttagggatcacacg

SEQ ID NO: 1551 - DNA, 345 bp, Artificial
  Synthetic
tttaatggcgaatcctaaattcttcttcgacatcttgattggtaagatgaaggcagggcgtgttgtaatggagttatttgcagatgtgactccgagaacagctaataatttccgtgctttgtgcactggggagaatggtattgggaaagcagggaaggctttacactacaaaggctcagcctttcaccgtataatcccagggttcatgtgtcaaggtggagatttcactcgtgggaatggaactggaggagaatctatttacgggtctaaatttgaagatgagaacttcaagttgaagcacactggtccagggattttgtctatggctaactctggtcccaacac

SEQ ID NO: 1552 - DNA, 653 bp, Artificial
  Synthetic
agcgctcgtctttctccgtcgtcgttttccggtgaacagctgtttaggaatggcgaacccccgtgtgttttttgacatcaccatcggcggcaaccctgcaggccgcatcataatggagttgtatgcggacaaggttccaaggacagcggagaacttccgtgccctctgcacaggtgagaagggaattggaaagagtgggaagccactccactacaagggtagctccttccacagggttatcaacgacttcatgtgccagtgtggtgatttcacgcggggggatggaacaggtggagagtccatctacggggccaagtttgccgatgagaacttttcgtgcaagcacactggtccaggcatcctctccatggccaatgcaggaccaaacaccaatggctcccagttcttcctttgcaccgtcccctgtgcatggcttgatggaaagcatgttgtcttcggcaaggtcgaaaatggaatggacgttgtcaagactattgagaaatacggatctgggagcggcaagacgaaagcccctgttgtcgttgctgactgtggccagctctcttgaagtatggttggtggctccccttagaagaataacctcttccccccctctaataagttttggagcctattcttcgctaagctttata

SEQ ID NO: 1553 - DNA, 246 bp, Artificial
  Synthetic
cccacgcgtccgacagaacctaatcttcttctccaatcaatctcagagaaaaaaagaaatggcaacaaaccctaaagtctacttcgacatgaccgtcggtggcaaatccgccggtcgtatcgtgatggagctttacgccgacacaacaccagaaaccgccgagaatttcagagcactctgtaccggagagagaggaatcggtaaacaaggtaagccattacactacaaaggatcaagctttcaccg

SEQ ID NO: 1554 - DNA, 350 bp, Artificial
  Synthetic
cccacgcgtccgggccaatgctgggagagacacaaacgggtcccagtttttcatcaccactgtaaccaccagctggttggacgggaagcacgtcgtgttcggtaaggtgctgtctggaatggatgtggtttacaagattgaagctgagggccagcagagtgggtcaccgaagagcaaagttgtcatcgcggacagcggcgaactgccgatgtaatgagctgaaatgatgtttcactgaagctactgctactgcttctcgttgtagaactgttattagctgctctgttttgctatgcttctaccccgaatctggttggagtaaatttctgttagactataacagcgtgctt

SEQ ID NO: 1555 - DNA, 757 bp, Artificial
  Synthetic
cagcgaaaacctcactgaaaaatctagagagatggcaaacccaaaggtgttctttgaccttactatcggcggcacaccagctggccgtgtggtgatggagctctttgccgacaccgtacccaagacggcggagaacttccgtgctctctgcaccggcgagaaaggcgtcggaaggatgggcaagcctttgcactacaaaggttcaaccttccaccgtgtgatcccagggttcatgtgtcaaggaggtgatttcaccgccggaaacggtaccggaggtgaatcaatctacggcgccaaattcgccgacgagaacttcaaaaggaagcacaccggccctggagtcctctccatggctaatgctggacctggaaccaacggttctcagttctttatctgtaccgctaagacagagtggctcgacggcaagcacgttgtgttcggtcaagttgttgaaggctatgatgcgattaagaaggctgaggctgttggatctggatctggcaggtgctccaagcctgttgtgattgctgactgtggtcaactctgctaaatctgaggacgttgatgatgatctagtttatctatatttaagtcgccgtttttggctttgtttttaatttaaatctatcagttactgcttgcttactgtggttctagttctagggttgtgctgtaattggtattggttctacttctaccagtttatgtttaatcttaagactatggtttaaataagataatactcttgttttctctg

SEQ ID NO: 1556 - DNA, 498 bp, Artificial
  Synthetic
  misc_feature (408)..(408): The residue at this position can be any nucleotide.
ttgatcctaaccctgatcctaaccttcattctagctctaaacctgtgctcgaatggcggatccgggtgctagtcgaatgcagtaccggagcttgggccgaactgcgctgaaggttagcgctctctcttacggagcttgggttagcttcggaaaccaagtcgacgtggatggggcgaagactctcctctcagcttgccgtgcgcacggtgtgaacttcttcgacaatgcggaggtgtacgcggaggggcgtgcggaggagatcatggggcaggccataaagggagcttgggtggaagcgctcggacttcgtcatctctaccaagctcttctggggcggaacccggacccaatgacaaaggtctctcccgaaaacacatcattgagggtgttaaggcctccttagcccgnctcaaaatggactacgttgacgtcctcttctgccaacgacccgatccctccaacccgattgaggaaaccgtccgtgctatgaacttcgtt

SEQ ID NO: 1557 - DNA, 612 bp, Artificial
  Synthetic
ccgattctcgatctctctctcgctgcagaggcaaaccaacctcaccgtcgacgaggaagaaggcggcggcggcggcggaggcggaggcggaggcggcgaagatgcagtacaagaaccttgggaggtcggggctgcgggtgagccagctgtcgtacggggcgtgggtgacgttcggcaaccagctggacgtgaaggaggcgaaggcgctgctccaggcgtgccgcgacgccggcgtgaacttcttcgacaacgccgaggtgtacgcgaacgggcgcgccgaggagatcatggggcaggcgatgcgggacctcgggtggcgccgctccgacgtcgtcgtctccaccaagctcttctggggagggcagggccccaacgacaagggcctctcccggaagcacatcgtcgagggcctccgcggctcgctcaagcgcctcgacatggactacgtcgacgtcgtctactgccaccgccccgacgccaccacccccgtcgaggagaccgtgcgcgccatgaactgggtcatcgaccacggcatggccttctactggggcacctccgagtggtccgcccagcagatcaccgaggcgtggagcgtcgccaaccgcctcgacc

SEQ ID NO: 1558 - DNA, 636 bp, Artificial
  Synthetic
cccacgcgtccgcccacgcgtccgcccacgggtccgcccacgcgtccgcccacgcgtccggcgaaggcggcgaagatgcagtacaagaacctggggaggtcggggctgcgggtgagccagctgtcgtacggggcgtgggtgacgttcggcaaccagctggacgtgaaggaggcgaaggcgctgctccaggcgtgccgcgacgccggcgtgaacttcttcgacaacgccgaggtgtacgcgaacgggcgcgccgaggagatcatggggcaggcgatgcgggacctcgggtggcgccgctccgacgtcgtcgtctccaccaagctcttctggggagggcagggccccaacgacaagggcctctcccggaagcacatcgtcgagggcctccgcggctcgctcaagcgcctcgacatggactacgtcgacgtcgtctactgccaccgccccgacgccaccacccccgtcgaggagaccgtgcgcgccatgaactgggtcatcgaccacggcatggccttctactggggcacctccgagtggtccgcccagcagatcaccgaggcgtggagcgtcgccaaccgcctcgacctcgtcggacccatcgtcgaacagcctgagtacaacctcttctcgcgccac

SEQ ID NO: 1559 - DNA, 1079 bp, Artificial
  Synthetic
tccatcccaaattctcatattccccacttttactcctttctccttcccgtttcttccttttaaaacaacaaatcttcatttcctcttttttcttcttgatttgccccccaaaaaacgaaaaaaagtgcaaatgcagtacaagaatttaggcagatcaggcctaaaagtatctcaactttcatacggagcatgggtcactttcggcaatcaactcgatgtcaaagaagctaaatccctcttacaaaaatgtcgtgaccacggtgtcaatttcttcgataacgccgaggtttacgctaatggaagagcagaagaaattatgggtcaagcaattcgtgaattaggttggaaaagatcagatattgttatatctactaagattttctggggcgggtcgggtccaaatgataagggtttatcgaggaaacatataatcgaagggacgaaagctagtttgaaaagactggatatggcttatgtggatttgatttattgtcataggcctgatgctagtacacctattgaagaaactgttagggctatgaattatgtgattgataaaggttgggctttttattgggggacaagtgaatggtcagctcaacagattactgaagcttggggtgttgctcaaagattggatcttgtgggtcccattgttgaacagcctgagtacaacttgttgtctaggcacaaggttgaatctgagtacctccctctgtatagcaactatggcattggtcttaccacatggagtcctcttgcttcaggcgttctgactggaaaatataatgcagggaacattccagcggacagtcgatttgcactggaaaattacaagaatttagccaacagatctttggtggatgatgtgttgaggaaagtagatggattgaaaccaattgctgaatcactaggtgtacctctgcctcaactggcaattgcctggtgtgctgcaaatcctaatgtctcatccgttattactggtgccaccaaagagtatcagattgaagagaacatgaaagctatcaatgtcattccaatgttaacacctgctgtgatggagaggattgaggctgttg

SEQ ID NO: 1560 - DNA, 319 bp, Artificial
  Synthetic
cccatcgtccgtatgggtcaagcgattcgtgaactgggttggcgtcgatccgatatcgtcatctctaccaagatcttctggggtggtcctggtcctaacgataagggtttatctaggaaacatatcgttgaaggcactaaagcttctctcaaacgacttgatatggattacgttgatgtgctctattgccacaggccggatgcttcaactcctatcgaagagactgtgagggcgatgaactacgtgattgataagggttgggccttctattggggaaccagtgaatggtcagctcaacaaattacggaggcatggggag

SEQ ID NO: 1561 - DNA, 439 bp, Artificial
  Synthetic
tctttagtgtcttttatgctggagtggtggcctcagggatagcattcgctgtacagatatggtgcattgacagaggtggcccagttttcgttgctgtttatcaacctgttcagactcttgtagttgctattatggcttccgtcgctttgggtgaagagttctacttgggagggatcattggagcagtgttgatcataacaggattgtactttgtgctatggggcaaaaacgaagaatccaaatttgcaaaggcagcagctgctgcaattcagtctccagtggatcattgtaacaacaacaggccaactagccatatcaagtcctctttggctcagccactgcttgcttcttcaactgaaaatgcttaaacaagaaaagtttactgcaaaccagaaaataagatctgctatcctaaatattaaggaagaaaagaaaaagg

SEQ ID NO: 1562 - DNA, 748 bp, Artificial
  Synthetic
ccaaaacagagggagagaaaaaaaaaagaaggaaaaataaggcaaaaatcatgtctgatgaagaacaccattttgagtcaaaagcagatgctggtgcctctaaaacttaccctcaacaagctggtaccattcgtaaaaatggttatatagttattaaaggcagaccctgcaaggttgttgaggtctccacttcaaaaactggcaagcacggacatgcaaaatgtcactttgtagcaattgatattttcaatggaaagaagcttgaagatatcgttccttcctcccacaactgtgatgtgccccatgttaatcgtaccgactatcagctgatagacatctctgaagatggttttgtgtctcttcttactgaaaatggaaacactaaagatgacctcaggcttcccaccgatgaagccctgctgagccaggttaaaggtggatttgaggaaggaaaggatcttgtgttgtctgtgatgtctgcaatgggtgaagagcagattaacgctgttaaggacattggtaccaaaaactagtttgcgctttctgcaacataaataatctgctttagccaagactttttatatcttaatcgttgtcgtactttgatgtccattgattatgaactcgacttatatcctattggcatggcttgaatagttggactttatagtttgtctggtaagacaaagaattggatttgatagcaaagtgagatctacatgaatgtcacttatccccggtttctatc

SEQ ID NO: 1563 - DNA, 572 bp, Artificial
  Synthetic
gcgcctccctctctctcgctcaccgcctccttctcctcgcgatctatccaaacaaggggctcgctaagatcggcatgtcggactctgaggagcaccatttcgagtcgaaggccgacgctggggcgtccaagacctatccccagcaggccggaaccatccgcaagaatgggtatattgttatcaagaaccgcccctgcaaggtggtggaggtttctacctcgaagactggtaagcacggtcatgccaagtgtcactttgttgccatagatatattcaatggtaaaaagcttgaggatattgttccttcgtcccacaactgtgatgttccacatgtgaaccgcacagagtaccagctgattgacatatcagaggatggattcgtgagccttcttactgagagtggtaacactaaggatgatcttagactcccaactgatgacagtctcctgggtcagatcaagactggatttggtgaaggcaaggatcttgttgtgactgtcatgtccgccatgggggaggagcagatctgtgcgctgaaggacattggccccaagtaactccctcaagtggaa

SEQ ID NO: 1564 - DNA, 669 bp, Artificial
  Synthetic
gcgatcgcgtctctcccatcctctcgcgcatcctcctccgactacctcggttgggttttgggggcggctggagatgtcggactccgaggagcaccacttcgagtcgaaggccgacgccggcgcgtccaagacctacccgcagcaggctggtactattcgcaagaacggtcatattgtcatcaagaaccgcccatgcaaggttgttgaggtctccacctccaagactgggaagcatggacatgcaaaatgccactttgtggccattgacatcttcaatgggaagaagcttgaagatattgtgccctcctcccacaactgtgacgtcccccacgtgaaccgtactgattatcagctgattgacatttctgaagatggatttgtatgtttctttagtccttttagctatctcttgattatttctcttttagctatctcttgattatttctgaagatggatttgtatgtttctttagtccttttaagatggatttgtatgtttctttagtccttttaagatggatttgtatgtttctttagtccttttagctatctcttgattatttctgaagatggatttgtatgtttctttagtccttttagctatctcttgatttggctcttggtattatttagtctggaatgcacgtctcacacattccacagggtcag

SEQ ID NO: 1565 - DNA, 595 bp, Artificial
  Synthetic
cgggaaccctagtcgccggatcgcgtctctcccatcctctcgcgcatcctcctccgactacctcggttgggttttgggggcggctggagatgtcggactccgaggagcaccacttcgagtcgaaggccgacgccggcgcgtccaagacctacccgcagcaggctggtactattcgcaagaacggtcatattgtcatcaagaaccgcccatgcaaggttgttgaggtctccacctccaagactggaaagcatggacatgcaaaatgccactttgtggccattgacatcttcaatgggaagaagcttgaagatattgtgccctcctcccacaactgtgacgtcccccacgtgaaccgtactgactatcagctgattgacatttctgaagatggatttgtcagcctcctgactgaaagtggaggcactaaggatgacctgaggctccctagtgatgaggctctgcttactcagatcaaggatggattcgccgaggggaaggatctgattgttaccgtgatgtctgccatgggtgaggagcagatctgcgctctgaaggatattggccccaagaactagaataccttgttaccgtgttt

SEQ ID NO: 1566 - DNA, 508 bp, Artificial
  Synthetic
ctctctctcgctcaccgcctccttctcctcgcgaggtatccaaacaaggggctcgctaagatcgccatgtcggactctgaggagcaccatttcgagtcgaaggccgacgctggggcgtccaagacctatccccagcaggccggaaccatccgcaagaatgggtatattgttatcaagaaccgcccctgcaaggtggtggaggtttctacctcgaagactggtaagcacggtcatgccaagtgtcactttgttgccatagatatattcaatggtaaaaagcttgaggatattgttccttcgtcccacaactgtgatgttccacatgtgaaccgcacagagtaccagctgattgacatatcagaggatggattcgtgagccttcttactgagagcggtaacactaaggatgatcttagactcccaactgatgacagtctcctgggtcagatcaagactggatttggtgaaggcaaggatcttgttgtgactgtcatgtctgccatggggg

SEQ ID NO: 1567 - DNA, 777 bp, Artificial
  Synthetic
gatcctcctctccctaaacttctctccggtgaagtgtaaacaaagaatagtacatcaaatcaaccatgtcggacgaagagcaccactttgaatcaaaggccgacgccggagcttcaaagacgtatcctcaacaagctggtactattcgtaagaatggtcatatcgtcatcaaaaaccgcccttgcaaggttgttgaagtttccacttccaagacaggcaagcacggtcatgctaaatgccactttgtggctattgacatttttactggaaagaagcttgaagatattgttccctcttctcacaactgtgatgttcctcatgtgaataggactgactatcagcttattgatatctctgaggatggatttgtgagtctgttgaccgaaaatggtaacaccaaggatgacttgaggctcccaactgatgataatcttctggccctgatcaaagatggttttgctgaggggaaggacctggttctgtcagtgatgtctgccatgggagaggagcagatttgtggtatcaaggacgttggccccaagtagctgcaggaggtggtggtgtatgttataaagtttcaaaaaaagctgtatcaaagctatgtagaagtaccaaaacttctttactttttgttattccagataactgttattcaaccatatggtatgactggattcttgtgtccactacgtgtttcctgttttctgatattgctacctgttagtctgtctgcgtgaaaagctctgtttctgcattataaagatagatttctggttt

SEQ ID NO: 1568 - DNA, 791 bp, Artificial
  Synthetic
tctgactcctctgcattacactactactttcgaatctctagctccccccttaaatcaaaaaagtttaatcaaaaaattttcaatttccagtgatgtcggacgaggagcaccactttgagtcaaaggcagatgccggtgcatctaaaacttaccctcaacaagctggtactatccgtaagaacggtcatatcgtcatcaaaggccgtccctgcaaggttgtggaagtctcgacatccaaaaccggaaagcatggtcatgcaaaatgtcattttgtcgctattgacatcttcactggaaagaagcttgaggatattgttccctcttcacacaattgtgatgtgccccatgttaatcgtacagattatcagcttattgacatctctgaagatggatttgtgagtctgctcactgagaatggtaacaccaaggatgatcttaggcttcctactgatgacaacctccttacacagatcaaggatggttttgctgagggaaaagaccttgttgtgtctgtcatgtcagccatgggcgaggagcagatttgtgccctgaaggatattggtcccaagtaaatctctcgattggagattgttcgatgcgaagttctttacaaccttaagtttgatagatattatagtcatggaaaaggtatggtcttatggaccaacttgttcaagaatattcttcaggattctcggaccattgcgagttagattttggtatttttgttattttaacttgtgttcgtctgaatttgttctaccttaaaagctttttcaaaaaaaaaaaag

SEQ ID NO: 1569 - DNA, 579 bp, Artificial
  Synthetic
gagaaagagagagagaaagatgtcggacgaagagcaccattttgagtcaaaggcagatgcaggtgcctccaaaacttaccctcaacaagctggtactattcgcaaaaatggttatatagtcatcaaaggccgcccctgcaaggttgttgaggtctccacttcaaagactggcaagcacggacatgctaagtgtcactttgtggcaattgacattttcaatggaaaaaaacttgaagatatcgttccttcgtcccacaactgtgatgtgccacatgtcaatcgtacggactatcagctgattgacatctctgaagatggttttgtctcccttcttactgaaagtggaaacaccaaggatgacctccggcttcctactgatgaagctctgctgaagcaggttaaagatgggtttcaggaaggaaaggatcttgtggtgtctgttatgtcagcaatgggggaagagcagattaatgccgttaaggacattggtaccaagaactagttgtctctgcaaacttaaatcgattgctattgttaagacattattatatcctaatgtcgtacttcgatatcacttga

SEQ ID NO: 1570 - DNA, 790 bp, Artificial
  Synthetic
ccccccggcgcgtggtcaacgagggggcgcggggcaacgggcggtaggcggcgtccagcagcgggcggcgggcggcggcggctcggcttcctcggctcggcggccgacaaccacgacggcagcggtgggagcgccgccgccgccgacgccgccgcgaccacctctcgcaaggggattttgtaggggtttctgatccgaggagcgggcgatgtcggactccgaggagcaccacttcgagtcgaaggccgacgccggcgcctccaagacctacccgcagcaggctgggaccatccgcaaaaatggctacatagtcatcaagaaccgcccctgcaaggttgttgaggtttcaacctctaaaactgggaagcacggtcacgccaagtgccactttgttgcaattgacatctttactgccaagaagctcgaagatattgtgccatcttctcacaactgtgatgtcccgcatgtgaaccgtacggagtaccagctcattgatatatctgaggatggatttgtgagtctgttaactgaaaatggcaacaccaaggatgacctcaggctccctactgatgataacctacttagtcagatcaaggatggatttggagaagggaaggacctggtggtgactgttatgtctgccatgggagaggagcagatctgcgcgctgaaggacatcggcccgaagtaaacctcacctgttccatgtgattactactgaactttcagttatgatcggtttgggtatgtaggaacaaggattctcttaaaacatacagagtcacaacca

SEQ ID NO: 1571 - DNA, 755 bp, Artificial
  Synthetic
gaattcaaaaagctctgtgaatctcattcatcttggtcatcatgtctgacgaagagcatcatttcgaatcaaaggccgattcaggagcttcaaagacttaccctcaacaagctggtaccatccgtaagaacggacatatcgttatcaagggcagagcctgcaaggttgttgaagtttcaacctccaaaaccggcaagcacggtcatgctaagtgtcactttgttgcaattgatattttcaatggcaagaagcttgaagatattgtgccatcttcccacaattgtgatattccacatgtcaaccgtactgattaccagttgattgatatctctgaggatggatttgtgagtctcctcactgataatggtggcaccaaggatgatttgaagctacccactgatgatgttgttcttacccagatcaaagaaggttttgcagagggaaaagaccttgtgttgtctgttatgtctgccatgggagaggagcagatctgtgctgtcaaggacatttctggatccaaatagagaagaactcttagactttattactgcagtctctgtttgttacttcatatggggagaagatgtgagctttaagttaatgagtggctattattactgctatctttctgttttaggcagacaagatcatataattattagtttttcatgggatgctttcttttctttattttaattttggtgggtttggtttgcttgagacacacattatcacaagtataccttttattaata

SEQ ID NO: 1572 - DNA, 457 bp, Artificial
  Synthetic
gccttgtttgtctttctctggagtagtaatgtctgacgaggagcaccagtttgagcacaaggccgacgctggggcgtctaagacttttcctcagcaggctggtaccatccgtaagaactcccacatcgtcatcaaatctagaccttgcaaggttgttgaggtatccacctcgaagactggaaagcacgggcatgcaaagtgtcactttgtcgcgattgatatttttaccggcaagaagctagaagatattgttccatcttctcacaattgtgatgttccagaggtcgtccgcactgattatcagcttattgacatttcagaagatggatttgtgagccttctcactgacaatggcagcacgaaggatgacttacgccttccctcagatgagcagcttcttacgcagatcaaggaaggttttgcagagggcaaagatattgtggtgactgttatgtct

SEQ ID NO: 1573 - DNA, 667 bp, Artificial
  Synthetic
gcggtgttggtggtggaggggggttcggggttcgagatgtcggatgaggagcaccagttcgagcacaaggcagacgcaggggcctccaagaccttcccccagcaggccggtaccatccgtaagaatgcttacatcgtcatcaaaaatcgcccttgcaaggttgtagaagtgtcgacctctaagactggaaagcatggccatgccaaatgtcactttgtggcgattgacatcttcactggcaagaagctcgaagatattgtcccttcctctcacaattgtgatgttccggaggtgactcgcactgattatcagctcattgacatttctgaagatggatttgtgagtcttcttcaagagaatggcagcacaaaggatgatctgcgtgttccaactgatgaaactctcctggtgcagatgaaggagggttttgcagaaggtaaagatcttgtggttactgtgatgtcggccatgggagaagatcaaatctgtgccttgaaggacattggaccaaaataggtctgttcaaaccttgactaagatcccgtgtggtgctccttgtgtggtagagggtgtgtaggatgaactctttcaactcttagttgctttaatgtggataagaccaattggcctctcaaataaaagagaaggatatactggtttagaatat

SEQ ID NO: 1574 - DNA, 768 bp, Artificial
  Synthetic
gatttcttctgtgctataattgggcgagttctcggggtctctttcttcctcttctccctctctctctctctctctctgatcacgagtggttctctctctctctgatcaggagtggtcccttgcctgcctgtctgtctctctctctcccagagtgaagatgtctgatgaggagcaccaattcgagcacaaggcagatgccggtgcctcaaagaccttcccccagcaggctggtaccatccgtaagaactcccatatcgttatcaaaaatcgcccctgtaaggttgtagaagtttccacctcaaagactgggaagcacgggcatgctaagtgtcactttgttgcaatcgacatctttactggcaagaagttagaagatattgtgccatcctctcacaattgtgatgtcccagaggttgttcgtactgattatcagcttattgacatttcagaggatggatttgtgagccttcttactgacaatggaagcaccaaggacgacttacgtctgccctctgatgaacagcttcttgcacagttgaaggaaggttttgctgaaggcaaggatcttgtggtgtctgtcatgtctgccatgggagaagatcaaatttgtggactgaaggatgttggtcctaaatagttatttagctcagttaatctaaggtcatacatacatacatacctcatcttgtttaatgtgtggcattaattgataagttggagagcttaaaagtgtagtaagaccgctgcctctttgaattcgtataatct

SEQ ID NO: 1575 - DNA, 759 bp, Artificial
  Synthetic
ttaagaataacatctcataagaaactttgaatgtttcaacacaaacttttccaacaatccaaaaccaatagatatggttgtcttgcaacaagaaacacacacaaagggtctaaattaggaaaaagaaaaacatcttttggttcttataacattgacgtccgttgtcaaactggtaataatatatcgaatgatacttgtttacttgccaccaccaacttccttgacggcacagatctgctcctctcccatggaagacatgacagacaccacaatatcctttccctcatcgaatccaagcctcatctgggcggtgagaccatcatcggtgggaagcttgagatcatccttggtgccaccactgtcagtgagaaggctcacgaagccatcctcagtgatatcaatcaactggtaatcaacacggttcacatgtggaacatcacaattgtgggaagatggaacaatatcttcaagcttcttagcagtgaagatatcaatagcaacaaagtgacatttggcgtgaccgtgcttgccagttttggaagtcgaaacctcaacaaccttgcagggacggtttttgatgacgatgtgaccacctttacggatgttaccggctgattgaggataggtcttggaagctccggattcgctggcctcaaagtggtgctcgtcgtcagacatgttttcacagaaatttgagagaagaaaggttttcggagaagatgagattgggagaagggaaaaaaaacccggacgcgtggg

SEQ ID NO: 1576 - DNA, 614 bp, Artificial
  Synthetic
cccacgcgtccgctttctctctgaaatctcaaattcatctcttctcttccgatttcgctgaatcatgtcagacgacgagcatcacttcgaatccagcgacgccggagcttctaagacttatcctcaacaagccggtaacattcgtaaaggtggtcacatcgtcatcaagggacgtccctgcaaggtggttgaggtatcgacttcgaagactgggaagcatggtcacgccaagtgtcactttgttgccattgatatctttacttctaagaagcttgaagatatcgttccttcttcccacaattgtgatgttccacatgtgaatcgtgttgattatcagttgattgatatctctgaagatggctttgttagtcttcttactgataatggtagcactaaggatgatctgaagctgccaacagatgaagctttactcacacagctcaagaatggatttgaggagggtaaggatattgttgtgtctgtcatgtctgcaatgggagaggagcagatgtgtgctctcaaggaagttggtcccaagtaataataataagtaagcattctctcttttacagaggctatgtattatcaagtttgacagagtcaaatgttataag

SEQ ID NO: 1577 - DNA, 607 bp, Artificial
  Synthetic
aagaaaaaatggctgacgaagaacacacctttgataccgttaacgccggtgcttcccagacctaccccatccagtgctccgctctgcgaaagaacggtcacgtcgtgatcaagggccgaccctgcaagatcattgacatgtccacctccaagactggtaagcacggtcacgccaaggtccaccttgtcgccaccgatatcttcaccaacaagaagcttgaggatctgtccccctccacccacaacatggaggtccccaacgtcaagcgagaggagttccagctcatcgacattgatgatggtttcctgtctctcttcaccgccgacggttccaccaaggacgatgttcctcttcccgagggtgagatcggagacaagatccagaccgagttcgacgagggcaaggatctcattgtcactgtcatctctgccatgggcgaggaggccgtcatctcctacaaggaggcccccaagggtaactaatcgcatctctgacttgtttttactataaaaagttgttggttttgagattatatatatgctgtccactgagctgttggtgacggtagttgtaccttagtagtcatgtagtaatgaagctatgtacc

SEQ ID NO: 1578 - DNA, 632 bp, Artificial
  Synthetic
agttagggttggggccagcagcggcgacaatgtcggacgaggagcatcacttcgacaacaaggcggatgccggcgcctccaagacctatccccagcaggcgggcaccatccgcaagaatgcctatatagtgatcaagcagcgcccctgcaaggtcgttgaggtgtcgacttccaagacgggcaagcacggccacgctaaatgccacttcgtggggattgacatcttcaccgggaagaagctcgaggatatcgtcccgtcatcccacaactgtgatgtcccggaagtcacccgcaccgactaccagctgatcgatatctcggaagacggatttgtgagcctgctcactgagaatggtgacaccaaggatgacctccgtcttcccaccgatgaccagctcaacgggcagatctcctccgggttttcggaaggcaaggacctggtcgtgaccgtcatgtctgctctgggagaggagcagatctgcgccatcaaggacatcgggcccaagtagcccagcgcgcagcatcaaaagccgaggaccactggttttgtacctgcctttttaagtcattttactctatagttcgttcgttttccttgcaaccttgttgtaaccagtgggggacgttctttt

SEQ ID NO: 1579 - DNA, 688 bp, Artificial
  Synthetic
acgcgtccgcggacgcgtgggtctctcccactcctccggattctttctgttcttggttgattgccggagatgtcggattcggaggagcatcacttcgagtccaaggccgacgccggcgcctccaagacctacccacagcaggccggcaccatccggaagaacggatatattgtcattaagaaccgcccctgcaaggtggttgaggtctctacttccaagactgggaagcatggtcacgccaaatgccactttgttggtattgacattttcaatggaaagaagcttgaagatattgtcccctcatcccacaactgtgacgttcctcatgttgatcgtactgattaccagctgattgacatttcggaagatggatttgtgagccttttgactgagagcggcaacactaaggatgacttgaggcttcccactgatgatactctgactaaccagatcaagaacgggtttggtgaagaaggcaaggatatgatcttgactgtgatgtccgccatgggtgaagaacagatctgtgccgtcaaggagattggggccaaaaactaagcggctttgctcgattgcctgcctgcctacgatactttgctatcttagtgttgagagctgagacacataaatagaagtttttttatgctacctgtggatgaaatgacgatcaaaaccttcatcgatttta

SEQ ID NO: 1580 - DNA, 598 bp, Artificial
  Synthetic
caaaacgttacaatggcttctaaggctcttgcagttacagctcttcttattacacttaatcttcttttcttcacctttgtaacctccacaaaatgtccaccaactactcctaaacccccaaaaaccccgaaatcgcctaagaaggctcctgccgtgaaacccacttgtcctaccgacacacttaagcttggtgtttgcgcagacttattgggcctagttaacgttgttgttggttctccaccaaagactccttgttgtacacttcttcaaggtcttgctaatcttgaagctgcggtttgtctctgcaccgctcttaaagccaatgtcttggggattaatctcaatgttcctattgatctaaccttgctgttgaactattgtggcaagaaagttcctcatggtttccaatgttcttgaagatttgagactttaaaagagaaaaatctctttggtttgctatgtttttatatgtttgtttctactgttatctattggttttgtgagaaaaagctttgttctgtcactgttgagtttgatgtaatgcttgagcttgttcatgatagaacctttgttctctcaatattgagtttgatgtaat

SEQ ID NO: 1581 - DNA, 608 bp, Artificial
  Synthetic
acttcataaaatcaatttttgttaattaaaaaaatggcttctaacaaggttttctctactcttgctattttccttacttttaacctaatttttttcacatttgtttctggttgtggaacttgtcctaaaccaaaaccgccaccaaaacctaagccttcttgtcctcctcctccatatgttccaaaaaaggaaacttgcccaattgatacattaaaattaggtgtttgtgctaatgttcttggattagttaatgttgttgttggttcaccaccagtgaaaccttgttgtagtcttatttcaggacttgccgatgttgaagctgctctttgtctttgtactgctattaaggctaatgttttaggcattaatcttaatgtacctgtctcattgagtttgcttcttaatgtttgctccaagaatgtcccttctggcttccaatgtcctacttaattgaattaaacgacagttcagtgcacaaagtatctcgcgctgactcagaagtcagataagagttaaaaattcaaagtttatctcattgtttgtattttctttgagggttttctatttttcatgtcaatttttctttttggagtttggggtgggggtgg

SEQ ID NO: 1582 - DNA, 578 bp, Artificial
  Synthetic
gtcacagtagtgagtgcatgcagtacttgcccaggccctaaacctaaacctaaaccaaagccaaagccaaagccatgcccccctcctccttcttctcatggtggcaaatgcccaactgatgccttaaaactaggcgtttgcgctaatgtgcttaacggtttgctgaatgttaccctgggaactcctccagtaaaaccatgctgcagtcttattggaaatcttgtggatttggaggctgctgtctgcctttgcactgcccttaaggctaacattttgggcatcaaccttaatctccctatttctcttaacttactgctcaatgtttgtagtaagaaggctccaaagggattcacttgtccctaaatggttctctcgcttttcgtttttcttctgaagttggtttttgattttcatttgtttagcagtttgtgatgttcgatttatctcctgcattaaacttcttgttaggtgcaaggttgtggtttgttttggattgatcattgttggaaagcgcttttgtaaggccaattgtttgtgtaccctttggaaataaatatatttcttggatgattctctct

SEQ ID NO: 1583 - DNA, 601 bp, Artificial
  Synthetic
gtagccctgtgtgcaacggcgcaagtgcttgtacgctttcagctagcgtagccatggcttccagggcattcctcctcctggctctaaatctggtcctcttcttcaccgtggccagcgcctgcggcaagtactgcccgacgccttcgacgccgtcgacgacgccatcgacgccgtcctacaacaccaagtgccccaagaacgcgctcaagttcgcggcgtgcgccgacgtgctgggcctcgtcagcgccgaggtcggccagccgccgtacgagccgtgctgcggcgtcctcggcggcctcgccgaccttgaggccgccgtctgtctctgcaccgccatcaaggccaacgtgctcggcatcaccctcgacatccccgtcaagctcagcctcctcgtcaactactgcggcaagaacgtccctagtggcttcatctgtgcttaagctacgtaacgcgcgtacggtgtaacgacgtgctagctttgcatgcatgcagcacgcatgcacgaacacatcgttcgttcttgagtgcctgcatgcatatcggtcgagtctttacttactctgttattagttctgaatgtagaactgcttcagatatcaat

SEQ ID NO: 1584 - DNA, 642 bp, Artificial
  Synthetic
caacatttcactaattagccacattcaattgttgagagtgctaactatttaactcttagaaatggctaagtttgcaatatcctccattgcccttcttctcactttgaacattgtcttcttaactatggttagttccactaatgtcccatgcccacccaccccatcaaagggtcattccaagccccaccctaagcctacccctaccccctctatcccatccaccccatcaactccatcatcaaaaggtaagtgcccaaaggacacacttaagctaaaagtgtgtgccaacttattgaatgacttggtgcaccttgttattggaagtgatccagccaagactccttgttgttctctaattcatggacttgctgatcttgatgctgctgtttgcctttgcactgcaattaaagccaatttattgggaattaacctcaacgtacctctttccctcagtttgttgctcaacaactgtggaaagtatgttcctaaggatttccaatgcgcataaactagctagccaataactttctccctgcagaaaatttccacttcatatatttatttttcagtgtgtttaatttggtattttgtatgcttatagtttgcttatgttttcaaaggaagatatattgtattctaatt

SEQ ID NO: 1585 - DNA, 761 bp, Artificial
  Synthetic
agcaaatatcaaaaagcagctccagcttcttctgatcgatcgatcgagctgagctataggcagtagctgctaattaagctaattaattgctaagcagtagtagagctagctaattaattaagatggccggcaagaaggtgcaggtttgtgcgctgttccttgccctcaatgtgctcttcaccatgcagatgggtgcagtagtgcaggcatgcgagccctactgccccacaccgacgccgccggtgacgccgcctccgtcgccgccgtcgggtggagggaataagtgcccgatcgacgcgctgaagctgagcgtgtgcgccaacgtgctcaacctgctgaagctgaagatcggcgtgccggagagcgagcagtgctgcccgttgctgggtggcctcgtcgacctcgacgccgccgtctgcctctgcaccgccatcaaggccaacatcctcggcatcaatctcaacatccccgtcgatctctctctccttctcaactactgccacaagacctgcccctccgacttcacctgccctctctaaattaatcgatcctccgatcccttaattaccataccattacaccatgcatcaatatccatatatatataaaccctttcgcacgtacttatactatgttttgtcatacatatatatgtgtcgaacgatcgatctatcactgatatgatatgattgatccatcagcctgatctctgtatcttgttatttgtataccgtcaaataaaagtttcttccacttgtgtt

SEQ ID NO: 1586 - DNA, 600 bp, Artificial
  Synthetic
cccccccgacctctctctagttgcagaccatcacttacgtagccctgtgtgcaacggcgcaagtgcttgtacgctttcagctagcgtagccatggcttccagggcattcctcctcgtggctctaaacctggtcctcttcttcaccgtggccagcgcctgcggcaagtactgcccgacgccttcgacgccgtcgacgacgccatcgacgccgtcctacaacaccaagtgccccaagaacgcgctcaagttcgcggcgtgcgccgacgtgctgggcctcgtcagcgccgaggtcggccagccgccgtacgagccgtgctgcggcgtcctcggcggcctcgccgaccttgaggccgccgtctgtctctgcaccgccatcaaggccaacgtgctcggcatcaccctcgacatccccgtcaagctcagcctcctcgtcaactactgcggcaagaacgtccctagtggcttcatctgtgcttaagctacgtaacgcgcgtacggtgtaacgacgtgctagctttgcatgcatgcagcacgcatgcacgaacacatcgttcgttcttgagtgcctgcatgcatatcggtcgagtctttacttactct

SEQ ID NO: 1587 - DNA, 462 bp, Artificial
  Synthetic
gctgaagctgggcgtgtgcgccaacgtgctcaacctgctcaagctcaaggtgggggtgccggcgagcgaggagtgctgcccgctgctgggggggctcgtcgacctcgacgccgccgtctgcctctgcaccgccatcaaggccaacgtcctcggcatcaacatcaacgtccccgtcgacctcgtcctcctcctcaactactgccacaagacctgcccttccgacttctcctgcccactcatctgattcttaatcttcattaccaccacaaccctagctacctaattaaggcttaagctttgcatggcttagtctgtgtgttgcagttgtgtcatacatatatacttatctcgatctatcagtgtgattattgatgatcagatctatcatctaatatatgtatcttgttattttaatgcgtactgtcaaataaaagtttcctccagtgtacgtacgttctatct

SEQ ID NO: 1588 - DNA, 496 bp, Artificial
  Synthetic
aaaaatctacttataacaactaaagttagtagctatatcattcattaagaaatggcttctaaaaaaactacttctcttgctctctttattcttgtcaaccttctatttttctcccttgtgagtgcatgtggcacttgccctagtcctaaaccaaagccaaagccgaaaccaaaaccaggtcctagcccatccaaaggcaagtgcccaattgatactctaaaattaggtgtttgtgctaatgttttaggcaatttgcttggacttttgattggtaatcctccaaaaaaaccttgttgcactctcattcaaggtgttgcggaccttgaggctgctgtttgcctatgcactgctattaaagccaacattcttgggattaaccttaatgtccctctttctctaagccttcttcttaatgtttgtggaaaaaaggttccatctggcttccagtgtccttgaacagtacaacgtccacatattttgatttgggttttggatt

SEQ ID NO: 1589 - DNA, 612 bp, Artificial
  Synthetic
tcagtattaatacaaaacataaatcctctgcttcgttatggattcaaagagatacttagttactctctttttattctttaacattcttttctttacccttgtaagtggctgctggagtggctgcaataatccaccaactccaaaaccaaattcgaacccgaacccaaatcctaaccctagcccatcaaagggacactgccctagagatgccctaaaactaggtgtttgtgccaaggtgctgaacggacctgtcggagccgtcatcggaactccaccggacatgccttgttgttccgtactaggtggacttttggatcttgaagctgcagtttgcctttgcactgcactgaaagccaacattcttggaataaacattgatattcccattgcattaagcttgcttattaatacttgtgggaaaagtctaccatctgacttcacttgtgcctaagctataatgcttctcttttaaagttcatgttgtattttagttcttcgttgttaggacttaggaatgagcacttgataatttgtacgaagctagggaatgttcttccatctcctttgtaattcactagtgctttctctattgacttgatgaatttctaattc

SEQ ID NO: 1590 - DNA, 665 bp, Artificial
  Synthetic
cccacgcgtccgcccacgcgtccgaattacttctctttacaattgttctaggaagtacattctgccttaacttccttataatatggcttccaaaacaagagcctcaattgcccttttcctctccttcaatctccttttctttgccatagccagtggaacagattgtatctcatgtcattataattctcctagcaccggtaatggtggtggcaatagtggtaatactggtggctcgggcaatggcggcggaggtggcaatggacaaggcacgtgcccgagagatgctctgaagttgggtgtatgcacaaatttagttggtggattggtgggcgcggtagttgggagtcctccaacgatgccatgctgcagcttgatcgcggggctggcggatttagaggcggcagtctgcttgtgcacagccataagggcgaacatgttgggaataaatctgaatgtgccactctctcttagccttgtcctcaacaactgcggaaggaatcctcctaatggcttcacctgctaatccaacgtccccaaatgcgtatttcagccttttgctatgtcagtcatgtactcatgttgtgtttgcatcaattttcctttatgatcatttgtttgctatgttgtgccaattgttattacaataagcgatcgagcttgcaaaa

SEQ ID NO: 1591 - DNA, 664 bp, Artificial
  Synthetic
agaagtaagaaagcagctacgtttacaagcagagatggaggcatccaagctagcaatctgcagcttgttcgtgctcgccgtggtagccgctacaatgtttcactgctccgatgcccagaactcgccgcaggactacctgtcgccgcagaacgcggcccggtccgccgtcggcgtgggtccgatgagctggagcacgaagctgcaggggttcgcggaggactacgcgaggcagcggaagggcgactgccggctgcagcactcgggcgggccgtacggtgagaacatcttctggggctccgccggcgccgactggacggccgcggacgcggtgcggtcgtgggtggacgagaagaagtactacaactacgccagcaacagctgcgccgccgggaaggtgtgcggccactacacgcaggtggtgtggcgcgactccaccaacgtcggctgcgcccgcgtgcggtgcgacgccaaccgcggcatcttcatcatctgcaactacgagccccgtggcaacatcgttggccgcaggccctactgatcatacgacgttgttgcaacaagctatatatatgtgtctagcacgcatgcatcgtccctcgctcgttacatgcacgcgctgtgtgtttgtgttatgtcttaattagagggagtaataataacatta

SEQ ID NO: 1592 - DNA, 152 bp, Artificial
  Synthetic
gtcgagccacgcgtccgcaacacgagacagaaaatggcaccttccaatgtcagtctcgccgggcgtgctcgccgtgggcatctctctggccatggcggccaccatcaccacctcggcgcagaacacgccggaggactacgtcaacctgcaca

SEQ ID NO: 1593 - DNA, 449 bp, Artificial
  Synthetic
cttcgggatcggagtaatgattaatagggacagtcgggggcattcgtatggcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgaccagggatcggcggatgttgcttataggactccgccggcaccttatgagaaatcaaagtctttgggttccggggggagtatggtcgcaaggctgaaacaacacgagacagaaaatggcaccttccaaggtcagcctcgccgccgtgctcgccgtggccatctcgctggccatggcggccaccaccaccacctcggcgcagaacacgccgcaggactacgtcaacctgcacaacagcgcgcggcgcgcggacg

SEQ ID NO: 1594 - DNA, 473 bp, Artificial
  Synthetic
cccccgatctcaaagcaagcaagacgtccgggaagatgaagcgcaccatggctgctacttccatcctgttcttcttcctcgccggcctcgccgccgcccacggcagcacagcggacgacaccacgaccaccaccaccaacaccatacgcctcccgatcgacggagcagtggcggcgcgaaggaggacgaggccgtggaagtgctgcgacaacatcgtgaggctgccggagaggatcaacccgccgttctggcagtgcgacgacgagctggagcccgggcagtgcttccgccagtgcgaggcgtgccgggatccgccggggcggccgttccccggccggccgctcatctgcgacgacgtcttctggggcgacgacccgggcacctcgtgcgcgccgtcgtcggagtggccgtggggcccgtgctgcgacatcgccgtctgcaccaagtcgctccctcccatctgccactgctcc

SEQ ID NO: 1595 - DNA, 638 bp, Artificial
  Synthetic
ccatggctatttccaccatccttctcttcctcctcgccggcctcgtcgccgcccacggcgacggcgacaccatgatccgtctcccaagcgacggcgccgaagcaccaccacgcccgcccaaaccctgggactgctgcgacaacatcgagatgtccccgctcgagatcttcccgccgctgtaccgctgcaacgacgaggtgaagcagtgctccgccgcctgcaaggagtgcgtggaggcgcccggcgacttcccccgcggcgccttcgtgtgccgcgactggtactcgacggtggacccgggccacatgtgcacggcgccggatcagccgacgacgaagaggccgtggaagtgctgtgacagcatcgtgcagctgccgcagaggatcttcccgccgttctggcgctgcgacgacgagctggagcccggcaagtgcaccgccgcgtgcaagtcgtgcagggaggcgccggggccgttcccggggccgctcatctgcgaggacgtctactggggcgccgacccgggccccttgtgcacgccgcggccatgggggaaatgctgcgacaaggccttctgcaacaagatgaacccgccgacctgccgctgcatggacgaggtgaacaagtgcgccgccgcgtgc

SEQ ID NO: 1596 - DNA, 575 bp, Artificial
  Synthetic
tcttagcaactgctgctcatgatggtgttaaacttgggatttacgcaaatgaagaattccgaaatttctctctttatgatgaaaatacaccgactcaatcagtgcaatttgaccatagtggaagttatctggccttaggaggctcagatatacgagttttccaagtcgccagtgttaaggctgaatggaatcacatcaaaaccctccccttcttatcaggcacaggtaaagcaacatgtctgaaatttggtccagatgcaaaatacatagctgtaggatctatggaccgtaatttaagaatatttgggctgcctggcgaggatcaaatggagagttaggctcatttccagcatgaaagcaaacagtcagcgccacagcttcgaatctgctgagaccactgtattatctctaggggagaggttgatgggtcctgttttattatgtaattcttctggtttttgctagatctttgggtggtctggcaaatagacataccaccaacttgggataatatccgaagtgcagggtttatttggtcgtctcaataccatccttgggcagtctattgtatcatt

SEQ ID NO: 1597 - DNA, 182 bp, Artificial
  Synthetic
gccattacggccggggatatgggctgatatttctcttgggttgtataggccaatgtatttgttctgcagtttagtgttaattagtttggaccaaagtgcttatgtataaatagtacatagacccgactcattagatagggaactattattttcttttttcaattaaaatatttggaagcttc

SEQ ID NO: 1598 - DNA, 652 bp, Artificial
  Synthetic
gccattacggccgggggaagatggcactttttatcctttgattatctacaccacaggaaaagcaaagaccaaaattaatttataaaatctatttaaagtaccaaaaatatctttagcagtgaccaaattaagtcgaaaaaaaaatggcaactcctgaagaaaacattgcacctgcagctccaccaccgccggcggcagaaccatcagcggtggaggctttagtgaccactattgaaacagcgaccaaacaggttgaaacaccgaaggaagtcaaggaggagaagaaaggaggagcacaggatctcaagttaacccttttgattccaggggctgtagtagctgttgttggagtagttcttgccattgtcaagaaggtgaaagagtcggctaattgaatgtagatcccttgtatcgtcaactttatatttctgtacattttttccccctttttgtaagacgagcctaaactctttgtcagctttgaagggaaataaataaatttcatatgcttttattataatgacttctacttgtataaatatatgagctctctagcttttattataatgacttctacttgtataaatgtatgagctctcttagcttatatcctcctctctacagggtatttattagaactaaaatgcgatta

SEQ ID NO: 1599 - DNA, 613 bp, Artificial
  Synthetic
aaagaatcaaagggagaaaaaagagatggctgctagttcaacctgccttggcattattagcacaagtgggttaattaacccaagccttgggtcacccatcaacaccaccagggatcgaatcgccctggggctaggccgtcgccctctactcattgtagcaggaagtggcaagaaaaaaatccaaaccaagcagccctttgggccatccggaggtaccaatttcaaggatgggttggatgcatctggccggaaaatgacgggcaagggggtgtaccagtttagcaacaaatatggagctaatgtggatggatatagcccaatttacgactctgatgattggtcaccatctggagatgtttatgtggggggtactggtggcttattgatatgggctataacattaggagcaatcctccttggtggagctcttcttgtgtacaacacaagtgctcttgctcaatagaaaggatttcataatgttaactttcatgagctagtcttggaatgggaatgcacttgttgtaaatatgatatctcctactatgtatcttatatgcttctctagtgtaataaaatacctaatgtgcattcttttagaagccttttttagaac

SEQ ID NO: 1600 - DNA, 606 bp, Artificial
  Synthetic
gccattacggccggggacatttacaggaagaaaagagagtataggaaatggcaagcacagtaatgagcctcaaacctgcagctttcagtgttgagaagacagcagtgaaaggactgccatcacttgctaggtcttcttcttccttcagagttcaagctagtggtgtcaagaagcttaagaccgacaagccttacggaattaatggaagcatgagcttgagagacggcgttgatgcctcaggcaggaagcccaagggaaagggtgtttaccaattcgttgacaaatatggagcaaatgttgatggatacagccccatctacaacacagatgactggtctccaagcggtgatgtctatgttggaggcaccactggcttagccatatgggcagtcaccttggttggcattctggctggaggtgctctccttgttttcaacacaagtgctttggcacagtagatcattatccttgtactcctatttcagttgtattccagctcgcaccatgtatcttttcaagaatactttgtatttgctggcatcttgattaatctgtaattgctgtggatattacacataatgttgattatttaaggtatttgtgatc

SEQ ID NO: 1601 - DNA, 536 bp, Artificial
  Synthetic
gaattcaggcaacaactccattccaagagaaagttgctagcagtattcaaggccttccatccctagcaaggtcggccacttcactcagaatttctgccaatcaagttaagaagatcaagactgacacaccatatggaactggtggtggcatgaacttgaggggtggtgttgacgcatctggaagaaagcccacgggaaagggtgtctaccaatacaccgacaaatacggtgctaacgttgatggatacagtccaatctacaccccagaggaatggtccgaaagtggtgataggtacgctggaggtgtaactggtctagcaatttgggcagcaactcttggtggtattctacttggaggagctctccttgtttacaacaccagtgctctagcttcttagatgtcaatcaaattgttgtaatcccatgtggtagttcctgtgtatgttttcaacaagatttcctaagtaaatggttgtctaatactctcttgtacacccaaaacttattcgtaatttgtatgaatttggttgatgata

SEQ ID NO: 1602 - DNA, 716 bp, Artificial
  Synthetic
ccccccgaccaaaggtttttggcgccacaattatattgagctgccattgcttctcacctctgctttgcatccatccatccatcagagatcaggtagaacagtgagagtgaggtgcagaaaaatttgagctgaagctgaggatggcaacatccatgatcacctcgccgctggtggcgccggcccgggccaagggccttccgtccatctcccgccggggatcctccttcgccatcgtctgcagcggtgggaagaagatcaagaccgacaagccctacgggattggaggtggcatgtcagtcgatattgatgcatctggcaggaagagcacggggaagggtgtgtaccaattcgttgacaagtacggcgcaaacgtcgacggctacagcccaatctactcgccggaggaatggtctcccaccggtgacacctacgttggtggaaccaccgggcttctgatctgggccgtgaccctcgccgggctcctcggcggcggcgccctcctcgtctacaacaccagcgccctcgccggctaaatttcacccaaatccagtctatgtatgtaacaccaagctgggtgtctgcatattcatctgtaatctaagatagccttcctctgaatgcgatgtgatgatgcccactgcttaatcaaactgcattgtgattaatctatgtaacactgtacttgcatgatgatgatatactacacttgatacttg

SEQ ID NO: 1603 - DNA, 712 bp, Artificial
  Synthetic
ccccaaaaaaaggtttttggcgccacaatggtattgagctgccattgcttctcacctctgctttgcatccatccatccatcagagatcaggtagaacagtgagagtgaggtgcagaaaaatttgaactgaagctgaggatggcaacatccatgatcacctcgccgctggtggcgccggcccgggccaagggccttccgtccatctcccgccggggatcctccttcgccatcgtctgcagcggtgggaagaagatcaagaccgacaagccctacgggattggaggtggcatgtcagtcgatattgatgcatctggcaggaagagcacggggaagggtgtgtaccaattcgttgacaagtacggcgcaaacgtcgacggctacagcccaatctactcgccggaggaatggtctcccaccggtgacacctacgttggtggaaccaccgggcttctgatctgggccgtgaccctcgccgggctcctcggcggcggcgccctcctcgtctacaacaccagcgccctcgccggctaaatttcacccaaatccagtctatgtatgtaacaccaagctgggtgtctgcatattcatctgtaatctaagatagccttcctctgaatgcgatgtgatgatgcccactgcttaatcaaactgcattgtgattaatctatgtaacactgtacttgcatgatgatgatatactacacttgatact

SEQ ID NO: 1604 - DNA, 587 bp, Artificial
  Synthetic
tcggggagaaaaaagagatggctgctagttcaacctgccttggcattattagcacaagtgggttaattaacccaagccttgggtcacccatcaacaccaccagggatcgaatcgccctggggctaggccgtcgccctctactcattgtagcaggaagtggcaagaaaaaaatccaaaccaagcagccctttgggccatccggaggtaccaatttcaaggatgggttggatgcatctggccggaaaatgacgggcaagggggtgtaccagtttagcaacaaatatggagctaatgtggatggatatagcccaatttacgactctgatgattggtcaccatctggagatgtttatgtggggggtactggtggcttattgatatgggctataacattaggagcaatcctccttggtggagctcttcttgtgtacaacacaagtgctcttgctcaatagaaaggatttcataatgttaactttcatgagctagtcttggaatgggaatgcacttgttgtaaatatgatatctcctactatgtatcttatatgcttctctagtgtaataaaatacctaatgtgcattctttc

SEQ ID NO: 1605 - DNA, 516 bp, Artificial
  Synthetic
cccacgcgtccggagagaagaatagtttgatcatcttgtgagaaaaataatggctgcttcagtgatgctatcttcggtgacattgaaaccagctggtttcacggtggagaagacggcggctagaggattaccgtcgctcacaagagctcgtccctccttcaaaattgtcgccagtggcgtcaagaagatcaagaccgacaagcccttcggaattaacggcagcatggacttgagggacggcgtcgacgcctccggcagaaagggcaagggatacggtgtttacaagtacgtcgacaagtatggagctaacgtcgatggatacagtcctatttacaacgagaacgagtggtcagcgagtggtgacgtgtacaagggaggagtcaccggattggcaatttgggcggtaactctcgccggaattcttgccggaggtgctcttcttgtgtacaacacaagtgctttggctcagtaaatcttaaagttgttagcgcatgtgtaatcatgtttctataaatg

SEQ ID NO: 1606 - DNA, 440 bp, Artificial
  Synthetic
cggccgcagtgatgctatcttcggtgacattgaaaccagctggtttcacggtggagaagacggcggctagaggattaccgtcgctcacaagagctcgtccctccttcaaaattgtcgccagtggcgtcaagaagatcaagaccgacaagcccttcggaattaacggcagcatggacttgagggacggcgtcgacgcctccggcagaaagggcaagggatacggtgtttacaagtacgtcgacaagtatggagctaacgtcgatggatacagtcctatttacaacgagaacgagtggtcagcgagtggtgacgtgtacaagggaggagtcaccggattggcaatttgggcggtaactctcgccggaattcttgccggaggtgctcttcttgtgtacaacacaagtgctttggctcagtaaatcttaaagttgttagcgcat

SEQ ID NO: 1607 - DNA, 302 bp, Artificial
  Synthetic
gccattacggccgggcaggaagaaaagagagtataggaaatggcaagcacagtaatgagcctcaaacctgcagctttcagtgttgagaagacagcagtgaaaggactgccatcacttgctagggcttcttcttccttcagagttcaatctagtggtgctttggcacagtagatcgttatccttgtactcctagttagttgtattccagctcgcaccatgtatcttttcaagaatactttgtattaatctgtaattgctgtggatattacacataatgttgattatttaaggtatttgcgata

SEQ ID NO: 1608 - DNA, 571 bp, Artificial
  Synthetic
gaaagagagtgagagagctcgagcaatggcggcagtgttggagagctcggccttctgcggctcggccctggcagcagcagcaccagctcggggcctccccgcattgagcagcagcaggctcaccgtgagagccagcggcggcaagaagatctcgacgaaaacacctctaggaccttctggggacctcagttttaagtctggacgcgatgcttctggacgtggcaccacgggaaagggcgtgtatcaattcacaaagaaatacggagctaacgtggatggatacagtccgatctatactccggacgaatggtcgccttcgggagacgtttacacgggtggccagactgggcttttgctatgggcagtaacgctgggaggtatactactggccggtgtgttcctcgtatacagtactagtgctctcgcaagctaaatcgtgtaaacgttatattgtcaaaaagcgagcaaaaaggattatttccataccttgtccatagcttggacacgacttcaatgtagataaaggttgtattaatatttacaaatatatcgtattttcttaccaaaaaac

SEQ ID NO: 1609 - DNA, 337 bp, Artificial
  Synthetic
acgcgtcgagctgaaggttaccatgagttgtcaaggatgtgttggggctgttaaaagggtgcttgataagatggaaggagtggaatcgtatgatattgacttgaaggagcaaaaagtagtggtgaagggcaatgcgaaaccagaggatgtgttcaacacggtctccaagacggggaaggccacatcatactggcctacagaacaagtggtagcagcatgatatgtgtgtagacccttttaagaagttgctagattctagtagcttataacctacatggcctaaatgcttctattgtattgataaggtataaataatataattatgcaaatctttgtc

SEQ ID NO: 1610 - DNA, 672 bp, Artificial
  Synthetic
gtttcttcccacgaaagtaaaaatctccctcatttttccccctactacttttcatcatcatgtctcagaccgttgttctcaaggttggcatgtcatgccaaggctgtgtaggagctgtgaacagagttttggggaaaatggaaggtgttgaatcttatgacattgatattaaggagcaaaaagtgactgtaaaaggaaatgtggagccagaagctgttttccagactgtttcaaagactggaaagaagacttctttctgggaagcagaaacaccagcaccagcaccagcaccaactgaacccgaaacaaagcccgttgaagtaaagcccacagaagaaaagcctgcagatacaccagctgaacccgaagctaagcccgcagacgaaaagccagcagaagctgttgcttgatgatactgatatatatatcaagcttaaagcagaatgtgatatgtaacagttaatcagctcttaaataacgtgttactaatttttgcgtttggtttttattgtaataatatagataagaagtcctgttatctactgaaaagaactacttcagtatactggagtgtattgtttaactagtctactggatttgcagactcttgattgtttttacggagtgatgattttactaatcaaatggagattacggaccctattatatggt

SEQ ID NO: 1611 - DNA, 187 bp, Artificial
  Synthetic
ctcaaggttggcatgtcatgccaaggctgcgtaggaactgtgaacagagttttcggggaaaatggaaggtgttgaatcttattacattgatattaaggagcatgaagtgtctgtaaaaggaaatgtagagccagaagctgttttccagactgactcaaacactgcaaagaagacttctttctgggaa

SEQ ID NO: 1612 - DNA, 419 bp, Artificial
  Synthetic
gcaagaattcgctacacaagaatcatggctaacgagatagtggagctaaaggttcatacaatagtggagttaaaggttgagatgagttgtcaaggatgtgttggggcagtcaaaagggtcattgaaaagatggaaggagttgaaagttatgatatcgacttaaaggagaataaggttgtcatcaagggtaccgtaaaaccagaggatgtgttcaacacaatctataagacaggaaagaccacaaccttttggcctaaagaagaataagaagagcatggcattatattgtaactccaactcttgggaactaaatattctattacattttgatagaaataatgtaaaaccaatgctagtactatattgcatcgattatgttaaatgaccttaaattgtctttactatgctaaatttatgtg

SEQ ID NO: 1613 - DNA, 442 bp, Artificial
  Synthetic
gaagaagcactaagcaagagtccatccatatacaatggctactcagactgtggagctgaaggttaccatgagttgtcaaggatgtgttggggctgttaaaagggtgcttgataagatggaaggagtggaatcgtatgatattgacttgaaggagcaaaaagtagtggtgaagggcaatgcgaaaccagaggatgtgttcaacacggtctccaagacggggaaggccacatcatactggcctacagaacaagtggtagcagcatgatatgtgtgtagacccttttaagaagttgctagattctagtagcttataacctacatggcctaaatgcttctattgtattgataaggtataaataatataattatgcaaatctttgtcaaaataattgtcttacactatgaaaacaatcattctagttttccataattaatttcaaag

SEQ ID NO: 1614 - DNA, 406 bp, Artificial
  Synthetic
gcaccaccaagctttggatatggccacggagactgtggaactgaaggttgagatgacttgtgaaggctgtgttggagcagtcaaaagagtcttaaacaaaatgcaaggggtggaatcttatgaagtggatttgaaagagaaaaaggtaattgtgaaggggaatgttaagcctgaagatgtcctcaaaacagtttccaaaactggcaaggctactcagtattggccaaaagagtagggaggaagcaaatgtctaaagcatagcctattcttatttataaatagactatatgcctgaactaaatggaaatctcaattaagtctttgaataaattttctgtcgttaattataaacatataacctaaaagtttgggattttctttgatttggctaacaaaaaaccacaac

SEQ ID NO: 1615 - DNA, 521 bp, Artificial
  Synthetic
atacactagtttcttcccaaaaaaagcaaaagctccctcagttttttctccttcgtacatttcatcattatgtctcagaccgtgttctcaaagttggcatgtcatgtcaaggctgtgtaggagccgtgaacagggttttagggaaaatggaaggtgttgaatcttatgacatcgatattaaggagcaaaaagtgacagtgaagggaaatgtggagccagaagctgttttccaaactgtttctaagactggaaagaagacttctttttgggaagcagcagcaccagcaccagaagcagcaccagcaccagcaccatcaccagaagccgcaccagcaccagctgaacctgaagtaaagcctgctgaagtaaagcctgtggatacaccagctgaacccgaagcaaagcccgcagatgaaaaaactaccgaagctgttgctgcagcctgatgatactaaaatatatatcacgcttatgatttatgcaactttaatatgtaacagttaatcagagcttaaatgatg

SEQ ID NO: 1616 - DNA, 482 bp, Artificial
  Synthetic
cccccccctggcaccattcaaaggtccaagttttctctcttgactttttgtatcaaaccattttcttcttcaaaaacctctcaagtttcttctcatcatcatgtctcaaactgttgttctcaaggttggcatgtcatgccaaggctgtgtaggggctgtaaaaagggtgttggggaaaatggaaggtgtaaaaaactttgacattgatctgaaggagcaaaaagtgacagtaaagggaaatgttcaaccagaagctgttctccagactgtttcaaagactggaaagccaatatctttctgggaagcaggggaaccggctcaaacagaagaaaaacctgcagaagctgttggtacagcttaattatgtctaatggcgtggaattgtatgttaaggcttgtgctttatacgactttatcaagaattcctttgtgtaatatgaggcttgaacagttaaaatctaaattgcaataagttcttgagc

SEQ ID NO: 1617 - DNA, 922 bp, Artificial
  Synthetic
tatttttattccgtcagctgtttagcaagagaagagagcaaaaaatggtgtcagtttcagggatctccgcaaggagggtggtggttgacgctcgccaccatatgttgggacgattagcttcaattttggctaaggaattgttgaatggacagagagttgtggttgttaggtgtgaagagatttgtttatcagggggacttgtgagacagaaaatgaagtatttgaggtttcttcgtaagaggatgaatactaagccttctcatggtcctattcactttcgtgctccttctaagatcctctggcgtaccatccgtgggatgattccccacaaaactaagcgtggagctgctgcacttgcccgcttgaaagtgtatgaaggtgttccaccaccatatgacaaagtcaagagaatggtcattcctgatgctcttaaggtattgaggctccaagcaggacataaatactgtctcttgggcaagctttcatcagaggttgggtggaaccattatgacactattaaggaacttgagaacaagagaaaggagagagcccaagttgcatatgagaggagaaagcagttggctaaactgagagttaaggccgagaaagctgccgaggagaagctcggtccacagcttgctgttattgaacctatcaagtattagagtgcaaatttagtagttatctgaggtgaaattttgctggagattgagatttcagcttatctgtttttttaaaagttgtaccgcatggtttggtattttgcttctagcaatatttgagcagactttaaattgttttaactatctttttgaagttacaattctctcatggttttattggtacagctttgttttctactccttgatagtttgcatctataagatgaatgactccattgagctgagtctctattagaaat

SEQ ID NO: 1618 - DNA, 702 bp, Artificial
  Synthetic
gaggtactaatggtaattttctaatcttgcaaattgttaaatatacatgaaaattaacacaactaaaagcaggtaataaggagatgaaagttgctatgctaagcaaatcaaagtcattgactagaagttgcaacatggcatcttttatgagaacaaaagagttacatatgaaaataaatgctcatcaaacttttttgaaataatgagattgaggagtttaggcagtgagctcctcctccttgtgtgtctcaatagtaacatcagactgtgggtaagcaacacaagttagaacaaatccatcagccatttggtcatcatcaagaaagtttccatcagactgatcaacatttccagctgtaacttttccagcacaagaagagcaagaaccagctctgcatgagtaaggaagatcatgtcccatttcctcagcttgatcaagaatgtaaacatcatcgggacaatcaaactcaacagctccttctggtgtaataagcttcactttgtaactggccatgcaagtaatcctaccacccctctgagatttaagaccaaagagagcttgcccaacatttggtatggctttcaggctagtcactgctggtttccttgggaggaaagaggtgctaaccatggtacctgaaatactggccatttttacaaaccttttctttgttttgctttgctctccccggccgtaatggc

SEQ ID NO: 1619 - DNA, 572 bp, Artificial
  Synthetic
gtgtcggccaccgcacccactcgcgcacgctcgctaagtgaaaccaagctcgtaaaccacgccgccatccatggcttccctcgccttcgcatcccctgcatccaccgccacctccgcgcccgcaccgttcaagatggccggtttcgcctctggccctcgtagcctcccatgccccacccccgccttcgtttcgtggccctcccccgccgtccgtataaacgtcgcgatggcttacaagaccgttctgaagaccccctccggcgagttcaccctcgacgtccccgagggtaccaccatcctcgatgccgctgaggaggccggctacgaccttcccttctcctgccgtgccggcgcgtgctcctcctgcctgggcaaggttgtatcgggctctgtcgaccagtccgagggctccttcctcgacgacggccagatggaggaagggttcgtcctgacctgcattgccatccctgagtccgacctcgtgatcgagacccacaaagaggaagagctcttttaagccccccacacccacatccaaacccacacactcatacccattgtttaggactatg

SEQ ID NO: 1620 - DNA, 707 bp, Artificial
  Synthetic
cctcctcgtctaccttacctagcagcagcagctagctagctgaattagctatagcagccatggcggcgacggcactgagcagccaggtccggttgccgatgtccctgcgggtggcgacggcgccggcgccggcgcgcgtgtcggtgctgccggcgagcaacaagctgggagacaggctgcggatgcaggcgacgtacaacgtgaagctgatcacaccggacggcgaggtggagctgcaggtgccggacgacgtgtacatcctggaccaggcggaggaggaagggatcgacctgccttactcctgccgcgcgggctcctgctcctcctgcgccggcaaggtggtctccggcgagatcgaccagtccgaccagagcttcctcgacgacgaccaggttgccgccggctgggtcctcacctgccacgcctaccccaagtccgacgtcgtcatcgagacccacaaggaggacgacctcatctaatcaatcaagcaagctccatatttataaatctctcgatccatctccatgcgttcttgagtttatcaattaagaatataatgtcgtcgtccctatgctatgcaagcaaagtattacgtacgtatatgttgagcgagataacaaaacaacagcgtgcccgagggttaattgttgttgtttaattaatgtacgttttgctgcacctgcttaatcatatccatatcacatttt

SEQ ID NO: 1621 - DNA, 170 bp, Artificial
  Synthetic
gccattacggccgggaaagaaaaatcttgaaaaaatggcggggattttatgtaccatggttagcacctctttcctaccaaggaaaccattagtgactatcctgaaagccataccaaatgttgggcaagctctctgtggtcttaaatctcataggggtggaaggattactt

SEQ ID NO: 1622 - DNA, 638 bp, Artificial
  Synthetic
aaaacacatagctctgtttggactcatcttgagcctctcctcgataactccgcttaatcctcaaactgtaaacatgtcaactgtcagacttcctgccacctgtgtggtaaaaattgttcctcagacccaaagaaagagcgtttttataaagagcccatcgtctctagggtctgcgaggagcatttctaaagcctttggattgaaagctaactgtgcctttagagcatcagcatcagcagtgtacaaggtcaagttggtttgtccagatggtgtagagcatgaattcgtggcaccttcggatgcttacatcctcgatgcagctgagaatgctggagtcgaactcccttattcttgcagggcaggtgcttgctcaacatgcgctgggaagattgtatcgggatctgttgatcaatctgatggttcttttctggatgataatcaaattgaggaaggctatttgctcacctgtgtttcttacccaacatcagattgtgtgattcatactcacaaggaatctgatctttactagttatttttatgtcaaataatgtctatggtcttgcttaaggtgaagcagttggaaaattgctctgttcttgagaatggggtcagctgtagagttcaatcaatcgggaaca

SEQ ID NO: 1623 - DNA, 634 bp, Artificial
  Synthetic
gaattcacaacctcaaacttgttagctacaacttctccatttctctcatcttattagaaaaatggcagcaacactttcaggtcccatggttagtacctcattcatcagaaaacaacccgtaacaagtcttcgttcaatctctaacgtaagccaagctatgttcgggctaaaatccagccgtggtggtagaataaccgcaatggctacatacaaagtgaccctagttacacccgagggaaaacaagaattcgactgtccagatgatgtctacattcttgaccatgctgaagaagttggaatcgatcttccttactcatgccgtgcaggttcctgttcttcatgcgccgggaaagtcactggaggaacactcgaccaatctgatggtagtttccttgatgatgagcagattgaagagggttgggtgttgacttgtgtcgcatacccaacatccgatgtcaccattgagactcacaaggaggaagaactaactgcttaattagttgtcccttcttcaattaattcatgacatttttcattatgtttcattttaagacaatatgtggttgtggtggtgttctgaatcctatctaaatttttctatttgtcttgattgattgtcttatgagaacatgag

SEQ ID NO: 1624 - DNA, 645 bp, Artificial
  Synthetic
cttgacccaacccaacctacctcgcgatccccccctcctccgccgccgtctcgtcgagagagagagagagagaaggactatcgagatggcaactgcaactgctccgagattgtgctttcctaaacccggcgcggccattgctccggcgaccaagagcccttccttcattggttacgcaaagcaaacattgaacatgtcaggcctaaggatctccaacaagttcagggtgtccgcgacagcggtgcacaaggtaaagcttataggcccggacggtgtcgagcacgagtttgaagcccctgaagatacctacattctcgaggccgctgaaactgccggggtggagctgccattctcatgccgtgctggatcatgctccacatgtgcgggtaagatgtcatcgggagaagttgatcagtcggaaggatccttcctcgacgagaaccagatgggcgagggatacgttctgacatgcatttcgtaccctaaggcggattgcgtcattcacacccacaaggaggaagaactctactaggtcgctctttttatgcttctgtgggcacatttgctgatttcaaagtggactcgctgttcagttagttttcgctatccaaaaaatggccatatctttgtattagtcttttgatg

SEQ ID NO: 1625 - DNA, 599 bp, Artificial
  Synthetic
ctagctcactcctctcctcctcgtctaccttacctagcagcagcagctagctagcttaattagctatagcagccatggcggcgacggcactgagcagccaggtccggttgccgatgtccctgcgggtggcgacggcgccggcgccggcgcgcgtgtcggtgctgccggcgagcaacaagctgggagacaggctgcggatgcaggcgacgtacaacgtgaagctgatcacaccggacggcgaggtggagctgcaggtgccggacgacgtgtacatcctggaccaggcggaggaggaagggatcgacctgccttactcctgccgcgcgggctcctgctcctcctgcgccggcaaggtggtctccggcgagatcgaccagtccgaccagagcttcctcgacgacctcatctaatcaatcaagcaagctccatatttataaatctctcgatccatctccatgcgttcttgagtttatcaattaagaatataatgtcgtcgtccctatgctatgcaagcaaagtattacgtacgtatatgttgagcgagataacaaaacacaggcgtgcccgagggttaattgttgttgtttaattaatgtacg

SEQ ID NO: 1626 - DNA, 646 bp, Artificial
  Synthetic
cactcctctcctcctcgtctaccttacctagcagcagcagctagctagcttaattagctatagcagccatggcggcgacggcactgagcagccaggtccggttgccgatgtccctgcgggtggcgacggcgccggcgccggcgcgcgtgtcggtgctgccggcgagcaacaagctgggagacaggctgcggatgcaggcgacgtacaacgtgaagctgatcacaccggacggcgaggtggagctgcaggtgccggacgacgtgtacatcctggaccaggcggaggaggaagggatcgacctgccttactcctgccgcgcgggctcctgctcctcctgcgccggcaaggtggtctccggcgagatcgaccagtccgaccagagcttcctcgacgacgaccaggttgccgccggctgggtcctcacctgccacgcctaccccaagtccgacgtcgtcatcgagacccacaaggaggacgacctcatctaatcaatcaagcaagctccatatttataaatctctcgatccatctccatgcgttcttgagtttatcaattaagaatataatgtcgtcgtccctatgctatgcaagcaaagtattacgtacgtatatgttgagcgagataacaaaacacaggcgtgcccga

SEQ ID NO: 1627 - DNA, 700 bp, Artificial
  Synthetic
gccattacggccggggagagcaaagcaaaacaaagaaaaaatttgtaaaaatggccagtatttcaggtaccatggttagcacctctttcctcccaaggaaaccagtagtgactagcctgaaagccataccaaatgttgggcaagctctctttggtcttaaatctcagaggggtggtaggattacttgcatggccagttacaaagtgaagcttattacaccagagggagctgttgaatttgattgtccagatgatgtttacattcttgatcaagctgaggaaatgggacatgatcttccttactcatgcagagctggttcttgctcttcttgtgctggaaaagttacagctggaaatgttgatcagtctgatggaaactttcttgatgatgaccaaatggctgatggatttgtgctaacctgtgttgcttacccacagtctgatgttactattgagactcacaaggaggaggagctcactgcctaagcccctccatctcattatttcaaaaaagtttgatgagcatttattttcatatgtagctcttttgttctcataaaagatgccatgttgcaacttctagtcaatgactttgatttgcttagcatagcaactttcatctccttattacctgcttttagttgtgttaattttcatgtatatttaacaatttgcaagattagaaaattaccattagtaac

SEQ ID NO: 1628 - DNA, 603 bp, Artificial
  Synthetic
attaggctgcattacataaaagcatttatgaaacagaagatgttcttgatttaactctagtcctgacactcaagagtacaagagcattatatagctgctttaccttaaaccaagatctgaagcataactaaaagttggatacctagtaaaggtcaccctccttgtgagtgtagatcacacaatcagaggttgggtaagaaacacacgtaagcagataaccctccttcatttggttgtcgtccaaaaacgatccgtcagactgatcaacagggcccgattctatcttcccagcacaagtcgagcaagcaccggccctgcacgaaaaagggagttcgactccagcttcctcagctgcatcgaggatgtaagtatcagatggtgcttcgaactcatgttctgtaccatctggacaaaccaacttgaccttgtacacatttgctgatgctctaaaaccagagtcagctttcaagccaaaggacatcgaaatgctcctcacagatcccagagaagacgggattttcacaaatgcactctttttctgagtctgaggagcagctttgaacatgcaggtggaaggaagtctcacggtcgacatgttttacc

SEQ ID NO: 1629 - DNA, 598 bp, Artificial
  Synthetic
atcaatttgccaaggctagaattaacataccagatagtggctttttctgcagctcctacatctccgaactgtatcgttttcacagttaagcatatcagccccactttagtcgcaattagcacatgtcaaccgggggcaacggaatggacaactgccaattaccaaaatcgtttgccatttgttagcagcatttggaataagttagttttctgcaatggtctcttttattgtctgagtcttactggttggttgggagtctataatccagaagaacgtacttggcttgttcgtgtggttccacctccgagatgccctgaaaattttttcgtgaaaaattggtggaaaggaaaatttatggcagagtacaatggagatatctatgtgatatacacttgctctactgcaaatccggtgatatataagttagaccaaataaataaaatttgggttgagatgcaaactttaggtggtttgacactttttgcaagctttctgtcatcccaagcaaggacagacgttcttggggtgatgagaaatagtatttatttctcgaaagttcgtttttatggaaggcgttgcatatcctattccctctatc

SEQ ID NO: 1630 - DNA, 277 bp, Artificial
  Synthetic
cttagaaaagaaccacaaaaaactgacttcttgcagctatggctgcaagcaaaaagaagaaaaatgaagttattagctgcaacaactccaactaatggtggtccttctactgaggagcgtgaaggatctgatgagcaaaactcattgtcttgtgtaccaatggaaattctagaactgattctctcccggttaaacttgagagaaaacatccgtgcttctgctgtttgcaagcaatggcttgctgtctccatttctgtacgagttgcaaataaaccac

SEQ ID NO: 1631 - DNA, 271 bp, Artificial
  Synthetic
atacaagtagaacattatgaaatttatttatttcccttcaagagtttaggctcgtcttacaaaaaatgtagaacatgaagttaaagatacaaaggatctacattcaattagctgactctttcaccttcttaagaatagcaacaagtgctccaaccacagctactacagcccctgaaatcaaaagggttgacttgagatcctgtgctcctcctttcttctcctccttgacttccttagatgtttcaacctgtttggtcgctgtttcaacagc

SEQ ID NO: 1632 - DNA, 357 bp, Artificial
  Synthetic
gccattacggccgggggcctacaacaaatctcagaacgttgacctatgtggctcatgctatggcttcaatggccggcctaataggctcttctcaaactgtgtaggatggtcaggtctgtggttcaacccgtttgatcactgttagcaccaccataatagccttggctataccacttctcaggattacagcccaacaggggtctgctgacactgaaactacccgtaaagccgtcatcggtcttgatgctgctggccttgctggatcctttgctcaagcaccctttgctgcaactaaatcaatcaggattggaggctgctcctcctccctgcggaggattacctgaaactttgaactct

SEQ ID NO: 1633 - DNA, 652 bp, Artificial
  Synthetic
gccaccgggatcgccggcggcgccctcgcgcaggcggcgctcgccgaggccgccaagcccatcaaggtcggccccccgccaccgccctccggtggactccctgggacgctgaactcggaccaggcgagggacacggacctgccgctgagggagaggttctacctgcagccgctgccgccggcggaggcggcggcgagggcgaaggagtcggcccaggacatcatcaacctcaagccgctcatcgagaagaagcagtggccgttcgtcagggacgacctccgcctcagggcctcctacctgcgctacgacctcaaaaccgtcatcaactccaagcccaaggccgagaagaagggcctcaaggacctcaccggcaagctcttcgccaccattgacgggcttgaccatgcagccaagatcaagagccccgaagaggcggagaagtactacacgttgaccaaatctgctcttggcgatgtcctcgccaagctaggctaggatcggcataatggccatatggggtttcggtgtttttatgtttgttcatatggaaccggcaatgtaccctccatgttgatattgtatcagcaagcacttacgtatgattcaatcttgagttgttgttgacggctaaatctccaagcaggcgcgatta

SEQ ID NO: 1634 - DNA, 648 bp, Artificial
  Synthetic
gaattcagtagctcacaagctgtcttggaagggagccttcaactcaacagctctacccgcttgagtggagttagtaacaaccgagtaagcgtgatcagtcgatctagtttcacagttaaagctcagtcatcggacaatgaagccgtagctcagagtagtcgcagagctgtcttgggactagtagctaccggattggtaagtggctcattcattcagcgtgtgcttgctgaagcaaggccaattaaggtcggatcacctcccaagccatccggtggattgcctggaactcttaactcagaccaggctagagaccttgatctaccattgaaggagaggttcttccttcaaccactgtctccaacagaggctacacaaagagctaaagaagctgctaaagagattcttaacgtgaagagtaacatagacaagaaggcatggccttacgttcagaacgatcttcgttcccaggctggatatcttcgttatgacctcaaaactataatttcttcaaagtccaaggatgagaaggcttcgcttacagatctcaccaacaaactctttatttcccttgacaaactggacaatgcagcaaagatcaaaagcagtgaagcagcagcaaagagttatgccgatgctgtagtgtctttg

SEQ ID NO: 1635 - DNA, 634 bp, Artificial
  Synthetic
ggaagatggctcagcagtagcgatggccgggcttgctcatccctctcctcggccgcttcctcgctcgacggggccggctctcgcctcttggcctcctccccttcttcctctgccccctctaaaccatcccttcgcctccctttaatccgcgctagctcgtcgaatccctcagaagacgcttctgctaaatctagtactagacgccaaatcttgtccctcgttgctgtctctgctttgcttgtctctaaacaagccctcgccgaccctagccctatcaagctctttggccctcccgccccttctggtggcctccctgggactgaaaatgccgacgaagctcgagatctagacttgccattgaagaatagattttacctgcaacctcttcctcccgtggaagcgatcgccagggcgaaggaatctgccaaagagattgtgaatgtgaaggcattgatcgacaagaaggcttggccctatgtccagaacgggctccgatcacaggcttcctacctgcgctttgacctcaacactgttatcgcttccaagccgaaggatgaaaagaaagctctcaaaagccttagcactaagctctttaacactatcaataatctggactatgctgctagaagcaaaa

SEQ ID NO: 1636 - DNA, 909 bp, Artificial
  Synthetic
cccacgcgtccgaaaaaaaatggctcaagcagtgacttcgatggctggcttacgtggagcatctcaggctgtccttgaaggaagtttacagatcaacggctcaaaccgtttgaacatctcaagagtctcggttgggtctcagagaaccggacttgtgatcagggctcagcagaacgtgtcagtaccagaaagtagtcgccggtcagtgattggactcgtggcggctggtttagccggtggttcattcgttaaagctgttttcgccgaagctattccgatcaaagttggtggtcctccacttccttccggtggcctacctggaacagataactcagaccaagcaagagacttttcattggcattgaaagatagattttacatacaaccattgtcaccaacagaagctgcagctagagccaaagattctgctaaagagatcatcaacgttaagtcatttatcgacaaaaaagcttggccctatgttcagaacgatctccgtttaagagcatcgtacctccgttacgatctcaacaccgttatctccgctaagcctaaggaagagaagcaaagccttaaagatctcaccgcaaagcttttccaaaccattgacaacttggactatgcggcgagatcaaagagtagcccagatgctgagaagtattactcagaaactgtctcgagtttgaacaatgttcttgccaagctcggttaatgaagaaagacttgcgttgtaatctgttgatgtcgatgttattataattactgctatccaagtactttgtctttctccttctcttcttgtctgatcaaatcggttatctctaatttcagtttcaagttttaaccaatatattggctggctctttagcaaaacattatatattcgtcctcgagctgacccctttgtac

SEQ ID NO: 1637 - DNA, 285 bp, Artificial
  Synthetic
tgttggatggtcagctctgtggttcagcccgtttgagcactgttagcaccagcagaattgccttggctagaccaggtctcagcattagagcccaacaggggtctgctgacactgaaactagccgtagagccgtcatcggtcttgttgctgctggccttgctggttcctttgctcaagcagcctttgctgcagctaaatcaatcaagattggtggcgctcctcctccctccggtggattacctggaactttgaactcggatgaggcaagggactttggtctaccac

SEQ ID NO: 1638 - DNA, 561 bp, Artificial
  Synthetic
ccgggggcgtccgaaaaaaaatggctcaagcagtgacttcgatggctggcttacgtggagcatctcaggctgtccttgaaggaagtttacagatcaacggctcaaaccgtttgaacatctcaagagtctcggttgggtctcagagaaccggacttgtgatcagggctcagcagaacgtgtcagtaccagaaagtagtcgccggtcagtgattggactcgtggcggctggtttagccggtggttcattcgttaaagctgttttcgccgaagctattccgatcaaagttggtggtcctccacttccttccggtggcctacctggaacagataactcagaccaagcaagagacttttcattggcattgaaagatagattttacatacaaccattgtcaccaacagaagctgcagctagagccaaagattctgctaaagagatcatcaacgttaagtcatttatcgacaaaaaagcttggccctatgttcagaacgatctccgtttaagagcatcgtacctccgttacgatctcaacaccgttatctccgctaagcctaaggaag

SEQ ID NO: 1639 - DNA, 694 bp, Artificial
  Synthetic
gggtggaagaagaggaggcagaagaagaaaagaagaaagagagatggcggcaatctcgtcgtctctgggcctcagcaaggcacagttcgtcggctcattcgatgctagcgatgcggcgagaggctcttcttctcgcgttggaatcgcgagatcgaagtgtgtgatccgcgcgatgcagcaagaacacgatccgtcgagacgagcagcagtgtttggcctggtcgcagtggccgcgggcgtactggccgtggaggaatcgcgagcagtgagtggaatcaagatcaatgggccacctccaccatccggaggacttcctgggacggagaacgccgatcagccgcgcgacttggatctgccactcaaagagcgatttttcatccagccgctgtcgccagccgaggcagtggatagaatcaaggacgcgtcgaaggacattgtgggagtaaaggagctgatcgagaagaagagctggccgtatgtccgcaacgatcttcgcagcaaggcgacttacttgaggtatgacatcaaaaccatcctggatgccaagcccaaggcccagcgcaaagagctcaagaaatacacggacagtctcttcgacacaattgacaagcttgactatgcagctcgagcaaaggatcccgcagccgcgagcaagtgctacagcgacactgtagctgcattggacactgttatt

SEQ ID NO: 1640 - DNA, 574 bp, Artificial
  Synthetic
gccattacggccgggggcagagatcgggaagaaaagatgcgtagaatggtagagtatggttggcaaaacacgtcgtcgaatgagtatcttgatcatattaaacgaatggagagatcgccaacgatgcaccctgatcttcctctctacccaaatgtccactccctcttcaaaaatggaatagtgagcaacggacaagaaaagaaatgcactacactaacaccacagtcgcagaagaaagttcatttcgtggaacctaaagctgaacttaccaagaatgaaaagaagagtattgacatggaggctgatggctatataaagcagaagcacgtcaactttgagctccacaaatggagaaccttcaaagcttgttaaaaagtttccaacgtacttcatacaagatatactacatgatatcttagtataaataacatgtaatatatgtctgtcttattagcttctgtttgtactctaaagggaaagatatctcttatatgcgctgtgactatatatttcgtagatgtggtgttttgatttcaatttatctaataataaagctataagtatgtttattacg

SEQ ID NO: 1641 - DNA, 688 bp, Artificial
  Synthetic
gtcagtacatcatcatcggcgacacgggtgtagggaaatcgtgcctgctgctccagttcacggacaagcgattccagccggtccacgacttgacgattggcgtcgagtttggggcgcggatgatcacaatcgataacaagcccatcaagctccaaatctgggacacagcaggccacgagtctttcagatcgatcacgaggtcgtactaccgcggtgccgccggtgccttgcttgtgtacgacattaccaggcgagagactttcagtcatctggcaagttggctggacgacgctcggcagcacgcgaactccaacatgacgatcatgctcattgggaacaaggccgatctggctcacaggcgagcagtgagcacggaagaaggcgagcaattcgccaaggaacacgggctcatctttatggagacgtcggccaagaccgctcaaaacgtcgaggaggctttcattaacacagcatcgaagatccaccagaagattgaagagggcgtgttcgacgtttcaaacgaggcgtcgggaatcaagatcggagttctaccaaataatccccacagaggtgattacccgggtcctcaaggtggtggctgctgcagctagaaggcgggtataagttctcattaaaaaatgatttaccatgtcgtgaataattttccctcctgtacaaagctatcgtg

SEQ ID NO: 1642 - DNA, 577 bp, Artificial
  Synthetic
acgcgtcggcgatcaccagcgcctactaccgcggcgccgttggcgctctcctcgtctacgacatcacccggccggtgacgttcgagaacgtggagcggtggctcaaggagctcaaggaccacaccgattccaacatcgtggtgatgctggtggggaataagtccgacctgcgccacctccgggccgtgtccaccgaggacggccaggccttcttcgagcgcgaggggctctacttcatggagacgtcggccctcgagtcgaccaacgtggagaatgcgttcaagcagatactgacgcagatttaccgggtggtgagcaagaaggccctggatgtcggcgaggacccctccgccgccccggctaaaggacagactatcaacgttggcggcaaggacgatgtcacggctaccaagaaggttgggtgctgctccacctgaatcatggtcgacgttttagctggtttcgattgatctggtagctacaggtgggaagtttagatcagacagctggttcttgatagctacgaattcttttgctctactaggtagcaaattctttaaatactttttcttaactt

SEQ ID NO: 1643 - DNA, 410 bp, Artificial
  Synthetic
acccacgcgtccgctacaattcctctgtcgctctcaccagttaacagctacagcacaaaactgtaaccacgcttccgatctctaaaacctgagagagagagagagagagagagagacagagagaagtgtttcaatagtttggcgtgaagatggccggaggaggcggatacggcggcgcatcggggaaagttgattacgtcttcaaagttgttctaatcggagattcggctgttgggaaatcgcaactacttgctcgattcgctagagacgaattcagcatggattctaaagccaccatcggcgtcgagttccaaactcgtaccctctccattgaacaaaaaagcattaaggctcagatctgggataccgctggtcaggaaagatacagagccgttacaagcgcatactac

SEQ ID NO: 1644 - DNA, 746 bp, Artificial
  Synthetic
  misc_feature (253)..(254): The residues at these positions can be any nucleotide.
  misc_feature (278)..(278): The residue at this position can be any nucleotide.
  misc_feature (282)..(283): The residues at these positions can be any nucleotide.
tccgatcccgtatggttggagatattccccttcatcattttttcctgagaaaattcaaatggccgttccacccgctagagctcgagccgattatgattacctaatcaagctcctcttgatcggcgacagcggtgtgggtaagagttgccttcttttacgtttctcagatggctccttcacgaccagttttattacaactattggcattgacttcaagataaggaccatagagcttgatagcaaacgaatcaannactacaaatcttgggatacctggnctgnngtcaggagcggttccgaacaattacaactgcttactaccgtggagccatgggtatattgctggtgtatgacgtgactgatgagtcatcttttaacaacatcaggaactggataagaaacattgagcagcatgcttccgacaatgtcaacaaaattctggtcggcaacaaggctgacatggacgaaagcaaaagggctgttcctacatcaaaaggtcaagcactagccgacgaatatggcattaaattctttgagacaagtgccaagacaaatatgaatgtggaagaggttttcttttccatagctcgggatataaaacaaagacttgctgaatctgattcaaaggctgagccacagactatcaggataaatcaaccagaccaggcagcaggagctgctcaaagcgctcaaaaatcagcttgctgtggctcttgaaatattgacagcaacgacgacaggatgat

SEQ ID NO: 1645 - DNA, 671 bp, Artificial
  Synthetic
aggcgagaatcaaatggcgctgtcttcctcctccgtcagcggcaacgagtttgatcacctcttcaagatactgctcgtcggggactcgggtgtcggcaagagcagcctgttgctgcgattcaccgccgacactttcgacgatctctcccccacaatcggtgtggatttcaagctcaagcttatgacgctggaaggcaagaggctcaagctcaccatctgggacacagccgggcaggaaaggtttagaacgcttacgagctcgtactaccgaggggcacaaggcgtcattcttgtttacgatgttacaagaagagatacgttcacgaatctctcggaagtttggctcaaggaggtcgagctctactccaccaaccaggactgcgtcaagctcttggtgggaaacaaagtcgacagggattccgagcgtgcggtgacgaagcacgaaggcatggctttcgcccggaagtatggctgcctgttcctggagagcagtgccaagacgaagatcaacgtccaacaatgctttgaagagctggtcaggaagattttggaaactcccagcttggtagccgaggccaagtcggtgaagaaaaacatcatcagaccaagcaacgatgaggagccgcctgcagctggcgataactctggtagctgcgcgtgttgatagagag

SEQ ID NO: 1646 - DNA, 263 bp, Artificial
  Synthetic
ggatcgagcagagggggacggactcttcctggatacgaggtcatggcgaacggcttcgtggatttcaatcagaagatcgactatgtcttcaaggtggtgctgattggggactcggcggtggggaagtcacagctgcttgccaggttctccaggaacgagttcactctggaatccaaggcaaccatcggcgtcgagtttcagacccggaccatggtggtggatcacaagaacgatcaaggcacagatctgggacaccgccggtc

SEQ ID NO: 1647 - DNA, 700 bp, Artificial
  Synthetic
cgggagggaagatcatcgtgcatcgcgcggaggtctggatcggcagcgctaatggcggcggggagagcgcgggcggactatgactacctcatcaaattgctgctcatcggcgacagcggtgtggggaagagctgccttttgctgcgcttctcggacgattccttcacgacgagcttcatcacgacgataggcattgacttcaaaatcaggaccgttgacctggatggcaagaggatcaagcttcaaatttgggacactgctgggcaagaacgcttccggacgatcacaactgcatactaccgaggagctatgggcattctcctcgtctacgatgtgacggatgaatcatcgttcaacaacatccggaactggatcaggaatatcgagcagcacgcgtcggacaatgtgaacaagatcctggtcggcaacaaggccgacatggacgaaagcaagagggccgtatcaacagaaagagggcaagctcttgcgaacgagtttggtatcaagttcttcgaaaccagcgcgaagacgaacatgaacgtggagaacgtcttcttcacaatcgcgggagacatcaagcggagactagcggaaacagactccagacccgagcctcccaggatcaacaacgtaatactagacccgtcgaaggatcagaacaacaacaaagacaagtcatcatgttgcacctgagagcaag

SEQ ID NO: 1648 - DNA, 665 bp, Artificial
  Synthetic
aaagccagccagccagccacctctgcatcatcccgcctgtctgcctgcgcgcgccggccaggcggccgccgcctcgtctgctccgccggtccaggttgggtccccctcttgacgaggggcgggagggagggagcgaatctgaggtggtggctatggggtcgccgggggcggggagcagcggcggcggtggaggtgggcatgagtgcagcttcaagatcctgctcatcggggactccggcgtcggcaagagcagcctcctcgtcagcttcgtcgtcgccgccgccgccgcccacctcgacgacgacatcgctcccaccatcggagtggattttaagatcaagttccttacgattggtggaaagaaattgaagctgacaatatgggatactgctggccaggagaggtttaggacaattactagttcttactacagaggtgctcaaggcattattctagtatatgacgtcacgaagagagaaagcttcacaaatctggctgaagtatggagtaaggaaatagagtcacactcatcaaacaaagactgcataaaaatgcttgttggaaacaaaattgacaaggaggatgaaagaactgtcacaagagaagaagggcttgcctttgcagaagaatctggatgcctatttcttgagagtagtgcgaaaaca

SEQ ID NO: 1649 - DNA, 640 bp, Artificial
  Synthetic
tatttgaaagtagagagagacagagagattccgatggcaggtgcacccggctctgccagtctccaagccaaattggtgcttctcggggatatgggagcaggaaaatccagcttggttttgcggtttgtgaaagatcagtttcacgagtatcaggagtcaacaattggtgcggctttcttttcacaaaccattgttgtgaacaacacaacagtgaaatttgaaatttgggacacagcaggtcaagaaaggtatcacagtttggctcctatgtactaccgtggggctgctgcagctatcatagtatttgacattacaaatcctgattcatttaatcgagcaaaaaagtgggtacaagagcttcagggacaaggaaatctgaatttggtcatggcacttgcaggaaacaaatctgatttagcatccaaaagaaaaattgaagcagaggaagctcaatcctacgctgatgaaaatggattgtttttaatggaaacatcagcgaagactgcacagaatgttagtgaaatttttcaagagatcgcaaagagactacctagagctcaatctgctcaaaatcctgccggggtttcacttactgataggcctgtggacagagcatcaagtctctcctcatgttgctctt

SEQ ID NO: 1650 - DNA, 627 bp, Artificial
  Synthetic
  misc_feature (201)..(201): The residue at this position can be any nucleotide.
tttcaactctcaagccttccgcttttatttctcccgttccaacacaaagcaccaacaaccgccatcatgaaccccgaatacgactatctcttcaagctcctcctcatcggtgattccggtgttggaaagtcttgcttgtctgctgcgatttgccgatgacacctacaccgagtcttacatctccaccatcggtgtcttttnctcgatccgaacgatagaactcgatggcaagaccgtgaagctgcagatctgggataccgccggccaggagcgtttccgaaccatcacctcgtcttactaccgcggtgctcacggcatctgcgtcgtctacgatgtcactgatatggactccttcaacaacgtcaagcagtggctccaggagattgaccggtatgccaccgagggcgtcaacaagttgctcgtaggcaacaagagcgatatgtccgataagaaggttgtcgagtacaccgttgccaaggaattcgctgacagcctgggcatcccattcctcgagacttccgccaagaacgccagcaacgttgagcaggctttcctcaccatggctcgccagatcaaggagcgcatgggcaccacgactgccaacaacacgaaacccagcgtgcacgt

SEQ ID NO: 1651 - DNA, 632 bp, Artificial
  Synthetic
cctccgatctcgccgcgtccgtgtcccctcgccgcgcagccagcgtcagggctcggcgaccggaggaggagaggccggaacccgccgccgccgccgccgcctccgcctgtagcgagatcgctcgatccggttcgcctcccgcgcgccagtccgccagcccagtttgtatccgttgagggggaggggacgctctagtgtggggattgggggaatcgatggcggcgccgccggcgagggctcgggccgactacgattacctcatcaagctgctcctcatcggcgacagcggtgttgggaaaagttgtctcctcctacggttctctgatggttccttcaccaccagttttattaccaccatcgggattgatttcaaaataagaacaatcgaactggatggtaaacggattaaacttcaaatctgggatacagtggtcaagaacgtttccgaactattacaactgcctactacaggggagcaatgggtattttgcttgtttatgatgtcaccgacgagtcatcatttaataatataagaaactggattaggaacatagagcaacatgcttccgataatgtgaacaagattttggtaggcaacaaagctgacatggatgaaagcaaaagggccgtac

SEQ ID NO: 1652 - DNA, 988 bp, Artificial
  Synthetic
gccattacggccgggggttctgaccattttcccctttcagcccaatgttgccgacgactttctgaccttctcaaaaacctctgtgtttctctcacatttctggtgccaatctcttgggttttgcatttgctgattcagatatttattggagaagacgatggcagctccaccagcgagggctcgagcagattatgattatcttatcaagctcctcctcattggtgatagcggtgtgggaaagagttgtttgctgctgaggttctcagatggttcctttacaacaagtttcatcaccactattggaattgactttaagataagaacaattgaacttgatggcaagcggattaaattacaaatttgggatacagctggtcaggagcgtttccgcactatcacgacagcatattatcgaggagccatgggtattctgctggtgtacgatgtcacggacgagtcatctttcaataacatcaggaactggattcgcaacatagagcagcatgcttctgacaatgtcaataagattttggttgggaacaaggctgatatggacgaaagcaaaagggctgtgccaacttccaagggtcaagctcttgctgatgaatatggcattaagttcttcgaaacaagtgcaaagacaaacatgaatgtggaagaagttttcttttcaattgctagggatatcaaacaaaggctttcagaatctgattccaagactgagcctcaggcaatcaagatcaaccaatcggatcaggcaggaacttctggtcaagctgtacaaaagtcatcttgctgtggttcgtgaatggagccaatcgtgtgggaagaacattcgttagttgcatttggatgtaaaaattgattgggatgaaaaactgattcctgttaacttcattaccaaatatttatttgccatctgatggcaagcttgatgtgtcaaaggttttactgctttcgttttgaatctattgtcatacagttaact

SEQ ID NO: 1653 - DNA, 433 bp, Artificial
  Synthetic
gccacgcgtcgcccacgcgtcggaaggaaggaaggaaaggatgtccatcgccgcctgacctgccgttccctgctatggcgaccgtcgtctgatctacccctttcctttccctcctcgccgatatggcgtcccgcccccgtgcagactatgacttcctcgtcaagctccttctcatctggggacagcggtgttggaaaaagttgccttcttctccgattctctgatgattctttcaccacaagctttattactacaattggcattgatttcaagattagaacggtggagatagatgggaaacggatcaaattgcaaatctgggacacagctgggcaggaacgctttcgaacaataaccacagcatactacaggggtgccatggggattatccttgtgtacgatgttacagacgagtcttcatttaacaacattg

SEQ ID NO: 1654 - DNA, 554 bp, Artificial
  Synthetic
gtgagttgatgatgggctctctgagctccctctctctcttcctcctccacttggccttagcttgccttgccttctccgtagctgagatcatcttcgaggaacgttttgaagatggatgggatagtcattgggtcaaatctggatggaagaagagtgaaggacttgctggaagctggcgacatacagctggcaaatggttttctgacccagatgataaaggtatacagacttaccctgatgcccgatttttcgctatctctgcacaactccctgagttcagcaataagaaccgaacccttgtgcttcaatactcggtaaagatcgagcagaagattgaatgtggcggagcttatgtaaaactcatgagtggttatgtgaaccagaaaaggtttagcaaggacaccccttacagtatcatgttcggaccggatctatgtggtactgatacaaaaaagcttcacacaattatctcctacaagggtcagaattatcccatcaagaaagagctacagtgtgagactgatcagctcacgcatttttacacgctaatcata

SEQ ID NO: 1655 - DNA, 584 bp, Artificial
  Synthetic
cccccggggaaagtcggtgggtcaagtcagaatggaagaaggatgagaacatggctggtgaatggaaccacacatctgggaagtggaatggagatcctgaggacaaaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacagcattatgtttggaccagacatctgtgggtacagcaccaagaaggtccatactatctttactaagaatgacaagaaccatttgatcaagaaggatgtcccctgtgagactgatcagctgtcccatgtgtacactttgatcatccgtcctgatgctacatacaccatactcattgacaatgttgagaagcaatctggcagcatctacgagcactgggatattctgcctccgaagcaaatcaaggacccagaagctaagaagccagaggactgggatgacaaggag

SEQ ID NO: 1656 - DNA, 609 bp, Artificial
  Synthetic
taaaactagtcttctcagctgaatcatttctactagttttgttacttttctcacttctcagctcttcattctctgagatcttttttgcagaacagttcgatgatgattggcggagcagatgggtgaagtctgactggaaaaggagtgaagggaaagcaggttcatttaagcatacagctggaaaatgggctggtgatcctgatgataaaggtattcagacatcaagcgatgccaaacatttcgccatttctgctaaggtaccagaatttagcaacaagaacagaactttcgttgtacaatattctataaagtttgagcaagacattgagtgtggtggaggttacataaagcttctctctggatatgtcaaccagaagaaatttgggggagacaccccttacagtatgatgtttggaccggatatctgtggtacacagacaaagaaacttcatgttatgctttcctatcaaggccagaattatcccatcaaaaaggatctacaatgtgaaacagacaaattaacccatttctacacattcattcttagacctgatgcatcatacagcatctggattgatggtcgagaaagggattctggaagcatgtata

SEQ ID NO: 1657 - DNA, 344 bp, Artificial
  Synthetic
ccgatctgagttttttttagcaatggcgagaatgattcctagcctcgtctctctaattcttatcggtcttgttgcgatcgcctccgccgcagttattttcgaggagcgctttgatgatggctgggagaacagatgggttaaatctgagtggaagaaggatgataacactgctggggagtggaagcacactgcgggaaattggtctggtgacgctaacgataaaggtatccagaccagtgaagactacagattctacgccatttcagctgagttccctgaattcagtaacaaggacaagaccttagtcttccaattctcagtcaagcacgagcaaaagcttgact

SEQ ID NO: 1658 - DNA, 650 bp, Artificial
  Synthetic
caacactctgttcgaaagagggcacaactgtaattgtaactgatctaaataccaataaccagacggattttgtgatcagtagccgagcttttatggccatggccaataagggaaaagctaaagacgttctcaaattgggaattgctgatgttgaatataaaagagttccatgtgattacaaaagcaagaatttggccattcgtgtggaagaatcaagtcaaaaaccaaattatctagcaatcagcttcttgtaccaaggtggtcaaactgaaattgtcgctgtcgacgtagctcaggttggatcatcgacctggaatttcctgagccgaaatcacggagcaatttgggacacaagtagagtgccaacaggggcattgcaatttaggtttgtggtgacagcagggtatgatggcaaatggtattgggcaaaatcagtgttgccagcagattggaaaaatggggtaatttatgacactggacttcagatcactgacattgctcaagaggcttgttctccatgtgatgatggaaactggaaacttcattagtgttaaaaataaaaaaattattttagctataataatctatgtgaatacacgtggtaaaagtaaaagagatcctaaattaataaaattgtagattgatgcagt

SEQ ID NO: 1659 - DNA, 291 bp, Artificial
  Synthetic
gcttgattgatatatattccttttggatatttgtctaattaggctttaactttagcattagatatgagtttaataacactcaaaaaccactgcattattctactagtgacactgatttttcctgcaatttgctattgtgaagaagccaattctctttacactagagcaacttattatggcagccctgattgctatggaacccctagtggagcatgtggatttggtgaatatgggaggaaaatttatgatgggaaagtgagtggagtttctaggctctacaaaaatggaact

SEQ ID NO: 1660 - DNA, 705 bp, Artificial
  Synthetic
ggagagaagaaaagcttagtactgttatgtctactttgtgagagattccacaatttcttatcctccaaattttagaagaatgagttcatatactagcataaaatgccctactgctgttagaaactccacaactcaattccctcatccaagaacaccaacatctaggaatgaaaaagcttcttatcctttcagtaaaactaaacccctcatctcccagatttcactctctactagctgctcatccttcagtcaccaaagtaaagcagataatctcaaccaatgtctagccgaaacaagaacctatagtgctagttctgaagacaaatatcccactatgtcagaaataatggaagcatcaagagcccaaaatcttgatcttcaccttcaaaaattgggacccttttttagaataacagctaggagcttaaaaccccaaagggaacttggaaaagctgagggtttgttaagggtctggtttcaaggtaaaattctacacttggactccataagactaaagagagagactttggggatggaaaaatcaatatttgggattggattgtttattggagcagttgcaattaggcatggttacgattctggttgtggaaaagctgagttgctcgccatttatgacaatgagctttatcactccaagcttgtgagtttctacacaaggattggtttcaagtcagtacaccaaag

SEQ ID NO: 1661 - DNA, 635 bp, Artificial
  Synthetic
tttcaatctctctctccgccgctacgttcacttcaaacccttcaccggcgttcgaaaaccctaggccctaatttcttccatgtcctatcaatcgtttaggtagctccgtaagatcgttatttattcttatccgtcaatttatctgataaaagttggattcggaggaatggcgagttcgactacgagcaatgtttacatccacgtcatcgaagatgtcatcagcaaggtccgtgatgagttcatcaacaacggtggtcccggagagagtatcctcaacgagctccaaggaactccattgcagactccgttgcctggtaccgcccagacaccgctacctggaacagtgcggacacccctcccgggaactgcccaaacacctcttcctggaacagcagatagcagctcaatgtataatattcctacaggtggcagtactccctttacaccgaatgagtactcttctttgaatgatactggtggtgcaactgagatgaaaggcggtccagggagacctagcccatttatgcaaccaccctccccttggttgaatcaaaggcctccccttgatgttaatgttgcttatgttgaagggcgagaagaagttgatcgcggagcttctcagcaacccatgactc

SEQ ID NO: 1662 - DNA, 804 bp, Artificial
  Synthetic
tccacattctctcaactttctctttctaaaaactcttcctatctctttctctagcacacagaccatcaatggcatcgccgcgcgaggagaacgtgtacctggcgaagctggctgagcaagccgagcgctacgaggagatggtagagttcatggagaaagtcgtcggcgccggcgacgacgaactcaccgtcgaggaacgcaaccttctctccgtcgcgtacaaaaacgtgatcggagcgaggagagcgtcgtggcgcataatttcatcgatcgagcagaaagaagagagtcgcggtaatgaagatcatgttgcctctattaaaacctacagatctaagatcgaatctgaattgacttcgatctgtaacggtatccttaagttgctcgattcaaaactcatcggcaccgctgctaccggtgactctaaggttttttatttgaaaatgaagggagattattacaggtacttggctgagttcaaaaccggagctgagagaaaagaagccgccgagaatactctttcggcttacaagtcggctcaggatattgctaatgtcgaattagcccctacacatccaatccgattggggctagctctcaatttctcagtgttttactatgagatattgaattctcctgaccgtgcttgtaatcttgccaaacaggcatttgatgaggcaattgcggagcttgacacccttggagaggagtcttacaaggatagcaccttgattatgcagcttcttcgtgataaccttacgttgtggacctcggatatgcaggatgatggaactgatgagatca

SEQ ID NO: 1663 - DNA, 390 bp, Artificial
  Synthetic
cccacgcgtccgtagaggaaagaagagagcaaagggaacgaagatcatgttgctattatcaaggattacagaggaaagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgc

SEQ ID NO: 1664 - DNA, 875 bp, Artificial
  Synthetic
tacaaaactccctctctcatttcctctctcatagcaacatcaatggcgtcgccacgcgaggagaacgtgtacatggcaaagcttgccgagcaagccgagcgttacgaggagatggttgaattcatggagaaagtcatcgccgccgccgacggcgccgaggaacttaccgtcgaagaacggaacctcctctccgtcgcatacaaaaatgttatcggagcacggcgagcctcgtggcgtatcatctcctccattgagcaaaaagaggagagccgcggcaacgaagatcacgttgcctccatcaaggagtacagatctaagatcgagatcgaacttacctcgatctgtaacggcattctcaagctcctcgattctaagctcattggcgccgctgctaccggtgactctaaggtgttttacttgaaaatgaaaggagattatcatcgctatttggctgagtttaaaaccggcgcggagcgaaaggaagccgccgaaaatactctctcggcttacaaatccgctcaggatattgcaaataccgagcttgctcctacacatccaatccgattgggacttgctctcaatttctctgtattttactacgaaattttgaattctcctgatcgtgcttgtaatctcgccaaacaggcctttgacgaggcaattgccgagctggacacattgggcgaagagtcctacaaggatagcactctgatcatgcagcttcttcgcgataacctcactttatggacttcagatatgcaggatgatggaactgatgagatcaaagaagcagcaaaaccagataatgagcagcagtaaaccggtgacatttctttaggattgaaattcatgttgtaactttttatttttcaatt

SEQ ID NO: 1665 - DNA, 367 bp, Artificial
  Synthetic
gccattacggccgggggatatgcaggatgatggaactgatgagatcaaagaaccatcaaaagcagaggagcagcagtaatgtgagtgaagcctctttgcttaggattgaaatcctatggactttgctcattgatcgaaatttgctgtttgtgtagttctgaattccctgaattgtaatacctaaaagtactgtttcttgccatttgttgttttcagcaaagattacttttttctcagtatctcccttgtatttggatgctccattcgtggaaatgaattcttgtttttacggagcaaatgatcattttgtatttccattttctctaaggaatgggggcattgctgatttgatctcccttttaattct

SEQ ID NO: 1666 - DNA, 338 bp, Artificial
  Synthetic
cccacgcgtccgcttcagacaaagcttgtaacatggccaaacaggcttttgaggaggccatagctgagcttgacactctgggagaggaatcctacaaagacagcactctcataatgcagttgctgagggacaatttaaccctttggacctccgatatgcaggagcagatggacgaggcctgaggatctagatgaagggggggagggttgttacgcgatgtttctgccaccaaatcgatctcaaaatccccataacctttgctcaaaaactgtgaaaaaagattgaagtgtttatgatgattatgattgtgcacagcttgatgatttatctactctact

SEQ ID NO: 1667 - DNA, 360 bp, Artificial
  Synthetic
cccacgcgtccggtaacgatgaccacgtcacggcgatccgtgaatataggtctaagatcgagacggaactctccggaatctgcgacggaatccttaagttgcttgactctagactcatccctgccgctgcttctggtgattccaaggtcttttaccttaagatgaagggagattatcacaggtacttggctgagtttaagactggtcaagagaggaaagacgccgccgaacatacactcgccgcttacaaatctgctcaggatattgctaatgcagagcttgctccaacacacccaattcgtcttggtcttgcattgaacttctctgtgttctattacgagatcctcaattctcctgatc

SEQ ID NO: 1668 - DNA, 592 bp, Artificial
  Synthetic
gtcaggagctgagaggaaggaagcagctgagaacactcttgtggcatacaagtctgcccaggatattgcactcgctgacctgcctacaactcacccaataaggcttggacttgcactgaacttctcagtgttctactatgagatcctgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacatt

SEQ ID NO: 1669 - DNA, 694 bp, Artificial
  Synthetic
gaattcatatgaagaaatggttgaatttatggggggagtaacaacaaatgttgaatcagaggaactttcagttgaagagagaaatttattgtcagttgcttacaaaaatgtgattggtgcacgcagagcatcatggagaattatttcatcaattgaacagaaagaagaaagccgtggtaacgaagagaatgtattgaccattcgtgattatagatctaagattgaaactgaactttcaggcatctgtgatgggattttgaagttgcttgatactagattgattccatctgcatcttctggtgattctaaagtgttttatttgaaaatgaaaggtgattatcatcgttatttggctgagtttaaaactggtaccgaaaggaaagaagctgctgaaagtaccctttctgcttataaatctgctcaggatatcgcaactgctgaacttgcacccactcacccaatcaggctgggacttgctcttaacttctccgtcttttactacgagatcttgaattctcctgaccgtgcttgtaatctcgccaaacaggcatttgatgaggctatcgcggagctggatacccttggtgaagaatcatacaaagacagcactctaatcatgcagctccttcgtgacaatcttactctgtggacctccgacatgcaggatgatggtgcagatgaaattaaagaagca

SEQ ID NO: 1670 - DNA, 532 bp, Artificial
  Synthetic
tgtatggcgcagagtggccattcggccgggggaagccaagtttgggaaaatcttaaaagaaagaaagaaatgatgacgaatcgccacttcctcttcgctcttcttttcactttctttctttcagctgttgctgcagattcttctgaagagtgtgtatacacattgtatgttaaaactggatcaatcataaagggtggaacagactccaaaatcagcgttacacttggcgatgctaaaggaaaatcagtatatattccagatctagagaaatggggtttaatgggcccaaattatgattactacgaaaggggtaatgtggatatcttcactggtagaggccaatgtttaagcccaccaatttgcaggcttaatgttacttccgatggatcaggtgaccaccacggttggtttcttgattttgttgagactacttttactgggccacacaaaacttgtagccaatccatattctatgtcgaacaatggttggcttctgatgctcctccttatgagttatcagtttctcttgatg

SEQ ID NO: 1671 - DNA, 699 bp, Artificial
  Synthetic
tcattttctagagaaagaaacaacaagacgtacagaacgagagttcaagaatctgcaatgggagtggctcgagttaaccaattctggttgcatcttctcatcctcttctccatctccgtttcttccatttctggcactgaactgaattgtgtatacacagcttatgttcggactgggacatactggggatctggaactgactcaaaaatttccttgtctctttatgatgccactggccatggacttagaatcaataacctacaagcctggggcgggcttatgggcccgggttatgactactttgaaatggaccaattggatatgtttacgggccgtggtccatgtttgactgggccaatctgtaaaatgaacttgacttctgatggatcaggtgagcaccacggatggtactgtaactacggggaaatcacgtctacagcagaacacaaacgatgcagccaacaggcgttcaccgtggaggcgtggctcagtgccggtcagtacccagatgggttgaccgccattaaggaacaactgtaagcgtatttccaacgaacaacaaccaattcatgattctgatcaatcttatcatgttgtggatgtaatttaattcgagtttattggacgttgtatgatttacgaaggccatttaggccaaggcctgatatgtactctcacgagtgctacatagttggaatg

SEQ ID NO: 1672 - DNA, 629 bp, Artificial
  Synthetic
ccccgatctccaccaccactttcccggggaccgcggcgggaaagggccttcgagacttgggaggttggagcgagcaagctcggccatggcgaagctctcctgccttctcatcgtctccttcgccgtcgtcgcggcgttggcggccacggacgacgacgcggcggcggcggctgaggggatcacggtggcggaggcgtcgtcggacccggagaacaagtgcgtgtacacgatatacgtgcggacggggacgatctggaagggcgggacggactcggtgatcggcgtgacgctgctgggcgccgacggctccggggtgcggatccgcgacctggagcggtggggcggcctcatgggcgacggccacgactactacgagcgcggcaacctcgacatcttcagcggcctcggcccctgcatgcgccaggcgccgtgccggatgaacctcacctccgacggcaccggcccgcaccacggctggtactgcaactacctcgaggccaccgtcacgggtccccacctcggctgcgcgcagcagctcttcaccgtcgagcagtggctcgccaccgacgcatcgccctaccgcctctacgccgtcgtcgacaactgcaacaaggccaaggacgccgccg

SEQ ID NO: 1673 - DNA, 614 bp, Artificial
  Synthetic
tttgcctttattcgttctcatttttctagagaaagagagttcaagaaaccatgggagtagctcaagttaaccaaatatggttccatttcatgataatcctcttcttcatctccatatcttctagttctgcatcagaagatgattgtgtgtacacagcttacgttcgaactggatcaatcataaaggctggaactgactcaaacattagtttgactctctacgatgccgctggctatgggataagaatcaagaacttagaggcatggggtgggcttatgggcccaggttacaactatttcgaaagaggaaacttggatatattcagtggacgtggtccatgtttgactgggccgatctgcaaaatgaatctgacttctgatggatcaggcccacatgccggatggtactgtaactacgtcgaagttaccgttactggagcccaccaacaatgcaaccagcagcttttcaccgtggagcagtggctcggcactgacgtttcgccgtatgagctgacggccgtcaggaacaactgtaagaagccaaagtttgagaaacaacaggccttttatgattctgaatcttatccagttgttgatgtaatttaatgggggtag

SEQ ID NO: 1674 - DNA, 619 bp, Artificial
  Synthetic
agagagttcaagaaaccatgggagtagctcaagttaaccaaatatggttccatttcatgatcatcctctttttcatatcttctatttcggcatctgaagatgattgtgtgtacacagcttacgttcgaactggatcaatcataaaggctggaactgactcaaacattagtttgactctctacgatgccgatggctatgggataagaatcaagaacttagaggcatggggtgggcttatgggcccaggttacaactattttgaaagaggaaacttggatatattcagtggacgtggtccatgtttgaatgggccgatctgcaaaatgaatctgacatctgatggatcgggcccacatgccggatggtactgtaactacgtcgaagttacagttactggagcccaccaacaatgcaaccagcagcttttcaccgtggagcagtggctcggcactaacgtttcgccatatgagctgacggccgtcaggaacaactgtaagaagtccaagtccacagtttatgattctgaatcttatccagttgttgatgtaatttaatgggggcagccccacatattgtctctgtggttttttctttagagtgagaagaattaacgtgatgc

SEQ ID NO: 1675 - DNA, 704 bp, Artificial
  Synthetic
aagtgaagaagcagtagcagtagaaggagatagaagggaacctctctctctctctctctctctttgctgatgatgaagacgactatggctgttttcgcccttctctctctcttccttcttctcctcgccccttttccttcatcagctgatgatccttgtgtatactcaatctatgtacgaacggggtcaatattcaaggggggaacggattcgaagatgagtgtggagctctacgatgcgaatgggtactacattacgatcaacaatttggaggagtggggggggttaatgggtccagaccacgactactatgagaggggcaatcttgacatctttagtggtttgggggactgcctgaccggacccatctgcgctctcaacctcacctcggacggcacgggggcccaccatgggtggtattgcaactacctggaagttactgccacgggtgcccacatcccttgctcccaacagctctttaccatagagcaatggcttgccactgatacctctccttactccctcactgcccttcgatataattgccctgatgctttgtcctcgcctcgcttccctcgcatgccttccaattcgcaaccgaagaatggtcaactaatgtcccattagtactctatcaccctgcttcgtaataaaaagatagcccctttcttgtgtactatggagggaggggggtatctctctca

SEQ ID NO: 1676 - DNA, 579 bp, Artificial
  Synthetic
gatgtcgacggggaaaggcttagctctaatcctggcatttgctgccatcgccacctgcatcacctctgctacgaaccaatgcgtatacactatttatgtgaggacgggaaaggtgataaaaggggggacagattcaaacatttcggcacgattctatgatgccaacggatactatatcaatttggaaaatttggcagaatggggtggtttgggaggtcctggctacaactactttgagagaggcaatttggatgtgttcacaggccttgggcagtgcctcacggcccccatttgcgcgctcaacctgacctcagacggcactggagaccaacacgggtggtactgcaactatgtcgaggtcacctccaccgggccccacatcccttgcagccaacaccaattcaccatcgagcaatggcttgccactgacacctaccctttcgagctcaatgccacccgtgacgattgcctggtcgagggcaaaaccagcgcctccaaggcaatttcatcagagtcgagctagagttccagctgggccttttttggcttccgtttttgatgaataagcaagctccttct

SEQ ID NO: 1677 - DNA, 666 bp, Artificial
  Synthetic
gggcggacgcgtgggcggacgcgtgggcggacgcgtggggccttttatcctctcatttctagagaaagaaaaaatttctcttgcacaactagctgccatgggagtagctcatcaagttaaccaattctggttccctctcattatcatcctcttctccatcaccatttcttctacttctggaactgaatcaaattgtgtgtacacagcttacattcggactgggccattcatggaggatgcaactgactcaaaaataagcttgactctctacgatgcgagtggctatggaattagaatcaagaacctagtggcttggggtgggcttatgggatcagggtacaactactttgaaacggaccactcggatatgttcagtggccatggaccatgtttgactgggccgatctgcaaaatggtcttgacttctgatggtacaggccgacactcagcatggtactgtaactacgtggaagtcacctcaacaggagaccacaaacaatgcagtcaacagctgttcaaagtggatcagtggcttagcacagatcgttcgccgtatcagttgactgccacaagaaacaactgtaggcgtatatccggtgaccaacaacccattgttgttgatgtaatttaattcgagttcatcatattgggctacttacaaactac

SEQ ID NO: 1678 - DNA, 715 bp, Artificial
  Synthetic
gaattcacttgaaaacaaaatcattgatgaagcgagcttctttacaatcctaaactacaagctgcatgccctatcccattcgacgaagccaagttatggcaaggccaaagtggacctgagctgaagcagcagatacagaagcagttcagaaatatcagtgcattgatggattgcgtgggttgtgaaaaatgtcgactttggggtaaacttcaggttcttggactaggaactgcattgaaaatccttttctctgttgatggccaggatcatgtggaccagcatccgcaactgcaaaggaatgaagtgattgccttggcgaatcttctgaatagactctcagaatctgtcaaattggttcgtcaaatgggaccgtcagctgaaaagatcatggagggacaggtgtttgcacatgctgaccaaactagcacatggcgaagaatatcgacttttttatctaaattgcggtagtaggctttacctacttctattgattatcaacctttcttagttcacatctgcgtgccttcggcagtattatggagggttaggttaactagaaacaactaacatggaatttacttttggcttccatgtagatgggaaagtgacaaacacataatttgatatctttcagatggtcatgaaccaaattctgaagttaaggctggaaattcagtgtttcggctgttcatatctttgaatactcaaatttcat

SEQ ID NO: 1679 - DNA, 380 bp, Artificial
  Synthetic
cccacgcgtccgagtagttggtgctggacaaatgggttcaggaatcgcgcaactcgccgccacgagtggcctcgacgtttggctcatggacgctgatcgagatgccctctctcgagccaccgcagctatctcctcctccgtcaaacgattcgtctccaaaggtctaatctccaaggaagttggtgatgatgctatgcatcgtctacgattaacatcgaatcttgaagatttgtgttctgctgatatcatcgttgaagccattgtggaatcagaagacattaagaagaagctgtttaaggatctagatggtatagctaagagttctgcgattttagcttctaacacaagttctatatccattactcgtcttgcatctgcta

SEQ ID NO: 1680 - DNA, 631 bp, Artificial
  Synthetic
gcgacggcgagagaaattgcggtggtgggagtgatcggcgcggggcagatgggctcgggcatcgcccagctcgccgccgccgccggctgcggcgtcctcctcctcgactccgacaccgccgccctctcccgcgccgtcgactccatctcctcctccctccgccgcctcgtcgccaagggccagctttctcaggcctcctgtgagcattccatcgagcagattaagtgcgtctccagtgtgcaagagcttagggatgcggatcttgtgattgaggctatcgtggagtcagaagacataaaaaagaagctgtttgttgagctggataagatcactaaaccttctgctattcttgcctccaatactagctcaatctctataacccgattggcttcagccactaatcgcccctgtcaggtgattggtatgcacttttttaaccctcctccgataatgaaattgattgaaatcatacgtggggctgatacatcagaagaggttttcactaaagtcaaatctttttctgaaaggcttgggaagacggtaatatgctcacaagactaccctggtttcatcgtgaaccgcatcctcatgccaatgatcaacgaggcgttctgggcactttacactggag

SEQ ID NO: 1681 - DNA, 633 bp, Artificial
  Synthetic
tttcgcgtgggtgcaactgcactgttgcttagtgggtatccagtgatcttgaaagaggttaatgacaaattcctccaggccgggatgggtagagtaaaagccaatttgcaaagcagcgtcaagaaagggaaaatgagtccagagaagtttgaaaagactctctccctactcaagggttctctcgattatgaaagttttagggatgtagacatggtcattgaggctgtcatcgagaatgtatcattaaagcagcaaatattttctgatcttgagaagtattgcccttcacattgcattctagcaagtaacacttccacgattgacttaaatttgattggcgaaaagaccaaatctcaagatcgtattatcggagctcactttttcagtccggctcatgtgatgccactcttggaaattgtccgcacccagaagacatcgccccaagtaattgtagacttgcttgatgttggcaagaagataaggaaaacccctgtggtagttgggaactgcactgggtttgctgtcaacagaatgttctttccttacacccaagctgctcttttgctagttgaacgtggaacagatgtctaccgcatcgataacgccatcactaaatttggcatgccaatgggt

SEQ ID NO: 1682 - DNA, 589 bp, Artificial
  Synthetic
ctctctcttcaacactattgttccagcatagcattaccaacttagttggttaggtgaagatggctcagatcttggctccatctgcgcaatggcagatgagaatgacaaagagctcaacagatgctaatcccttgacttcaaagatgtggagttctgtggtgttgaagcagaataaaagacttgctgttaaaagctctgccaaatttagagtctttgctctccaatctgatagtggcactgtgaacagagtggaacagctgctaaacttggacgtaactccatatactgacaagatcattgctgaatatatttggataggaggatctggaattgacatgcgcagtaaatcaaggactatttcaaagccagtcaagcatgcttctgagctcccaaagtggaactacgatggatcaagtactggacaagcacctggagaagacagtgaagtcattctataccctcaggcaatatttaaagaccctttccgtggtggtaacaacatcttggttatctgtgatgcctacacaccagctggagagccaattccaacaaacaaacgccataaagctgctcaaatttttagcgactc

SEQ ID NO: 1683 - DNA, 398 bp, Artificial
  Synthetic
taagataatgtttattcataaataatacacagaaatgttttcaataggatgtgaagtaaataaaaagcagaataagcagagcaaatctttgacttatcctaagacattgcttgatagagaacacaaactttgaatcttgcaagaaacacaaatttgagtgacattcaagattttttcttgatctgatgatcatcaaggattccagaggatggtggtctctgcaatcatggaagtaacaatgtaaggatccatgttcgaagctggcctcctgtcctcaaagtatcctttcccttctttctccgtatcacgtcctactcggatcgatgctccacggttcgcaacaccctacatacaacattccaacacacaaaagaatcacaaaatgtatcgtaattcgg

SEQ ID NO: 1684 - DNA, 601 bp, Artificial
  Synthetic
cccacgcgtccgctttccctaaacacactgattattttctctccgacgccgccatgtctctgctctcagatctcgttaacctcaacctcaccgatgccaccgggaaaatcatcgccgaatacatatggatcggtggatctggaatggatatcagaagcaaagccaggacactaccaggaccagtgactgatccatcaaagcttcccaagtggaactacgacggatccagcaccggtcaggctgctggagaagacagtgaagtcattctataccctcaggcaatattcaaggatcccttcaggaaaggcaacaacatcctggtgatgtgtgatgcttacacaccagctggtgatcctattccaaccaacaagaggcacagcgctgttaagatcttcagccaccccgacgttgccaaggaggagccttggtatgggattgagcaagaatacactgtgatgcacaaggatgtgaactgcccaatcgggtggcctgtgggtggctaccctggccctcagggaccttactactgtggtgtgggagctgacaaagccattggtcgtgacattgtggatgctcactacaaggcctgtctttacgccgg

SEQ ID NO: 1685 - DNA, 680 bp, Artificial
  Synthetic
acattattgttctggccgagtgctggaacaacgacggaacccccaacaagttcaaccaccgacacgagtgcgccaagctcatgagcgcccacgagaaggaggtcatctggttcggaatcgagcaggagtacaccatgttcgacgagagcgataaccccgtcggatggcctaagggcggtttccccgctccccagggcccctactactgtggtgtcggaaccggcaaggtctttgctcgagacgttgttgaggcccactaccgagcctgtctctactccggaatcaacatctccggtatcaacgccgaggtcatgccttcccagtgggagtaccaggttggtccctgcgagggtatctccatggccgatgagctgtggatgtcccgatacctgctgcaccgagttgccgaggagtttggcatcaagatctccttccaccccaagcccctgcagggagactggaacggagccggctgtcacaccaacgtgtccaccaagtcgatgcgagagcccggtggaatgaagcacattgaggctgccatcgagaagcttgctgcccgacacaaggagcacattgccgtctacggcgaggacaacgacatgcgactcaccggccgacacgagaccggctccatcggctctttctcttccggagttgccaaccgaggctgctccatccga

SEQ ID NO: 1686 - DNA, 575 bp, Artificial
  Synthetic
cttgatccaaaaccaattgagggtgattggaatggtgccggatgccacactaactacagtacactaagtatgagagaagagggaggatttgaagtaataaagaaagcaattctgaatctctcacttcgtcacaaggagcatataagtgcttatggagaaggaaatgagagaaggttgactggaaagcatgaaactgcaagtattgacaaattttcatggggagttgccaaccgtggtgcctcaatccgtgtggggcgtgacaccgagaagcaaggcaaaggttatttggaagaccgccgcccagcttcaaacatggacccttatgttgtgaccggattacttgctgaaactactattctgtgggagccaacccttgaggctgaagctcttgctgctcaaaagctcgcattgaatgtttagattatttaagggcagaattatccgtaataatcttcttagagttcatgagctgctaagtgaagaaatttgtaccttgtttagattcccttttagggaaaatcttgtaaaggaaccacagtttatcagttcttcctataaaagaggttccttaagac

SEQ ID NO: 1687 - DNA, 498 bp, Artificial
  Synthetic
tgagattgctggagttgtggtgtcatttgaccccaaacctattccgggtgattggaatggtgctggagctcatacaaactacagcacaaagtctatgaggaatgagggaggctatgaagtcattaagaaggcaattcagaagcttggactgaggcacaaggagcatattgcagcatatggtgaaggcaacgagcgtcgtctcactggaagacacgaaacagcagacatcaacacattcaaatggggagttgcgaaccgtggtgcatctattcgtgtgggaagagacacggagaaggaaggcaagggatacttcgaggataggaggcctgcttcaaacatggatccatacgtcgtgacttccatgattgccgagaccaccattctatacgagctttgagtgtagagtcgtcttttaagtatttgatgactaaaaattgggagaaagaattgaatttcggaacaaccctttccttacatgttcttagggtatagttagtt

SEQ ID NO: 1688 - DNA, 581 bp, Artificial
  Synthetic
gaggatttgaggtgatcaagaaggcaatcctaaacctatcacttcgccatgacttgcatataagtgcatatggtgaaggaaatgaaaggaggttgacaggtttacacgagacagctagcattgacaatttctcatggggtgtggcaaaccgtggatgctctattcgggtggggagagacaccgaggcgaagggaaaaggctacttggaagaccgtcgcccggcatcaaacatggacccgtacgtcgtgacagcgctattggctgaaaccacaattctttgggagccaaccctcgaagcggaggttcttgctgctaagaagttggccctgaaggtatgaagaacttggacgatgaatcggggcaaataaatcccagcaaaatttgtttgctgcccaccagtcttgatcttgtatttcttctgtctggggattggtctgtacaaatctgcagtttctagaaaaccacgccaccttccattcgccagttaacattttggttgaacaccacacttgatctgggtctgtattttgagtccatttgtgagtgacagaacggatgatgaaacacatcagggacacttt

SEQ ID NO: 1689 - DNA, 514 bp, Artificial
  Synthetic
gcaacgagcgccgcctcaccggccgccacgagaccgccgacatcaagaccttcaaatggggcgtggcgaaccgcggcgcgtccatccgcgtggggcgcgacacggagaaggagggcaaggggtacttcgaggacaggaggccggcgtccaacatggacccatacgtcgtcaccggcatgatcgccgagaccacgctgctgtggaagcagaactaagccgtccggcgggcctctcccgtgcatttctgcgcccaaaaaaaacaaaaaaaagaaacgtacgcgtgcgtgcatcagccgtgatgtgtcaacgttggatttcggtctcggtctatccttggcgtcgacaaggccctttgaattttattactagtctgtcctgttcaccgagtgtcattttgtgtactctgaataataatgctttgtaaaacggatttgctttttccgtagggacggatgttcttgattttcctatatcgtgatttatatatatggaaaaccgctgtctttttttgttc

SEQ ID NO: 1690 - DNA, 312 bp, Artificial
  Synthetic
cccacgcgtccggggctgcacaagtattcagtgatccaaaggtggtcagccaagtgccatggtttggaatagaacaggagtacactttgctccagagagacgtaaactggcctcttggctggcccgttggaggctaccctgggccccagggtccatactactgcgctgtaggatcggacaaatcgtttggccgtgacatatcagatgctcactacaaggcatgtctttatgctggaattaacattagtggaacaaatggagaggtcatgcctgctcagtgggagtaccaggttggacctagtgtcggtattg

SEQ ID NO: 1691 - DNA, 1299 bp, Artificial
  Synthetic
gaattcagaaaaagtagagtgaacaaaaaaagaaaaaaaaaagtaatggcttcttcagtgatctcctctgctgcagtcgcctctgtaaggagcgctgccccagctcaagctagcatggttgcaccattcagcggcttgaaatccgttgctgcattcccagttacccgaaaatcaaacgacatcacctccgttgccagcaatggtggaagagttaactgcatgcaggtatggccaccaagtggtttgaagaagtttgagaccctctcataccttcccccattgaccgtcgagcaactatcaaaggaagtagtgacaataaataacaataccgggctcttcgagtctggtaattggaatgagtacaatctaaatcccttaacgaggatccattggagggcaagtctggtgccagcagccgcggtaattccagctccaatagcgtatatttaagttgttgcagttaaaaagctcgtagttggactttgggttgggtcgtccggtccgccctttgggtgtgcaccggtcgtctcgtcccttctaccggcgatgcgttcctagccttaattggccgggtcgtgcctccggtgctgttactttgaagaaattagagtgctcaaagcaagcccaagctctggatacattagcatgggataacatcataggatttcggtcctattgcgttggccttcgggatcggagtaatgattaacagggacagtcgggggcattcgtatttcatagtcagaggtgaaattcttggatttatgaaagacgaacaactgcgaaagcatttgccaaggatgttttcattaatcaagagcgaaagttgggggctcgaagacgatcagataccgtcctagtctcaaccataaacgatgccgaccagggatcggcggatgttgcttttaggactccgccggcaccttatgggaaatcaaagtttacgatggtccctgcggatgctaacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagccgtctttggcggcgaaggtgaaataccactacttttaacgt

SEQ ID NO: 1692 - DNA, 466 bp, Artificial
  Synthetic
cccacgcgtccgaaacacactgattattttctctccgacgccgccatgtctctgctctcagatctcgttaacctcaacctcaccgatgccaccgggaaaatcatcgccgaatacatatggatcggtggatctggaatggatatcagaagcaaagccaggacactaccaggaccagtgactgatccatcaaagcttcccaagtggaactacgacggatccagcaccggtcaggctgctggagaagacagtgaagtcattctataccctcaggcaatattcaaggatcccttcaggaaaggcaacaacatcctggtgatgtgtgatgcttacacaccagctggtgatcctattccaaccaacaagaggcacaacgctgctaagatcttcagccaccccgacgttgccaaggaggagccttggtatgggattgagcaagaatacactttgatgcaaaaggatgtgaact

SEQ ID NO: 1693 - DNA, 335 bp, Artificial
  Synthetic
cccacgcgtccggcgggacggattcaaagtcatatctgagctgccttcagattgttttggagcttatattatctctatggcaacttcacctagtgatgtgcttgcggttgagcttttacagcgcgaatgccatgtgaaaaatccacttagagttgttccactctttgagaagctagctgatcttgaagcagctcctgccgctgttgcaagactcttttctatagactggtacaaaaaccgtattaacggtaaacaagaggttatgattggttactcagattcagggaaagatgcagggcgtctctcagctgcttgggagctatacaaagctcaag

SEQ ID NO: 1694 - DNA, 583 bp, Artificial
  Synthetic
ccccccgagttccccatttcagcagcaaaggcaacaatggcggctgcaagagtaatgatatcagccaacaacactctaacaacttctcttttatccaaaattcctctccaaaagcccaatagtttcaacctttgtttccgcaataggtctgctgctgcacacaggagccaacttttcacttgcactgctatttacaatccccagattcaaatcaaagaacaaggccagcccgaaactttagattaccgtgtctttttcgttgatgattccggcaaaaaggtgtccccttggcatgacataccactgcatttaggtgatggtgttttcaattttattgctgaaattcctaaagaatcgagtgcaaagatggaagttgctacagatgagctgtacacaccaataaagcaagacacaaagaaggggaaacttagatactacccatataatattcattggaactatggattgcttcctcaaacctgggaagacccctcatttgcaaatgctgaagttgagggggcattcggagataatgaccctgttgatgttgtccagattggggaaagtcgtgctaaaattggcc

SEQ ID NO: 1695 - DNA, 605 bp, Artificial
  Synthetic
tttttcctctcccctcaccaaacccccttcttctccatctgcacaatcaaccattcccatcacacaacttacacaacaattcaaccatcaaaatggctttatccacaaatcggacggttaaccaccttctaaagccattatcagccgccatctgggccacgcgccgcctatcgtccgacaccatcaccgtcgagactagcctcccatttaccggccacaacatcgatcctccttcacgcgccgtcgagacaagcgccaatgaactaatgactttcttcaaagacatggcggagatgcggcgtatggagatcgccgctgattcgctctacaaggcgaaactcattcgtggattctgccacctctacgacggccaggaggccgttgccataggcatggaagctgcaattaccaaaaaggactgtatcattacggcttatagggatcactgtttattcctagggcgtggtggagggttatacgagtcatttgcggagttaatggggagaaaagatgggtgttcgaaagggaaaggagggtcgatgcatttttataagaaggagagtggattttatggaggtcatgggattgtaggtgctcaagttcct

SEQ ID NO: 1696 - DNA, 593 bp, Artificial
  Synthetic
gaattcagaatcacagagaaacccagtgaagcacttgggaaacaaacacaatgtctttttcgacaatcaaaatcattcaacctgtcccagttactagatctcatgaaaaatccattcttgaccctttaaaatcaaacaacaattccttcttgggcactactaataatcttcgttcaatctcatccaaatcgaatttcccttcatttattcgtcgatcttcttcaatttcagctgtttctgatgtcgttaaggagaaaaaactcaaatctaactccgccatctccaatttgttgataactaaagaggaaggactggtattatatgaagatatggtattagggagagcatttgaagatatgtgtgctcagatgtattacagaggtaaaatgtttggatttgttcatctttacaatggacaagaagctgtttcaactggatttattaagctattgaaaaaggaagattctgtagttagtacttaccgtgatcatgttcatgcactaagtaagggtgtacctgctcgtcaagttatgagtgagctctttggtaaggctactggatgttgtcgtggacaaggaggatctatgcatatg

SEQ ID NO: 1697 - DNA, 566 bp, Artificial
  Synthetic
tagcactcaccaaacgctctctccagattctctcttacagagatcgaaaatggcgctatctacaggccgaagaaccgtcaatcacctcttgaaacctctaacggcggcggtgtccgccacgcgccacgtatcgtcggactcgaccgccacaatcacggtagaaaccagcctcccattcaccggccacaagatcgatcctccatcccgcaccgtcgaaacaagcgctaatgaactcatgacttttttcaaggacatggtggagatgcggcggatggagatcgccgcggattcgctctacaaagcaaaactcatccgtggcttctgccatctctacgatggacaagaagccgtcgctattggcatggaagccgcaattaccaaaaaggattgtattattacagcttatagagaccattgcatcttccttgcccgcggcggagggttatatgaatcatttgcggagcttatgggaaggaaagatggatgttcgaaaggtaaaggaggatccatgcatttttataggaaggatagtggattttatggaggtcatggtattgttggtgctc

SEQ ID NO: 1698 - DNA, 722 bp, Artificial
  Synthetic
acgcgtcgagaagaacagctaggaagagctcctcgtctctccatggcgtcgcgagctatggcgtcgatcagcccatcttccatctccgccggcgcctgccgcgacgacgtcggatcttccagtgtagtaggcttccataatagaagcggcaacagcagcgcatttaccggccgcggcatccgggtctcgaccagatcgctgtccatcgccagcgccaagaagaggagctgcgccgtcgccgccaccgccgcgccggtcaaggaatccccgccaaagatcgccgacacgctcgtcacgcgggaggaaggcctggagctctacgaggacatggttcttggtcgatccttcgaggatatgtgcgcccagatgtactaccgcagcaagatgtttggattcgtccacctctacaacggccatgaagccgtctccacgggattcatcaaggcgctcaagaaggacgactacatctgtagcacgtatcgagaccacgtccatgcgctgagcaagggcgtccccgccaggcaagtcatgagcgagctcttcgggaagtccacgggatgctgccgcggccagggcggatccatgcatatgttctccaaagagcaccgcctgctcggtggattcgccttcatcggcgaggggatccccgtcgccaccggcgcggcattcaccaccaagtactcgcgggaggttctcaaggaccagagcgttgatgcggtgac

SEQ ID NO: 1699 - DNA, 686 bp, Artificial
  Synthetic
agcatgctatgcgtttccgtgtcaaggatttctggaaatggatacagctttggtcttccaacaagcccggcccgtctccctctccggcgccggacgtgatccatgtcgacattccggtcccattccagctccatctcctcaaggaaggcccgcgtcgcgagtccgagaccaccaaggaggacctcgtcaggatgtacagggatatgttccgcattcgccggatggagatcactgctgataagctcttcaagtcccagctagttcgcggtttctgccacctttacgatggccaagaagcggtcgcgatcggcatggaagccgcattgacgtttgaagactcggtgatcacggcgtacagagatcacggtacattccttggacgaggaggaacagtgcatgaatgtttcgccgagctcatgggaaaatccaccggatgtgctcgagggaaaggaggctccatgcatctctacaagccttcgaataacctctacggtggatggggaattgtgggaacctcgggacctctcggtaccggattggcatttgcgaacaagtaccagaagaaggacaacgtcacagtagcaatctatggtgatggtgctggcaatcagggacaattgtttgacgcgaaaaatatggcggcgctgtgggatctgccggttatttttctcgtcgagaacaatcac

SEQ ID NO: 1700 - DNA, 748 bp, Artificial
  Synthetic
tcgaccacgcgtcggaaggaagagcgatggcgatagcgatggctcggcggcggcttctctcctcctcctcctcctccacgtcctcggcagcggcagccgcggcgccgcttctccggcgggcggcggcgctcaatccatccaggtacttcgcgtcgtcggggatggacgacacgacgccgttcgtggtggacatccccgtgccctacgccgggcatcgatgcgaccccccggagcagaaggtggagacttcggccaaagagctggtggactacttcaaggtgatgtacgtgatgaggcggatggagatcgccgcggacagcctctacaaggccaagtttatacgtggtttctgccacctttacgacggccaagaggccgtgtgcgtcgggatggaggcggcgctcaccaaagaggacgctatcatcaccgcgtatcgagaccactgcacgcatcttggacgtggtggaactgtgctcgaggtgatggccgagttgatggggaggaaggatggatgctcgctgggaaagggtggatcgatgcatatgtacaagaaggatgccaacttctatggagggaatgggatcgttggtgcacaaactgctctcggtgctggcctggccttcgcgcagaagtataacaagcagggcgcggtgtcgctggcgctgtatggagatggtgcggccacaccagggcagctgtttgaggcgatgaatatcgcggcgctgtgggacttgccggcgatcttcgt

SEQ ID NO: 1701 - DNA, 1066 bp, Artificial
  Synthetic
tttggtttctcctctctatttctcgttttctccgcacttttcacttattaaaccattgattatataattcaacacatttcatctgtttgttagacacagcaattccattttttgatttttcctgtaattccttcatctgtgtctccaaaaacatggcgacggctttttctgcaacaaaagttttgcaacctttgccctttaattctactagatctgctgaaaacccccttttgatccaaagttcatcttttcttggatcatcattttctcataagctttctctcaagaagccttttttgcctcctaattcccagcgtcgatccaatgcagcggttgttgctgtttctgatgttgttaaggaaaagaagtctaagtccaaatcgtctctctccaatctgttgattactaaagaggaagggttggtactgtatgaggacatggtgctgggaagagcttttgaggacatgtgcgcccaaatgtattacaggggaaaaatgtttggttttgtgcatttgtacaacggccaagaagctgtctcgactggtttcattaagctcttgaagaaggaagactctgtagttagcacttaccgtgaccatgtccatgcattgagtaaaggtgtcccagctcgtcaagtgatgagtgagctatttggaaagaccacgggctgttgtagaggccagggtggatccatgcacatgttctccaaagagcacaatgttcttggtggtttcgcttttatcggtgagggaatcccggtggctgcaggtgctgcattcactagcaagtacagaagggaggtcttgaaggaggctgattgtgatcatgtcactctagccttctttggtgatggaacttgcaacaatggccaattctacgagtgcttgaacatggccgcattgtggaaattgcccattatctttgttgttgagaacaatctgtgggcaattgggatgtctcacttgaggtctacttctgatcctgaaatttggaagaaaggtcctgcttttgggatgcctggggttcatgttgatggcatggatgtgttaaaggtgagggaggtagc

SEQ ID NO: 1702 - DNA, 710 bp, Artificial
  Synthetic
cccacgcgtccgagcactgctactggacatactctactactactagccagtaagctagctaactaactacgtggctatggcccccaccgtgatggcctcctcggccacctccgtggctccattccaagggctcaagtccaccgccggcctccccgtcagccgccgctccaccaactcgggcttcggcaacgtcagcaatggcggaaggatcaagtgcatgcaggtgtggccaattgagggcatcaagaagttcgagaccctatcgtacctgccaccactcaccgtggaggatcttttgaagcagatcgagtacctgcttcgatccaagtgggtgccttgtctcgagttcagcaaggttgggttcgtctaccgtgagaaccacaggtctcccggatactacgatggcaggtattggaccatgtggaagctgcccatgttcggctgcaccgatgccacccaggtgctcaaggagctcgaggaggccaagaaggcctaccctgatgcctttgtccgtatcatcggcttcgacaacgtcaggcaggtgcagttgattagcttcatcgcctacaagcccccaggttgcgaggagtctggtggcaactaagctaagatcaagcatcgcgctggtggattgctgcctataataatagtatgcagctttgttttgggctatgttgatgatatatcaatatataatatgctatatattt

SEQ ID NO: 1703 - DNA, 714 bp, Artificial
  Synthetic
ccccccccgaatattcagcaatggcttcctcagttatgtcctcagctgccgctgttgccaccggcgccaatgctgctcaagccagtatggttgcacctttcactggcctcaagtccgcaacctccttccctgtttccagaaaacaaaaccttgacattacttccattgctagcaacggcggaagagttcaatgcatgcaggtgtggccaccaattaacaagaagaagtacgagacactctcataccttcccgatttgagccaggagcaattgcttagtgaagttgagtacctgttgaaaaatggatgggttccttgcttggaattcgagactgagcgtggattcgtctaccgtgaacaccacagctcaccaggatattatgatggcagatactggaccatgtggaagttgcccatgttcgggtgcactgatgccactcaggtgttggctgaggtcgaggaggcaaagaaggcttacccacaagcctgggttagaatcattggattcgacaatgtccgtcaagtgcaatgcatcagtttcatcgcctacaagccagaaggctactagaatctccatttttaaggcaacttatcgtatgtgttccccggagaaactgttttggtttttcctgcttcattatattattcaatgtatgtttttgaattccaatcaaggttatgagaactaataatgacatttaatttgtttcttttct

SEQ ID NO: 1704 - DNA, 736 bp, Artificial
  Synthetic
ggtaaaggaaaaaaaaggaaaagagagaaagagaaatctttctgtcttaagtgtaattaacaatggcttcctcagttctttcctcagcagcagttgccacccgcagcaatgttgctcaagctaacatggttgcacctttcactggtcttaagtcagctgcctcgttccctgtttcaaggaagcaaaaccttgacatcacttccattgccagcaacggcggaagagtgcaatgcatgcaggtgtggccaccaattaacaagaagaagtacgagactctctcataccttcctgatttgagcgtggagcaattgcttagcgaaattgagtacctcttgaaaaatggatgggttccttgcttggaattcgagactgagcacggatttgtctaccgtgaacaccacaagtcaccgggatactatgacggcagatactggaccatgtggaagttgcctatgttcggatgcactgatgccacccaagtgttggccgaggtggaagaggcgaagaaggcatacccacaagcctggatccgtattattggattcgacaacgtgcgtcaagtgcagtgcatcagtttcattgcctacaagccagaaggctactaagtttcatattaggacaacttaccctattgtccgactttaggggcaatttgtttgaaatgttacttggcttcttttttttttaattttcccacaaaaactgtttatgtttcctactttctattcggtgtatg

SEQ ID NO: 1705 - DNA, 611 bp, Artificial
  Synthetic
gaattcaagtatgaactaattcagactgtgggactgcgaatggctcattaaatcagttatagtttgtttgatggtacttgctactcggataaccgtagtaattctagagctaatacgtgcaacaaaccccgacttctggaagggatgcatttattagataaaaggtcgacgcgggctttgcccgttgctcagatgattcatgataacttgacggatcgcacggcctttgtgctggcgacgcatcattcaaatttctgccctatcaactttcgatggtaggatagtggcctactatggtggtgacgggtgacggagaattagggttcgattccggagagggagcctgagaaacggctaccacatccaaggaaggcagcaggcgcgcaaattacccaatcctaacacggggaggtagtgacaataaataacaataccgggctcttcgagtctggtaattggaagagttaactgcatgcaggtatggccaccaagtggtttgaagaagtttgagaccctctcataccttcctccattgaccgtcgagcaattgtcaaaggaagtcgactaccttctccgtaatggatgggttccctgtttggaattcgacgcca

SEQ ID NO: 1706 - DNA, 293 bp, Artificial
  Synthetic
gaattcatgaccaccatccggtttgaagaaggttgacaccctctcatactttcctgcattgaccgcggactaattatcaaaggaaggtgactaccttctccgtaatggatgggttccctgcctgaaattcgacgccagaagattactgtacagataacacagcaacacccctggatactatgagtggtgcggtactggacaatgcggaagttacccatgttcgggtgtaccgactctttccacgttatcaaggagctacaagaggccaaggctgcttacccacactcattcat

SEQ ID NO: 1707 - DNA, 685 bp, Artificial
  Synthetic
caagaagtactcgagcaaagaaggagagagcttggtgagctgcagagatggccccctccgtgatggcgtcgtcggccaccaccgtcgctcccttccaggggctcaagtccaccgccggcatgcccgtcgcccgccgctccggcaactccagcttcggcaacgtcagcaatggcggcaggatcaggtgcatgcaggtgtggccgattgagggcatcaagaagttcgagaccctctcctacctgccaccgctcaccgtggaggacctcctgaagcagatcgagtacctgctccgttccaagtgggtgccctgcctcgagttcagcaaggtcggatttgtctaccgtgagaaccacaggtcccctggatactacgacggcaggtactggaccatgtggaagctgcccatgttcgggtgcaccgacgccacccaggtgctcaaggagctcgaggaggccaagaaggcgtaccctgatgcattcgtccgtatcatcggcttcgacaacgttaggcaggtgcagctcatcagcttcatcgcctacaagcccccgggctgcgaggagtctggtggcaactaagccgtcatcgtcatatatagcctcgtttaattgttcatctctgattcgatgatgtctcccaccttgtttcgtgtgttcccagtttgttcatcgtcttttgatttaccggc

SEQ ID NO: 1708 - DNA, 660 bp, Artificial
  Synthetic
gaattcaggcgtagtaattctagagctaatacgtgcaacaaaccccgacttctggaagggatgcatttattagataaaaggtcgacgcgggctttgcccgttgctcagatgattcatgataacttgacggatcgcacggcctttgtgctggcgacgcatcattcaaatttctgccctatcaactttcgatggtaggatagtggcctactatggtggtgacgggtgacggagaattagggttcgattccggagagggagcctgagaaacggctaccacatccaaggaaggcagcaggcgcgcaaattacccaatcctaacacggggaggtagtgacaataaataacaataccgggctcttcgagtctggtaattggaatgagtacaatctaaatcccttaacgaggatccattggagggcaagtctggtgccagcagccgcggtaattccagcaacggtgggagagttaactgcatgcaggtatggccaccatccggtttgaagaagtttgagaccctctcataccttcctccattgaccgtggagcaattatcaaaggaagttgactaccttctccgtaatggatgggttccctgcctggaatttgacgccagaggattcgtgtacagagaacacggtaacacccctggatactatgatg

SEQ ID NO: 1709 - DNA, 580 bp, Artificial
  Synthetic
gaattcaagtatgaactaattcagactgtgaaactgcgaatggctcattaaatcagttatagtttgtttgatggtacttgctactcggataaccgtagtaattctagagctaatacgtgcaacaaaccccgacttctggaagggatgcatttattagataaaaggtcgacgcgggctttgcccgttgctcagatgattcatgataacttgacggatcgcacggcctttgtgctggcgacgcatcattcaaatttctgccctatcaactttcgatggtaggatagtggcctactatggtggtgacgggtgacggagaattagggttcgattccggagagggagcctgagaaacggctaccacatccaaggaaggcagcaggcgcgcaaattacccaatcctaacacggggaggtagtgacaataaataacaataccgggctcttcgagtctggtaattggaaagaggattcgtctacagagaacacggtaacacccccggatactacgatggtcgttactggacaatgtggaagctacccatgttcggttgtaccgatgcttcccaggttatcaaggagct

SEQ ID NO: 1710 - DNA, 424 bp, Artificial
  Synthetic
gaattcaaaggaaaaaatggcttcttcagtgatttcctctgccgcagtcgcctccgtaaggagtgccgcccccgctcaagctagcatggttgcaccattcagtggtttgaaatcagttgccgctttccctgttacccgcaaatcaaacgatatcacctcagttgccagcaacggtggaagagttaactgcatgcaggtatggccaccatccggtttgaagaagtttgagaccctctcataccttcctccattgaccgtggagcaattatcaaaggtagtgacaataaataacaataccgggctcttcgagtctggtaattggaatttgacgccagaggattcgtgtacagagaacacggtaacacccctggatactatgatggtcgttactggacaatgtggaagttacccatgttcggttgta

SEQ ID NO: 1711 - DNA, 561 bp, Artificial
  Synthetic
gaattctaattaaaacaaagcattgcgatgggccctgcggatgctaacgcaatgtgatttctgcccagtgctctgaatgtcaaagtgaataaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagccgtctttggcggcgaaggtgaaataccactacttttaacgttattttacttattccgtgaggcggaagcggggcatcgcccctctttttatatccaaggctagcttgctatgccgatccgttgctgcattcccagttacccgaaaatcaaacgacatcacctccgttgccagcaatggtggaagagttaactgcatgcaggtatggccaccaagtggtttga

SEQ ID NO: 1712 - DNA, 762 bp, Artificial
  Synthetic
gaattcaggccaaggctgcatacccagactctttcatcagaatcatcggattcgacaacgttcgtcaagtacaatgtgttagtttcatcgcatacaagccagacagtactgcctactgaaaacctttgatgaattagttcatacttacatatgcttgtctcaaagattaagccatgcatgtgtaagtatgaactaattcagactgtgaaactgcgaatggctcattaaatcagttatagtttgtttgatggtacttgctactcggataaccgtagtaattctagagctaatacgtgcaacaaaccccgacttctggaagggatgcatttattagataaaaggtcgacgcgggctttgcccgttgctcagatgattcatgataacttgacggatcgcacggcctttgtgctggcgacgcatcattcaaatttctgccctatcaactttcgatggtaggatagtggcctactatggtggtgacgggtgacggagaattagggttcgattccggagagggagcctgagaaacggctaccacatccaaggaaggcagcaggcgcgcaaattacccaatcctaacacggggaggtagtgacaataaataacaataccgggctcttcgagtctggtaattggaatgagtacaatctaaatcccttaacgaggattcgtctacagagaacacggtaacacccctggatactatgatggccgttactggacaatgtggaagctacccatgttcggttgtaccgacgcttc

SEQ ID NO: 1713 - DNA, 683 bp, Artificial
  Synthetic
cccacgcgtccggcaaaagctaaataattaattgcaacaatggcttcctctgtgatttcctcagctgctgccgttgccaccggcgctaatgctgctcaagccagcatggttgcacccttcactggcctcaaatctgcttcctccttccctgttaccagaaaacaaaaccttgacattacatccattgctagcaatggtggaagagtccaatgcatgcaggtgtggccaccaattaacatgaagaagtacgagacactctcataccttcctgatttgagccaggagcaattgcttagtgaagttgagtatcttttgaaaaatggatgggttccttgcttggaattcgagactgagcgtggatttgtctaccgtgaacatcacagctcaccaggatactacgatggcagatactggaccatgtggaagttgcccatgttcgggtgcactgatgccactcaggtgttggctgaggtcgaggaggcaaagaaggcttacccacaagcctgggttagaatcattggattcgacaacgtccgtcaagtgcaatgcatcagttttatcgcctccaagccagaaggctactaaaatctccatttttaaggcaacttatcgtatgtgttccccggagaaactgttttggttttcctgcttcattatattattcaatgtatgtttttgaattc

SEQ ID NO: 1714 - DNA, 825 bp, Artificial
  Synthetic
tggacatactctactactactagccagtaagctagctaactaactacgtgctatggcccccaccgtgatggcctcctcggccacctccgtggctccattccaagggctcaagtccaccgccggcctccccgtcagccgccgctccaccaactcgggcttcggcaacgtcagcaatggcggaaggatcaagtgcatgcaggtgtggccaattgagggcatcaagaagttcgagaccctatcgtacctgccaccactcaccgtggaggatcttttgaagcagatcgagtacctgcttcgatccaagtgggtgccttgtctcgagttcagcaaggttgggttcgtctaccgtgagaaccacaggtctcccggatactacgatggcaggtattggaccatgtggaagctgcccatgttcggctgcaccgatgccacccaggtgctcaaggagctcgaggaggccaagaaggcgtaccctgatgcattcgtccgtatcatcggcttcgacaacgttaggcaggtgcagcttatcagcttcatcgcctacaagcccccgggctgcgaggagtctggtggcaactaagccgtcatcgtcatatatagcctcgtttaattgttcatctctgattcgatgatgtctcccaccttgtttcgtgtgttcccagtttgttcatcgtcttttgattttaccggccgtgctctgcttttgtttttgtttcacctgatctctctctgacttgatgtaagagtggtatctgctacgactatatgttgttgggtgaggcatatgtgaatgaaatctatgaaagctccggctatatatattta

SEQ ID NO: 1715 - DNA, 686 bp, Artificial
  Synthetic
ccgctcaagccactgctgcagcgtgactctgctctagcacctcaccaagcagaaagctagagagctagcaatggcgcccaccgtgatggcctcgtcggccacctccgttgctcccttccaggggctcaaatccaccgccgggctccccgtcagccgccgctccaacagcgccggcctcggcagcgtcagcaacggtggaaggatcagctgtatgcaggtgtggccgattgaaggcatcaagaagtttgagaccctgtcgtacctgccaccgctcacggtcgaggacctcttgaagcagatcgagtacctgctccggtccaaatgggtgccttgcctcgagtttagtaaggtcgggttcgtctaccgtgagaaccacaggtctcctgggtactatgatggcaggtactggaccatgtggaagctgcctatgttcggatgcactgatgccacccaggtgctcaaggagctcgaggaggccaagaaggcatatccagatgcatttgttcgcatcatcggcttcgacaacgtcaggcaggtgcagttgattagcttcatcgcctacaagcccccgggttgcgaggagtccggcggaaactaagctagttggcaagccagcaagctcactcgtgagctctatacagaggagactcgattgatctattcggttttggcagctttgaacgttc

SEQ ID NO: 1716 - DNA, 738 bp, Artificial
  Synthetic
cccgctcttgaaagcaaaggtcaagggtagcaatagctttaagcttagaaattattttcagaaatggcttcctcagttatgtcctcagcagctgctgttgcgaccggcgccaatgctgctcaagccaacatggttgcacccttcactggcctcaagtccgcctcctccttccctgttaccaggaaacaaaaccttgacattacctccattgctagcaatggtggaagagttcaatgcatgcaggtgtggccaccaattaacatgaagaagtacgagacactctcataccttcctgatttgagccaggagcaattgcttagtgaagttgagtaccttttgaaaaatggatgggttccttgcttggaattcgagactgagcgtggattcgtctaccgtgaacaccacaactcaccaggatactacgatggcagatactggaccatgtggaagttgcccatgttcgggtgcactgatgccactcaggtgttggctgaggtcgaggaggcaaagaaggcttacccacaagcctgggttagaatcattggattcgacaacgtccgtcaagtgcaatgcatcagttttatcgcctccaagccagaaggctactaaaatctccatttttaaggcaacttatcgtatgtgttccccggagaaactgttttggttttcctgcttcattatattattcaatgtatgtttttgaattccaatcaaggttatgagaactaataatgacat

SEQ ID NO: 1717 - DNA, 908 bp, Artificial
  Synthetic
gttttcaccaacttttcatatgcttgagatccagaggaaaaaaaaaacagagaacacagtagtaggcacaaccctcgtcacactcacccacccactcatcagccgacaccattttgaaatattcctacataaccacttcgatacccattgttaatattgcacttaccttagatctgaactttttcctcagctgcagaaaacaaaatatcaaaacaatggagtacaagggaattcttttgggcatgggaaatccattgctcgacatctcagctgttgtagatcaagatttcttgaacaagtatgacatcaggccgaacaatgcaattcttgctgaggagaagcacttgcctatgtatgatgaactggcatccaagagcaatgttgaatacattgctggaggtgcaacacaaaattctatcagagtggctcagtggatgctaccatttccaggtgcaacaagttacatgggctcgattggaaaggacaagtttggggagaaaatgaagaacaatgcaaaggatgctggcgtcaatgttcattactatgaggatgatgctccaacagggacttgcgctgtttgtgtactcgatggtgagaggtcattggtagccaacttatcagctgcaaactgctacaaggttgaccatttgaagcgaccagagaactgggctttggttgagaaggccaagttttactacattgctggattctttctcactgtttccccagaatctattcagcttgttgctgagcatgccgctgccaataacaagatattctcgatgaacctttctgcaccattcatctgcgagttcttcagggatccacaagagaaagccttgccgtataatggattttgtattcggaaatgagaccgaagcaagaaccttctcaaaagtacatggatg

SEQ ID NO: 1718 - DNA, 1004 bp, Artificial
  Synthetic
gccctcctcctcaccttcacccatcgtgcggtaaactctagccagatctcgctcgctcgccgctcgccgccgccgccgcgttccaccgagcggagagtagagggaatggcgtccgagggcgtgctcctggggatgggcaaccccctcctcgacatctccgccgtcgtcgacgacgccttcctcaccaagtatgacgtcaagctgaacaatgcaattctcgctgaggaaaagcacttgcctatgtatgatgagttggccagcaagggcaatgttgaatatattgccggaggagccacccagaactctatcagggttgctcaatggatgcttcaaactcctggtgcaacaagttacatgggttgcattggaaaggataagtttggtgaggagatgaagaagaatgcccaagctgctggtgttactgctcattactacgaggatgaggctgctcccacgggcacatgtgctgtctgtgttgttggtggtgaaagatcactggttgcaaacttatcagcagcaaactgctacaaatctgagcatctgaagaaaccggagaactgggcactagtggagaaagcaaaatacatctacattgctggctttttccttacggtctccccagattctattcagcttgttgctgagcatgctgccgctaacaacaaggtgttcctgatgaacctctctgcaccctttatctgtgagtttttccgtgatgcccaggagaaggttcttccgtttgtggactacatcttcggtaacgaaacagaagcaagaatctttgctaaagtccgtggatgggagactgagaatgttgaggagatcgcgttgaagatttcccagcttccattggcctctggaaaacaaaagaggattgccgtgattactcaaggtgctgatccagtagttgtcgctgaggatggacaggtgaaaacattccctgtgatcctactggcaaaggagaagcttgttgacaccaacggcgctggtgatgcctttgttgg

SEQ ID NO: 1719 - DNA, 618 bp, Artificial
  Synthetic
gaattcacgacatcaagttgaacaatgcaaggcttgcagaggaaaagcatgtgcctatgtacgatgaattggctgctaaagacaatgttgagtacattgctggaggtgcaactcaaaattctatcagagttgctcagtggatgctacaaactcctggtgccactagtttcattggttgcatcggaaaggataaatatggtgaagagatgacgaaaaactcaaagcttgctggtcttaacgttcactactacgaggatgagaccgcagctactggtacgtgcgctgtttgtgttgttggtggcgagaggtctctcattgccaacctggccgcagcaaattgctacaaatccgaacatttacagaaaccagaaaactgggctttggttgagaaggctaaatactattacattgctggatttttcctcactgtttcccccgactccattcagcttgtagcagagcatgccgctaaaaacaacaaggtcttctgtcacaacctttctgctcctttcatctgcgagtttttcaagggtgtccaggagaatgttcttccgtacgtggattatcttttcggaaacgagtcagaagcaagaactttctcaaaggttcacggctggg

SEQ ID NO: 1720 - DNA, 831 bp, Artificial
  Synthetic
ccccccccggcacctaccttaagatctaaacgtccattttcaacagcaaaacaaattcacagaaatatcaaaaaatggattctgagggtattcttttgggtatgggcaatccattgctcgatatctctgctgttatcgatcaagatttcctcaacaagtatgacattaagccaaacaatgcaattcttgctgaggaaaagcacttgtctatgtatgacgaaatgacatccaagtttaatgttgaatacattgctggaggcgcaacacaaaattcaatcagagtagctcagtggatgcttcaaattccaggtgcaacaagttacatgggctctattgggaaggacaaatatggggaggaaatgaagaaaaatgcaaaagatgctggtgtcaatgtttgctattatgaggatgagagtccaacgggtacttgtgctgtctgtgtccttgatggcgaaaggtcgctggttgcaaacttatcagctgcaaactgctacaaggttgaccatttgaaaaaaccagagaactgggctttggtggagaaggccaagtactattacattgctggattttttctcactgtttctccagaatctattcagcttgttgctgagcatgcagctgccaaacacaaggttttttcaatgaacctttcagcaccatttatctgtgagttcttcaaggatcaacaggagaaagtcttgccatatatggactttgtctttggtaatgagacagaagcaagaaccttctctagagtccacagctgggagactgataatgtagaagaaatagctttgaagatctcccagtgggcaaaggcatcaggaacac

SEQ ID NO: 1721 - DNA, 1058 bp, Artificial
  Synthetic
  misc_feature (256)..(256): The residue at this position can be any nucleotide.
  misc_feature (275)..(277): The residues at these positions can be any nucleotide.
  misc_feature (288)..(288): The residue at this position can be any nucleotide.
ttgtagttatacaaaaacaggggctgagaccaagagagaagttctacctcaagcaacctgtacatggcgctgtatctactgtacgagtcggcgtctgggtacgcgttgttcttggctcatggaattgatgaaattgggcagaacacggaggcggttcgcaactccatcactgatctcaatcggttcgggaaggtcgtaaagattgaagcttttaacccttttgagtcagcccttgacgccctcaatcaatgcaatngctgtttcctagaaggggnnnaaatgcactgnagagagctaaggaacttcttggagcgtagtctcccaaaagtcaaggagggtaagaaggctaagttcagtttaggattggcagagcctaagcttggttctcatatccatgaagtaactaagattccctgccaaagtaatgagtttattcttgagcttctgcgtggagtacgcttgcattttgagaagttcattgaaaacctaaagcctggagatctggagaaagcccaacttggtctgagtcacagttacagcagagcaaaggtcaagttcaacgttaatcgtgttgacaatatggttactcaggcaattgtcctacttgatactcttgataaagatattaatacctttgccatgagagtcagagaatggtactcttggcatttcccagagttggtgaatattgtcaatgacaattatctatatgccaaagtagcaaaatttgttgatgacaaatcccaattgtgtgaaaacaaaattccagacttaatagaaatagttggagatgaagataaagcaaaagaaattgtagaagctgcaaaagcatccatgggccaggatttgtcgccagttgacttgattaatgtcaagatgtttgcacagagggtaatggaccttgtcgaatacaggaaggatctttatgattatcttgttgctaaaatgcatgacatagcaccaaatttggcttcgctgattggtgaagttgttggtgctcgtttaatttctcatgctggtagtctcacaaatttggcaaagtgcccttcttctaccct

SEQ ID NO: 1722 - DNA, 527 bp, Artificial
  Synthetic
acagcgcagtggcgggcatggacttggatcagtggatcgaaaaggtcaagtcggggcagcacctcctcgaggacgagctcaagcagctgtgtgaatatgtcaaggagattttggtagaggagtcgaatgtgcagccagtagacagcccggtcacggtttgcggagatattcatggccagttccacgacttgatgaagctcttccacaccggcggccatgtcccccacacgaattacatctttatgggagattttgtggatcgtggatataacagtctcgaggtttttactattcttcttcttctcaaagcgaggtatcctgcgcatatgactctcttgagagtgaatcacgagagtaggcaaattacgcaggtgtatggtttctatgacgaatgcgagcggaagtatggaaatccaaacgcttggcgttactgtactgacgtttttgactatctgactatttcggcgatcatcgacggaagagtgctttgcgtgcaaggaggtctatcgactgacatcagatccatt

SEQ ID NO: 1723 - DNA, 413 bp, Artificial
  Synthetic
cccacgcgtccgaattcacaatttctcttcttctaaatccatggagtgatgatgatgatagatagattgaatccaaacacaaaccggatccgagattaaaaacaatccggattgtttatatttactttagatcggagaaagatgccgccggcgaccggagatatcgatcgtcagatcgagcagcttatggagtgtaaagcgttatctgaaacggaggtgaagatgttgtgtgagcacgcaaagacgattcttgtggaagagtataatgttcaaccggttaaatgtccggttaccgtctgcggtgatatccacggccaattttacgatctaatcgagctttttcgtatcggtggttcttctcctgatactaattatcttttcatgggtgattatgttgatcgagggtattattc

SEQ ID NO: 1724 - DNA, 653 bp, Artificial
  Synthetic
aagaaaacttttggatagacaaatgtctgtcaacagtgttcccaaaaaggtgattgcccatcttttgaaacctcgaggatggaagccgcctgtcagacggcaatttttcttggattgcaatgagatagctgatctctgtgatagtgcagaaagaatattttccagtgaacctagtgtgttacagctaagggctcctattaagatatttggtgacttgcatgggcaatttggggatctcatgcgcctttttgatgagtatggttccccatcaactgctggggacatagcgtacatcgattatctcttcttaggagattatgttgataggggccagcacagcttggagaccatgactcttctccttgctttaaaggtggagtatccacacaacgttcatttaattcgagggaaccatgaagcggcagatattaatgctctttttggcttccgaattgagtgcattgaacgaatgggtgagagagatggaatctgggcttggcatcggatcaataggttgttcaattggcttcctctggcagcactaattgagaaaaaaataatctgtatgcacggtggtattggaaggtcaattaatcatgtagaacagatagagaatatacagcgtcctatcaccatggaagcagggtcgatca

SEQ ID NO: 1725 - DNA, 625 bp, Artificial
  Synthetic
ggaaaccatgaaagcaggcagatcactcaagtgtatggattctatgatgagtgtcttaggaaatatggaaatgcgaacgtgtggaagtacttcaccgatttgttcgactacttaccactcacggcgctcattgagaaccaaattttctgtctccatggcggtctttcgccgtctctggatactttagaccacgtccgtgctctggatcgcattcaggaagtaccgcatgaaggaccgatgtgtgatctgctttggtccgacccggatgatcggtgtgggtggggaatctcgccaaggggtgcggggtacacattcggtcaagacatcgcagagcagttcaaccacactaatggcctgagcttggtggcccgtgcacaccagcttgtgatggaaggatacaactggtgccaggacaagaacgttgtgacggtgtttagtgctcccaactactgttaccggtgcggaaacatggcggcaataatggagatcgacgagacgatggggcggactttcctccaattcgagccggctcctcgacagagtgagcccgacgttactcgcaagacacccgactactttttgtaagaggcaagtcctttcttgttccttggcgagcttgagtttg

SEQ ID NO: 1726 - DNA, 699 bp, Artificial
  Synthetic
gatattattcgtggtttggttgagtttcggaacacaagacctggatcggggaatcaagttcatctcagtgaaggtgaaattcttcagctttgtgctgtctccaaagaaatatttcttcaacagcccaatctgcttgaattggaagctcccatcaagatctgcggtgatattcatgggcagtattcagatctattgaggctttttgagtatggagggttccctcccgaagctaattatttgttcttgggtgattatgttgaccgtggcaagcaaagcttggaaacaatatgtcttcttctagcttacaaaatcaagtaccctgagaacttcttcttgttgagagggaatcatgaatctgcttccattaatcgtatttacggtttctatgatgagtgcaaacgcaggttcaatgtcagactctggaaaatattcaccgattgctttaactgtcttcctgtggccgccttaattgatgacagaatactatgtatgcatggtgggatttccccagagctgaaaagtttggaccagattagaaatattgcacggccgatggatattccggagtctggtttggtatgtgatttactatggtcggatcctagtggagacgtaggctggggcatgaatgatcgtggtgtttcatacacttttggagctgacaaagtcccagagttcttggagaaacatgacatggac

SEQ ID NO: 1727 - DNA, 642 bp, Artificial
  Synthetic
attcgtcactgcttcacctcgcttgccattgaaaacgccagctacgtcaacaccgaaagaaggggttacatcgacaatttaaatattacgacaacgacaacgacaatggacgtggaaatgacagacgtcaaggagcctgcgtctaccttgtacactggcactctcgaccaatggattgaacagctgaaggaatgcaaaccgctgaccgaagccgaagttgccaccatgtgtgacatggctcaagaaattcttcagcaagaatctaacgtccagggtgtgcacacccctgtcacagtgtgcggtgatgtacacgggcagttccatgaccttatggagctattctgtattggaggaccctgtccagatacgaattacctgttcatgggagactatgttgaccgaggatactactcggtcgagactatctccttgctggttgccatgaagatccggtatcccaacagaatcaccatcttgcgaggaaaccacgaatctcgacaaatcacacaagtctatggcttctacgacgagtgcctgcggaaatacggccatgccaacgtttggaagcgattcacagacctcttcgactacttgcctctcacagctctcatagaaaacaaaatattctgtctgcacggagga

SEQ ID NO: 1728 - DNA, 595 bp, Artificial
  Synthetic
ggctatggcggcgcatcgcgacgagggctggttcgctatcgatcgagaggagggatgcgcggtggtgcccggcatctagatgtggcgacgccgcgattcttcttcttcttcttgtcccagcttctccgggcgtggagattttcggatttccggcctcaagcaactggagctagggcgcattggctgtgggtgatctaccgccggggcagggttgcacggatctgattgttccagcagcgctagggtttgtggattttggggagatttcttctccaaatcgtcgtcttcttggatcgatcgatccctcttgcttcgtccatccgccatgccttcccacggtgatcttgatcggcagatcgagcagctatgggagtgtaagccgctctcggagatggaggtgaagaatctgtgcgagcaagccagggccatcctcgtcgaggaatggaacgtccagccggtcaagtgcccggtgacggtgtgcggcgacatccacggccagttccacgatctgatcgagctctttcggatcggcggcaaggcgcccgacacgaattatctcttcatgggcgactatgtcgatcgcgggtactactct

SEQ ID NO: 1729 - DNA, 432 bp, Artificial
  Synthetic
ggcaggtgtcaaccagtggactgcacaaaaggataatttcgactttgttgaaacctcgagggtggaaacctccagctagaagacagtttttcttggatttcaatgacattgctgaactttgcgacactgctcagcaaattttcacacaagagccgaatgttcttaagctaaaagctcctgtgaagattttcggtgacctgcatggtcaatttggagacctgatgcggttgtttgatgaatacggtttcccttcaactgccggagacataacgtatatcgactaccttttccttggcgactatgttgacagaggacaacatagcttggaaactatcattttgctgctggcattaaaggtagagtatcctgaacatatacatctaatccgtgggaatcacgaggccgcggacatcaatgctctctttgggttcc

SEQ ID NO: 1730 - DNA, 739 bp, Artificial
  Synthetic
ttcgctttcccttccacagtagaaaaatcaaccccttcatgcgtacagattatagagacccagaaaaaggggatacccactttctcaatggacgctgcagcagttgataggatcattgagaagctaatagaagtccgatcatcgaagcctggaaagttggtgcagctgtccgagtctgaaatcaagcaactgtgtgttgcctctcgtgatatcttcctcaaacagcccaatctccttgaacttgaagcacccatcaaaatttgcggtgacattcatgggcagtacagtgacctgttgaggcttttcgaatatggtggttttcctccgaaggctaactacttatttttaggtgattatgtagatcgtggcaggcagagcctggaaacaatatgcctcttgcttgcctacaagattaagtatcctgagaacttttttctgcttagaggaaaccatgaatgtgcttcaataaataggatatatgggttctatgacgaatgtaagcgccggttcaacgtgaaactgtggaaatcctttacagactgtttcaattgtcttcctgtggcagcacttattgatgagaagatactatgcatgcatgggggtctctcgcctgatctctctagcttggatcagataagaaacttaccacgtccaactgccatacccgatactggtttgctttgtgatttactttggtcagatcctggtaaagatgtgaaggggtgggggatgaacgata

SEQ ID NO: 1731 - DNA, 629 bp, Artificial
  Synthetic
cccacgcgtccggccacctgttcggcgacaatttttcttggactgcaatgagatggcggatctttgtgacagtgccgaaaggatatttgcgagtgaacctagcgttttacagcttagggctcctattaagatattcggtgacctgcatgggcaatttggggatcttatgcgtcttttcgaagagtatggttccccatcgactgctggggatatatcgtatattgactaccttttcttaggagattatgttgacaggggccagcacagtttggaaacgataactcttcttcttgctttaaaggttgagtatcccctcaatgtacatctaattcgtgggaaccatgaagctacagatattaatgcgcttttcggctttcgaattgagtgcattgaacggatgggtgagcgagatggaatttgggcatggcatcgatttaatagattgttcaactggcttcctctggcagcattaatcgagaaaaagataatctgtatgcatggtggtattggaaggtcaattaatcatgttgaacaaatagaaaatatccagcgtcctatcactatggatgctggctcaattgttcttatggatttattgtggtctgacccaacagaaaatgatagcgttg

SEQ ID NO: 1732 - DNA, 816 bp, Artificial
  Synthetic
atttctctctactttctgtattctcctttcgggttttggggcagattctgagagattcacttcgttgtaaagaactgctctatcagtcgactctgcatttgggcaaataattgcattcagaaacaaataattagttaattggcagagctgtagatttagaaaaggggcagatggatttggatcagtggataacgaaggtgaaagacgggcagcacttggccgaggacgagcttcagctcctttgtgaatatgttaaggaaatcctgatagaggagtcaaatgtgcaacccgttaatagtccagttactgtttgtggagacatccatggccagtttcatgatctaatgaaactttttcagactggaggtcatgtacccgagacgaattacattttcatgggagattttgttgatcgtggatacaatagtctagaagtatttacaattttgttgctccttaaagcaaggtacccagccaacattactctgttacgtggaaatcacgagagcaggcaactaacacaggtttatggattctatgatgaatgccaaaggaagtatggaaatgcaaatgcttggcggtattgcaccgatgtttttgactatcttactctctcggccatcatagacggaacagtattatgtgtccacggtggactttctcctgatgttagaattattgatcagatcagagtcattgaacgaaattgcgaaattccccatgaagggccctttcttgcgacccttatgtggagtgaccccgaagatattgaaacatgggcagtaagtcctcgaggagcaggttggctttttggat

SEQ ID NO: 1733 - DNA, 589 bp, Artificial
  Synthetic
cgacggcgcagcaggggagtgaagagagcaattctcttcagctgcaattgccctaccctatgctattcaatcggagaagatattagtagtagattttggttacagagctcgccggtgacttgaagaagtttgacgaagaagtcagaaagatgtcagacctagacaggcaaatagaacagctcaagagatgcgaaccgttaaatgaatcggaagtgaaggctatttgtcttaaagctatggaaatcctcgttgaagaaagcaatgtgcagagagtggacgcccctatcactatatgtggtgatatccacgggcaattttacgacatgaaagagctattcaaagtgggaggtgattgtccaaagacaaattacttgtttctcggagattttgttgatagaggattttattccgttgagacatttcttcttctactagctctgaaggtgagatatccagatcgaatcactcttatcagaggtaaccatgagagccgccagatcacacaggtgtatggattctatgatgagtgcctgcggaagtatggttcagtaaatgtttggagatattgcacggatatctttgactactt

SEQ ID NO: 1734 - DNA, 566 bp, Artificial
  Synthetic
tccatttttttacggcttattctgatttctgttgcctcatccatctccgtctccgtcgccatcgccaggaggaggaggaggaggcctcgagccccccccctgccacctaactgtaactgtttattatccgtctccgccacctctaatggaccaagccttgctggatgatatcattgcacgcttgttggacgtgcggagcagccggccagggaaactggtgcagctttctgaggcagaaatcaggcagctatgtaccactgccaagactatcttcatggagcagcctaacctgattgagcttgaagcacccatgaagatttgcggtgacattcatggacaatactctgatctattacgtctttttgagtatggtgggtttccaccaaatgccaactatctctttctaggagattatgtggaccgggggaaacaaagccttgaaacaatctggctactccttgcatacaaaatcaagtatcctgaaaacttcttcttacttaggggaaaccatgagtgcgcttcaataaatagaatatatggcttctacgatgaatgccaaaggagat

SEQ ID NO: 1735 - DNA, 591 bp, Artificial
  Synthetic
cccgctctcctcctcggccgcgtaaaacacctcccaccgcctcctccaccccctcctcctccccccgcagagccgaaaccctaactccgccgatctctccaggtgcccaaggggagggaggggatggcggcggcaccgggggcgggagggcagggcggcggcgggatggacgccgtcctcctcgacgatatcatccgccgcctgctcgaggtgcggacggcgcgcccggggaagcaggtgcagctctccgagtcggagatccgccagctctgcactgtatcccgagaaatcttcctcagccagcccaatctcctcgagctcgaggcgcccatcaagatctgcggtgacatccatggtcagtacagtgaccttctaaggctttttgagtatggtggttttcccccagaagccaattatctattcttaggtgattatgttgatcgaggcaaacaaagtttggaaacaatatgcctcctccttgcatacaaaatcaagtacccggagaatttttttcttctcagaggcaatcatgagtgtgcatcaataaacaggatatatggattttatgatgaatgcaaacgccgatttaat

SEQ ID NO: 1736 - DNA, 541 bp, Artificial
  Synthetic
cggacgcgtggggccaattgtccgacctgctccggctgttcgagttcggcgggctgccgccgacggcgaactacctgttcctcggcgactacgtggaccgcgggaagcagagcatcgagacgatctgcctcctgctggcatacaagatcaagtacccggacaacttcttcctgctgcgaggcaaccacgagtgcgcgtcgatcaaccgaatctacgggttctacgacgagtgcaagcgccggttcagcgtccgcctctggaagctcttcaccgactgcttcaactgcctccccgtcgccgccgtcatcgacgacaagatcctctgcatgcacggcggcctctcgccggacctcgacagcctcgaccggatcagggagatcgcccgacccgtcgacgtccccgaccagggcctcctctgcgacctcctctggtccgaccccgaccgcgagagctccggctggggcgagaacgaccgcggcgtctccttcaccttcggcgccgacaaggtcaccgagttcctcaacaagcacgacctcgacct

SEQ ID NO: 1737 - DNA, 796 bp, Artificial
  Synthetic
tcctctctctctctctctcctctctcctctctctctgtagagctgagagaaaatcaaatcaaatcaaaccccctttgatttgacccccttttcctctagggtttctgcacaaatttccctccagaagcagtaaaaaagaagatcaatcagcaatggatccggtgccatcgagcgcatctcatggaaatcttgacgaacaaattgctcagcttatgcagtgcaaacccttgtctgaacaggaggtaagagggctatgtgagaaagcaaaggagattctaatggaagagagcaacgtgcagcctgtgaaaagccctgtgactatatgtggtgatattcatggtcagttccatgatcttgctgagctttttcgaattggtggaaagtgtcctgacactaattatttgttcatgggagattatgtggatcgtggatactattctgttgaaacagtaacgcttttagtggctctcaaagtgcgatatccccagcgaattacaatcctaaggggtaatcatgagagtcgccagattactcaggtttatgggttttatgatgaatgcctgcggaaatatggtaatgccaatgtgtggaagactttcacagatctgttcgactactttcctctgactgctttggttgagtcagagattttttgcctccatggtggtctgtctccatctattgaaactcttgataatattcgcaattttgaccgtgtacaagaagttccacatgagggtgctatgtgtgatcttttatggtctgatcctgatgatcgatgtggttggggtatctc

SEQ ID NO: 1738 - DNA, 572 bp, Artificial
  Synthetic
  misc_feature (493)..(493): The residue at this position can be any nucleotide.
gggctcaaggattgcataagaagatcatatccactttgcttaggccgcgaaattggaaagcacctgttaatagaaagttctttctcgattcatatgaagtgggtgagctttgttatgcagctgagcagatcttcatgcatgagcctacagttcttcaattgaaagctcctgtcaaagtttttggtgatcttcatggacagtttggtgatttgatgcggctatttgatgaatatggatttccttcaacagctggagacattacttacattgactatttgtttctgggtgattacgttgatcgaggacagcacagcttggagacaatcactttactcctagctctgaagattgaatatccagagaatgtacatttgataagggggaatcatgaagctgctgatataaatgcactttttggcttccgtattgaatgcatcgagagaatgggagagagtgatgggatctgggcatggacgcgtttcaatcaactttntaactatcttccattggctgccctcgtcgaaaagaaaatcatctgcatgcatggtgggatagggaggtcaattaattca

SEQ ID NO: 1739 - DNA, 570 bp, Artificial
  Synthetic
ccccccccccccgattgaatgaatcaatcaggggataatcttcttataccaagtcgctcacatctacaccctcaaaactcaaaccccatttgcagtaggtaaaaaattgttagagaaaactgaaaaaaatggaccaaaatgtgttagatgatattataagttggcttcttgaagtaaagggtaaaccagggaaacaagtagtgttaacagaggctgaaatcaaacagctgtgtttgatttctaaagagattttcttgaaacagcctaatttattggaacttgaagcacccatcaagattggtggtgacattcatggtcaatattctgatcttctgcggctctttgagtatggtggattgccacctcaatcaaactacttatttttaggggattatgttgatcgcggcaagcagagcctagagactatatgtcttttacttgcatacaagataaaatatccggaaaactttttcttgctaaggggaaatcatgagtgtgcttccataaaccgtatatatggattttatgacgaatgtaagagaagatttaatgttagattatggaaaatct

SEQ ID NO: 1740 - DNA, 650 bp, Artificial
  Synthetic
gccctaaaccactggagcagcagcattgcccttatcctcgcggcgaatctcttcccggtacgtgattcctcgtctagattctagcggcggcgccgcttctcgctatcgattgattgagccgccgctgctccgcgaagatgggaagcataaaggaatggtcgggcatcaaccagttccccgtcgctacacagaccgctctccacgggctgcttggcaaggtccggcaacagaatgtggatagtatgactgttcttgttctcggtaaaggaggagttgggaaaagctctaccgttaattctgtaattggtgaaagagtagcggctgtcagtgccttccagtctgaaaccttgaggccgctctgcgtttcccgatccagagctggatttactttgaacatcattgatacaccgggtttgatcgaaggtggatgggtgaatgaccaagctctagagattatcaagaggtttctcttggacagaactattgatgtggttttgtatgtcgatcggctggacggctatcgagttgatagcctggacaagcaagtgatcaaggccattagtcgtggctttggtcctcagatctggaaaatttgtctgctcgttttgactcacgcacagcttcctccacccgacggtacaagttacgac

SEQ ID NO: 1741 - DNA, 618 bp, Artificial
  Synthetic
gaccaaaatacgaagacgataaggcggtccgaaactttttttcaaagctaaaaaagctgaagagaggcttcccttaaaccctttctctcttcctccacacccccacaatctgtcatctgtggtagatttcgcaaggataattctcacaatcaactgcatttctctctacccatttgctatccatggcatctcaactaattagagaatgggccggaatacagcagtttcctgctgccactcagtccaagttgcttgaattactggggaaactgaaacaggagaatgtttgtaccctgacgatcctagtaatggggaaaggcggtgttggaaaatcttcaacagtgaactcaattatcggggaaagagcagttgctgttagtgcatttcagtcagaaacaccaagaccagtgatggtttcgcgttctcgagctgggtttacattaaacataattgacaccccagggcttgttgaaggaggatacgtcaatgaccaggctcttgatctcattaagaagttcctcttgaacaagacaattgatgttttgctctatgtggatcgtctggatgcatatagagtggataacttggacaaacagattgtgaaggctattactgaaa

SEQ ID NO: 1742 - DNA, 636 bp, Artificial
  Synthetic
agaggaaggattgggtggtacaggcggccatggcggcagcgtccatcacgccggcttgtgcgcgatgcaatgccgctgctagcaagggcttttcggatttctccggcctcaagagcaagaatgctgtcacattcggtcgcggagccgaggatttggcgaccagagtagcttcccaaacttgcaaggtttgaattatttgattgctatggatggaagttcgttcttatgtacaagttagagagtgtagatctccagctccggtggagcaaagcgcgcggttgccgaggccaagatcaaggttgcgatcaatggatttggaagaattggccggaacttcatccgctgctggcacggaagaaaggactcgccattggacgtgattgtcatcaacgacaccggcggcgtcaagcaagcctctcacctcctcaagtatgattccatgcttggaactttcgatgcagacgtcaaggtctctggagacagcgcgatctcggtcgatggcaaggtcatcaaggttgtctccaaccgagatcctctcaagttgccatggggagagcttggagtagaccttgtgatcgagggaactggagttttcgtggatcaagatggagctgggaagcacttgaaagccggtgc

SEQ ID NO: 1743 - DNA, 772 bp, Artificial
  Synthetic
ataagatccatccatttagcagcaccttaggatggcatagccttaaaagtgaagggcgaggttcaaacgaggaaaggcttacggtggatacctaggcacccagagacgaggaagggcgtagtaatcgacgaaatgcttcggggagttgaaaataagcatagatccggagattcccgaatagggcaacctttcgaactgctgctgaatccatgggcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgtcgtgctgctaggcgaagcagcccgaatgctgcaccctagatggcgaaagtccagtagccgaaagcatcactagcttatgctctgacccgagtagcatggggcacgtggaatcccgtgtgaatcagcaaggaccaccttgcaaggctaaatactcctgggtgaccgatagcgaagtagtaccgtgagggaagggagctcaggtcagactataagatgattgcaagagctctgactcgaaagggaactgccctggtaaagatggcaaaaacttcaaaggattttgaacctgcaattgagactttccagaaagcccttactgaacatcgcaacccggatacactgaaaaaactgaatgatgctgaaaaggcgaagaaagaattagagcagcaagagtatttcgatccacaaatagcagat

SEQ ID NO: 1744 - DNA, 438 bp, Artificial
  Synthetic
cttacggtggatacctaggcacccagagacgaggaagggcgtagtaagcgacgaaatgcttcggggagttgaaaataagcgtagatccggagattcccgaataggttaaccttttgaactgctgctgaatccatgggcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaaaaaaagcgtcgtgctgctaggcgaagcggtggagtgccgcaccctagatggcgagagtccagtagccgaaagcatcactagcttatgctctgacccgagtagcatggggcacgtggaatcccgtgtgaatcagcaaggaccaccttgcaaggctaaatactcctggggc

SEQ ID NO: 1745 - DNA, 342 bp, Artificial
  Synthetic
cccacgcgtccgggcttacggtggatacctaggcacccagagacgaggaagggcgtattaagcgacgaaatgcttcggtgtcttactcggtggtaacatcactctcctccgtggtattctctactggattgctcagcttcttggctccgtcgccgcttgtttcctccttagctttgccaccggtggcgagccaatcccagcgttcggtctctctgccggagtcagatcattaaacgctctcgtcttcgagatcgtgatgaccttcgggctcgtctacaccgtctacgccacagccgttgatcccaagaacggtagtctcggaacaatcgcaccaatcgccat

SEQ ID NO: 1746 - DNA, 383 bp, Artificial
  Synthetic
gggcggacgcgtgggcacagacgatgaatggcgtagtaatcgacaaaatgcttcggggagttgaaaataagcatagatgcggagattcccgagtagggcaacctttctaactgctgctgaatgcatgggcatgcaagacacaacctggcaaactgaaacatcttattagccaaaggaaaagaaagcaaaagtcgattcccgtagtaacggggagcgaaatgggagcactctaaaccgtgaaaacggggctgtgggagagcaatacaagcatggtgctgatatgcgaaccagcccgaatgctgcaccctagatggggaaagttcactacccgaaagcatcactaactcatgctctgacccgagtagcatggggcacgtggaatc

SEQ ID NO: 1747 - DNA, 656 bp, Artificial
  Synthetic
ggcttgcggtggagacctaggcacccaggcacgaagaagggcgtagcaagcgacaatgcttcgggaagccagagataagcatagatccggagatccccgaatgggttaacccctagaactgccaaatccgtgggatggggcaagagacgacctggcaaaccgaaacatccaagtagccgggggaagagaaagcaaaagcgattcccgtagtagcggcgagcgaagagggagtagcctaaaccgtgggaacggggttgtgggagagcaataagtataaggttgtgctgctaggtgaagcggtcgagtcccgcatcccagacggttagagtccggtagccggaagcagcacaggctgacgctccgacccgagtagcatggggcacgtggaatcccgtgcgaatcagcgaggaccacctcgtaaggctaaatacttctgggtgaccgatagcgaaatagtaccgtgagggaaaggtgaaaagaacccccaccagggagtgaaatagaacatgaaaccgtaagctcccgagcagtgggaggataattggagatctgaccgcgtgcctgttgaagaatgagccggcgacttataggcggcggcctggttaaggaaacccaccggagccgtagcgaaagcgagtcttcccaggggcaactgt

SEQ ID NO: 1748 - DNA, 272 bp, Artificial
  Synthetic
aaattgcggacagtgaaactattagtgttgatggtaagctcatcaaagttgtctccaacagagaccctcttaagcttccatgggctgagctcggcattgacattgttatcgagggaacaggagtgtttgttgatgggccaggagcagggaagcatatccaagccggagcctcgaaagttatcatcactgcaccagccaaaggtgctgatatccctacctatgttatgggagtcaatgagcaagactatggtcacgatgtcgctaacattatt

SEQ ID NO: 1749 - DNA, 649 bp, Artificial
  Synthetic
gaattcaaaggcttacggtggatacctagggacccagagacgaggaagggcgtagcaagcgacgaaatgcttcagggagacaagaaatctgtagtgcgaagatgttttgctactgaagctgctgagctgaagaagacagctctttacgatttccatgttgcccatggaggaaaaatggttccttttgctggttggagcatgccaatccagtacaaggattcaattatggattccactctcaattgcagatccaatggtagtctttttgatgtttcccacatgtgtggacttagcctcaagggtaaagactgcattccgttccttgagaagcttgtgattgctgatgttgcttcacttgctcctgggactggtagtcttactgtctttaccaatgagaagggtggagctattgatgattctgtgatcacaaaagtcacagatgatcatatatacctggttgtgaatgccggttgtagggataaggatttagctcacattggagcacatatggaggcattcaaagccaagggtggagatgtctcatggcatatccatgatgagagatcccttatagctctccagggccctcttgctgcaccagttcttcagcatctaactaaagatgatttgagcaagttctactttgggg

SEQ ID NO: 1750 - DNA, 486 bp, Artificial
  Synthetic
cttgcggtggatacctaggggcccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaactagccccgcttgaagggaaagtaagaaagaaggc

SEQ ID NO: 1751 - DNA, 680 bp, Artificial
  Synthetic
gaattcggggcccagagacgaggaagggcgtagcaagcgacgaaatgcttcggggagttgaaaataagcatagatgcggagattcccgaataggtcaacctttcgaactgctgctgaatccatgggcaggcaagagacaacctggcgaactgaaacatcttagtagccagaggaaaagaaagcaaaagcgattcccgtagtagcggcgagcgaaatgggagcagcctaacacggggaggtagtgacaataaataacaataccgggctcttcgagtctggtaattggaatgagtacaatctaaatcccttaacgaggatccattggagggcaagtctggtgccagcagccgcggtaattccagctccaatagcgtatatttaagttgttgcagttaaaaagctcgtagttggactttgggttgggtcgtccggtccgccctttgggtgtgcaccggtcgtctcgtcccttctaccggcgatgcgttcctagccttaattggccgggtcgtgcctccggtgctgttactttgaagaaattagagtgctcaaagcaagcccaagctctccagcaacggtggaagagttaactgcatgcaggtatggccaccaagtggtttgaacaagtgtgagaccctctcataccttcctccatcgaccgtcgagcaattgtcaaaggaagt

SEQ ID NO: 1752 - DNA, 543 bp, Artificial
  Synthetic
cccggctgcattcttcttgatctgatcgtcggacatggggtcgcccatgctctccgccgccaccgtgccactccagggaggcggcttgtcggagttctccggcctgaggagctcgtcgtcgctgccgctgcggcggaatgccacctccgacgacttcatgaacgcggtctccttcaggacccacgcggttggcacgaccggcggggcgcggcgggcgccgacggaggcgaagctgaaggtggcgatcaacgggttcggccgcatcgggcgcaacttcctgcggtgctggcacgggcgcggcgacagctcgcccctcgacgtcatcgccatcaacgacaccggaggcgtgaagcaggcgtcgcacctcctcaagtacgactccacgctcggcatcttcgacgccgacgtcaagcccgtgggcgacaacgccatctccgtcgacgggaaggtgatcaaggtcgtctccgaccgcaacccgtccaacctgccgtggggcgagctcggcatcgacctcgtcatcgagggcaccggtgtgttcgtcga

SEQ ID NO: 1753 - DNA, 573 bp, Artificial
  Synthetic
cggacgcgtggggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaagtagtaccgtgagggaaaggtgaaaagaacccccagtgggtagtgaaatagaacgtgaaaccgtgctgagctcccaagcagtgggaggggaaagtgatctctga

SEQ ID NO: 1754 - DNA, 579 bp, Artificial
  Synthetic
  misc_feature (54)..(54): The residue at this position can be any nucleotide.
gaattcaaggcttacggtggatacctaggcacccagagacgaggaagggcgtancaagcgacgaaatgcttcggggagttgaaaataagcatagatccggagattcccgaataggtcaacctttcgaactgctgctgaatccatgggcaggcaagagacaacctggcgaactgaaacatcttagtagccagaggaaaagaaagcaaaagcgattcccgtagtagcggcgagcgaaatgggagcaatacaagcgtcgtgctgctaggcgaagcggtggagtgctgcaccctagatggtgagagtccagtagccaaaagcttggtttatatacttattcattggtgtcggagcaattctatttgtcatatcatgtttcggctgtattggtactcttgccaggagtggatgctgcctcacttgttattctctattggtcatcttgttgatcatggcagagctgggatgtgcggctttcatattctttgacaagagctggaaagatgcaatacccggatgacaaaactggagattttgatatgatatacagtttcctagaacataactggaaaatcgcaaaat

SEQ ID NO: 1755 - DNA, 427 bp, Artificial
  Synthetic
gaattcagggaggaatggcgtagtatcggcgagcgaaatgcttcggggagttgaaaataagcatagatccggagagcccgaataggtcaacctttcgaactggtgctgaatccatgggcaggcaataggcaacctggcgaactgaaacatcttattagccagaggaaaagaaagcaaaagcgattcccgcgtgcctgttgaagaatgatccggcgactcataggcagtggcttggttaagggaacccaccggagccgtagcgaaagcgagtcttcatagggcaattgtcactgcttatggacccgaacctgggtgatctatccatgaccaggatgaagcttgggtgaaactaagtggaggtccgaaacgactgatgttgaagaatcagcggatgacttgtggttacgggtgaaatgccactcgaacc

SEQ ID NO: 1756 - DNA, 735 bp, Artificial
  Synthetic
gaattcaggagtcttatttctactccttccgtgctagcttgcagagcattctctcttgaaagctcatcatggcttctgcatttctctcagtagccaagccttctactctccaggttgcaaagggactcggcgaattctctggtctccgcaattcctctgcttcttcccttccctttgcttcaaggaaatccaacgaggattttctctccctcgtggccttccagacatctgctgttgctgttggaagcggttacaggagaggagtaacagaagcaaagttaaaggttgcaatcaacgggtttggaaggatcggaaggaatttcttgaggtgttggcacggtaggaaggattcccccttggatatcatcgccatcaacgacaccggcggtgtcaagcaagcttctcatcttctcaagtacgattctaccctcggcatttttgatgctgatgtcaagcctgttggtgacgatgctatctctgttgatggcaagatcatcaaggtagtctccagccgtaaccccctcgacctcccctggggggatatggaggtggatctagttattgaagggacaggagtgtttgtggacagagaaggtgcagggaaacacatacaggcaggtgctaagaaggtgttgatcacagcacctggtaaaggtgacattcccacttacgttattggtgtcaaccaagaactttacacccacgccgatacaatcatcagcaatgcttcttgca

SEQ ID NO: 1757 - DNA, 699 bp, Artificial
  Synthetic
tggtatcaacgcaggtggcattacggccgggggtgctgcgactgctattctaaatccgtaggaccatttttcagaacatcaaagaagcgaaaatggagcagactttcatcatgatcaagcctgatggtgtccaacgtggcctggttggtgagattatcggaagatttgagaagaaaggattctctttgaaaggcttgaagctcatcactgtggatcgtgcctttgctgaaaagcattacgcagacttgtctgctaagcctttctttagtggtcttgttgattatattatctctggccccgttgttgcaatggtctgggaaggtaagtgtgtagttaccactggcaggaagatcattggagcaacaaacccattggagtctgctcctggtacaatccgtggtgattatgctattgacattggcaggaacgttattcatggaagtgatgcagtcgagagtgcaaggaaggaaattgctctttggttccccgaaggagttgcagagtggcagagcagccttcactcttggatctatgagtagaaatgttttgtttactttagaactctattaatggcctgcctgtttgggtgtaacttatgaattttggatgtgatttgagtctagaagtttattgtttgaggttttctgttattccctatttcaagaatatttaatgtgatcagtattactttcgtgatat

SEQ ID NO: 1758 - DNA, 827 bp, Artificial
  Synthetic
tacagttgctggttgcccttccgccctcccctctctccaccgaagatggcgtcgaggttcgccctccgagcatctcgagcccttcgctctgccctcgccccagaagggcgaacctttgcaactgctgcctttaacaggggccactcagctgtgtcccagttattgcaaacttctacaggatcggataaattctttaaagctggggctatcctcttacctatggcagtgcttgcagcaaccactgatgagaaattccacgctgctgaggctgagagaacattcattgcgatcaagccagatggtgtgcaaagaggactgatttcggagattgttggtcgctttgagcgaaagggctataaacttgtagcgatcaagcttattgtgccaactaaagggtttgcagagaagcactatgacgatttgagaggcaggccattttttaatgggctttgtgaattcctgagttctggtcctgttgtcgctatggtgtgggaaggccaaggtgtgatcaagtatggaaggaagctgattggtgccacaagtccacataattcagagcctggaactatcagaggagatcttgctatctctgtgggaaggaacatcatacatggtagtgacggccctgaaacagcaaaagcagagatcgggctttggttcaagccagaggagcttgtaaattattcgaccatttctgagaagtggttatatgagccttgaagaaagctgtagatctgatcatcatgcttttcacacctggggtttttctgaagggctattgaatctaatctaacttccaatatatatatatgcttacaattgaaata

SEQ ID NO: 1759 - DNA, 704 bp, Artificial
  Synthetic
gcgaaagagatagaaagggagatggagggtcttagcgttgtaggagcaagtccttgcgtttcttcttctgtactaccatcttcactttcttcgcctaccagccgcttatcctgcgcaccctcttgcaaacttatccttaaccccatcaagaagcaccaccatttggctgcatttcaacctgcatttcatctttttgcaagtaaccgtgaccaatctcgttcccatgcctccaaaaggaaccatacagctcgtatattccttccccacttggttgcttccatggaagaagtggaggagacatacattatgattaagcctgatggtgttcaaagaggacttgttggggagattatttcaagatttgagaaaaaagggtttaagctaactggtttgaagctttttgaatgccccaaagaattggcagaggagcattacaaggacctacagtccaaatcattcttccccaagctgatcgattacattacctctggtcctgttgtctgtatggcctgggagggtgttggtgttgtagcatctgcccgtaagctaataggagcaactaatccacttaatgcggagcccggcacaatcagaggagaccttgctgttcaaactggaagaaatgtggtgcatggaagtgatagccctgacaatggcaagcgtgaaatagcactttggtttagagaaggtgaactgtgctcatg

SEQ ID NO: 1760 - DNA, 937 bp, Artificial
  Synthetic
ctttttttttagggccaactgatctttcctctggtaacagaaagaaaaaatccaagaaaaatgaggttcagtatggtagaggtaaagttgctaccagcctaaggaaaaatggcatccgatttattcgtgataaattatgagtatgctactcttcatgccgatttaatggcaattcagattaaggtagaataggttcgctcagttgtcaccatatacccacctctctgaattgcttgtgtagttaaccaactcttctggtttaaaccataggttgatctcatccttggcagtctctggtccatcgctaccatggatgatgttccttccgactacaacagctaagtcacctctgatggttcctggttcggatttctgtggatctgtggctccgataagcttccttccatatctgattactccttcaccttcccaaaccattgctaggacagggccagagctaaggaaatcacataggccattaaagaatggtctcgccgacaagtcatgatagtgcttctgtgcgaattccttggaaggaatcacaactttgattgcaaccagcttgaaacccttgcgctcaaagcgtgctatgatttctgaaatcaggcccctctgcactccatctggcttgatggcaataaaggtgcgctccatctgagcagcatgtgcttcttgctcttggagcatgtaagctgctgcaggaagggcaaggacaccagaaatccaagctctagatgcgtttccagaatctgtcctgccatatgaggctagagaaggcaccactcctctcaaagaaactgtggctgctgcagctgctgctcgccccccagaaaaagcacgagaactctgtttggaggcagaaacgagagacttagcagctcgtgaagcagatctgtaaatctgagaattcatctcttagacttttacaagaaaaaga

SEQ ID NO: 1761 - DNA, 563 bp, Artificial
  Synthetic
agcacatcccgccagtccaaccagtatgctatacccctccttccactccaaaaacagtcgccatggcttccaccgagcagaccttcattgccatcaagcctgatggtgtccagcgtggcctgatcggccccatcatcagccgcttcgagagccgtggcttcaagctggttgctatcaagctcacccagcccggaaaggagcacctcgaggcccactacgccgacctcaagggcaagggcttcttcgatggcctcatcagctacatgaactccggccccatctgcgccatggtctgggagggccgtgatgccgtcaagaccggccgcaccatcctcggtgccaccaaccctcttgcctccgcccctggcaccatccgtggcgactacgccatcgatgtcggccgcaacgtctgccacggctccgactccgtcgagaacgccaagaaggagattgccctctggttcaaggacggtgaggccgtttcctacaaggcttcccagttcgactggatctacgagaaggagtaaactgtcttttatgacaatatgacagagctctgaagc

SEQ ID NO: 1762 - DNA, 149 bp, Artificial
  Synthetic
cccccgccttctccctcaacctacggcgccgaccacctccaaaaccagaccccgaaatctcgaggagcttgtcttttttcggtagcaatggcgttggagcagaccttcatcatgatcaagcccgacggcgtccagaggggcctcattgg

SEQ ID NO: 1763 - DNA, 637 bp, Artificial
  Synthetic
ccccgacgacccactccgcctcgcctccggtcctctcctctccgcatcctcctcatcgcctccgcttctgcttttttttttcttttttctcgttgatcggtttgttcgatcagatcggttctttggagagatggagcagtccttcatcatgatcaagcctgacggcgtccagagaggcctgattggagacatcatcagcaggttcgagaagaaaggattctacctgagggggatgaagttcatgaatgtggagaggtcctttgcacagcagcactatgccgacctttccgacaagcccttcttccctgggttggtggagtacatcatctctggccccgtcgttgcgatggtttgggaagggaaggatgttgttgccactggccgcaggatcattggggccaccaggccctgggaggcagcccccggcaccatccgtgctgactatgccgtggaagttggcaggaatgtcatccatgggagcgactccgtggacaacgggaagaaggagatcgctctctggttccctgaaggtttagctgagtggaggagcaaccttcacccttggatctatgagtcttagagcttcgcgcctataatcgatcacctcttggtggctagttctcgttaaatatttgag

SEQ ID NO: 1764 - DNA, 515 bp, Artificial
  Synthetic
ccccagagatggagcgcacctttatcgccatcaagcctgacggcgtccaaaggggcctgatttctgagatactgtcccgatttgaaagaaaaggattcaagcttgttgccatcaagctggtggttccatccaaagaatttgctcagaagcactatcatgatttgaaagacagacctttcttcaatggattgtgtgacttccttagctctggccctgtgcttgccatggtttgggaaggagagggtgttatcaagtacgggagaaaactgattggtgctacagacccacagaagtctgaaccaggaaccatcaggggtgaccttgctgttgttgttggcaggaacatcatccatggaagcgatggcccagagactgcaaaggctgagattggtctctggtttgagcccagggagctggtctcttacaccagcaacgaagagaagtggatctacggggtcaactaaccggcgaatcatctcccctgtttgttttggttttttttcattttctctcac

SEQ ID NO: 1765 - DNA, 578 bp, Artificial
  Synthetic
gactgcgacggagatggcgaacatggagcagagcttcatcatgatcaagccggatggcgttcagcgtggactggttggggatatcatctcgagattcgaaaagaagggatacactctcaaagggctcaagctcatgcaaattgagaagtccttcgccgagaagcactacgcagacctctcggccaagccattcttcggcggtctcgtcgagtacgtgacttcgggcccggttgtggcgatggtttgggaaggcaaggccgtggtggaaaccgggcgaaagataatcggggccacgaatccgctcgcttccgcacccggaactattcgtggagacttcgccatcgacgtcggaaggaatgtgatccatggcagcgactcggtcgacaacgccaagaaggagatcgctctgtggttcccggatggtgtcacggattggcagcagtctgtgcacccgtggatctacgaatgaatccaagagatctccgcatttaaattcctttaaagttttgctttcgtgtatccattcaattaatatggcaaagttcctctaaaactgttttaatacaaaaaaaacaaaa

SEQ ID NO: 1766 - DNA, 1030 bp, Artificial
  Synthetic
aaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatggagcagtccttcatcatgatcaagcctgacggcgtccagagaggcctgattggagacatcatcagcaggttcgagaagaaaggattctacctgagggggatgaagttcatgaatgtggagaggtcctttgcacagcagcactatgccgacctttccgacaagcccttcttccctgggttggtggagtacatcatctctggccccgtcgttgcgatggtttgggaagggaaggatgttgttgccactggccgcaggatcattggggccaccaggccctgggaggcagcccccggcaccatccgtgctgactatgccgtggaagttggcaggaatgtcatccatgggagcgactccgtggacaacgggaagaaggagatcgctctctggttccctgaaggtttagctgagtggaggagcaaccttcacccttggatctatgagtctgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatctattggaaccgcaaaaatgcgccctgaatggaatcgttggacacagttgtggaatgccatgctccattgcggaagaggcttgtgatcaact

SEQ ID NO: 1767 - DNA, 701 bp, Artificial
  Synthetic
ccacacataacttaacaacccaacggaatacttaaacgtagcattccctcaaaacagagtatcactttggatcaattaaggctttctaaaattgttaccttgttagaagggaaaaggtccaaattcacttttgtactttgcaaaaatagccacatccccacattgtagaaacacagcataattcagaaccgaaaaaatggagcagaccttcatcatgatcaagcctgatggtgtccaacgtggcctggtttacttcgattcaatttcgtttaattttgtttttgtgtttgttgagctacacttttattaattcgctttttttttttttctgttagctgatctatgctttaattgactaattttggatcaatggtttgattttatgtttcaggttggtgagattattggaagattcgagaagaaaggtttctctttacaaggcttgaagctcatcaccgtggatcgtgcttttgctgaaaagcactatgcagacttgtctgcaaagccgttcttcaatgggctcgttgaatacattgtttctggccccgttgttgcaatggtgtgggcaggtaagggtgtagttactaccggtaggaagataattggcgcaaccagcccattggagtctgctgctggcaccatccgtggtgattatgctatcgacattgggaggaacgttattcatggaagtgattctgttg

SEQ ID NO: 1768 - DNA, 711 bp, Artificial
  Synthetic
cttgtatacagttgctggttgcccttccgccctcccctctctccaccgaagatggcgtcgaggttcgccctccgagcatctcgagcccttcgctctgccctcgccccagaagggcgaacctttgcaactgctgcctttaacaggggccactcagctgtgtcccagttattgcaaacttctacaggatcggataaattctttaaagctggggctatcctcttacctatggcagtgcttgcagcaaccactgatgagaaattccacgctgctgaggctgagagaacattcattgcgatcaagccagatggtgtgcaaagaggactgatttcggagattgttggtcgctttgagcgaaagggctataaacttgtagcgatcaagcttattgtgccaactaaagggtttgcagagaagcactatgatgatttgagaggcaggccattttttaatgggctttgtgaattcctgagttctggtcctgttgtcgctatggtgtgggaaggccaaggtgtgatcaagtatggaaggaagctgattggtgccacaagtccacataattcagagcctggaactatcagaggagatcttgctatctctgtgggaaggaacatcatacatggtagtgacggccctgaaacagcaaaagcagagatcgggctttggttcaagccagaggagcttgtaaattattcgaccatttctgagaagtgg

SEQ ID NO: 1769 - DNA, 529 bp, Artificial
  Synthetic
aattgaacaatataaattcaaatactagtcatcccatacttattggttatgctctgattactgagttcaccggggaaaaatcaaaacccggaatgtgtttgtatccgtaacaactgtttcttgtttttattgtatgggtaagaaaagaaaagaaaaaccaatgtgatttgatttcaaaagacaagaggaagagggatttagttgtcaccataaagccacttctcaaagttactagtgtaaaaaacaagttcttgaggcttaaaccacagactgatctcatcctttgcagtctctggtccatcacttccatggattatgttcctgccaacagtaactggaaaatctcctcggattgttccaggctcaaatttctgaggatcagtggctccaatcagtttacgtccgtatctgatcacaccatctccttcccagaccatggcaataacaggaccagagctaaggaagtcacacaaaccattgaagaaaggtctttccttaaaatcatggtaatgcttttgtgcgaaatctt

SEQ ID NO: 1770 - DNA, 637 bp, Artificial
  Synthetic
ttaatggctgtagcgtcctcttcgtcggctctagttcaaattctagggcagcattgcgggagacctactagggccgatggcgccgcatctccaggaagaaatcgcgtctccaccacagtggcattccgcagccaccggatccgctggcgccctagctccatttgccatcgcatccatcgcgtcgattccaaagctgttgttagcgacgaggagacgcgcgtcgtagctaagcctagagcagagggaggactggagcagacttatgtaatggtaaaacccgatggcgtccagcgcggcctggttggagagattatctctagatttgagaagaaaggatttcgtctcgcgggattaaaaatgttccaatgtcctgagggacttgcaaagaaacactacgaggagcttaaagagaagcctttctttcccaagctggtgaagtacattacctccggtcccgtcgtttgcatggcgtgggaaggtccaggggtcgtcgcttccgcacgaaaacttattggatcgacaaatcctttgctggccgagccaggaactattcgtggtgatctcgctgttgccgttggaaggaacgtcattcatggcagcgatagcgttgcgaatggagagcgcgaaattggcctat

SEQ ID NO: 1771 - DNA, 676 bp, Artificial
  Synthetic
ccctcgaccacgcgtccggctatggctcttcgtaaactctcttatggttcctccattaagcttcttcgtcctctctccatggcccttccctctattacatgtcgtctttgcctagtcaagcaattcgtgaaagggaggatccgcgtgttacgtggataaagcagctgattgtgctacttgaggatatcgatccagagatcgccgacatcattgagcatgagaaagctagacaatggaagggtcttgagcttatcccttcagagaattttacgtcattgtcggtgatgcaagcagttggatcagtaatgaccaacaagtacagtgaagggtatccgggtgctagatactatggaggaaacgagtacattgacatggcagagagattgtgtcaaaaacgtgcattagaagtttttaacttggatcctgccaaatggggagtcaacgttcagtcgttgtctggatccccttcaaactttcaagtgtacactgctttattaaagcctcatgagagaattatggccctcgatcttcctcatggtggacatctctcacatggttatcagaccgacacaaagaaaatttctgctgtatctatctttttcgagaccatgccatacagattggatgagagcacaggttatattgactatgatcagctggagaaaagtgcagtact

SEQ ID NO: 1772 - DNA, 912 bp, Artificial
  Synthetic
caggggagaagctgacaataattatggccatggcaacggctcttcgaagactctcctcttctgttgacaaaccaattaagcgtctctataatggcggctctctctattacatgtcatcgttgcctaatgaagctgtttacgagaaggaaaaaaatggtgtcacgtggccaaagcaactgaatgctcctctagaggaggttgatcctgaaattgctgacattattgagcttgagaaagcacgccagtggaagggacttgaactcattccttcagaaaatttcacttctgtgtctgtaatgcaagctgttggatccattatgacaaacaagtacagtgaaggatatcctggggctagatactatggaggaaatgagtatattgacatggcggaaacattatgccagaaacgtgctttagaagcattccggttggatcctgcaaaatggggagtgaatgtgcagcctctatcaggatcacctgctaattttcatgtttacactgcacttttaaaacctcatgaaagaatcatggcccttgatcttccccacggtggacatctttctcatggatatcagactgatacaaagaagatatctgccgtctctatattttttgagaccatgccatacagactgaatgagagcactggctacattgactatgaccagcttgagaaaagtgccacactctttaggccaaagttaattgtcgctggtgctagtgcttatgcacgtctttatgactatgcacgtatccgaaaggtttgtgacaaacagaaggctgtcatgttggcagatatggctcatattagtgggttagttgcagctggagtcatcccatcaccatttgattatgcagatgttgtgactaccacaacccacaaatcccttcgcgggcctcgtggtgccatga

SEQ ID NO: 1773 - DNA, 673 bp, Artificial
  Synthetic
ctgagaattgttggattgtgtgattgttttttcaattacaatggatttgagccaatcgcaatcgagtaatctctcgctagggtttattgctcatgcgtccccggcgggaagcgcacctagtcgtgctcatatcgccgacgactcgatcacttttcagatcgattctagggttaaggaccaatcgcatctgattccgcctgttccacttcaattgatggacaagcaaacggaggagaacgaaaagaacgggggagagagtggggatgaagagagggaagttgaagaatttcgtattctaggacattccatgtgtataaaacggaggagagatattgatagcacgtcgtcttcttcgtcttcaaagtgctttagggttacgagttccaatgagcatatgctagggctagaatcgcgaataagcgctgttagagcttggggtaatcagggtttacaggtagctgacccggatatatttgagataatggagaaggagaagcagagacagtacaaagggattgaactgattgcctctgagaattttgtatgcaaggctgtgatggaggcattagggagccatttaacaaacaagtattctgaaggagcaccgggggcaaggtactatggtggtaatcagtttatagatgagattgaaactctatgttgtaagcgtgca

SEQ ID NO: 1774 - DNA, 832 bp, Artificial
  Synthetic
caaaatcagttttgctcaatacccttttcaagattcactcagagttcaaaactttcattgaaaaaatcaagaatggttgttgtttcagctacaactgctgctgagaaatccaataaaaggtatcctggtgaagctaaagggtttgttgaggagatgagatttgtggctatgaaattgcatactaaggatcaatctaaggaaggtgaaaaagaacctgaaggtcagcctatggctaaatgggaacctagtgttgaagggtatttgaagtttttggtggatagtaaattggtttatgatactttggaaaagattatggaaaaggctcctttttctgagtatgctgagttcaggaacacgggattagaaaggtcagaggccttagcaaaagatttggaatggtttaggctgcaaggttatgccatcccagaaccatcagctcctggtctcaactatgctcgttacctagaggagctatcagaaaaggatcctcaagcatttatttgccacttttacaacacatactttgcgcattcagctggtggtcgcatgatagggagaaaggtggctgaaaagatactcaataagaaagagctggaattctacaaatgggacggtgacctttctcagctgctgcagaatgttagagagaagctgaataaagttgcagaaaattggactagagaggagaagaatcattgtttggaagagacggagaagtcattcaagttctcaggggaaatcctccgattaatattgtcttgatgcgcggctttgcatttgtacgttggatggcctaaagctcaaattactgtgaatagtcgtgttcattttc

SEQ ID NO: 1775 - DNA, 646 bp, Artificial
  Synthetic
gcggcggcggcatccacggcatcgacgattgggagcacgctaccgcggccgggtctccggcgacgtaagcatgaatcctctcccttctcgccgtgctcgtcgtgctctttctccaagtcggcagcggcagagcctctggatcgaagagcgacgatttggtgccctggatcgcagagaatggcgggcgtgcaggaatcgagggggaggatggcggcattcgcggcgacgacggtctccgagagctcggatatccggccgcggcggcctggggagaaaaaagggtttgtggaggagatgaggtttgtggcgatgaagctccacaccaaagatcaggccaagcaaggcgagaaggaggccgatgtggagccggttggaagctggaagccgagcattcgtggttatatccagttccttgtggataacaagcttgtctacgagacgctagaggctgtcgtgaacagaggatcgcatccagcttatggccagtttcgagaaacgggattagagagatcggaagcgctggcgaaagatttggaatggttcaaggagcagggacacgagatcccagagccgagcttggagggtaaatcctactcagagctcctagaaacgcttgccgaggatgatccgccagcttttatatgtc

SEQ ID NO: 1776 - DNA, 655 bp, Artificial
  Synthetic
gagaaggcaggcctttgccgtacatcatcggaaccctatggcggtctcaagctgtgctagggcttttccatcctttgaatgtcgttcggatgccgaattctctggcggtattccccgccacgacattcctaactccggcaaggccagcattttgagtcacggatcgtccattcacggtctgtcttctcttatttataggtttcctccgaactttgttaggcagttgagcattaaggctcggaggaactgcagcaacatcggtgtggctcaagttgtggcggcttcgtggtctaacaataactcatctcctgatttcactccggtggctaaggccgtcgatgccgccgccattgctcctgttgataccacggtagttaatgaggacgtggcgctggtggaaaatgagacttgtaatgatcaaaatgtactgtttgacagtttgccaagtgtgaaatacgcttcgtttttgaattctgatgggagtgtcgctattcatgccggtgaaaggttgggacgtggcattgttacggatgcaattactaccccagtagttaacacatctgcctatttcttcaacaagacttctgagctcattgattttaaggagaaaagacgtgcaagttttgaatatgggcgctatgggaacccaactact

SEQ ID NO: 1777 - DNA, 428 bp, Artificial
  Synthetic
acagattctctgagctaaaatttcctgtctcagcttcttgtagggaaggcagagggcgccgccggtgaaatcacacttttaaccctcaaattcatcacaaatccaatggccgtttcaagctgttcagctgcagctagggcatttccatccttcgaatgccgttccgatgccgacttctccgccggcggcgttccacgtcacaacgacgttccaaaaagctcctccggcgttcgtttctccggtaaggcaagctcgttaaatcacggatcgccgattcacggtggcatgtcttctctgatccttaggtttccgccaaacttcgtgcggcaactgagcgtcaaagctcgtcggaactgcagcaacatcggcgttgcacaagtcgttgcggcttcctggtcaaacaacctcggttcccctgacttcactcc

SEQ ID NO: 1778 - DNA, 918 bp, Artificial
  Synthetic
gaattcgagaaactaaaacccccaccaaaaaaaaacaagaaaaaaaaaaatggccgtctcagcaggatgtgctagggttctaccggtttttgaatgtagatcagatccagatttctctacaaaccagaaccagcagaaatcaagttccagattcatttctggatctttcaatggtggtggtgggttatattcatcattgattctgcggtttcctcctaatttcgtaaggcaattgagtattaaagcaagaaggaattgtagcaatattggtgtagcacaagttgttgctgcttcctggtcaaacaatgacaataccaacaagaaggttcctaatgtatctgctgtcgattctgcttctgctgcttctgagattgaagaaattcctttgattgatgatgaagttgtggatgctggggttgatggtggtgatatttgtaataataatggtgtacagttgtctggtttggccgctttaaaggcctcatttttacgctccgatgggagcatcacagttcatgcaggagaaagattaggtcgtggaattgctacagatggaatcactaccccagtcgtcaatacttctgcttattggttcaagaactccaatgaactcattgatttcaaggagggactccataaaagctttgagtatgggcgctatggcaacccaaccacagtagttgcaaaaaacaaaataagcgcacttgagggggcaaaatcaactattttgatgtcgtctggcatgtgtgctactacggtcatgatgtttgcattggtaaagaagggtggccatataataacaactacagattgctacaggaagacgacaattttcattgatgattttcttgttcccaacatgaatataacggtccatgtcattgaccctgccgatatggatggcctgaaatctgcatt

SEQ ID NO: 1779 - DNA, 775 bp, Artificial
  Synthetic
gaattcatgggtagtcttccaattggtaatcttgaaagcctatcaatatcttcacaaaatccactcgacccagatgaattcagaaggcaaggtcacatgattattgattttcttgctgattactacaaaaacgtcgagagttaccctgttaggagccaagttgaacccgggtacttgcgtaaacgattaccagaatcagctccaaacaattctgaatccattgaaacaattcttcaagatgtcacaaatgatatcatcccgggtctaactcattggcagagtccaaattactttgcttactttccatcaagtggttccattgctggatttcttggagaaatgcttagtactgggtttaatgttgtgggattcaattggatgtcttcaccagctgcaactgagttagagagtattgttatgaattggctcggccaaatgcttacacttcccaaatcttttctcttctcgtcagatgggagttcaggaggaggcggggttttgcaggggactacctgtgaagctattttatgtacgctaactgcagcaagagataaaatgttgaacaaaattggccgagaaaatatcaataagctagttgtttatgcttctgatcaaactcattgtgcactacaaaaagctgctcagatagctggtataaacccaaagaacttccgtgcaatcgccacatcaaaggctacaaacttcgggctctctcccaattcacttcaatcaacaatccttgctgatatcgaatccggcttagttccattatttc

SEQ ID NO: 1780 - DNA, 559 bp, Artificial
  Synthetic
gttaatagttctgtggagatgggggaggcaagcggtggtctgaagccaatggacccggaagagtttcgaaagcatgctcacgagatggtggacttcattgccgattattatcgcgatatcgagagcttccctgttcgcagccaagtttctccaggatacttgagaactctgcttccccggactgcaccagaagatcccgaaagcttggacgacgtttttgctgatattcagagcaagataatgccgggtgtcacacactggcaaagtccgaattttttcgggtactatccttctaacagtagcacggcaggactcctgggggaaatgttgagtgctggactcaacattgttggattcagctggataacttcgcctgcagcaacagaactggaagccattgttcttgactggcttgcaaagttgctcaaacttcccgaggagtttttatctggaggcaaaggtggtggagtcatccaagggactgctagtgaagcagttgccgtggtgctactcgctgctaggactcgagccatttcggaaaacaagaggaaaggcctgt

SEQ ID NO: 1781 - DNA, 730 bp, Artificial
  Synthetic
gagtgattgaatggctgggaacgcgacgctggccgtggccgctccgggcagcaaatcgagctgccagagctcgttctgggggcggaatcaggaatttggtcgggtttctagcgcgagaccatcgacgagccaggggagagctatcagcttgcaagtcaatgcaacttcaagagtggataaattctcgaagaaggatgtgatcgtgtcgccatctattctatcagcgaatttctctaagttgggagaacaggtgaaagcagtagaaacagcaggctgtgattggatacatgtcgatgttatggatggacggtttgttccaaatatcacaattggtcctctcgttgtggatgctttgagaccagtgactgatcttcccctggacgttcacttgatgatcgtggagcccgagcaaagagttcccgattttgtgaaagcgggtgctgatatcctcagtgtgcattgtgagaatgcgtccacgattcatttacatcgtaccatcaatcaaattaaagaccttggctgtaaagctggcgttgtcttgaatccggccacgccactggcggctatcgaatacgtgctcgaagttgtggatttggtgctgatcatgtctgtgaatcccggctttggaggacagagcttcattgagagtcaagtaaagaagatctctgacttgaagaagttgtgctctgagaagggagttgatccgtggatcgaggttgatggtggagtc

SEQ ID NO: 1782 - DNA, 562 bp, Artificial
  Synthetic
ttcagaggttaaaaatatcgaaaatgcacgcctctttttctctctctcgacatcaggctatttcttctaaaacccataacaaatttcatccttcacacgtcggatcaagcagccgccgaatctatttctggattcagacgtcttaatcctaagaaaaacaaacgaggccttagtattactactccgaaataaagagagagaagctacttacgccggcaccggactttagattgaatggagaatttaacggccgatagggaggaggagaagatggtgaaagcaatcatagcaccgtcgatgttgtcatcagacttcgctaatttggcatctgaagcacaacgcatgctcaattgcggtgctgattggcttcacatggacatcatggacgggtaggtcagatagtcacgtcaagctggttgtttacaacatgttaaaatgatgggtggataccaattgaataatactttctttcttttttcttttttcccccacttgtctcttttgcagacactttgtaccaaaccttacccttggtgctccagttatcgagagtctgcgaaag

SEQ ID NO: 1783 - DNA, 706 bp, Artificial
  Synthetic
gagttatcaccttcctccggcagttaagcaagaatctgcagaaggaggtctctgtgtgggtatatccatggcagcagtttcatccacagcattgctgaagagtagcctctttggtgtcaaaccatccctacgcactacttctcgatgcgcaactccatcttcaagcaaggtgttcattccagtggtgaaggcatcatcccgtgtggacaagttctcaaagacagatatcattgtttcaccatctattttatcggctaactttgccaagttaggagagcaggtgaaagctgtagaagaagcaggttgtgattggatccatgttgatgtgatggatggccgttttgtgccaaatattactatcggcccactcgtggtggatgcattgaggccggtgactgatttgccacttgatgtgcacttgatgatcgtcgagcccgagcaacgtgttccggactttattaaggccggcgctgacattgttagtgtgcattgtgagcagtcatccacgattcatcttcatcgaacagtaaatcagattaagagcctaggagccaaagcaggagtggtcttgaatcctgccacacccctcagcactattgaatatgtcctagatgtggttgaactagtcttaatcatgtcagtcaatcctggctttggtgggcaaagcttcattgagagtcaagtgaagaaaatcttagacttgagg

SEQ ID NO: 1784 - DNA, 670 bp, Artificial
  Synthetic
gaaagatggccaagattgcgccatccatggtgtcctcggacttcgccaatctcgcagccgaggcacagcgaatgctggattgtggagcggactggctacacatggacatcatggatgggtgaggaagggatagatgctttgaaaacctctgatctcgtgtgatcccgcaggcattttgttccaaacttgactattggagctccggtggtaagttcgctgcgaaagcatacaagtgcttatttggattgccaccttatggtgacgaatccactcgactacgtagagcctcttgccaaggccggggcgtctggcttcactttccacattgaagcttctcgagataattggacacaaatatcaaagaaggtcaaggaatgcggcatgaaagttggaatttgcctcaagcctggaactccagtcgaagaggtgtaccctctagttgacagtggtgatattgatttagtgttgatcatgactgtcgagccaggatttggaggtcagaagttcatgccggaaacaatgagcaaggtgaaagctcttcgagctcgctatccaaaactagacatcgaggttgatggcggtcttggcccttcgacgatccagcaagccgccgatgctggagcaaactgcatcgtcgctggaagctcggtttttggagctccagatccgg

SEQ ID NO: 1785 - DNA, 667 bp, Artificial
  Synthetic
aagagggtggttgaaattttaagctcgctttcaaattgacaaagcaccaaccttttctcctcctcaattccccaaacaagagaaagtttgctgcaagagaaaaagaagtaaatttcaatggcaacaactgcttcttgtgtgggttcatcaactctgttacaatcccaaattaatggatttggcgggagtgttaagcttcagaagcccaattcactcactttcaccaggaggagagttcaaacagtggtgaaggcttcttctcgggtggataagttttcgaaaagcgatattattgtttctccatccatcctttcttctaacttttctaaattaggagagcaggtaaaagcagttgagcaggcaggctgcgactggattcatgtagatgtgatggatggtcgatttgttccaaatataactattggaccccttgtagttgattccttgcgtcctatcactgatcttccattggatgtgcatctgatgattgtcgaacctgaccagagagtacctgatttcataaaagcaggtgctgatatcatcagtgttcactgtgagcaatcttctaccatccacttgcatcgtacaataaatcagattaaaagtttgggagctaaagctggggttgtcctcaatcctggaacccctttaaccgcaattgaatatg

SEQ ID NO: 1786 - DNA, 748 bp, Artificial
  Synthetic
gaattcaagaaaaacacccaccaaacttccccctgaccaacaccaaaacaccgtacagtgagagaaggaagaatgtctgcaacaacagcttctttgtgttcatcggcagctactaatcttaaatcccaaatcaatggatttggtctccagaaactatctttctctccttcccctacttcttttacccccacaaggaggacgatgagaactgctgttaaagctatgtctcgtgttgataagttctcaaaaagcgatattattgtctccccatctattctatcagctaactttgccaagttgggagagcaggtgaaagcagttgaattggctggatgtgattggatccatgttgatgtgatggatggccgttttgtgcctaatattacaatcggaccccttgtggttgatgcactgcgcccagtgaccgatctcccactggatgtacatctgatgattgtggaacctgatctacgagtgcctgattttatcaaagccggagcagacattatcagtgttcactgcgagcaatcttccaccatccatttgcatagagctgttaatcaaattaaaagtcttggagctaaagccggagtagttctgaacccaggcaccccactggctgccattgaatacgtacttgattcggttgatctggtcttgattatgtctgtgaaccctggatttggtggacagagctttatagaaagccaagttaaaaagatctctgacttgagaaaaatgtgtcttg

SEQ ID NO: 1787 - DNA, 654 bp, Artificial
  Synthetic
cgcgacgcctcctagccgccaccgcttcaccaaatcaaaagctctcgctgctcctcgagagggagttggtggagagagaaagagagagagagagatggcgtcgccgtcgtcgtcgtcgtcgctgtgctcgaccttcgcctcgccgcgcgccgcctccctcggccgccgcctcgccttctcctcgcccaggaaagcattccgagtgagggcatcatccagggttgacaagttctcgaagaatgacatcatcgtgtccccttccattctttctgcaaacttttccaagcttggcgagcaggtaaaagctgtggaggtggcaggatgtgactggattcatgttgatgtcatggatggacgttttgtgccaaatatcacaatcggacctttggttgttgatgctctgcggccagtcactgatcttccgttggatgtgcatctgatgattgtggaacctgagcaacgagttccagattttatcaaggcaggtgctgatattgttagcgttcactgtgagcaatcgtcaaccatccatctacaccgaacagtcaatcagattaaaagtcttggagcaaaggctggagttgttttgaatcctgcaacccctctcactgcgatagattatgtacttgatgttgctgatctagtattgattat

SEQ ID NO: 1788 - DNA, 609 bp, Artificial
  Synthetic
cccccgaaatcaaaagctctcgctgctcctcgagagggagttggtggagagagaaagagagagagagagatggcgtcgccgtcgtcgtcgtcgtcgctgtgctcgaccttcgcctcgccgcgcgccgcctccctcggccgccgcctcgccttctcctcgcccaggaaagcattccgagtgagggcatcatccagggttgacaagttctcgaagaatgacatcatcgtgtccccttccattctttctgcaaacttttccaagcttggcgagcaggtaaaagctgtggatgtggcaggatgtgactggattcatgttgatgtcatggatggacgttttgtgccaaatatcacaatcggacctttggttgttgatgctctgcggccagtcactgatcttccgttggatgtgcatctgatgattgtggaacctgagcaacgagttccagattttatcaaggcaggtgctgatattgttagcgttcactgtgagcaatcgtcaaccatccatctacaccgaacagtcaatcagatcaaaagtcttggagcaaaggctggagttgttttgaatcctgcaacccctctcactgcgatagattatgtacttgatgtt

SEQ ID NO: 1789 - DNA, 669 bp, Artificial
  Synthetic
tctctctctctctctctctctctcatccccaagttatcaccttcctccggcagttaagcaagaatctgcagaaggaggtctctgtgtgggtatatccatggcagcagtttcatccacagcattgctgaagagtagcctctttggtgtcaaaccatccctacgcactacttctcgatgcgcaactccatcttcaagcaaggtgttcattccagtggtgaaggcatcatcccgtgtggacaagttctcaaagacagatatcattgtttcaccatctattttatcggctaactttgccaagttaggagagcaggtgaaagctgtagaagaagcaggttgtgattggatccatgttgatgtgatggatggccgttttgtgccaaatattactatcggcccactcgtggtggatgcattgaggccggtgactgatttgccacttgatgtgcacttgatgatcgtcgagcccgagcaacgtgttccggactttattaaggccggcgctgacattgttagtgtgcattgtgagcagtcatccacaattcatcttcatcgaacagtaaatcagattaagagcctacgagccaaagcaggagtggtcttgaatcctgccacacccctcagcactattgaatatgtcctacatgtggttgacctagtcttaatcatgtc

SEQ ID NO: 1790 - DNA, 661 bp, Artificial
  Synthetic
tcgctaattttaataacgcctttaataatgtcgcgtttgttgttaactgactcttcaaatgcctgttgtacatcccgataatcgtaaatatgcgtcaccatcgatttcacatcgaatcgccctgaagaaatagcttcaatcgtgaccggataacgattggcatagcggaataccgtctggatagtgacttcgcgattgattttgaggaaattgattgccgaatcgccgggtacagtaccaacaatcataattttaccgccgcgcattaccagataaggtgcctgtttaacggtgaccgcagaacccgctgtttcgaaaacaatatctgcgcccatgtcttcggtaaattgctgacagcgtgcaatagtgtcttcttttgcgccgttaataaccactgtcgcaccaagctgttccgccattgccagacgtttttccagcacatcaacgacggcaatttccgttgctcccaggcatttgcacgcttgcaacgtcatcaaaccaatacaacctgctcccagaataattatcttcttacccggtttaacatctgccagcatcgcggcatgcatcccgactgcggcaggctccaccagcgccccttccatcgtgtccatattgtcgggcagtttgtaagtaaagctctccggatgacacagatagt

SEQ ID NO: 1791 - DNA, 690 bp, Artificial
  Synthetic
gcgtttgttgttaactgactcttcaaatgcctgttgtacatcccgataatcgtaaatatgcgtcaccatcgatttcacatcgaatcgccctgaagaaatagcttcaatcgtgaccggataacgattggcatagcggaataccgtctggatagtgacttcgcgattgattttgaggaaattgattgccgaatcgccgggtacagtaccaacaatcataattttaccgccgcgcattaccagataaggtgcctgtttaacggtgaccgcagaacccgctgtttcgaaaacaatatctgcgcccatgtcttcggtaaattgctgacagcgtgcaatagtgtcttcttttgcgccgttaataaccactgtcgcaccaagctgttccgccattgccagacgtttttccagcacatcaacgacggcaatttccgttgctcccaggcatttgcacgcttgcaacgtcatcaaaccaatacaacctgctcccagaataattatcttcttacccggtttaacatctgccagcatcgcggcatgcatcccgactgcggcaggctccaccagcgccccttccatcgtgtccatatcgtcgggcagttcgtaagtaaagctctccggatgacacagatagtgcgttaatgcgccgcggtagttgggttgtgtcgccataaaatcaacgtccgggcagatgtt

SEQ ID NO: 1792 - DNA, 978 bp, Artificial
  Synthetic
gaattcagaccacaaggaaaaatgacattgccgtaaatttacaagattccatttccatttattcatcaaaagagtacttccctttgaagccagaattgattttccttgatatctgacataatgcataaaaggatccttgaacaaccataggaaggtctgaaaatcattactaaacactactacaggatgctccatttttccatagaaatttattcgctcaagaaggattctaaaagatgttgatcgtaaacgaaaagattgtttacggagaaaaactaatatggattcgcattcatatacatgagaattatataggaagaagaaaaagcgttgattctcctttgaaaaaagggaaattgctttattttgagtaataagactatagcaattacgatactcatggagaaagaatcgcaataaatgcaaagagggaacatcttgtatccaagagcgtaggatttgaaccaagatttccagatggacagggtagggtattagtatatctgacacatgagttaaatgtgataatttatcctctaaaaaaggaaatattgaatgaatagatcgtaaattatgagatttttttatatcctttccttctagaaaagatactaatcgtagtgaaaatggaatttctactatgactgaaagcccctcagatattatttgataataaacatttgggttgtgcgcaaaaaattttttttgtttagcaacatttgtcgaaatcatcaaattaaaatgtttctgttgatacatttgagtaattaaacgtttcacaagcagtgaactgaatttattatcataacctacatttttcacggattcataaagaattgatccatttaaaccatgatcatgagcaagtgcataaatatactcctgaaaaagaagtggatataggaagtcttgttgccgagatctatctatttttgaatatgcccccaattccttcatttaaaattcgatttggaattc

SEQ ID NO: 1793 - DNA, 614 bp, Artificial
  Synthetic
cccacgcgtccgcgttcggggtagatagcccgcttcctcctctctctctcagatcaccacacctcgagtcgccgccgccgccgccgctgctgctgcttacctcctccgcgccgcgcactccttgcactagcccatggcgacggctatgatggctgcgaccgccacctcgtgctcccctcgccgcgcgccggtcgtcgcgtcgtcgtccgtgcagccgcccaggcggcagcagcagcagcaaccgcggaggggattgaagcagctgccggggctcgtggcgacggcggccgtggccgtggccgcggcgccgctaccggcgctggcggagcagatggagaaggcggcgctgttcgacttcaacctgacgctcccgctgatcgcgaccgagttcctgctgctgatggtggcgctggacaagctctacttcacgccgctgggcaagttcatggacgagcgcgacgccaagatccgtgccgagctcggcggcgtcaaggacgcgtccgaggaggtgcggcagctggaggagcaggccgccgccgtgctgaaggcggcacgcgccgagatcgccgcggcgctcaacaagatgaagaaggagaccacccaggagctggagg

SEQ ID NO: 1794 - DNA, 669 bp, Artificial
  Synthetic
gaattcgaaggagaaaaaccagaaactggtttcatcatagtgatggcaaacatgatcatggcttcctcatccaaaaccctaatcacatctccttcaatccaatcaacaccaaaattccaacttccccaattcacaaccctaagaatcagaagccaagccaatcaaaccagcaccagcagcaacaaaatcaaactcccaactctaaacctaaactcactcaaatcaacagcagcaattgcagcagcagttctaacaatggctccaccatcactagcagcagaaattgagaaagcagcattgtttgatttcaatctcactctaccactaatcatggcagaatttctcatacttatgtttgctctagacaagatttactacactccattgggtaactttatggatgcaagagatgcagatattagagggaaattgaacagtgttaaagatacatctagtgaagtcaaggaattggatgaacaagctgctgctatcatgagagcagctagagctgaaattgcagccgctttgaaccagatgaagaaagaaacaactgtggaggttgaagcacagatggcagaaggaaggaagaaattggaagctgaattggctgaagctcttggtaatttggagaaccagaaggaggaaactattaaagctcttgattctcaa

SEQ ID NO: 1795 - DNA, 541 bp, Artificial
  Synthetic
  misc_feature (283)..(283): The residue at this position can be any nucleotide.
  misc_feature (286)..(286): The residue at this position can be any nucleotide.
gtcgaggcacgcgtccgcggacgcgtgggccgccgccgccgctgctgctgcttacctcctccgcgccgcgcactccttgcactagcccatggcgacggctatgatggctgcgaccgccacctcgtgctcccctcgccgcgcgccggtcgtcgcgtcgtcgtccgtgcagccgcccaggcggcagcagcagcagcaaccgcggaggggattgaagcagctgccggggctcgtggcgacggcggccgtggccgtggccgcggcgccgctaccggcgctggcggancanatggagaaggcggcgctgttcgatttcaacctgacgctcccgctgatcgcgaccgagttcctgctgctgatggtggcgctggacaagctctacttcacgccgctgggcaagttcatggacgagcgcgacgccaagatccgtgccgagctcggcggcgtcaaggacgcgtccgaggaggtgcggcagctggaggagcaggccgccgccgtgctgaaggcggcacgcgccgagatcgccgcggcgctcaacaagatg

SEQ ID NO: 1796 - DNA, 618 bp, Artificial
  Synthetic
accagtggatggcggcggctatggcgacttgcagtgccggagctctggtcgtgcgctcggcatcacttccatgcaagggggggttgccgtcgagcagcaaagccaaggttggttttctcactaaactggggagagccctggacagtggtgcgttgcggaacgcagcattcggggcgctgaacctggcgacgctgagcttgcccgcagctttggcactggctgccgaggaggagaagaaggagcccgggaagctgttcgacttcgacgccaccttgcccataattgtggccgagttcctgtttctcatggtcgctctggacaagatctggttcacgcctgtcggcaagatcatggacgagcgggacgagatgatccggaacaagctcgagagcgtcaaggacaactcggaggagataaagaagctccaggacgaggccgaggcgctgattcaggcggctcgagccgagaccaccgccgcgttgaacaagatgaagaaggagacggccgcggagctggaggcaaagttgcaacagtcgagggagaggatcgagcaggagctggcccaagcgcttgccaacttggaagagcaaaatcaggagacgctcaagagcctggagc

SEQ ID NO: 1797 - DNA, 566 bp, Artificial
  Synthetic
gaattccaccagaaaaatgaactcccaactgagagaatcatatgcttgagtgatatcaatctttaaacccatattgccccctcttctcttgtaatcaagctcattgactaactcagaagccataacaattttttcctgaatatttccccccttaataaaagcaccttgatttggggacaccactttcttaatcatttcagtcaatcttaatgttataatctttgtgaaaactttaaaactaaaattcatcaagccaatgggtctaaattgttttgcttttcttgcattcttaactttaggcagtaaaagaagaaaattagcattcaaaccattaggaatgaaacctttactccaccaaaattaaattgctctgatgaagtcaaagctaattatatcccaaacttctctataaaaccatccatcaaaaccatctggaccaggagcactctctggattcaagtcaaatacagcttctttaatttcctctgcacttggagtagcttcaagaagaatattatcctcctcagaaattacattagggatatcttgaaacaaattttcttcaa

SEQ ID NO: 1798 - DNA, 591 bp, Artificial
  Synthetic
gaattctcaccccgtggacgtaggtaatcatgttgaaccacgtaaatccttgtgttcatgtttgattctattacttttgtttagtgtttgcatgttctttacctttggatgtagtttgtagatttttgcaactacataaagcaccggggccagatggttttactgctgaatttttcaagagttgctggagcactttaaaggaagatttcatggggttagttaatgacttccacaggtttggttcaatagattggcgctttaattgttctttcatcactctcatcccaaaaaaggaggacccttgcactccaaaagactataggccattaagtattattggtatggtgtataagattatctcaaagcttctcgcagtttggttgaagacgatgattccaaggttggtatctgattttcagggggcttttattcatggcaagcaaatcctagaataattgcaaacgaatgtgtcgatagcagactgagggctaggaagcctggtatattgtgcaagattgatatggagaaagcttttgataatgttaaattgggaatgctttgtgcacaatcttgcagaagcatgactttgga

SEQ ID NO: 1799 - DNA, 573 bp, Artificial
  Synthetic
gcacctgcacgtactaggggacgacggccgccggtgtggactgcggcggcggccaccgcagcagcgccggcggacacggcggcgtcggcgcggcgggagcaggtggagatcgcccggtcgctgaacgcgtgggtggaggagaacatgctcccgctgctcacccccgtcgactccgcgtggcagccgcacgacttccttccctgctcggccgcgggcggcggcgaggcgctggcggcgttcacggagggcgtggccgagctgcgcgcgggcgccgccggcgtgccggacgaggtgctggtctgcctcgtggggaacatggtgacggaggaggcgctcccgacgtaccagagcatgggcaaccgcgccgagggcctcgccgacggcaccggcgtgagccccctcccctgggcgcgctggctccgcggctggaccgccgaggagaaccgccacggcgacctcctcaaccgctacctctacctctccggccgcgtcgacatgcgccaggtcgaggccaccgtgcaccgcctcctccgcaacggcatggagatgctggcgccggcgagcccgtaccac

SEQ ID NO: 1800 - DNA, 620 bp, Artificial
  Synthetic
aaagaaagccaatggcgtcttcaggcctcgcagttgcagcaacagcctcgtcagcctggctctgctgccccaatcatcacatccataccagcagcagcagatctcgcaagcatcttcttctccatggcctgtacgggggacgacggccgccggtgtggactgcggcggcggccaccgcagcagcgccggcggacacggcggcgtcggcgcggcgggagcaggtggagatcgcccggtcgctgaacgcgtgggtggaggagaacatgctcccgctgctcacccccgtcgactccgcgtggcagccgcacgacttccttccctgctcggccgcgggcggcggcgaggcgctggcggcgttcacggagggcgtggccgagctgcgcgcgggcgccgccggcgtgccggacgaggtgctggtctgcctcgtggggaacatggtgacggaggaggcgctcccgacgtaccagagcatgggcaaccgcgccgagggcctcgccgacggcaccggcgtgagccccctcccctgggcgcgctggctccgcggctggaccgccgaggagaaccgccacggcgacctcctcaaccgctacctctacctctccggacgcgtcgacatgcgc

SEQ ID NO: 1801 - DNA, 637 bp, Artificial
  Synthetic
gggtgggcttcggatcgctcgacctcctcgcagctctccagcaatggccgccgtcgccaacgtttgcgggatgcctatgaggagcgcattcgttccatgccacgaaatccacctcgtcaagccgccggttgtctccatcacttcggtgaggagctccagatttcccggaatcgccatgactgctacggctccagcaacggagaacattgcaaagcaagtcagcaagccttcccaaatcatgcattctctttctccggagaaggtcgagatgtttaagtctctcgagagctgggccgaggaagcgatccttccattcctgcggccagtggagaaatgctggcaacctcaggactacctcccggagccgtcctcggagagcttctacgacgaggttcgcgagctgaggaagcgggccgagtgcctgcccgacgactacttcgtctgcctcgtcggggacatgatcaccgaggaagctctgccgacttacttgacaatgctcaacactctggacggctcccgagacgagaccggcgcgagtcagagtccctgggccgtctggggacgtgcttggacggcagaggagaaccgtcatggcgacctgctcaacaagtatctctacctcactggacgcgtcgat

SEQ ID NO: 1802 - DNA, 701 bp, Artificial
  Synthetic
gcgtttgcgctattatagtcagtgtcgccaaagtttgtgcgatctctcctcctcaggcgccggaacaatgtcgaacctcaacgatttgctcaacctcgacatcactgacaccaaagagatcatcgccgagtacatatggattggggggtcgggtatggacctccggagcaagggccggactctgaagggcccaattaccgatccctagaagctcccgaaatggaactatgatggttccagcactggacaggctcctggcgaggatagcgaggtcatactatatccgcaggcaattttcagggatccgttcaggaaaggagacaacatattggttatctgcgacacttacactccaaagggagagccactcccctcgaacaagcgagccaaagccgaggcgattttcagtcagaaggcagtgagtgacgaagttccctggtatggaatcgagcaagagtacacattgctccagcgggaggtcaagtggcctctgggatggccgattggtggctatcccggcccccagggaccgtactattgcggaaccggagctgagaaagcttgggggagagatattgtgaatgctcactacaaagcatgcatctatgccggcgtccagatcagtggtatcaacggcgaagtcatgccaggccagtgggaataccaagtcggtcccgctgttggaatttccgctggtgacc

SEQ ID NO: 1803 - DNA, 1211 bp, Artificial
  Synthetic
cttctctcaccgatctcgtcaacctcactctccgacaccacggagaagatcatcgccgagtacatatggatcggtggatctggcatggatctcaggagcaaggctaggactctctccggccctgtgactgatcccagcaagctgcccaagtggaactacgatggctccagcaccggccaggcccccggcgaggacagtgaggtcatcctgtacccacaggctatcttcaaggacccattcaggaagggaaacaacatccttgtcatgtgcgattgctacacgccagccggagaaccgatccccaccaacaagaggcacaatgctgccaagatcttcagctcccctgaggttgcttctgaggagccctggtacggtattgagcaagagtacaccctcctccagaaggacatcaactggccccttggctggcctgttggtggcttccctggtcctcagggtccttactactgtggtatcggtgctgacaagtcttttgggcgtgatattgttgactcccactacaaggcttgcctctatgccggcatcaacatcagtggaatcaacggcgaggtcatgccaggacagtgggagttccaagttggcccgtctgtcggcatttctgccggtgatcaggtgtgggttgctcgctacattcttgagaggatcaccgagatcgccggagtcgtcgtctcatttgaccccaagcccatcccgggagactggaacggtgctggtgctcacaccaactacagcaccaagtcgatgaggaacgatggtggctacgagatcatcaagtccgccattgagaagctcaagctcaggcacaaggagcacatctccgcctacggcgagggcaacgagcgccggctcaccggcaggcacgagaccgccgacatcaacaccttcagctggggagttgccaaccgcggcgcctcggtccgcgtcggccgggagacggagcagaacggcaagggctacttcgaggatcgccggccggcgtccaacatggacccttacgtcgtcacctccatgatcgccgagaccaccatcatctggaagccctgaagcggctttttgacgccacgacatcctcgtcatcgtcctccccagctcgccgtgtcgctccggttgctccattgatcggacgatctggtgaattgcattggtgctgggagaagtaaaaaaaaaaaagggaaggagaaaaaaaaaaa

SEQ ID NO: 1804 - DNA, 1307 bp, Artificial
  Synthetic
attgatcagagaattgttaggcttctattttcattatgtctctgctttcagatcttatcaacctcaatctctctgattctaccaagaaaatcatcgctgaatacatatggatcggtggatcaggcatggacataaggagcaaggccaggactcttgatggtcctgttactgatccttcagaactacccaaatggaactatgatggatctagcacaggtcaagctcccggagaagatagtgaagtgatcttatacccacaagctatctttaaggatccattcagaagaggcaacaatatcttggtcatgtgtgatgcgtatactccttctggtgagcctatcccaacaaacaagaggcatgctgctgccaagatcttcagcaaccctgatgttgttgctgaggaaccatggtatggtattgagcaagaatacaccttgttgcaaagggatattaactggcctctgggctggcctattggaggcttccctggacctcagggaccatactactgtggaaccggagctgataaggcctttggacgtgatattgtggactcccattacaaggcttgtctttatgctgggattaacatcagtggtatcaatggagaagtcatgcccggacagtgggaattccaagttggaccttctgttggcatttcagccggtgatgaagtgtgggtagctcgttacattcttgagaggattgcggagattgctggagtggttgtgtcatttgaccccaagcctattccgggcgattggaacggtgcaggtgctcacacaaactacagcaccaagtcgatgagggaagatggaggctatgaagtcattttgaaggctattgagaagcttggcctgaagcacaaagagcacattgctgcatatggtgaaggcaatgagcgtcgtctcactggaaagcacgaaacagccaacatcagcaccttcaaatggggggttgcaaaccgcggtgcatctgtccgtgtaggacgggacacagagaaggcgggcaagggatactttgaggacagaaggccagcttcaaatatggacccatacgtcgttactgccatgatcgcagacaccacgatcatcgggaaaccttgaagctttttagtatgaattgcttgtttctggtttgcacaatttgggatagaaaaggattgatttatgaaacagccctttcgcttcgcctgtgtctttagttagggtagtttggtcttttggtatttttcttttattccagttgaagttgtattttcatacagcaaggctgatttcattgcctatgatttggcaatggtatta

SEQ ID NO: 1805 - DNA, 599 bp, Artificial
  Synthetic
cccggcgaggacagcgaagtgatcctctaccctcaagccattttcaaggacccgttcaggaggggcgacaacatccttgtgatgtgcgactgctacacgccacaaggtgagccaatccccactaacaagaggcacagtgccgccaagatcttcagccaccctgatgttgttgctgaggtgccatggtacggtattgagcaggagtacacactccttcaaaaggatgtgaactggccccttggctggccagttggtggcttccctggcccacagggaccatactactgcgctgccggtgccgaaaaggcgttcggccgcgacatcgtggacgcccactacaaggcctgcatctacgccgggatcaacatcagtggcatcaacggggaagtcatgcccggccagtgggagttccaagttggcccgtcagttggcatcgccgctgctgaccaagtgtgggttgcccgctacatcctcgagagggtcacagaggtggccggagtcgtgctctcccttgacccgaagccgatcccgggtgactggaatggcgctggtgcccacaccaacttcagcaccaagtcgatgagggagccgggaggcta

SEQ ID NO: 1806 - DNA, 985 bp, Artificial
  Synthetic
gcattgcattccatttgattgcttcattttcagtccatttgttggtcttttctgaaatacccatataccggtgtacacccgtatatatacagctggttgaactgcactccgctcgcattcaatcttccccactacatcatcacatttcttctttctcccacaaacaacatcacacacaaccgtcatcatggccaaccgagaaattctgtcgtctcgaaccgagactctcaacaagtacctgaagctcgaccagaagggcaagatcatggccgagtatgtctggatcgattctaccggcgagactcgatcaaaatccaggacgctccctgagctcaaggacaaggaatacacccccgaggatctgcccgtctggaactttgacggctcttcaactggccaggctcctggtcacgattccgatgtctacctgcgccctgccgccgtctaccccgatcctttccgtggctctcccaacatcatcgtcctcgccgagtgctggaacgccgacggcactcccaacaagtacaactaccgccatgagtgcgccaaggtcatggaggccaacgctgctctcgagccctggttcggtctcgagcaggagtacactttcctcgaccacgatgacaggccctatggctggcccgttggcggtttccctgctcctcagggtccctactactgcggtgtaggtagcggcaaggtcgtcctccgtgacgtcgtcgaggcccactacaaggcctgtctgtatgctggcatcaacatctccggtaccaacgccgaggttctctcaagtcagtgggagttccaggtcggcccttgcgtcggcatcaacatgggtgacgagctctggatcgcccgtttcttccttgcccgcatcgccgaggactttggcgtcaagatctccctgcaccccaagcccatcaagggtgcttggaacggcagcggtctgcactccaacttctccaccaaccagatgcgtgaggag

SEQ ID NO: 1807 - DNA, 610 bp, Artificial
  Synthetic
gaattcaaacagagagctagatagataattggcattgttaattcatcatattcattcgtcaaatatgtctcttctaacagatcttatcaacttagatctctcagacaaaactgagaagatcatcgctgaatacatatggatcggtggatctggtatggaccttcgaagcaaaggaaggacattacctggacctgttagtgatccttcaaagctaccaaaatggaactacgatggttctagcactggacaagctccaggagaagatagtgaagtcatcctatatcctcaggctatcttcaaagacccattcaggaggggaaacaacattcttgttatgtgtgatgcttacactccacaaggagaaccaatcccaactaacaagagatgcgctgctgcaaagatcttcagcaatcctattgttgagaaagaagttccatggtacggaattgagcaagaatacaccctcttgcagaaggatattaactggcctcttggatggccccagggaggctttcctggaccacagggaccttactactgcggtactggtgcggacaaggcattcggacgtgacattgttgatgcccattacaaagcctgtctctatgca

SEQ ID NO: 1808 - DNA, 570 bp, Artificial
  Synthetic
gaattcaacaacgcaacaatggcgtcctcagggggagctccaagagccacaactttttcctcaaaaactctaattaatctctgcagaagagtaccaattttccttccacgtagatcatttcattcctctactcaattccaaaccctaaaattcattcccaatacttacagagaacgtcgtttcagtgtaagagctgagactccatcagaaaacggtggtgtaaattacgattatgacctatttacaatcggtgctggtagtggtggtgttcgtgcttctcgtttcgcttctaattttggtgcttctgttgctgtctgtgagctcccttttaacactatctcttctgatactgctggtggcgttggtggaacgtgtgtacttcgtgggtgtgtaccaaagaaattgctcgtctacgcctccaaatattcacatgattttgatgatagttgtgggtttggttggaagtatgaaacggacccagttcatgattggggaacattgatggctaataagaatgctgagttacagcgtcttacagggatctacaagaatatcttgaaaaatgctaat

SEQ ID NO: 1809 - DNA, 956 bp, Artificial
  Synthetic
tcttgctttggatatacactttgtggagttaatctgtttctcatagaatagaagaagatggatcaatcctcatcaatggttcgcctggctcgctttgctgcccatctggctcctcccttgaatgaaggcggaagagcagttcatatggagagttgccgagcgaagggtgcagcacctggcttcaaggttgctgtgcttggggcttcgggtggcattgggcagcctctttcccttttgctcaagatgaaccccttagtttctgtgctccatctttatgatgttgtcaatacactcggagtgactgccgatataagccacatggatactagcacagtggtacgtggctttgttgggaaagatcaattggaggctgctttagagggcatggagcttgttgtaattccagctggtattccacggaaaccagggatgactagagatgatctattcaagatcaatgcgggcattgtgcgcacactttgtgaaggaattgccaaatgttgcccgaatgctatagtgcatatcattagtaatccggtaaattccacagttccaattgcagctgaggttttcaagaaggctggaacatacaatccaagacggcttatgggtgttacccatcttgatgtggtgcgagcaaacacctttgcggcagaggttatgggagttgatccaaaacttgtcactgttcctgtcgttggaggacatgctggcataaccattttgccactcctttctcagattaagcctgctttttcctttaccaaggaggagactgaatttttaacaaacaggattcagaatggagggacggaggtagttgaggcaaaagcaggcacaggctcagcgacattgtcaatggcctatggagctgctaagtttgcagagtattgtttacatgccatgtgtggtgaagccggtattttggtctctgcccatgttgcttcacaggtgac

SEQ ID NO: 1810 - DNA, 624 bp, Artificial; identical to SEQ ID NO: 55
  Synthetic

SEQ ID NO: 1811 - DNA, 317 bp, Artificial
  Synthetic
cccacgcgtccgaaaccagggatgacccgcgatgatctgtttaaaatcaatgctgggattgttaaaacactatgtgaaggtgtagcaaaatgttgtcctaatgctattgtcaacttgatcagcaaccctgtgaactctactgtccccattgccgctgaggttttcaagaaagctggaacttatgatcctaagaagctccttggagttactacactcgatgttgctcgtgccaacacatttgtggcagaagttcttggccttgatccaagagaagtcgatgtgccagtagttgggggacacgccggagtcacaatctt

SEQ ID NO: 1812 - DNA, 505 bp, Artificial
  Synthetic
aattcggcaccagcagactttctccatttcaattcattaactattccgaatgactttatccatgttgagatctgtcgtccggaggaccacaacttcaggcgcgtctcgcctcacgcgccgccaattctcatcgagggccgcaccggagaggaaagtcgcaattttgggagcagcgggaggaatcggacagcctctttcacttctgatgaagttgaatcctttggtatcaacgctttcactctacgatattgccggcactcctggtgttgccgctgatgttagccacatcaataccagatctcaggttgctgggtttgcaggagaagaccagctagggaaggctctggaagggtctgacgtggtcatcattcctgctggtgtgccccgcaaaccgggtatgacccgtgatgatctgttcaacattaacgctggtattgttaaatcattatgcacagctatcacaaagtattgccccaatgcccttgtcaatatgatcagcaaccct

SEQ ID NO: 1813 - DNA, 584 bp, Artificial
  Synthetic
cctgctctccaccaaccgccccaatcgcctctgtccttggatcaattcctcgcatctctctttagatcatcatgttggcttccagaatccagcgcagggccttctctgcctctgcccgcaacctgtccaaggttgccgtcctcggtgctgccggtggcattggccagcctctctctctcctcctcaagctcaacacccgtgtcaccgagcttgctctgtacgatatccgtggcggacctggtgtcgccgctgacatctcccacgtcaacaccaagtccaccgtcaagggctatgaggccacccccagcggccttgctgccgccctcaagggctccgacatcgtcctgattcccgctggtgtcccccgtaagcccggcatgacccgtgacgatctcttcaacaccaacgcctccatcgtccgcgacctggccaaggctgttgccgagtccgcccccgaggccaagctcctcatcatctccaaccccgtcaactccaccgtccccatctgcgccgaggtcttcaaggcccgcggtgtctacaaccccaagaagctcttcggtgtcaccaccctcgacgttgtccga

SEQ ID NO: 1814 - DNA, 502 bp, Artificial
  Synthetic
ccccccgaccgagtcagatctcgagcgccgcagaggagagcggcaatgaggccgtcgctgatgagatccgcctcgcaggtcctccgccgccgccgcggctactcctccgcctccggccagccggagcggaaggtcgccatcctcggcgcggccgggggcatcgggcagccgctctccctcctcatgaagctgaacccgctcgtctcctccctctccctctacgatatcgccggcacccccggcgtcgccgccgacgtctcccacatcaacgccccggcccaggtgaaggggttcatgggggatgaccagctcggggaggcgttggaggggtcggacatcgtgatcatcccggccggcgtgccgaggaagcccggcatgaccagggacgacctcttcaacatcaacgccggcatcgttaagaacctctgcaccgccattgccaagtactgcccgaatgctcttgtcaacatgatcagcaacccagtgaattcaacggtcccaa

SEQ ID NO: 1815 - DNA, 796 bp, Artificial
  Synthetic
aactcctcgaaactcacgaatctatcgccaataaatgctctcctcatcttcccctctttgaacattttcattttcgactcacattttctccgccgtagcattttccttttccttttctttgttcatcacaaaccaaccaattattcaaccatgttgagatctattgcccgcagaacctcgaccaccggtgcatatctcacgcgccgcggattcgcgtcggagtccgctgctgaccggaaagtagcaattttaggggcagctggtgggatcgggcagcctctatcacttcttatgaagttgaatcctttagtatcacaactctcactttacgatattgccggtacccctggtgttgccgctgatgtcagccacatcaacaccaggtctcaggtttctgggtttgcaggagacgaacagctaggacaggctttggagggagctgatgttgtcatcattcctgctggtgtgccacgaaagcctggtatgacccgtgatgatctgttcaacattaatgctggtattgttaaatctctttgcacagccatcgcaaagtattgccctcatgcgcttgtcaatatgatcagcaaccctgttaactccactgtcccaattgccgctgaggttttcaagaaggctggaacctatgatgaaaagagactctttggagtgaccacacttgatgttgttagggcaaagactttctatgcaggaaaagctaaagttaatgttgctgacgtcattgtccccgttgttggtggtcatgctggcataaccatcctcccactattttcccaag

SEQ ID NO: 1816 - DNA, 735 bp, Artificial
  Synthetic
gaattcactgtaagccaggaataatctagaaacagattcttcttattaaagccaataattctcctctactacagatagtaagatggctgcaacagcggcaactactttttcggttgcatctgtttcttatggaagccaaggatcaaaatctaaatccttgaactttagattcaactccccaaactatcttaagagtttcagtggtctaaaggctgcaggatctgttaaatgtgaatctgaagcgtctttcgttggccaagatagtggtgctgctcttcgtgcctctgtcgcagtaagagctgtgaaacagaacaaggagggtcttgagaaatgtttccagcctcaggcttcttttaaagtggcaattctcggagcagctggaggaattggtcaacccctttcacttttgatcaagatgtcgccattggtctcggcccttcatctctatgatattgctaacgtgaaaggagttgctgctgatctcagtcactgcaatactccttcccaggttctagacttcactggccaagcagaattaggaaattcgttgaaaggtgtcgatgtggttgtcataccagctggtgttccaagaaaaccaggaatgacacgtgatgatctcttcaacatcaacgctagcattgtgaaaaccctgattgaagccgtagccgataattgtcctgatgcattcatccacatcatcagcaaccctgtcaactctacagtaccaattgcagc

SEQ ID NO: 1817 - DNA, 882 bp, Artificial
  Synthetic
gacacacaattcttttgtgctccaaagtatcagaagatgcagccattcagtgcagaagttcaccaacgtattgctagaatttctgctcatctcaaccccccaaatctccagatgggagaggggtctgtgttggaaagatcaagctgcagagcaaaaggtggggctcctggatttaaagttgctatattgggtgctgctggaggtattggccaaccacttgcaatgttgatgaagatgaaccctttagtctcagttcttcatctctatgatgttgttaatgctcctggtgttactgctgatgttagccacatggacacgggtgctgttgtgaggggttttcttgggcaaagtcagcttgaggctgcacttacaggaatggaccttgtgatcatacctgctggtattccaagaaaaccaggaatgacaagagatgatctttttaagattaatgctgggattgtgaggaccctctgtgaaggaattgcaaagtgttgtcctaatgctattgttaatttgattagcaatccagtgaattccacagttcctattgcagctgaagttttcaagaaagcaggtatttatgatccaaagaagcttcttggagttacctcactagatgttgtcagagccaatacttttgtggcagaagttttgggactagatcctagggaagtagatgttcctgttgttggaggtcacgccggggtgacaattttgcctcttctctcacaggtcaagcctccttgctccttcacacaggaggaaacagaatatttgactaagcgcattcaagatggagggacagaagttgttgaggccaaaaaaggagctggatctgcaactctatcaatggcatatgcagctgtaaaatttgcagatgct

SEQ ID NO: 1818 - DNA, 321 bp, Artificial
  Synthetic
cccacgcgtccgcctaacgagaggaaactgaggaacacaacaatggagtttcgtggagatgccaaccagaggattgctaggatttcagctcatctcactcctcagatggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagct

SEQ ID NO: 1819 - DNA, 631 bp, Artificial
  Synthetic
gtctccttggagtgacaacactggatgtagcaagggcaaacacctttgtggctgaagtacttggaattgacccaaaagatgtcaatgttccagttgttggtgggcatgctggagtgactatattacccctcctctcccaggtccaccccccatgctcatttaccccagatgaaatcagctatttgactaaacgcatacagaatggtggcacagaagttgttgaggcaaaggcaggagcaggctctgcaactttgtcaatggcttttgctgcagcaaaatttggtgatgcatgcttgcgagcaatgcgtggtgatgctggcgttgtggaatgttcatatgttgcatctgcggtgaccgagttgccgttctttgcaacaaaagtgaggttaggtcgtgctggagccgaagaggttctccctcttgggccgttgaatgattttgagagagctggcttggagatggcaaagaaagagctgatggagagcattcagaagggcatcgatttcatgaacaagtgaggtgtatgaagggacaaagttatgcatacatgtaaagagtgtcctatatatagtgctcatatacatgtaaaattttcgccgggctcatatacatgtaaaatcacttctgtaaa

SEQ ID NO: 1820 - DNA, 296 bp, Artificial
  Synthetic
gcgaggtgattattagggcaatgggtttagagatggcccaggatcgggcgagggagcggatgggccgaatctcatcacacctgaagcgcagtgatgtgtgtatggaggtgtgccgtgctaagggggccgccacggggttcagggtggctatactgggggcggcaggaggcatcgggcagcctctatcgctgctaatgaaaatgaatccgctggtttccacgttgaacctgtatgatgtggtcaacactccgggtgttaccgcggacttgagccacatagactcaacagcagtggtg

SEQ ID NO: 1821 - DNA, 629 bp, Artificial
  Synthetic
ggcaatgggtttagagatgcccaggatcgggcgagggagcggatgggccgaatctcatcacacctgaagcgcagtgatgtgtgtatggaggtgtgccgtgctaagggggccgcacggggttcagggtggctatactgggggcggcaggaggcatcgggcagcctctatcgctgctaatgaaaatgaatccgctggtttccacgttgaacctgtatgatgtggtcaacactccgggtggttaccggcggaacttgagccacataaaactcaacagcagtggtgcgaagcttcctggggaaagacgcgctccattcggcattggaaggggtggatctggtcataattccggcaggtattccccgaaagccagtgatgagccgggatgacttgttcaagataaacgcgggcattgtgcgaacactttgtgagggcgttgcacgggcatgcccgcgggcacttatcaacattatcagcaacccggtgaactccaccgtgcctatagcagctgaggttttcaagaagtctggcacgtacgacccacgacggttgtttggtgtcaccacccttgatgttgttcgaggcaacacatttgtgggcgaggtcgtgggagtggatccaaagctcatcaa

SEQ ID NO: 1822 - DNA, 298 bp, Artificial
  Synthetic
gagtttcgtggagatgtcttccattgtattgctaggatttcagcttctcactcctcagatggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagctgttgtccgcgggttcttgggagcg

SEQ ID NO: 1823 - DNA, 703 bp, Artificial
  Synthetic
ggatcgatcgatcgatcgaggatgtcgtcgaagcagcgggcagcgatgatcttcaagcgggctatggcgacagtgcccgggggaaagccgctgcccgtgaggaagcctctgccttatcgtagggtcgcggttctgggggcggccggcggcattgggcagccgctgagcatgcttctcaagctcaatcccctcgtctccaagctctcgctctacgatatcgctggaacacccggcgtgtccactgatctatcgcacatcaacacgaggacagaggtgcatggatttgctggggatgatcagctcaaggacgctctaaaagacgcggatctcgttatcattcctgccggtgttccccgcaagcccgggatgacgagggacgagcttttcgatatcaatgcggggattgtgaagaagctgtgccaagccatcgcgaagcactgccctcttgcattgattaacatgatcagcaatcccgtgaattccaccgtgccaatcgcggcagagatgctcaaggccgagggaacttacgaccacacgaggcttttcggcgtcaccaccctggacgttgtgcgagcgaggactttctacgccaaagccaagaacctgcccatcgaagatgtggacgtccctgtcgttggtggacatgccggcaagaccattcttccactgttctcacaggcaaccccacaagtacccctcaccc

SEQ ID NO: 1824 - DNA, 566 bp, Artificial
  Synthetic
ggaatatcttccttttgagccttcttcttctccccttttattcctcccacatattccccctataaccgctaccatggtcaaagcagttgttgctggtgcctccggaggcattggacagcccctctccctcctcctcaagggcagccctctcatcgacgagctggctctgtacgatgttgtcaacacccctggcgttgctgccgacctttctcacatctcctccccggcgaaagtgactggctacctgcccgccaatgacggcgcaaaggccgctttcaaggatgccgacatcatcgtcatccccgctggcattccccgcaagcctggtatgacccgtgacgatctcttcaacatcaacgccggcatcgtcaagggcctcatcgaggtcattgctgatgttgcccccaaggccttcatcctggtcatctccaaacccgtcaactccaccgtccccatttccgccgaggtcctcaaggccaagaaggtctttgaccccaagcgcctctttggtgtcaccactctggacgtcgtccgtgccgagacttttgttgccgagattgttggcg

SEQ ID NO: 1825 - DNA, 687 bp, Artificial
  Synthetic
cgtcgggcgcttccgttcttccggtcggcggcatggaggacgcagcagcaaggcggatggagaggctcgcctcccacctccgcccgcccgcttctcagatggaggaatcacccctcctgaggggctccaattcccgggcaaaaggtgccgctccgggtttcaaggtcgccatcttgggagcgtctggtgggattggccagcctcttgcattgctcatgaagataaaccctcttgtttctgtgctccatctgtacgatgttgtcaacactcccggtgtcacagctgacattagccacatgaacactggtgctgtggtgcgtggtttcttgggccagccacagttggaaaatgcccttactggaatggatcttgtgatcattcctgctggtgttcctcgtaagcctgggatgacaagggatgatttgttcaacatcaatgccggaatcgtccggactctttgtgaaggaattgcaaaatgctgccccaatgcaattgtgaatgtgatcagcaaccctgtcaattctactgttccgattgctgctgaggtttttaagaaagctgggacatatgaccctaagcgccttttgggtgtgacgacacttgatgtagtgagagccaatacttttgtggcagaagttcttgggcttgatcccagagatgtaaatgttcctgtcattggtgggcatg

SEQ ID NO: 1826 - DNA, 617 bp, Artificial
  Synthetic
atcttcaaaaatgttccgaacccgagttaccggctccaccctgcgatccttctccacctccgctgcccgacagcacaaggttgtcgtccttggcgccaacggaggcattggccagcccctgtctctgctgctcaagctcaacaagaacgtgaccgacctcggtctgtacgatctgcgaggcgcccccggcgttgctgccgatgtctcccacatccccaccaactccaccgtggccggctactctcccgacaacaacggcattgccgaggccctcaagggcgccaagctggtgctgatccccgccggtgtcccccgaaagcccggcatgacccgagacgatctgttcaacaccaacgcctccattgtgcgagacctggccaaggccgtcggtgagcacgcccccgacgcctttgtcggagtcattgctaaccccgtcaactccaccgtccccattgtcgccgaggtgctcaagtccaagggcaagtacgaccccaagaagctcttcggtgtcaccaccctcgacgtcatccgagccgagcgattcgtctcccagctcgagcacaccaaccccaccaaggagtacttccccgttgttggcggccactccggtgtcacca

SEQ ID NO: 1827 - DNA, 674 bp, Artificial
  Synthetic
  misc_feature (233)..(233): The residue at this position can be any nucleotide.
acgcgtcggtccctactgggggagggtatcgcctaatagacgttcccatgagcaactgcatcaacagtgggatcaacaaaatcttcatcctcacacagttcaactccacctccctcaaccgccatcttgccaacacctacaattttggcaacggtgtcaattttggaaatggattcgtcgaggccttgtctgcaactcagacaccggggaaggacggaaagaactggttccangggactgcggatgctgtcagacagttcacatggctcttcgaggagaacaagaataaagacctcgagcacgtgctaattctttccggagatcacctctatcgcatggattacatggatttcattcagaaacatcaggaaaccggcgccgacataaccatctcctgtgtccccattgatgaaagccgagcatccgactatggcctgatgaagatcgataacacaggccaaattctctacttcaaggagaagccaaagggggctgatttaaaggcaatgcaagtggacacatcttcattggggctttcaccagaagaggcacgtgcaaagccatatatagcttcaatgggcatttatgttttcaggaaggatgttctactgaatcttctcaggtcgaaattccctacctcaaatgattttggatcagaaattataccggcagca

SEQ ID NO: 1828 - DNA, 646 bp, Artificial
  Synthetic
gaattcacatccggtggaagaagaagaattccgtgggttgtttctcccaaagctgtttctgattccaagaattcacaaacttgtcttgatccagatgctagcagaagtgttttgggaattatacttgggggtggagctgggacacggttataccctcttacaaagaagagagcaaagcctgctgttccactgggagcaaattacaggctgattgatatccctgttagcaactgcttgaacagtaacatatcgaaaatatatgttcttacgcaattcaattctgcctcgctgaatcgtcatctttctcgggcatatgctagtaacatgggtggatataaaaatgaaggttttgttgaagtccttgctgctcagcagagtccagagaatccgaattggtttcaaggcacagctgatgctgtgaggcagtatttatggttgtttgaggaacacaatgttatggagtaccttattctagctggtgaccatctataccgtatggattatgaaaaatttatccaagcacacagagagactgacgccgatattactgttgctgcactcccgatggatgaaaaacgtgcaaccgcgtttggtctcatgaagatcgatgaggagggacggattattgaatttgctgaaaaaccaa

SEQ ID NO: 1829 - DNA, 599 bp, Artificial
  Synthetic
gaattccattacggtatctctacttgtgcgtgcattaaaaaatggcattgttttcggccgatggtcggatttgtttctcagctgccgctggtaacttacgcggcaacacagggctggctgggaacaagctgtgcagcaatggaggagagctgatgggagtgaagctaatgaagttgaataaccagagagtacctcttaactctaaaacttccaagtcttttgcttgcaaggctgtggctactaacaatgtagttggtgagagtaagttgagagacttggaccaggaaaaaaggaatcccaagactgtcgtagccattgttttgggtggaggtgctggtactcgtctattccctcttaccaagcgcagagccaaacccgcagtgccaattggaggtgcctacaggctcattgatgtgccaatgagcaattgtataaacagtggaatcaacaaagtttacattctcacgcaatacaactctgcttcacttaatcgacatcttgctcgtgcgtataactttggtaacggtagttttggagatggttttgttgaggctcttgcagccacccagactcctggtgaatcagggaataagtggttt

SEQ ID NO: 1830 - DNA, 540 bp, Artificial
  Synthetic
aaagtttgaaacttgagaagaaggaaagcaagatcaaacctggggttgctttctctgttatcactactgacaatggcaaagagactctgactgtggaggctccacgttttgacagacgacgggcaaaaccaaagaatgtagcttcagtcatactaggaggaggtgctggaaccaagttattcccgctgacaagtagagctgccacccctgctgtaccggttgggggatgctacaggctaatagacatcccaatgagcaactgtatcaacagcggtattaacaagatatttgtgctgacccagtacaattctgctcccttgaatcgtcacattgctcgaacatattttggcaatggtgtgagctttggagatggatttgttgaggtgttggctgcaactcagacacctggggaaacagggaaaaaatggtttcaaggaactgcagatgctgttagacaatttatatgggttttttgaggaggccaagaacaaagatgtcgataatatccttatattatcaggagatcatctttataggatg

SEQ ID NO: 1831 - DNA, 738 bp, Artificial
  Synthetic
agaaatagctgagtagagcagagcagaacatatccatggcttctattggagccttaaaatcttcgccttctccccaaaattgcattaatgagagaaaaaatgacgctactcgtgcaatgtcctttcgaaacctttccttttcatcgtctcatctctctggagacaagctaatgtctatggcaaccttacattctcagcagcgccattccagcgagaggaggagtccactgatcgtgtcgcctaaggctgtttctgattcacagaattcgcagacatgtctcgatcctgatgctagccgaagtgttttgggaattattcttggaggtggagctgggacccgactttatcctctaactaaaaaaagagcaaagccagcagttcctcttggagcaaattatcgtctgattgacattcctgtaagcaattgcttgaacagtaacatatccaagatctatgttctcacacaattcaactccgcgtctctgaatcgtcacctttcacgggcatatgctagcaacatggggggatacaaaaatgagggttttgtggaagttcttgctgctcaacaaagtccagagaaccccaattggttccagggaactgctgatgctgtcaggcagtatctatggttgtttgaggagcataatgttcttgaattcctcgtacttgctggagatcatctatatcgaatggattacgaaaagttcattcaagcccacagagaaacagatgctgata

SEQ ID NO: 1832 - DNA, 721 bp, Artificial
  Synthetic
tctctctctctccgtttcgcgttgccgatcgcagtccttccgctatggctctccctggacagcaggtagctgattgcccaaactttaagctggtcattgtaggcgatggaggaacagggaagaccacattcgtgaaaaggcatttgacaggagagtttgagaagaaatatgaacctaccattggagttgaagttcatcctcttgatttcttcaccaactgcgggaagattcgattctattgctgggatacagctggtcaagaaaaattcggagggctccgagatggttactacattcatgggcagtgtgctatcataatgtttgatgtgacatcgcgattgacctataaaaatgtcccaacatggcatagggatctctgcagggtttgtgaaaacataccaattgtcctatgtggaaataaggtcgatgtgaagaacaggcaagtgaaagcaaagcaggttacattccataggaagaagaatctccagtactacgagatctcagccaaaagcaattacaattttgagaagccttacctataccttgcgaggaaattggcaggtgatcagaatctgcactttgtggaatctcctgctcttgcacctccggaagtgcaaatcgacctggcacaacagcaacagtatgaagctgaactggctgctgctgcagctcagccattgccagatgatgatgatgaggcttttgagtgacctttgagtga

SEQ ID NO: 1833 - DNA, 631 bp, Artificial
  Synthetic
  misc_feature (587)..(587): The residue at this position can be any nucleotide.
agcaatagcaatagtgataatagtaatagtaataatcagttggccttcttttcttccatctgcaagatcatttctgttcttctcctcgttgttgctcaattcgattcccctcgtttttgttttgcgatggctcttcctggtcaacagcaggtggactgtccaagctttaagcttgtaattgtgggtgatggcggaacaggcaagacaacttttgtgaagcgacatttgacaggggagtttgagaagaaatatgaacccacaattggagtggaagttcatcctcttgatttcttcacaaactgtgggaaagtccgctattattgttgggacactgcagggcaggagaaatttggtggacttcgggatggctactatatacatgggcaatgcgcaattatcatgttcgacgtgacgtcccgtttgacgtacaaaaatgtcccaacgtggcatcgggatctttgcagggtgtgtgagaacatccccgtcgttctttgcgggaacaaggtggatgtcaagaacaggcaagtgaaggcgaagcaggtcactttccacaggaagaaaaacctgcagtactacgagatctctgncaaaagcaactacaatttcgagaagcattcctttatctcgcaag

SEQ ID NO: 1834 - DNA, 675 bp, Artificial
  Synthetic
ggcccccattcctcccccaccccggtgtcctcccctccgccgctcgcgtcgccgcctttttcccctatggcgctgccgaatcaggggaccgtggattaccccagcttcaagctggtcatcgtcggcgatggcgggactggtaaaactacatttgtgaagaggcatctcactggagagtttgaaaagaaatatgagccaaccattggtgtcgaagttcaccctctagattttaccaccaactgtggtaagatccgcttctactgctgggacactgctggacaagagaagtttggtggacttagggatggatactatatccatggtcaatgtgcgataattatgtttgatgtcacttcaaggctgacttacaagaatgttccaacatggcatagggacttgtgcagggtgtgtgaaaacatccccattgtcctgtgtggtaacaaggttgatgtgaagaacaggcaggttaaagccaagcaggtcacattccacaggaagaagaatctccagtactatgaaatttctgccaagagcaactacaactttgagaagcccttcctttatcttgcaaggaagcttgctggtgacccgaacctgcatttcgttgaagctgttgctcttaaacctccggaagttcccattgagctggcaatgcagcaacagcatgaggctgag

SEQ ID NO: 1835 - DNA, 726 bp, Artificial
  Synthetic
ggaccccgcctgtttacatcacctcacgctcgtcgctaatcactcgagccgtcaatatggctgagcaacagactcctaccttcaagcttgtgcttgtcggcgatggtggtaccggcaagaccacctttgtcaagcgtcacttgactggtgaatttgagaagaagtacatggccaccctcggtgtcgaggttcacccccttggcttcaccaccaactacggtcagatccagttcgatgtgtgggataccgccggtcaggagaagtttggtggtctccgtgatggttactacatcaacggccagtgcggtatcatcatgttcgatgtgacatcccgtatcacatacaagaacgtccccaactggcatcgtgatcttgtccgcgtttgcgagaacatccccatcgtcctgtgcggtaacaaggttgatgtgaaggagcgaaaggttaaggccaagaccatcaccttccaccgaaagaagaacctccagtactacgacatctccgccaagtccaactacaacttcgagaagcccttcctgtggctggcccgcaagctggttggcaaccccgccctggagttcgttgctgcccccgccctggctcctcccaccgcccaggtcgacgaggctctcttggagcagtacaagaaggagatggacgaggccgccgccatgcctcttcctggtgagctgtctgacgatgatctgtaaacgaatcgcacgacggcga

SEQ ID NO: 1836 - DNA, 349 bp, Artificial
  Synthetic
ggccgactttggcgaggtcgtgacggagactctggatggctgtacacgccgattgaagcacactcctcacaagacgactgatgtccatcgccgccctgatgccaggtgtcacttgaacacatccaggttcttgtcctccccgttttctccccacttcttttgactaacacagaccaccttcgttaagcgacacgagaccggtgagttcgtgaaccgatacaacgccaccctcggagtggaggtgcaccccctcaacttcgccaccgactgcggaaacatccgattccacgtgtgggataccgctggacaggagaagttcggaggtctccgacacggctactacatcaac

SEQ ID NO: 1837 - DNA, 621 bp, Artificial
  Synthetic
aaaaccctagcttgctcgctctctctctctagaatcttactgctttttttcttctctttcaatatggctctccctaaccaacaaactgtagattatccaagcttcaagcttgtaattgtgggtgatggaggaactgggaaaacaacttttgtcaagaggcatcttactggcgaattcgagaagaaatatgaacccactattggtgtggaggttcatccattagacttcttcacaaattgcgggaaaattcgcttttattgctgggatactgctggacaagagaagtttggaggtctacgggatggttactacattcatggacaatgcgcaattatcatgtttgatgttacagcccgtctgacctacaagaatgttcctacatggcatcgagatctctgcagggtttgtgaaaacatccccattgttctttgtggaaacaaagttgatgtcaagaacaggcaggttaaggcaaagcaagttaccttccacaggaagaaaaatttgcaatattatgagatctcagcaaagagtaactacaacttcgagaagccttttctgtaccttgccagaaagcttgctggggatgctaatcttcactttgtggaatcacccgcacttgct

SEQ ID NO: 1838 - DNA, 593 bp, Artificial
  Synthetic
aattcgcggccgcctgacttcgcttctcctctcagatggctctacctaaccaacaaaccgtagattatcctagcttcaagctcgtcatcgttggtgatggaggcacagggaaaacgacctttgtgaagagacatcttactggggagtttgagaagaagtatgaacctactattggtgtggaggttcatcctttggatttcttcacaaactgcggaaagatccgtttttactgctgggatactgctggacaagagaaatttggtggccttagggatggatactacatccatggtcaatgtgcgataataatgtttgacgtcacagcaaggctcacatacaagaatgttccgacatggcatcgtgatctttgcagggtgtgtgaaaacatcccgattgttctgtgtggaaacaaagtcgatgtgaagaacaggcaagtgaaggcaaagcaagtcacattccacaggaagaagaatctgcagtactatgagatatcagcaaagagcaactacaacttcgagaagcctttcttgtaccttgctaggaaactggctggagaccagaaccttcactttgtggagtcaccagctcttgct

SEQ ID NO: 1839 - DNA, 505 bp, Artificial
  Synthetic
tgaagttcatcctcttgatttcttcaccaactgcgggaagattcgattctattgctgggatacagctggtcaagaaaaattcggagggctccgagatggttactacattcatgggcagtgtgctatcataatgtttgatgtgacatcgcgattgacctataaaaatgtcccaacatggcatagggatctctgcagggtttgtgaaaacataccaattgtcctatgtggaaatacggtcgatgtgaagaacaggcaagtgaaagcaaagcaggttacattccataggaagaagaatctccagtactacgagatctcagccaaaagcaattacaattttgagaagccttacctataccttgcgaggaaattggcaggtgatcagaatctgcactttgtggaatctcctgctcttgcacctccggaagtgcaaatcgacctggcacaacagcaacagtatgaagctgaactggctgctgctgcagctcagccattgccagatgatgat

SEQ ID NO: 1840 - DNA, 606 bp, Artificial
  Synthetic
gaattcatttcttctcctacgtgcttcagctggcaaactttcaccattctgttcatgattgggcaccaaaatgaatcgattttcttggtttctttctcctacatcttgtgtttgattttgaatagtatttccattcataggagaaactcgtccttccctttctgatctagcatttgatcttgtgatactctgtgatcttctgttctgtaacatctcattttccatcctcaactcatgattctccctggtaagatttgcacgtgcttccgcttccaaccttcgttcttcttgaaaattctgtctttgtgcttgcagtgtctctatttctctgttgcgagttattcttcccaacaatctcccattttcatctatctgtacttatttttcctctcttgaaggtgaatctgatctccaggtgtgtatacttactcgatcatactccatctcttctcttggtattaattcttgttcacctgactgtcgagtttgtttcctttgactgtttcttcttttactagtttctccaatctcattcacctcttctcctgcgagtcttgcactccttcttactgcagttgatggttctgttagatttcctcttcttgt

SEQ ID NO: 1841 - DNA, 664 bp, Artificial
  Synthetic
gaattcaagggactttactgatcgagccaaagcctcaggaaccaactaagcaccagtatgactgggatgcggcaactacagctgcatttctactaaaatatggactttctggtgaattcaaactcaacattgagtgcaaccatgctacactttctggtcacagctgccaccatgagcttgagaccgccagaaattttgggatgcttggaaacattgatgcaaacactggagatcctcagattggatgggatactgatcagttccttactgacattggagaagcaactctggttatgctcagcgttgtcaggaatggaggactagcaccaggaggattcaacttcgacgcaaaattacgacgagagagtaccgatgtcgaagacttgttcatcgctcatatctcaggaatggatacattggcccgcggacttcgaaatgttgccaagctgcttgaggacggatcactaactgagcttgttcgtaaacggtatgagagcttcgacacagaaattggtgcccagatagaggctggaaaggctgattttgaagcacttgagaagaaggcaatggaatggggagaaccaaaggttggctctgcaaaacaggaattggctgaaatgcttttccaatcaccactatagaaagtagcttatgttgagtacag

SEQ ID NO: 1842 - DNA, 686 bp, Artificial
  Synthetic
gaattcaacatcaaagtttctctctttctacaaacgagggcattgctacatatataaaatgaagattgaggatattattttgggtttggtgtgcttaaaatgtgatcacacttgcagttattgctagtagtccccctacttgtcctgctgatcttggaaaggaatgtgccagtgatggtgaatggaagggggaattcttccctggcattcctgaaatcaagtatgagggtccttccagcaagaacccactttcgtttaaatggtacaatgcggaggaagagattcttggaaagaaaatgaaggattggatgagatttagtgttgccttttggcacactttccgtggaactggaggagacccttttggtgcacctaccaaggtctggccatgggaagacggtactaattcattggcaatggccaaaagaagaatgagagcaaactttgaatttattcggaagcttggtgtagatttatggtgctttcatgatagggacattgccccagatggaaaaaccttggaggagtccaatgcgaatttggatgaagtggtcgctttggcaaaagagcttcagggaaacaaaatccatcctttgtggggcacaaatgagttgttcatgcatcctcgctacatgcatggtgctgctactagctccgatgtaggtgtctatgcttatgccgcagcc

SEQ ID NO: 1843 - DNA, 598 bp, Artificial
  Synthetic
tttctctggctaagcaacttcaggaaggcacagacatcaggcctctctgggggactgcgcagctcttcaagcacccgagatacatgcatggagctgcgacaagtcccgacgctcgaatctatgcctatgccgctgctcaagtgaaaaaggctatggaggtgaccgaagagctcgggggagaaaattacgttttctggggtggccgggaaggatatcagtctcttttgaatactgatctcgataaggagctgaatcacacggcacagtttctaaaatccgctgcggagtggaaaaagaagattggtttcgacggagttctcctcattgaaccaaagccccaggaaccaacaaagcaccaatatgattgggatgctgcaactacaattggcttcctgctgaaatacggtctgaaagacgatttcaagcttaacattgaatgcaatcacgcaacactctctggacacagctgctatcacgagctggaagtagctcgaatcaacggggtcttgggaaacatcgatgcgaacactggcgatgctcagacaggctgggataccgaccagttcctcatggatattgcggaaaccacacaaatcat

SEQ ID NO: 1844 - DNA, 668 bp, Artificial
  Synthetic
tctctctctctctcctagcgcataaacgagatcaatggcggcactacaacaaactccgattgctttccagtccagatcacccccgacaactcaaatcatcagcggaccgacggcgaagctctccttttccggcggcctcaagctcccgaaactcaccatcaagctccgctgtaatcgcacctcgcgccgcggcggcggtgctgccggagcaaaaatggtggcttccgctgccggaagttacgcgaacgcactcgccgacgtagccaagtcgaacggaactctagaacaaaccgtcgccgacctcgaaaaaatcgaaaaaatcttcgacgacgaagcagtgtacaacttcttcgtgagccctatcgtcggcgaagagaagaaacgcgaactcgtggacgagatcgtttcatcctcgagcatccagccgcacgtggcgaatttcctgaacattttagtagacatgaagcgagtggagctaatcaaagaaattgtaaaagagttcgagaaagtatacaatacgattacggacacggaacttgctgtggtcacttctgttgtgaaattggaatcgcagcatttggcgcagatagcgaaaggagtgcagcgattgacaggttcgaaaaatgtgaggattaaaacggctattgatgaatcgctagtagctggat

SEQ ID NO: 1845 - DNA, 550 bp, Artificial
  Synthetic
aaggaagtgagtcgcagaagtatcaagcgatggagactgtgcggcaaaccctgtcttccctcaatgctcctagctccgctgccgtgtctccttcagctcgccagcccttgaccgcatcccgcctccgctcttcctcgaaaccgtgcgtcgtcgccgccactctccgtatccaaggattgcctacacggcgtcaaaccctaatgccgaagccttcctctggccaccgtatcgtgatgaaggaaagccctgctagaggctacgccggcgcccttgccgaagctggccaggctgggaagaacctagaagctatcgccactgacgtcaccaagttcgggtcttacctcaacgacccccagttctaccaattcatggttaaccctgtcatgtccgcggagaacaagaagaaggttatcgaggatgtgggtgccagtgccggattccagccgtttactgtcaacctcctgaacatcctcattgacagaaggagagctgatctcatgacggaggttgtcaaagaattcgaggctatctacaatgaaatgaccgaggt

SEQ ID NO: 1846 - DNA, 751 bp, Artificial
  Synthetic
tcgcgaggaagcagggcctcacgaagtactcacctgtggagagcaaaaagcttttaacccatccactaccctcctctctctctctctcttctctctctccttgcgcataaacgaaatcaatggccgcactacaacaaactccgacagctttacagtgcaggtcaccgccgccgactcaaatcatcaccggacctacggcgaagctctcattttccggcggcctcaagctcccgaaactcacaatcaagctccgctctaatcgcacctcccgccgcggaggcggtgctgccggagcaaaaatggtggcttccgctgccggaagttacgcgaacgcactcgccgacgtagccaagtcgaatggaaccctagaacaaaccaccgccgacctcgaaaaaatcgaaaaaatcttcgacgacgaagcagtgtacaacttcttcgtgagccctatcgtcggagaagagaagaaacgcgaactcgtggacgagatcgtttcatcctcgagcatccagccgcacgtggcgaatttcctcaacattctggtagacatgaagcgcgtggagctaatcaaagaaatcgtgaaggagttcgagaaagtctacaatacacttacggacacggaacttgctgtggtcacttctgttgtgaaattggaatcgcagcatttggcgcagatagcgaaaggagtgcagcgattgacaggttcgaaaaacgtgagaattaaaacggctatcgatgaatcgctagtagctgg

SEQ ID NO: 1847 - DNA, 529 bp, Artificial
  Synthetic
ccgagcgcaaagccaagccaagccaagccgcactcctcgagtccaccactccgccgcgcaccactccccacctcccgacgagatggccaccctccgcctcacctccgtcaccctccgccccgccgcctccccctcgtccgccgccgcgccgcggtccgccaacttcgcccgcgccgcggcgcgcgggttcccctcgctccgcctcgcgccgccgcgccgccgcggggacctcgccaggcgcagggccgccgccgacgccgcggcggaggggtacgcgacggcgctgtccgaggtggcctcggagaacggcacgctcgaggcgaccgtgtcggacctggagaagctggagaagatcttcgcggaggaggccatcgccgagttcttcgacaacccgacggtgccgcgcgacgagaaggcccagctcatcgacgagatcgccaagtcgtcggagctccaggcgcacgtcgtcaacttcctcaacgtcgtggtggacaacggccgcgcgggcctcatgacgcagatcgtgcgg

SEQ ID NO: 1848 - DNA, 723 bp, Artificial
  Synthetic
gaattcaaggaactgctgctgctgaagcaatggcgatgtgtaataatatccagaaagggaagaaaaagacttttattattgctagtaattgtcatccacagacaattgatatttgcaagactagagctgatgggttcgatttgaaagtcgttacttcggatcttaaggatatcgattattcgtctggtgatgtgtgtggggttttagttcagtatcctggtactgaaggtgaggttttggattatggagagtttgtgaagaaggcacaatcagcaaactcaaatggaacattagaagcaacacaacaagacattgaaaagattgaaaaaatcttcacatcaccagaagtttatgatttctttgtcaatccaacagttgctgtggagaagaaatactcattgatcgatgaaattgcaaaatcatcaaacctcaaaacaactacaatcaatttcttgaatatcttagttgatgtcaagagaattgatttgattagagaagttgtgaaggaatttgagttggtttttaatgcaatgactgatactgaattggctgttgttacatctgttgtgaagctggaagctaatcatttagcacagattgctaaaggagtccagagattgacaaattctaagaatgttaggattaagactgtgattgatccttctcttgttgctgggtttacaatcaggtatgggaattctgggtctaaattgattgatatga

SEQ ID NO: 1849 - DNA, 649 bp, Artificial
  Synthetic
gaattcaagcaatgacggtatctggggaacaacaggtggaaacggctgctaataccccgtaggctgaggagcaaaaggaagacattgtcaggtggggagtttggctggggcggcacatctgttaaaagataacgcaggtgtcctaagatgagctcaacgagaacagaaatctcgtgtggaacaaaagggtaaaagctcgtttgaaagagttaactgcatgcaggtatggccaccaagtggtttgaagaagtttgagaccctctcataccttcctccattgaccgtcgagcaactatcaaaggaagttgactaccttctccgtaatggctgggttccctgtttggaattcgacgccagaggattcgtctacagagaacacggtaacacccctggatactacgatggtcgttactggacaatgtggaagctacccatgttcggttgtaccgatgcttcccaggttatcaaggagctagaagaggccaaggctgcataccctgactctttcatcagaatcatcggattcgacaacgttcgtcaagtccaatgtgttagtttcattgcatacaagccctgagagttcagcctactggagatgtttaatttgatggattagtagcggtgcacagagcaaaatcctatccatata

SEQ ID NO: 1850 - DNA, 587 bp, Artificial
  Synthetic
gcccctgaacagacttccccacctgacaatgtcttccgcccggatcggcccgagggactcgggccttagagccaaaaggaggggccaggccccgcttccgactcacggaataagtaaaataacgttaaaagtagtggtatttcacttgcgcccgagggctcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcagcatccgcgaggaccatcgcaatgctttgttttaattaaacagtcggattccccttgtccgtaccagttctgagtcggctgttcgacgcccggggaaggcccccgagggggccgttcccggtccgtcccccggcc

SEQ ID NO: 1851 - DNA, 689 bp, Artificial
  Synthetic
aacaaagcattgcgatggtccctgcggatgctaacgcggtgtgatttctgcccagtgctctgaatgccaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagccgtctttggcggcgaaggtgaaataccactacttttaacgttattttacttattccgtgaggcggaagcggggcatcgcccctctttttagatccaaggctagcttgctatgccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgctcaagctagcatggttgcaccattcagcggcttgaaatccgtctctgcattcccagttacccgcaaatcaaacgacatcacct

SEQ ID NO: 1852 - DNA, 524 bp, Artificial
  Synthetic
gaattcaagaagaccctgttgagcttgactctattccgactttgtgaaatgacttgagaggtgtaggataagtgggagccgtctttggcggcgaaggtgaaataccactacttttaacgttattttacttattccgtgaggcggaagcggggcatcgcccctctttttagatccaaggctagcttgctatgccgatccgggcggaagacattgtcaggtggggagtttggctggggcggcacatctgttaaaagataacgcaggtgtcctaagatgagctcaacgagaacagaaatctcgtgtggaacaaaagggtaaaagctcaagctagcatggttgcaccattcagcggcttgaaatccgttgctgcattcccagttacccgaaaatcaaacgacatcacctccgttgccagcaatggtggaagagttaactgcatgcaggtatggccaccaagtggtttgaagaagtttgagaccctctcataccttcctccattgaccgtcgagcaactatcaaaggaa

SEQ ID NO: 1853 - DNA, 195 bp, Artificial
  Synthetic
gaattccagctgaccaccatggatataaactcaaatgcctcgtcatcgaattagtgacgcgcatgaatggattaacgagattcccactgtccctatctactatctagcgaaaccacagccaagggaacgggcttggcagaatcagcggggaaagaagactgaacaaactacttaacatggcaattcccggggatc

SEQ ID NO: 1854 - DNA, 693 bp, Artificial
  Synthetic
aattcggcaccagagctgttcccgcggcgagagcgggtcgccgcgtgccggccgggggacggactgggaacggctccttcgggggccttccccgggcgtcgaacagccaactcagaactggtacggacaaggggaatccgactgtttaattaaaacaaagcattgcgatggtccctgcggatgctaacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagcttcggcgcaagtgaaataccactacttttaacgttattttacttactccgtgaatcggaggcggggtacaacccctgtttttggtcccaaggctcgcttcggcgggtcgatccgggcggaggacattgtcaggtggggagtttggctggggcggcacatctgttaaaagataacgcaggtgtcctaagatgagctcaacgagaacagaaatctc

SEQ ID NO: 1855 - DNA, 762 bp, Artificial
  Synthetic
gggttccacacgatatctctgtgctcgttgagctcatcttaggacacctgcgtgatctgttaacagatgtgccgccccagccaaactccccacctgacaatgtcctccgcccggatcgacccgccgaagcgagccttgggaccaaaaacaggggttgtaccccgcctccgattcacggagtaagtaaaataacgttaaaagtagtggtatttcacttgcgccgaagctcccacttatcctacacctctcaagtcatttcacaaagtcggactagagtcaagctcaacagggtcttctttccccgctgattctgccaagcccgttcccttggctgtggtttcgctggatagtagacagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgttagcatccgcagggaccatcgcaatgctttgttttaattaaacagtcggattccccttgtccgtaccagttctgagctgactgttcgacgcccggggaaagctcccgagagagccgttcccagtccgtcccccggccggcacgcggcgacccgctctcgccgcggaagcagctcgagcagtccgctgacagccgacgggttcggaactgggacccccgagcccagccctcagagcaaatccttt

SEQ ID NO: 1856 - DNA, 649 bp, Artificial
  Synthetic
gctaccattgctttaatcgggatcgcggaggcggaggaagaaagagtagcgacgatggatgcgaacggcgtggtggccgtgtacggcaacggcgccatagcggagcccaagaaggcgtcgtacgcggtcaaggtcggtctcgcccagatgctccgcggcggcgtcatcatggacgtggtcaacgccgagcaggcccgcatcgccgaggaggccggcgcggtggcggtcatggccctggagcgcgtcccggcggacatccgcgcccagggtggcgtcgcacggatgagcgacccgggcatgatcaaggacatcaagaaggcggtcaccattccggtcatggcaaaagcccgcattgggcattttgtcgaggggcaggtgctcgagtccatcggcgtcgacttcgtggacgagtccgaggtgctcacccccgccgacgacgccaaccacatcaacaagcacaacttccacgtcccgttcgtgtgcggctgccgcaacctgggcgaggcgctgcggcggatcaccgagggcgcggtcatgatccggacccaagggcgcacgcggcaccgggaacgtgatcgaggcggtgcgccacgtccggtcgctcatgggggacatccggcggctgcgcagcctggacgaggacgaggtg

SEQ ID NO: 1857 - DNA, 605 bp, Artificial
  Synthetic
acaacacacacacaacacaatgtctaccgtcgagaagtcttttgaggagcagttcaagctgcaggccggtctggcccagatgctcaagggtggcgtcatcatggacgttgtcaacgccgagcaggccaagattgcccaggaggccggagccgtggccgttatggcccttgagaagatccccgccgacattcgagccgacggaggagtcgcccgaatgtccgaccccgctatgatcaaggagatcatggctgccgtgtccatccccgttatggccaagtgccgaatcggtcactttgtcgaggcccagatcattgaggagattggtgtcgactacattgacgagtctgaggttctgacccccgctgaccagttccaccacatcaacaagcgagacttcaaggtccccttcgtttgcggtgccaagaacctgggtgaggctctccgacgaatccacgagggagctgccttcatccgaaccaagggtgaggccggtactggtgatgtcaccgaggccgtcaagcacatgcgaaccatccagtccgagatcaacaagacccgacacatgtctgagattgagctctacacctacgccaaggagattggtg

SEQ ID NO: 1858 - DNA, 624 bp, Artificial
  Synthetic
ttagtagtagacggccgccattcttcctcttcggttctatcgatcgatcgatccatcagccatggccgccgcaacagccgccgcatcgtcgcagctcctctcgccggcggcgtcgctgggctcggcggcgtcgccgtcgtcgtcgtcgtcgccttccggcaatcgcgccgggttcaggtcattggggaggcaatgcttcgcgggactcgtcgcggggcgccgggaggtgcggcggctgggggatttcgagcggcagcagccggatttcgcggcggcagtggcggcggcggtgaggtcgtcggggggcaatgggcgcggcagccgcggcgtggtgtgcatggccaagaagagtgtgggggatctcaaggaggcggacttgaaaggcaagcgtgtctttgtcaggcctgatctcaacgttccactggatgccgatctaaacatcaccgacgatacgaggattcgtgctgccgtgccgacgatccagtatctcattggcaatggggctaaggtcatcctcagcagccatctggggcgtcccaaaggagtgaccgagaagtatcgacttacacctcttgttggaaggctctcagagctcttgggaaccaaggttgagaaggctgacga

SEQ ID NO: 1859 - DNA, 614 bp, Artificial
  Synthetic
gtttattcagaatgtctcttaccaacaagctctcccatcaaggatctcgatctcaagaacaagcgagtcttcatccgagtcgactttaacgttcctctcgatggcaccaccatcaccaacaaccagcgaattgttgctgccctgccctccatcaagtatgccattgatcagggtgccaaggctgtgatccttgcttctcatctcggccggcccaacggccagcgagtcgagaagtactctctcaagcccgtccaggccgagctttcaaagctccttggcaagcccgtcaccttccttgacgactgcgtcggccccaaggttgaggaggaggtctccaaggccaaggacggtgaggtcattctcctcgagaacctgcgattccaccccgaggaggagggatcccacaaggacgccgacggcaagaagatcaaggctgaccccgccaaggttgaggagttccgaaagtctctgacttctctcgccgatgtctacgtcaacgacgctttcggaaccgcccaccgagcccactcctccatggtcggcattgagcttccccagcgagccgctggtttccttgtcgccaaggagctcgagttcttcgccaaggctctgga

SEQ ID NO: 1860 - DNA, 659 bp, Artificial
  Synthetic
gtgttcttcttctcgacaacgtgagattctacaaggaggaacagaagaatgaacctgagtttgcaaagaaacttgcatcattggcagatctttacgtaaacgatgcatttggtacagctcacagagcacatgcctctacagagggagttactaaatttttgaagccttctgttgcaggtttcctcttacaaaaggaattggactatttagtcggggcagtttcaaatccaaagaggccatttgctgctattgtgggtggttcaaaagtttcatccaagattggagtgatcgaatcacttttagagaaatgtgatatattgcttttgggtggaggaatgatctttaccttctacaaggctcagggtctttcagttggttcctccttggttgaggaagacaaactagaactcgctacatcactcctagagaaggccaaggagaaaggagtcagtctcttgttaccatctgatgttgtgattgcagataaatttgctcctgatgcaaacagcaagattgtgccgtcatctgctatcccagacggttggatggggttggacattggaccagactctgtcaagactttcaatgatgccttggataccacaaagacagtgatctggaatggacctatgggggtgtttgaatttgacaagtttgct

SEQ ID NO: 1861 - DNA, 676 bp, Artificial
  Synthetic
cttcactctgtcttcacactctctgcttttgccgtaggacagaatcgtcgagtttagtgacgaagactgtaatcaatggcatcagctacagcttctcacactttgtgcggcatccccgccacctcatcctctactaccaacaagtctattgccccttcatctgctcgcttcctctctaaaactcctccccgcggcctcggcttcgctggcgccgccgctgattctctcttcaccaaccacgtggcaaccaagctccgatccctcaagagctcctccaagcctgttaggggcgttgcttctatggccaagaaaagcgtcggagacctcaccgctgccgagttgaagggcaagaaagtcttcgtcagggccgatttgaatgtcccacttgatgatagccagaacattactgatgacactagaattagagctgccgtccctactatcaagcacttgatggccaatggtgctaaagttattctctccactcacttgggacggccaaaaggagtcactcctaaatacagcttggcacccctagtccccaggctatccgaactgcttggaatccaggttgtgaaggctgaggactgcattggtccggaagtcgagaagttggttgcttcacttcccgagggtggtgttcttcttctcgagaacgtgagattctacaaggagg

SEQ ID NO: 1862 - DNA, 766 bp, Artificial
  Synthetic
gccatccccaccatccagtaccttatcaagaacggtgccaaggtcatcctctccagccacctgggtcgcccaaagggtgttactcccaagtttagcttggctccccttgtaccgcgattgtctgaacttctcggcatacaggtgactaaggcagaagatgttattggaccagatgttgagaaattggtatctgaattgccaaatggtagtgttttgctccttgaaaatgttagattttacaaggaagaggagaagaatgacccagagtttgccaagaagcttgcctccttagcagatctctatgtcaatgatgcattcggaacagcccacagagcacatgcatcaactgagggagttaccaagtttttaaagccttctgtcgcagggttccttttgcagaaggagcttgactaccttgttggagctgtttcaagccctaaacgcccatttgctgccatcgtgggtggttcaaaggtgtcatccaagattggggttatcgaatcccttttggagaaatgtgatatccttcttttaggtggtggtatgatcttcacattttacaaggcacaaggactctctgttggttcttccttggttgaggaagacaaacttgagcttgcaacatctctccttgcaaaggcaaaagaaaagggtgtctcccttctgttgccatctgacgttatcattgctgataagtttgctcctgatgctaacagccaggttgttccagcatctgctattcctgatggttggatgggtctggata

SEQ ID NO: 1863 - DNA, 1107 bp, Artificial
  Synthetic
aacgaatatcacatcatttgagttttccattctcacgaaatggcggtgaagaagagtgtgggatcactgaaagaagcagatctgaaagggaggagagtattcgtgagagttgatctgaatgttccattggatgacagcttcaatattactgatgacaccagaatccgagctgctgttcctaccattaagtatttgatgcaacatggatctcatgttattcttgcctctcatcttggtcgtccaaaaggtgtcactccaaaatacagcttgaagccacttgtaccaagactgtcagagctattgggacttgaggtcaagatggcagatgattgcattggtccagaagttgagaagttggttgtcgaaataccagaaggaggagttctgctgctggaaaatgtgagattctataaagaagaggagaagaatgagcccgagtttgcaaagaagctggcgtctcttgcagatttgtatgtcaatgatgcctttgggactgcacacagagcacatgcttccacagaaggggttgctaagtacttgaaaccggcagttgctggattccttatgcaaaaggaacttgactatcttgtcggagctgtatcaaatccacagaagccatttgctgccattgttggtggttcaaaggtttcaagtaagattggcgtgatagagtcacttttggagaaggttaacgtgttattgcttggtggaggtatgatctttactttctacaaggcccaaggatactctgttggatcctcacttgtagaggaggacaagcttgatctagcaacatcacttattgaaaaggcaaaggcaaaaggtgtatctctgttgcttcctgctgatgtagtgatagcagacaagtttgctgctgatgccaacagcaagattgttccagcatctgaaattccttggctggatggggttagatattggacctgatgctatcaagtcttttggcgaagctttggatgccaccaaaactatcatatggaatggacctatgggagtatttgagtttgaaaaatttgctgctggaacagaggctattgcaaaaaaactggcagagcttagtggaaaaggagtaacaacaatcataggggg

SEQ ID NO: 1864 - DNA, 615 bp, Artificial
  Synthetic
gaattcagcactacaagatggaggtgttctatggcttgaaaatctgaggatgcacaacgaggaaactgagaacagccttgagtttgctaagaagttagcttccctggctgacctgtatgttaatgatgcatttcaaagtactatgtttgcacatgcttccacggttggagtccctaatatcttaaagcctgctgtggctggactcacaatggagaaggaactcaactatctttgcggagctgtcttacatcctaagaggccatttgctgccattgtttctggctctaagctgtcatccaacagaagtcttattgaggccttgttggataaagttgatatcctcgttttaggtggagaaatgatattcacgatttacagggcccaaggccgcagtgttgggtcatgcctcgttgaggaacacatgtttggctttgcattgtcaatccttaagaaggctctagataataaagtcgaacttgtcttacccaaggatgctgttattagtaaaatagattctcctggcactgaagacaagcatgtagcacttgctggtatctcaaagggttggagggcagtggacatcggtcccttgaccatctttatgtacaattcatc

SEQ ID NO: 1865 - DNA, 1258 bp, Artificial
  Synthetic
gaattcagaaaacaaaaacaacaatggcttcaacagcttcacacactactctatctctactcagaacaacagcatcatcttcatctgctcgcaacaaccgtgtatcatcaacattacaagttgcagcagcatctcgattaagaaacatcggattacaagttagaaacccaaaaagtcttgggttttctggtgttgcagtagatcctcttctttcatcacacgtttcttcacaaattggagctgttagtggtaaaggggtgagaggtgttgtttcaatggctaagaaaagtgttggggatttgagtgcatctgaattgaaaggtaaaagggtttttgttagggctgatttgaatgtcccgttggatgacaatcagaacattactgatgatactagaatccgtgctgctattccaactatcaaacatttgatggccaatggtgctaaagtcattcttaccagtcatttgggaagaccaaagggtgttactccaaaattcagcttggcccctcttgtccctaggctctccgagcttcttggcatcactgttgagaaagctgatgattgtattggccctgacgttgagaaattggttgctgcactaccagaaggtggtgttctccttcttgaaaatgtgagattctacaaagaggaagagaagaacgaaccagaattcgcaaagaaacttgcttccctcgcagacctatatgtcaacgatgcctttggaacagcacacagagctcatgcttcaactgagggagttaccaaatacttaaagccatctgttgctggtttcctcttgcagaaggaactggactatcttgttggggcagtttcatccccaaagagaccatttgctgccatcgttggtggttccaaggtgtcatctaagattggtgtgattgagtcgttgctagagaagtgtgatattctacttttgggtggaggtatgatcttcacattctacaaggcacaggggctatcagtaggttcttctcttgtggaggaagacaagcttgaacttgcaacctccctccttgagaaggccaaggcaaagggtgtgtcacttttgttacccagtgacgtagttattgccgataaatttgctgctgatgcaaacagcaagattgtacccgcatctgagatcccagatggttggatgggattggatattggcccagattctatcaagacattcaatgatgccttggacaccaccaagaccgttatctggaatggacctatgggagtttttgaaat

SEQ ID NO: 1866 - DNA, 584 bp, Artificial
  Synthetic
agcagcgcgactcctgtttcgctctactcgccaatttcccgccaaaatgtctctctccagcaagctgtccatcactgacgtcgacgtcaagggcaagagggtcctgatccgggttgacttcaacgtccccctcgacgagaacaagaagatcaccaacaaccagcgcattgtcggtgccattcccaccatcaagcacgctctcgacaatggggccaagtccgtcatcctgatgtcccaccttggacgccccaatggtgccgtcaacgcaaagtactccctccagcccgttgttcccgagctcgagcgcctcctgggcaagtccgtcacctttgcccccgactgcgtcggccccgaggtcgaggccatcgtcaacggtgccgacaacggtgccgtcatcctgctggagaacctccgattccacattgaggaggagggcagcgccaaggacaaggagggcaacaagaccaaggctgacaaggccaaggttgaggagttccgcaagggcctgaccgctctgggtgacatttacgtcaacgatgctttcggcactgcccaccgtgctcattcttccatggttggcgttg

SEQ ID NO: 1867 - DNA, 896 bp, Artificial
  Synthetic
tgctcatgtcattcttgcctctcatcttggtcgccctaaaggtgttactccaaagtacagcttaaagccgcttgtgcctagactatcagaactattgggagttgaggtcaagatagcaaatgattcaattggtccagaagttgagaaattggtcgctgaaataccagaaggaggagttctgttgctggagaatgtcagattctataaagaagaggagaagaatgagcccgaatttgccaagaaattggcatctcttgcagatttgtacgtcaatgatgcatttgggactgctcatagagcccatgcttccacagaaggggtggctaagtacttgaaaccagctgttgcgggatttcttatgcaaaaggaacttgactatttagtaggagctgtggcaaatccccagaagccatttgctgccattgttggtggttcaaaagtatcatctaagattggtgttatagagtctctcttggagaaggttgacgtgttattacttggcggaggaatgatctttactttctacaaggcgcaagggtacgctgttggatcatcactagtggaggaggacaagcttgatttggcaacatctctcatggagaaggcaaaggcaaaaggggtatctctattgcttcccactgatgtagtgattgccgacaagtttgctgctgatgcgaacagtaaggttgttccagcatctgaaattcctgatggctggatgggattggatatcggacctgatgcaatcaagtcatttggcagcgccttggataccaccaagactgtcatttggaatggaccaatgggtgtgtttgagtttgacaagtttgctgctggaacagaggctattgcaaagaaactggcagagcttagtggaaagggagtgacaaccatca

SEQ ID NO: 1868 - DNA, 600 bp, Artificial
  Synthetic
ttcgaggggttaaggtttgtcttttcacagccaattacttgagaatggccaacccacatgtcttctttgacatggccatcggcggcgtcagcgctggtcgcattgtgatggagctgtacagtgacacaaccccaaggactgcggagaatttccgggccctgtgcacgggggagaagggcactgggagcagcgggaagcccctccacttcaagggctcctctttccacagggtcatccccaacttcatgtgccagggtggcgacttcacccgtggcaatgggactggtggggagtccatctatggcactaagtttgccgatgagaacttctccaggaagcacacaggtgagggtgtcctctccatggccaactctgggcccaacaccaatgggtcccagtttttcatctgcactgtcccctgcaactggctcgacgggaagcatgttgtgtttggccgtgttgtcaatgggatggacgtagtgaagaccattgagaaggttggttcgagctctggaaagaccagcaagcctgttgtagtagctgactgtggtcagctctaagcactagttagtaatattgatgataaagcttaataaagtt

SEQ ID NO: 1869 - DNA, 693 bp, Artificial
  Synthetic
  misc_feature (568)..(568): The residue at this position can be any nucleotide.
gaagaacatagcagaaatttctgaaattttttaattttatttagaggagatgggtagagcgatctcagttttattgcagccacggtggcttctgatctttcttgctgttttagttcttatctttcttgcttcctccttctcccaaaaggaatatgaaaaggtggaagaggtgtatgatattacccacagagtattcttggatgttgatatagataaacaacgtgtaggaagaattgtgattggattatatgggcaagttgtaccaaaaactgttgagaatttcagggctttgtgcacaggggaaatgggcaagaccgctgatggaatatctcttcactacaagggaaagccatttcatcgtgtaatacctggattcatgattcaaggtggagatattgtgtcgggtgatggaaggggaaacatttccatttatggtggtacctttcgtgacgagaatttgaagataaagcattctcatgcaggtgttatttccatggtgaacacaggacccaactccaacggctgtcagttctttataccgacagtgaaggctagctggttggacggngagcatgttgtatttggcaaagttattgaaggtatggacacggtatatgcaatagaggggggagcaggaacgtacagtggaaaaccgagaaaaaggttattattgcagactctggggaaatacct

SEQ ID NO: 1870 - DNA, 544 bp, Artificial
  Synthetic
ccccctgaggccacgcagcgatctggagtgaaacagcaaaaaaaatcaaacaaaaagaaaaaaaattccccatctgtgaaattcgcaaaaccctagcgcggcggcgatgtcgaacacgagggtgttcttcgacatgaccgtcggcggagctccggcggggcggatcgtgatggagctgtacgcgaaggacgtgccgcggacggcggagaacttccgcgcgctctgcaccggcgagaagggcgtgggcaagagcggcaagccgctgcactacaaggggagcaccttccaccgcgtgatcccggagttcatgtgccagggcggcgacttcacccgcggcaacggcacgggaggggagtcgatctacggcgagaagttcgccgacgaggtgttcaagttcaagcacgacagccccggcatcctgtccatggcgaacgccgggcccaacactaacgggtcccagttcttcatctgcaccgtgccctgcagctggctggacgggaagcacgtcgtgttcggccgcgtcgtcgagggcatggacgtcgtc

SEQ ID NO: 1871 - DNA, 694 bp, Artificial
  Synthetic
agccattcgtcatgttgagcttccggcggctctttaccaccgccatcttgttggtggtgggattgctcttcttcgtcaagtcggccgaggctgccaagggccccaagatcacccacaaggtctactttgacattgagcacggcgacgagaagctgggccgaattgtcatgggtctgtatggaaagactgtccccgagaccgctgagaacttccgcgctcttgccactggcgagaagggcttcggctatgagggctctaccttccaccgtgttatcaagcagttcatgatccagggtggtgactttaccaagggcgacggcaccggtggcaagtcgatctacggcaacaagttcaaggatgagaacttcaagctgaagcacaccaagaagggtatcctgtccatggccaacgccggacctgacaccaacggctcccaattcttcatcaccactgttatcacctcatggctcgacggccgccacgtcgttttcggcgaagtcctcgagggttacgacattgtcgagaagattgaaaacgtcccgaccgccgccggtgaccgcccagtgaagactgtcaagatcgccaagagtggcgagctggaggtccctcccgaaggtattcacgtcgagctctaaatttatcttacatgattcagagccctccggcacggctatcgcacccggagccgttggtg

SEQ ID NO: 1872 - DNA, 669 bp, Artificial
  Synthetic
tgtgaagggaaatttgtggataagaagctgagaaaagacttcgagtggtgaactctaggtcctgatgtttaaatctactgtatttaccttcgcattaattaagcatgtcgaacacgagggtgttcttcgacatgaccgtcggcggagctccggcggggcggatcgtgatggagctgtacgcgaaggacgtgccgcggacggcggagaacttccgcgcgctctgcaccggcgagaagggcgtgggcaagagcggcaagccgctgcactacaaggggagcaccttccaccgcgtgatcccggagttcatgtgccagggcggcgacttcacccgcggcaacggcacgggaggggagtcgatctacggcgagaagttcgccgacgaggtgttcaagttcaagcacgacagccccggcatcctgtccatggcgaacgccgggcccaacactaacgggtcccagttcttcatctgcaccgtgccctgcagctggctggacgggaagcacgtcgtgttcggccgcgtcgtcgagggcatggacgtcgtcaaggccatcgagaaggtgggatcccgcggcgggagcaccgccaagccggtcgtcatcgccgactgcggccagctctccgcggccgcttatccgtatgatgttccggattatgccgagctctacaaac

SEQ ID NO: 1873 - DNA, 692 bp, Artificial
  Synthetic
ggcgggagagagatggagggaatgtggcgggcgctgctgttgctgctggcgctggtggtggcggggatctcgctctccgccgccgcgaagaagccggagaagaacctggaggagatcacgcacaaggtgttcttcgacgtggagatcggcggcaagccggcgggccgggtcgtgatggggctctacggcaatgcggtgcccaagacggcggagaatttccgggcgctgtgcacgggcgagaaggggactggatcccagggcaaggcgctccacttcaagggctcgtccttccaccggatcatccccagcttcatgatccagggcggggatttcacccacggcaacggcatgggcggggaatcgatctacggcgccaagttcgccgacgagaatttcaagctcaagcacaccggccccggggtcttgtccatggccaatgccggatccaacacgaacggatcccagttcttcatcaccaccgtcaagacgagctggctggacggcaagcacgtcgtgtttgggaaggtgatcagcggcatggacgtggtgtacaaggtcgaggcggaggggtcgcaaagtggctcacccaagtccaaggtcaccatagccgacagtggcgagcttccactatagtaattcttatttatattgtacccgttttcccccttgtttaattgaagagattgggtcca

SEQ ID NO: 1874 - DNA, 737 bp, Artificial
  Synthetic
cccacgcgtccgcttcttcagtcttttagagatctcacgtttcaaacaacaagaatggcgttccctaaggtatacttcgacatgaccatcgacggccagcccgcgggaaggatcgtgatggagctgtacaccgataagactcccaggactgccgagaatttcagagctctctgcaccggagagaaaggtgttggcggtaccggaaaaccccttcacttcaagggatctaagtttcaccgtgtgatccctaacttcatgtgccagggaggagatttcaccgccgggaacggaacaggcggtgagtcgatctacgggagcaagttcgaggacgagaatttcgagaggaagcacaccggaccggggatcctgtcgatggcgaacgccggtgcaaacacgaacggatctcagttcttcatctgcaccgtgaagaccgattggcttgatgggaagcacgtggtgtttgggcaggtcgtggaaggcttagacgtggtaaaggccatcgagaaggttggatcatcatctggaaagccgacgaagcctgtggttgttgccgattgtggtcagctctcttaggatcttcctatcatcatccttaatttagcatcatcgtcgtcattgtggtgtctctttatgcttttgcttttgttatggagtcgttttaaaatttgtagtcataagtttggtgtgtgttctcatgggaacatatataaacttgcccctttaatattaactccccc

SEQ ID NO: 1875 - DNA, 604 bp, Artificial
  Synthetic
gctccggtagtaaggtatggctaatcccagagtgttcttcgacatcaccatcggcggcaaccccgcggggcgcatcatcatggagctgtttgcggacactgtgcccaagacggcggagaacttccgggcgctgtgcaccggcgagaaaggaatcggcaagagcggcaagccgctgcactacaagggatccaagttccaccgcgtcatccccgactttatgtgccagggcggcgacttcaccgccggcaacggcaccggcggcgagtccatctacggcatgaagttcgcggacgagaacttccagaggaagcacgcggggccgggcgtcctgtccatggccaacgccggggccaacaccaacggatcccagttcttcctgtgcactgttccctgctcctggctcgacggcaagcatgtcgtcttcggcaacgtggttgaaggcatgaacgttgtcaaggacatcgagaaggtgggcagcccctcgggcaggacgagcaagcccgttgtcgttgccgactgcggccagctctcttagatctatgtgtttgtctgtcgctcccgttggggatggcgaggtttcgtttctccttcaaatcaatgaaaa

SEQ ID NO: 1876 - DNA, 663 bp, Artificial
  Synthetic
gtcttcttcagtttgccggagtcattttcccttcgaggggttaaggttgtcttttcacagccaattacttgagaatggccaacccacatgtcttctttgacatggccatcggcggcgtcagcgctggtcgcattgtgatggagctgtacagtgacacaaccccaaggactgcggagaatttccgggccctgtgcacgggggagaagggcactgggagcagcgggaagcccctccacttcaagggctcctctttccacagggtcatccccaacttcatgtgccagggtggcgacttcacccgtggcaatgggactggtggggagtccatctatggcactaagtttgccgatgagaacttctccaggaagcacacaggtgagggtgtcctctccatggccaactctgggcccaacaccaatgggtcccagtttttcatctgcactgtcccctgcaactggctcgacgggaagcatgttgtgtttggccgtgttgtcaatgggatggacgtagtgaagaccattgagaaggttggttcgagctctggaaagaccagcaagcctgttgtagtagctgactgtggtcagctctaagcactagttagtaatattgatgataaagcttaataaagtttgcctggagttgtaattggactagtttggatgg

SEQ ID NO: 1877 - DNA, 403 bp, Artificial
  Synthetic
ccaatcctcccgtcttcttcgatgtctccatcgccggcgatcccgccggaagaatcgtcatggagctctatgccgataacgtgccactcacagcggacaacttccgtgcactgtgcacaggagagaaaggtgctggcaaagacacaggaaacccactgtattacaaaggctccatctttcaccgagtgatcaaagggttcatggctcacggcggcgacttcaccaagcgggatggaactggtggcgacagtatatacggcggcaccttcagtgatgactcttttgttttcgctcatgactcacctggagttctatccatggccaatgctggaccaaataccaacaagtcgcagttttccctgacgtttgctccagccccgcatcttaatgggaaacatgtcgt

SEQ ID NO: 1878 - DNA, 571 bp, Artificial
  Synthetic
caatctctttttctccaaatgtccaaccaggtttactttgacgtgtccgccgacggccagcccctgggccgaatcgagttcaagctgtacaacgacattgtgcccaagaccgccgagaacttccgagctctgtgcaccggcgagcagggctttggctacgccaactccatcttccaccgagtcatcccccagttcatgctgcattgttggagacttcacccgacacaacggaaccggaggcaagtccatctacggcgccaagttccccgacgagaactttgaggccaagcacacccgacccggtctcctgtccatggccaactccggccccaacaccaacggctcccagttcttcgtgaccaccgtcccctgcccctggctcgacggcaagcacgttgtcttcggtgaggtcaccaacggtatggacgttgtcaagaagatcgagtccttcggctcttcttccggcgccacccgagccaagatctccatcgacaagtccggtgagctctaagcggccagtacgatacaatcagtgcttagttaaatattattgtcccggttaatccggaat

SEQ ID NO: 1879 - DNA, 573 bp, Artificial
  Synthetic
cccacgcgtcgggaatgccgtccgcactacagactcggacgatgatggacacggcaatgcgaatgtatcgtctactgcatcgtctcgtgattgtgcagcggcagcagccggatctccgcctcccttcctcaccaaggcatacgatatgattgacgacatttcctcggacccagttgtgtcttggagcaacagaggcaccagcttcgtggtctggaatccaccagagtttgcacgggatctgttgccccagtatttcaagcacagcaacttctccagtttcgtgcgtcagctcaacacctatggtttccgaaaagtcgacccggaccgatgggagtttgcgaacgaggagttcgtccgaggcaagaagagcctgctcagaaacatatctaggaagaagccctcctcgcagcaacagcagcagaaagcagccacatgtgagtcaaagcttggtttggaagcggaggttgacagactcaatcgggataagaacgtgttaatgctggagctcgtgaggctgaggcagcagcagcagcaggcggagagagagctgctgatattgggccaacgtgtgca

SEQ ID NO: 1880 - DNA, 974 bp, Artificial
  Synthetic
aaatcccctttagaagaagagaaaaaagcctctcaaatctcatctcaaaccacctaatttctctcatactcgctcgacccatggctctattagtcgagaagaccacctctggccgcgagtacaaggtcaaggacatgtctcaggccgatttcggccggctcgaaatcgagctggccgaagttgaaatgcctggtctcatggcttgtcgtactgaatttggcccatcacaaccatttaaaggtgctaaaattactggatctttacatatgaccattcaaactgcagttttgattgaaacccttactgctttgggtgctgaagttagatggtgttcttgtaacatcttctccactcaagatcacgccgctgctgccattgcacgtgacagcgctgccgtgttcgcgtggaagggtgaaactttgcaggagtactggtggtgcactgagagggcacttgattggggtccaggaggtggtcccgacttgattgtcgatgatggtggtgatgctacactcttgattcatgagggtgttaaggcagaagaagagtttgctaagaatgggacaatcccagatcctaactctaccgataatgctgagtttcagcttgtgcttactattattaaggaaagtttaaagactgatcctttaaagtatactaagatgaaggaaagactcgtcggtgtttctgaggaaactaccactggggttaagaggctttatcagatgcaagctaatggaactttgctcttccccgctattaacgttaacgactctgttaccaagagcaagttcgacaacttgtacggatgccgccactcactgcccgatggtctcatgagggctactgatgttatgattgccggaaaggttgcccttgttgcgggttacggagatgtcggaaagggatgtgctgctgccttgaacaagctggtgcccgtgtgattgtgaccgagattgacccgatctgtgctc

SEQ ID NO: 1881 - DNA, 584 bp, Artificial
  Synthetic
caagaacattctcagcttctagaaggttttctcaccaacccccaaattatgagaaaattacgaaattggctaaccaactacaaaagaatgattcaattcaccaaacgaattaaatgaagcattaaattgagagtaaatgagttttcgttagagtgaaactcacgtaagtgttgagctgacgaatgaagcttgagaaattattatgcttgaagtattgaggaagaagatctttagcaaactctgctgttttccacacgacaaaagctgttccttcttcgttccatgaaacgacgtcgtctgtgctatgatcatcaactagctgatacgttttgcttaaaaacggcgccggaactgatctttgcgccgccgtcacagccgtcatctccggcgaactttttttattttaccacagaaaaataaaactaaaaataatctaatacacaaagagaagaagaaagattggaaatagaaagtcgaaggaaaaagaatcagcaactaaaaagcaagagagcggtgagaaattcccaatcccagcaataaaagccagagaggaaaacacgagaacggagaagatcggagtttcg

SEQ ID NO: 1882 - DNA, 562 bp, Artificial
  Synthetic
gtaaacccctctctctttccactctctctctctgtcccatttccgtcgtctttgttgcagctcactgcaagtcttcttccttcagggtgaagaggaacttctagagctttgcaaccttagctcgacggaaatggcagccatggaactatcagtacagaagacctctagcggtcgggagtacaaggtcaaggacatgtcccaggctgactttggccgtcttgagcttgacttggccgaggtggagatgccgggtctcatgtcctgccgaaccgagttcgggccaagccaacccttcaagggggcccagatcacaggatccctccacatgaccatccaaactgcagtgctgattgagaccctgacggcattgggtgctgaagtccgctggtgctcatgcaacatcttctccacccaggaccatgcggcggctgcgattgctcgcgacagcgctgccgtttttgcgtggaagggcatgtccctccaggagtactggtggtgcaccgagcgggcccttgactggggtgttggaagcggccctgacctcattgtcgatgacggagga

SEQ ID NO: 1883 - DNA, 607 bp, Artificial
  Synthetic
tatatcactcggctctcactctctttcattaatccccacaaaacccacctttcaaaaccgttaatcttaagtgtaactgaaaaagtaaaaggaaatggaggatggagtgagagtgaagcgggaggaagacggcgttgccaccgccgtgacggcggcgccgctaccaatggaggggctgcatgacgtgggtccaccaccgttcttgagcaagacttatgaaatggtggaagacccttcaacggatgcagtgatttcatggaccagagcaaggaatagctttattgtttgggattctcataagttttcaaccactttgctgcctaagcatttcaagcacagtaatttctccagtttcattcgccagcttaacacatatctttagacagaagttcagatagtctctgcagctgatggttggtggttctgatgaattctactgcttgtgtttgatggttgtacgatgaatactcgaagaaaagaagcacgttagggttttagaaaagtggatccggatagatgggaatttgcgaatgaaggttttctaggcggacagaagcatctcttgaagaccataaagaggaggaggaatgttggtcaaagcatgaac

SEQ ID NO: 1884 - DNA, 772 bp, Artificial
  Synthetic
aagataaaaaggggaaaaggtcgcccagcggctgaaaccgggctgcattgctcctcgctgctttggattcgcacttcgcagcttgagaccgggagcagaacgagcggcggaatgggttccggatccggatctttcctcaaggtggtggtaaagaacttggatgttcttgcggggcctatagtttcacttgcttatccactatatgcatctgttcgagcgatagaaacaaaatctgctgtagatgatcagcaatggctcacatactgggtgttgtactcgtttatcactctatttgagctcactttttctccggtacttgaatggcttcctttatggtcttatgctaaattgtttttcaattgctggttggtcttgccctacttcaatggtgctgcacatgtctatgaacactttgtgaggccaatggttgtcaaccagcaaatagttaatatctggtacatcccaagaaaggatgagtcagatagacccgatgatgtgatatcagctgcgcagagatacattgaacaaaatggatcaaaagcgtttgaaagtctggttaacaagtttaaggcttcaaacacaaggcgctccattctggaggaggtagaggctgaaagaagagccaaggctgaactagaagcagaagcaagggatgagaatcctttcttcaatcaaaattatcggtactagaagtcagggttcataggatcaaatttatgctcatggggtatgtgttcaaacgatcatggattagtgtaaatagggtcaagga

SEQ ID NO: 1885 - DNA, 643 bp, Artificial
  Synthetic
acgcgtcgatcggttcgaagaagaagaaagaagagttcgaaatttttagaatgggtgcagtctgggctgtgatcatcaggcttcatgccttcgcagggccgatcctctcggttctctatcccatgcttgcttccgtcaaggcgatcgagagtccacgcaaggaagatgatgagcagtggttaacttactggatcctctactcgctcatgacactgtttgaggcagccgcgtctccagctctggcctggtttcctttgtggtacccgctgaagctggtgcttctttgctggcttgttcttccacagttcaagggtgcgagctttgtctacaacgaggtcgtccgcaagtacgtggttaaaaacagtgggatgatcaaggagaaggtagacgaagtaatgggacccgagacgaggtcgtccgtggagaggttcatcaacgagaatggactggacgcactagacaagctactcgctgacgcgaagaacaaaaaggagcctttgcccactcccaagcaagaatcacaggagagatactgaagaaggcaaggaactttagttcctttgtagccaccccatgtacattctaacgcattcttcatgtcggtgggagtttaattaagcgctatattttcttaaaaaaaaaa

SEQ ID NO: 1886 - DNA, 599 bp, Artificial
  Synthetic
agcgcctccatttccagggatttggaacaatggccttcatccttctccatggcactctccatgccacgatctacgaggccgcggagctgcagcacgaccatagcgctgggggtttcttcaataagataattggtggcttctcgggtgatggagcacacaagctctacgcgacggtcgatctggaaaagactcgagtcggccggacacgcatgatcggcaaagacgagacatggaacgagtgcttccacatctactgcgcacaccacgtctccaaagtggtgatcacgatcaaggacgacaaggccatcggggccgtactgctgggacgagcaagcatcgaggtgtcggacctcctcagcggcgaggtcgtggagaactggtacaatctctacaacgacgaaggtgagcagcgtggcgactccaaagtccgggtccggctccagttccacgacgtagccaaagatcctcgattcggcagaggtctcctggatggaagaaagttccagggcgtgcctttcacgtactgccagcagcgcaagggatgtaaggtgacgctctaccaggacgctcatatgaccgagaactttctcccggatatc

SEQ ID NO: 1887 - DNA, 423 bp, Artificial
  Synthetic
agtttccggaaggccatagctgctgtcagatcgttccactctctaggagttcatggctctacatttgttacatgggaccttccacatcactatctgcgaggcttcagggctaccgaagcaccatgctgggttcttacatagaatcgtgggacttggagggtcgcaacaactatatgcgaccatagatatggagagggcgagggtgggtcggacaaggatgattgatcacgagcctacaaatccctcctggaacgaaagcttccacgtctactgcgcctaccatgtgtcccatgtagtggtgagtatcaaggatgacaatgcagtgggtgcggcaatcgtgggaagagcaaagatccccgtggaagatattttaggcggggaggagattgaccagacctatggcctcgtcaaagacaatgggga

SEQ ID NO: 1888 - DNA, 618 bp, Artificial
  Synthetic
cagtttggagctcttcctgttatgccaatccaggcaatgacacagcaggctaccaggcatgctcggcgagtttatgttggtggactaccagctcatgcaaatgaacagtctgttgcgactttctttagtcacgttatgtctgcaattggaggaaacacagctggtccaggggatgctgttgtcaatgtctatataaactatgaaaagaagtttgcttttgttgaaatgagatcagtagaggaagctagtaatgccatggcattggatggcatcatatttgagggcgcaccctgtaaggtcagaagaccgagtgattacaatccttctctggctgctactcttggtcctagccaaccaaacccaaacctcaacctggcagctgttggattgagcccaggttctgctggagggctggaaggtcctgatcgtatttttgttggtggtttgccctactatttcacagaagcacagattagagagctgttagagtcttttggtccacttagaggatttgatttggtcaaagatagagaaactgggaactcaaaaggctatgccttctgtgtctatcaggatgtctctgttactgatattgcttgtgcagctcttaatggtatt

SEQ ID NO: 1889 - DNA, 431 bp, Artificial
  Synthetic
ggcgatgccagctcaagcaatgactcaacaggctacaaggcatgcgcgccgtgtgtatgtaggcggattacctcccttggcgaatgagcagaccatcgccacatttttcagccaagttatgtctgctattggagggaacacagctggtcctggcgacgcggttgtgaatgtgtacattaatcaagaaaagaagttcgcttttgtggaaatgcggactgttgaagaagccagcaatgcaatggctttggatggaattatatttgagggtgtttctgtccgcgtgagaagaccgagtgactataacccctccatggctgctacactaggtcctagtcaaccgagtcctcacctaaacctttcagctgtcggcctgacccctggtgctgccggtggagctgatggccccgaccgcatctttgttggcggtcttc

SEQ ID NO: 1890 - DNA, 678 bp, Artificial
  Synthetic
  misc_feature (463)..(463): The residue at this position can be any nucleotide.
  misc_feature (468)..(468): The residue at this position can be any nucleotide.
cttcttcttctttctctctctctctctttgtgttggtgttggtgtatagtggagatggcaatggaagggggggacaagggaggaatccaaaggcttcttgcagcagagcaggaggctcaacatatcgttgcagctgcaagattagcaaaggcaacgaggttaaaacaagcgaaagaggaggctgaaagagaagttgctgcttatcgagctcagcgagaaagtgaattcagaaaaaggcttgctgatacaagtggagattctggtttaaacatcaagagattagaagcagaaacccactcaaagatagaacagcttaaagaggaagcagcgaatgtttcacctgaggttgtggaaatgatgataaaatatgtaacaaatgtcagaaattgatttgaccttggcttcagtttaccctaaagtttaaagcttttagcaggaagttcaataggtataatgggtattngtttngtatcagtgtttatgaatatgcaccataaggttgaaactagaagttggtggacctgctagagaactatttttgtctaccatcgaactcgagtttctgctatgtccgattgtaaaggagatcattgatttgaagtttgtgacgagcacttcgatgtacactatttattgtcatgtaagtgaatgactatggtttagtatagttatgtaatg

SEQ ID NO: 1891 - DNA, 670 bp, Artificial
  Synthetic
ccccccgacgaaggaagatagattttccccatcgaaatctcgtcgcttcccccgggttcgattcgagtcttctctctcgcagcacaaagatggacgcaaacagacgccaaagtggaatccagcaattgttggctgcagagcaagaggctcagcaaatagtaaatgctgctagggctgcaaaatcggcaaggcttaggcaagcaaaagaggaggctgagagggaaatagctgaataccgtgcccagatggaggctgaatttcagaggaaggttgcagagagtagcggtgactctggtgcaaatgtcaagcgtcttgagcaggagacagcggaaaaaatcgcacaactcaagcagcaggctgcaagtatctcccctgaagtgattcagatgcttctgaggcatgtcaccactgtgaagaactaagggttgatggcttgctgctaggcgatttgccatacatctgatggcaaacttgtactgtttattttttgagagggtggtaagaataacttcgtctcttctagctgtaattccgtgttccgaataacggaataaactgcttctgttcatcagcagccatgtttcgtactttgaaaacctcggttcctgtctggtaaatattatcctttcatgtatcatttgaataaaataatgggagattctttttgttt

SEQ ID NO: 1892 - DNA, 408 bp, Artificial
  Synthetic
gagagggatagggagagggagaggcagagagagagagagagagagagagagtggcgatggcttctgaccagggaggaatccagaagcttttggctgcagagcaggaagcccagcagatcatttcctctgctacatcagctaaggcaactagactgaaacaagcaaaataagaagctgagagagaagttggtgcttatcgtgcacaacgtgaaagtgaatttcgaaaaagattggctgagacaagtggagattctggttccaacatcaagaggctataagctgaaacgcatacaaaaattcatcatcttaagcatgaatcggcacatatatctcctgaggtggtgccgatgcttattacctacgtcacgactgtaaaaaattgagggagggaatattttgaggcggagg

SEQ ID NO: 1893 - DNA, 702 bp, Artificial
  Synthetic
ccccccgatacaaaatccaattccagaaaggcctcaactttcgcagcaaccgattctcaactccgattccacagagttgtcttagtgttatagacgagtatggcatctagcagtggccagaatggaattcaactccttttagctgccgaacaggaagcccaacacattgtaaataccgccaggactgctaaacaggctagattgaagcaggccaaggaagaagctgagaaggagatagctgaatttcgtgcttacatggaagctgagtttcagcgaaagcttgaacagactagtggtgactctggcgctaatgtcaaacgtcttgagctagaaacagatgcaaagatcgagcacctgaaaactgaagcagaaagagtctcccctgatgttgtccagatgctcctgaggcacgtaaccacagtgaagaactaagatcttctgtgcgtgtagtgggtcaggcttaatgttcattttgcagatttatgaaccacccttgtttgatcagtccaatggtgctctccatttgtattttatgtttattatcattattttattgtcttgtctgttgaataaaacaactcactcgagctcgtttcaacccgtgtgttgtaaacttagatgagaaaccaaggtcagatgagtaggcatggctgctccttatttatctagaactgaggagtctttgattctcaaaaatagctg

SEQ ID NO: 1894 - DNA, 1030 bp, Artificial
  Synthetic
cccccccggatcgatctcgtcgtcggcgatggagaagttgctttcctcctccggcgccgccgccgccgtggcgtcgcagggccagctcccggactgcttcgtgttcccggccgaccggcgcccaccggcctccaccgcggccgtgtcgctccccgtcatcgacctctccggcccccgcgacgccgtccgccgcgccgtcctcgacgccggcaaggagctcggcttcttccaggtggtgaaccacggcgtgccgccggagacgatgcgggagatggcggcggtgtgcgaggagttcttccggctgccggcggaggacaaggcggcgttctactccgacgcggaggagaaccccaaccgcctcttctccagcaccatctacgaggtcggcgaccagcgctactggcgcgactgcctccgcctcgcctgcggcttccccgtcgccgacgacaccaacacccactggcccgacaagccccaccatctccgggatgtcacggagaagttcttcgtggcgacgaggggattggggatcgagctgctgcggctgctgtgcgaggggatggggctcaggccggactacttcgagcgcgacctcaccgccggcgatgtcatcatcaacgtcaaccactaccctccatgcccggatccgagcctgacgctgggcttgccgccgcactgcgaccgcaacctcatcaccctgctcctccagggcgacgtcttcggcctccaggtctcctacaatggcgactggatcaacgtcgaccccgtccccgacgccttcgtcgtcaactttggccacctcctcgagattgcgacgaacggagtgctgaagagcatcgagcacagggcgatgacgaactcggcggtggcgaggacgtcggtggcgacgttcatgatgccgccgatggactgcctcgtcggaccggcgaaggagctcgtcggagacggcggccagccgcagtatcgcaccgtcacgttccgcgagttcatgcgcatctacaagaccgtcggcgcgcgccgcgacagcgtc

SEQ ID NO: 1895 - DNA, 580 bp, Artificial
  Synthetic
gatcgatctcgtcgtcggcgatggagaagttgctttcctcctccggcgccgccgccgccgtggcgtcgcagggccagctcccggactgcttcgtgttcccggccgaccggcgcccaccggcctccaccgcggccgtgtcgctccccgtcatcgacctctccggcccccgcgacgccgtccgccgcgccgtcctcgacgccggcaaggagctcggcttcttccaggtggtgaaccacggcgtgccgccggagacgatgcgggagatggcggcggtgtgcgaggagttcttccggctgccggcggaggacaaggcggcgttctactccgacgcggaggagaaccccaaccgcctcttctccagcaccatctacgaggtcggcgaccagcgctactggcgcgactgcctccgcctcgcctgcggcttccccgtcgccgacgacaccaacacccactggcccgacaagccccaccatctccgggatgtcacggagaagttcttcgtggcgacgaggggattggggatcgagctgctgcggctgctgtgcgaggggatggggctcaggccggactacttcgagcg

SEQ ID NO: 1896 - DNA, 646 bp, Artificial
  Synthetic
agttcttccgcggcagagtgactcaggcgtaaaaaacctggtaaattctggcattgacaagctccccgatgcatacgtccaaccaaaaggcgagcgtccagatgcagttcatcacgaagcaagcttccccgttctggatattgcatcggctttggattccagccatggccgggcagcacttgtctcacaaatccgcgaggcttgcaagaaatggggcttcttccaggtgatcaatcatggcgttccaaactctgtgattgatgagatgacatcggtggctcgtgagtttcatgctctaccaaacgaggagaaaatgcgctacttctccacgcataccaaatctccaatgcgatttggaaccagcttcaatatcatgcaggacgaggttcttaactggagagactatctccgccatagctgccttccactgtccgagatgcaaaagctctggccagaaaagccagaatcatacaggaaaattacgggtgactatgcaactcgccttctagatcttggcaagctccttctggagcttgtctcggagagcttgggtctcccaagtgactacatagacaatgctttccaaggctgctcgcaaatcatggttctcaattactatcccgcttgtctggagccagatctggtg

SEQ ID NO: 1897 - DNA, 784 bp, Artificial
  Synthetic
gatagttttaggaacaatgccgactcagggagtcaaggagctagtggagaattctcaagatcatataccagataagtatatcaagcccgagcgtgcccgtgttagatacaacagttccacagcagggattcccctcattgacctcgctgaaatccatggacaaggaagaagtgatgttcttcgtgccataagagatgcggcaggagagtggggattcttccaggtgatcaatcacagcgttccaccagctttgatggaggctatgatgaaggctgctcgtgagttcttcgacctgcctctagaggaaaaaatggcatatttttctgaagattttgaggagagaattcgtttctgcaccagctttgttccttcaacggaagaacgctgggactggcaagacaacctctcgcatacttttccaccttacggagacgatcacccctggccaaagaagccacacttgtacgaggaagttgcgaaggagtatctccaccaggttttggagctggggaacgcaatcgcaggtgcaatctctgaaagcttgggcttagaaaaagactttctcctaaaggcgttcggagagggcaggcacaacatgcgtctaaactattatgcaccttgtccaagacccgatcttgcagtgggcttcagtcctcactccgacttcggaggttttaccatcctgatgcaagaccaagtaggagggcttcaggtgaaaaaggacgacgactggtactttgtcaaaccagtcaagcactccttcgtggtcaatatcagtgatcaa

SEQ ID NO: 1898 - DNA, 634 bp, Artificial
  Synthetic
ccaaaaaaaaaggaaaaaaaaaagccaaaacacaccaagccaaataaaagcgacaatgggatcgctcaccaccaacatcgtcctcgccgtcgccgtggtggccgcgctggtcggcggcgggtcgtgcggcccgcccaaggtgccacccggcccgaacatcacgaccaactacaacgccccgtggctccccgccagggccacctggtacggccagtcctacggctccggccccgctgacaatggtggcgcgtgcgggatcaagaacgtcaacctgcctccctacaacggcatgatctcctgcggcaacgtcccaatcttcaaggacggcaggggatgcggctcatgctacgaggtgaagtgtgagcagccggcggcgtgctcgaagcagccggtgacggtgttcatcacggacatgaactacgagcccatctcggcgtaccacttcgacttctccggcaaggcgttcggcgccatggcttgcccggggaaggagaccgagctccgcaaggccggcatcatcgacatgcagttcaggagggtgcgctgcaagtaccccggcggccagaaggtcaccttccacgtcgagaagggctccaaccccaactacctcgccgtgctcgtcaagttcgtcgcc

SEQ ID NO: 1899 - DNA, 598 bp, Artificial
  Synthetic
aaaaaaaaaaggaaaaaaaaacaaaacacaccaagccaaataaaagcgacaatgggatcgctcaccaccaacatcgtcctcgccgtcgccgtggtggcagcgctggtcggcggcgggtcgtgcggcccgcccaaggtgccacccggcccgaacatcacgaccaactacaacgccccgtggctccccgccagtgccacctggtacggccagccctacggctccggctccaccgacaatggtggcgcgtgcgggatcaagaacgtcaacctgcctccctacaacggcatgatctcctgcggcaacgtcccaatcttcaaggacggcaggggatgcggctcatgctacgaggtgaagtgtgagcagccggcggcgtgctcgaagcagccggtgacggtgttcatcacggacatgaactacgagcccatctcggcgtaccacttcgacttctccggcaaggcgttcggcgccatggcttgcccggggaaggagaccgagctccgcaaggccggcatcatcgacatgcagttcaggagggtgcgctgcaagtaccccggcggccagaaggtcaccttccacgtcgagaagggctccaacccca

SEQ ID NO: 1900 - DNA, 607 bp, Artificial
  Synthetic
attcacaaataactaacacccatcagcaacaatggcatcctcttgtctccttctggcctgtgtcgtggcagcggccatggtgtctgcagtgtcatgtgggccgcccaaggtgccgcctggccccaacatcactgcggcctacggcaaacagtggctggaagctaggggtacctggtacggcaagccaaagggtgccggccccgacgacaacggcggcgcttgtgggtacaaggacattgacaaggctcccttcctcggcatgaactcatgtggcaatgaccctatcttcaaggatggcaagggctgcggctcctgctttgaggtcaagtgttccaagccagaggcctgctccgacaagcccgtcatcatccacatcaccgacatgaacactgagcctatcgccgcctaccacttcgacctctccggccatgcttttggtgccatggctaaggaaggcaaggatgaggaactccgcaaggcgggaattatcgatatgcagtttcgtcgcgtccgctgcaagtaccctggtgagactaaggtcaccttccacgttgagaagggctccaaccccaactactttgcagtgcttgtcaagtacgtcggtggt

SEQ ID NO: 1901 - DNA, 496 bp, Artificial
  Synthetic
tccaccagcaataacattatattgcagcaatggcatcctcctcccttctactcgcctgtgttgtggtggcggctatggtgtccgccgtctcctgcgggccacccaaggtgccaccgggccccaacatcacgacaagctacggcgacaagtggctggaagccaaggccacctggtatggtgcgcccaagggtgctggccccaaggacaacggcggcgcctgcgggtacaaggatgtcgacaaggctcccttcctcggcatgaactcctgcggcaacgaccccatcttcaaggacggcaagggctgcggctcatgcttcgagatcaagtgctccaagccggaggcctgctccgacaagcccgcccttatccacgtcaccgacatgaacgacgagcccatcgctgcctaccactttgacctctccggccttgccttcggcgccatggctaaaggatggcaaggacgaagagctccgtaaggccggcatcatcgacacgc

SEQ ID NO: 1902 - DNA, 445 bp, Artificial
  Synthetic
cccccccccgaaaaacaaaacccccactcatctcagtgcgggctctttctcttctcttcagttcaccaccggcacctctctcatcggatccctgcagaggaggaaagggcagtggcggcgaaaggcgacatgggctccctgtcctctctcgccgccgcggcggtgtttctctccctcctcgccgtcggccactgggccgccgccgatttcaacgccaccgacgccgacgccgacttcgccggcaacggcgtggacttcaactccagcgacgccgccgtctactggggcccctggaccaaggccagggccacctggtacggccagcccaagggcgccggccccgacgaaaacggcggtgcgtgcgggttcaagcacaccaaccagtacccgttcatgtcgatgacctcctgggggaaccagccattgttcaaggacggcaagggat

SEQ ID NO: 1903 - DNA, 642 bp, Artificial
  Synthetic
ctcttagataatttagcatgcaaaaaagaaaaagatcattcaaaagattatagtcataaacgacatagagaaacaaatattctacaatgaagtactactatatcaacttctttctctgcttttgagatccttcttatgtcctttcaagattttgggtgcttttgaagctgtgaacgagcagcaaaaatagaaaacagagaagtacttaagcaatggagaaattttctgggcttagccacctatttatgacagtatttctgagttgcttctctacatttatggtgattccacctatgactgatatcactttatcagccatttgtccaggcaaagatgaatgctcccttgctatttacctcactggaattcaacaagcgattgtaggaatgggatcactagtgatgatgccagtattggggaatttgtcagacacttgcggtagaaaaatcatactaactgttcccatgaccctttccatcttccctctagcgatattagcgtacagcaggacaaagtacttcttctacgcttactacgtgctaagaactctcattgccatgatttgcgaaggaagcgttcagtgtcttgctcttgcctatgtggctgataatgttccagaaagtcgacgagcctccgtttttg

SEQ ID NO: 1904 - DNA, 627 bp, Artificial
  Synthetic
tactcttcaactcaatttttatgaacattgaaaaagaaatctaattaagtaatggcagtgtcagcggtagcaactcttctatttcttcttgttgcttctccggttgcttttgccgccaaccatgtcgttggaggcagtggcgggtggagccagaccgtagattactccacttgggctgctggtgaaaccttcaacgttggtgacacccttgagttcaactatggtgcaagccacagcgtggatgtaataagcaaagatgactatgaaaattgcaacaccggaaacgccctcgagtctcacagcgacggcaaaaccaccatcaaactttccaaggccggtccaatgtacttcacttgttccacatttggtcactgtcaatctggcatgaaattaaccgtcgatgtcaaagatagctcctccactccgtcaactccgtcaactccttcaactccttcaaccactccttcaactccgtcaaccactccttcaactccttctgactcacccaccacacccacccctgaggttggcaactcgccgtcgaagtcgacacctgtagcacctaacggagcagccggagttatgggcaaaactgtagtcggattttcagttgtgttgggagctatg

SEQ ID NO: 1905 - DNA, 646 bp, Artificial
  Synthetic
cgcccattcgtctcaaacacacattctttgattcttccttcaatttccccttttcaactctgtcatcaacttaattgttagaagcgacctaaagattttgcggccgatcgagcatggcgtccccttcggctctgatcgcaatgctcctcgtcatggtcgtcggctgcgccgccgtggcctcggcgatggagctgagtttcattgtcggagatgcgcagggttggaacaccggcgtcgactacaccgcttgggcgaagggcaaaaccttcgaggctaacgacacgcttgtattcagatacgccaggaagcagcacacggtgacagaggtgaccaagagcgactacgacgcctgcaccgtcagcggcaaaccgatcagtgatttcgaaggaggcgcgcttgtgacattcatagcgctcagccccggcgagcactacttcatctgcaaaatcggcaaccattgcgccagcggcatgaagctcgccgtcaccgtctccaactccagcgacaccccgaggccgcaaccttggattgggccttactccacgccagccagcgcgtccgcacacctgcacgccggtggcgccgtcgtcgcggcggccgttgggatcctcctcaatctcgccctcttctgagatcgcattgacgc

SEQ ID NO: 1906 - DNA, 695 bp, Artificial
  Synthetic
atcgatttctagcttagcttctactgccaattgcttggagatcgatcgaccatcatctccatcgagcctcaaagtcgatatatagctaattggaccatattccatggcgatcatggcagccagagctctcctcgtcgtcgccatggcggcggcggtgctcggaacggcgctcggcgccacctacaccgtcggagctccgagcggctcatgggacttgaggactaactatgaccagtgggtttccaacatcaactttcgtgccggagaccagatagtgttcaagtattctccagcggctcatgatgtggtggaggtgaacaaggccgactacgactcatgctccagctccagccctatcgccaccttcaactccggcgatgacaccatccctctcaccgctgccggcacccgctacttcatatgtggcttcaatggccattgcaccggagggatgaaggtcgctgtcaaggttgaggccgccaccggcagcaacccggccccatcaccgatgacccctcgaccacgcacaccgacagcaatggcaccgaacgcaatgccgccaacggctggtggccggcccgtgcctccatctaactcagcaagccagcccactggtgttgcatctctagttggtcttagtttgggtgccatagttgttggtctcatggccttctaaattagagtaagaagatact

SEQ ID NO: 1907 - DNA, 634 bp, Artificial
  Synthetic
ggcaatggcaatggccatgaacagtgtgctggtggtgatgctcgggctcgcaatggcggcgacatcgtcggcggcggtctacaaggtcggcgacacctccggctggaccatcctcggcaatgtcaattacactgactgggctgtcaagaagaccttccatgttggggacaccatagagttcaagtacccgcaggggattcacaacgtggtggaggtgaagaaggcggactacgacagctgcaccaactcgtcgccgatcgccacgcacacctccggcgacgacaagatcgccatcaaggccgccggccaccgcttcttcatctgcggcgtccccggccactgcgccgccggccagaaggtcaacatccgcgtcctcaagccacagcgctcctcctcctctgacgccccttccccggcgcccgccgcctccaagcgcggcgccgccgccgcgccgtcccccgccgtctcgtcgtcgccgccggagtcctcctcccccaccacggacagctcgtcctcctccacgaccaccgctccggcgcccaacgccagcgccgccgccggcggcggcggcgctaaggcggccttcgctgccgtggcgttggcgctggtcgccgccacggcgatgctacagtaa

SEQ ID NO: 1908 - DNA, 687 bp, Artificial
  Synthetic
atagaaaattagatcagaaatgcaaatatccgaactatataaaatacaacaacaagtacgaattaataattccaaaaatatttattctctccccaccaaatatattcgatacattacaaaaaagccctagacaattattagtaagcccaaataagaccaataaccaacgatccaacaacgaacatgtacccaatggaagcacgtagcccatcacccgaactagatttagaacccgaccctgaatctgaacccgaacccgaacctgaaggagaggaaccggatttggagtcaacaacgttgactttgatcttcatgccttgttcgcaatgtccaacggttccacaaacgaagtaacgagtaccggttttggaaagcttaacgacgtcgtttccagagcttaaggagttaactgatgttcccaggtcacaactcttgtatgccgtttcacttcctagctccacaacgctgtgtagtcctgaatacttaaaaacaatttggtcgccgactttgaaagattgatcagaagaccaagaatcaaaatcaacggattgttcccagccttggctaccgccgatcacatgttgtgctgctaacgctgtcttaaccgaaagtaaaccggagaaaaccaagataacaagaactgcttgcattttcattggtttagtgaattgaactcggacgcgtggg

SEQ ID NO: 1909 - DNA, 397 bp, Artificial
  Synthetic
ggatctgctagagctactgagcacattgtgggaagctctgcgggatggcttgttccgtctgcgaacgtaaattacaccacctggtcttccacaaatatctttcatgtcggagataccctcttgtttaagtacagcaatatcagtcacaatgtggaagaagtgactgaagccaactacaacggatgcaacacggtaagccccatatctacttacacggatggaaacacgacaatcgaactcaccaagacaggcatgcattactttctatgtggtttcccgagccactgcctggggggtcaaaaggtctctgtaaatgtagttgcggagggcacaacatccaactcaacatccaactcaactgggtcctcaagtggggtttcgctattggattttaatc

SEQ ID NO: 1910 - DNA, 661 bp, Artificial
  Synthetic
agcatctcctcggcggcggcggcatcggcgcctagatctagctccatctcccggcagcaacaaggatagaaatggctctctccgtggagaagaccgccgctggccgcgagtacaaggtcaaggacatgtcccaggccgactttggacggctggagatcgagctagcggaggtggagatgcccggcctcatggcctgccggaccgagtttggcccgtcccagccgttcaagggtgcccgaatcaccggctctctccacatgaccatccagacggccgtgttgatcgagaccctgaccgctctaggggccgaggtacgctggtgctcgtgtaacatcttctccacccaggaccacgccgccgccgccatcgcccgcgacagcgccgcggtcttcgcctggaaaggcgagaacttgcaagagtattggtggtgtaccgagcgagctctcgactggggagttggcggcggtccggatcttatcgtggacgatggcggcgacgcgactttgctcatccatgagggtgtcaaggccgagaaggagtacgagaagaatgggacgctgccggatccgagctcgacggccaaccaggagttccagatcgtgctggggatactcaaggatggtatgcaggctgacccgaagaagtaccataagatgatgga

SEQ ID NO: 1911 - DNA, 441 bp, Artificial
  Synthetic
acgcgtcggtaatctaaacctctcccctctctctctctctctctccttcggttctatttccgtcgtctgtgttgcagctccctgcaagacttcttccttcaggtgaagaggaacttctagagctacgcaaaccttagcttgacggaaatggcagccatggaactatcagtacagaagacctctagcggtcgggagtacaaggtcaaggacatgtctcaggctgactttggccgacttgagcttgatttggctgaggtggagatgccggggctcatgtcctgccgaactgagtttgggccaagccaacccttcaagggggcccagatcacaggatccctccacatgaccatccaaaccgcagtgctgatcgagaccctgacagcgttgggtgccgaggtccgctggtgctcgtgcaatatcttctccacccaggaccacgca

SEQ ID NO: 1912 - DNA, 320 bp, Artificial
  Synthetic
ctcgagcttgcggccgctctagctcaaccatggcgttgctcgtcgagaagacctcaagtggccgtgaatacaaggtcaaagacatgtctcaagccgatttcggtcgtctcgaactcgagctcgccgaagttgagatgcctggactcatggcttgtcgtaccgaattcggaccttctcagccattcaaaggcgctagaatcaccggatctcttcacatgaccatccaaaccgccgtactcatcgaaaccctaactgctctcggtgctgaagtcagatggtgttcctgcaacatcttttccactcaagaccacgccgccgca

SEQ ID NO: 1913 - DNA, 480 bp, Artificial
  Synthetic
ctcgagcttgcggccgcctcagatctagctcaaccatggcgttgctcgtcgagaagacctcaagtggccgtgaatacaaggtcaaagacatgtctcaagccgatttcggtcgtctcgaactcgagctcgccgaagttgagatgcctggactcatggcttgtcgtaccgaattcggaccttctcagccattcaaaggcgctagaatcaccggatctcttcacatgaccatccaaaccgccgtactcatcgaaaccctaactgctctcggtgctgaagtcagatggtgttcctgcaacatcttttccactcaagaccacgccgccgcagccatcgctcgtgactccgccgctgttttcgcctggaaaggtgagactcttcaggagtactggtggtgtaccgagcgtgctctagattggggtccaggtggtggtcctgatctgattgttgatgatggtggtgacgctactcttttgattcatg

SEQ ID NO: 1914 - DNA, 594 bp, Artificial
  Synthetic
ccaccctctcgccgtcgcagatccgatccaggaagagctcgccgccgccgctgccatggcgctctccgtggagaagacctcgtcggggagggagtacaaggtgaaggacctctcccaggcggacttcggccgcctcgagatcgagctcgccgaggtcgagatgccggggctcatggcgtgccgcgccgagttcggcccctcccagccgttcaagggcgcccggatctccgggtccctccacatgaccatccagaccgccgtcctcatcgagaccctcaccgcccttggcgccgaggtccgctggtgctcctgcaacatcttctccacgcaggaccacgccgccgccgccatcgccagggactccgccgccgtgttcgcctggaagggggagaccctcgaggagtactggtggtgcaccgagcgctgcctcgactggggcgtcggcggcggccccgacctcatcgtcgacgacggcggcgacgccacgctgctcatccacgagggcgtcaaggccgaggaggagttcgagaagtcaggcaaggtccccgacccggagtccaccgacaacgccgagttcaagatcgtgctcaccat

SEQ ID NO: 1915 - DNA, 694 bp, Artificial
  Synthetic
cggacgcgtgggcggacgcgtgggcaaaaactccattgaagagaggcctacatttcctctttctctctctcctattttactctctctctctctctagccatggctttgctcgttgagaaaaccacctctggccgtgagtacaaggtcaaggacatgtctcaggctgacttcggtaggctcgaaatcgagcttgccgaagtcgaaatgcctggtcttatggcttgccgtaccgaatttggtccgtcacagccatttaaaggcgctaaaattaccggatctctacacatgaccattcaaaccgctgtccttatcgaaaccctaactgctttaggcgctgaagttagatggtgctcttgcaacattttctctacccaggaccacgccgccgctgccattgcgcgtgacagcgctgccgtgtttgcgtggaagggcgagacgttgcaagagtactggtggtgtactgaacgcgcccttgattggggcccgggtggtggaccagatttgattgttgatgatggtggtgatgctacacttttgattcatgaaggtgtaaaagctgaagaggaatatgctaaatctggtaaattaccagatccaagttctactgataatgctgagtttcagcttgtgcttactattattagggatgggttgaaaactgatcctttaaaatacactaaaatgaaggagcgac

SEQ ID NO: 1916 - DNA, 679 bp, Artificial
  Synthetic
cccccccccgatcgagtcgccggattggtagccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgctgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtattaactacaaatattgcaataaaagtccctgttactac

SEQ ID NO: 1917 - DNA, 561 bp, Artificial
  Synthetic
ttacttttactctctctgtatttgttcttcttaaaaatcccttttacagaaaacccaaaagtagtgcaaaaattgagaattaatggcaaatctaggaggaattcgtgaggcaggaggatctgagaacagccttgagatcaatgatcttgctcgctttgctgttgatgaacacaacaagaaacagaatgcacttctggagttcggaaaggttgttaatgtgaaggaacaagtggttgctggaaccatgtactacataacactggaggcaactgaaggtggtaagaagaaagcatacgaagccaaggtctgggtgaagccgtggcagaacttcaagcaattggaagacttcaagcttattggggatgccgctagtgcttaacaagtgctaaatgaatgcatcttatgcttgtgaaaataaaggtaacatagtttcgcttgcgagtatttgaatatcgtaaagtaagctttaaactatgtcgtagtgttaagttacaagtaactgtaactttacaatgttccatatttcatattatatggtcctccatatgatagttctatgat

SEQ ID NO: 1918 - DNA, 660 bp, Artificial
  Synthetic
gcagtctgtccacagatgagagtatttggaaacaccacactgctatttgctttaattttgttattaagttttctgttctctgcgtttgggttaagcgaaaccggaggaggattttgcggtgaagaggaagagaaagaaagtaatctgattgagatggctactcttggtgggatccgtgattcgcatgcttcgtcccacaacagcgacgagatccatagccttgccaaatttgctgtcgacgagcacaacaagaaggagaatgcgatgattgaatttgccagagttgtgaaggcgcaagagcaagttgttgctggtacactgcaccatctgactcttgaggtcatagatgctggaaaaaagaaactctatgaggctaaggtctgggtcaaaccatggttgaatttcaaggaacttcaagagttcactcatgttgaagatgttcctaccttaacatcctcagatctaggtgttaagcaagaggaaggctctggattgaaatcagtgcctgtgcatgatccggtggttcaggaagctgcagaccatgcaattaagaccatccagcagcgatccaactcactacttccatatgaactgcaagagattgttcatgcaaatgctgaggtcattgcggaggacaatatgaagcttcatatgctcatc

SEQ ID NO: 1919 - DNA, 588 bp, Artificial
  Synthetic
ttcgcattattatgcatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgccgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatctattggaaccgcaaaaatgcgcc

SEQ ID NO: 1920 - DNA, 774 bp, Artificial
  Synthetic
cggcataatccggaacatcatacggatagcggcgcgggcggtggcgtcgtcgaggggcttgaaatcctggagctgcttgaagttctcccacgccctctcccacaccttggcctcgtacagcttattggcgccgccgggttccttcacctcgacggtgaggtagtgcatgaacccgcccaccacctgctgcctcaccttcaccaccctctccaactccaacatcgcgttggccttgctgttgtgctcggcgacggcgaaccgggcgagctcgacggtggtgaggtcgttctcgcgcccggccggcgcgtcgtggatgccgcccaccttcacgccgcgtggctctgcgcctcctcggccatgcttaattaatgcgaaggtaaatacagtagatttaaacatcaggacctagagttcaccactcgaagtcttttctcagcttcttatccacaaatttcccttcacaattaaacagcaacttaaacttattaaagtcaaagatatgataacataaagaaaccaaagcagaaatagcactataaggggatcgatatctatccactaaagccttatccaaagcatcaagcaccttaaagtctttgtaagatttgtaattgtcattgatagagatataaatctcactcaaaacttctacatctctcacatcagttctacctaattttgtgataaattttgccgcatctggaacaaattgatattttccatctatgcacagcagaaattaccacaaaatgcggggtacttgaagtcgaacac

SEQ ID NO: 1921 - DNA, 594 bp, Artificial
  Synthetic
agcgctactgccgcgttgatgtctttgctgtgtgcagcggcatcgagcgctagggtgtctttgcggtgcttggcgacgaagggccagggcgagcagctaccgatggcgcagctcaaagaaatcgccaagaacaagatgtttgatggatttaatcgccggttccagcaccagagcagctcctgtggttgtaacatgaatttcacggtctatttccctccagctgcggatcataaaaaagttccagttctttactggctttcgggacttacatgcacagatgataactttatccaaaaatctggagcacagcgtgttgctgctgccgagggagtagcaattgtttgtcctgatacttctcctcgtggattaggagttccaggagaaagtgatagctgggattttggtgtacgagccggtttttatctcaatgcaactcaagagaaatggaagaactggcgaatgtacgactactgcaccaaggagcttccggaactcctcagcgccaatttcgatcagcttgacaccaagaaggcgtcaattttcgggcactcaatgggaggtcacggggccttaactatcttcttgaagaacccg

SEQ ID NO: 1922 - DNA, 536 bp, Artificial
  Synthetic
aggaccccccctagaggttgcacactgcgcatcatcaccctcctcgtctctccatctcagagaaaatttgcatatatttctgaagcgaaggccatggatgccccggaggagattagtaagataaagatgtttggtggatacattaaacgctacaaacatcagagctctacacttggctgtgctatgaatttcacgatatatttccctcctgctgcacaagagaagaaagttcctgttttatactggctgtcggggcttacatgcacggatgaaaactttgtgcaaaaaagtggagctcaaagagcagctgcagcttgtggcatagctttggtagctccagatacatcaccaagaggtcttaacgtggaaggagaatcagaaagttgggattttggtgtaggggctggtttctatcttaacgctgcacaggagaaatggaagaactggcgaatgtatgactatgtgacggtagagataccgaggctccttagtgctaactttggtgagcttgatacagcatgcgcttctctctctgg

SEQ ID NO: 1923 - DNA, 465 bp, Artificial
  Synthetic
cccccccccctttcgcctaaaggaaaatgtcgcgtctcgtctcccctccttgcgccatctcgcggctgacagggtaggggcgccgatctccatctggcgagcagagcagagcaggcgaggggaggggatcctggtgcataattcttgaatccattttaagtgcagcaattctgagtaccaaaaaatccattcaaaatggtggttcttgctgcttccatcatttcaaagtccgggaaagcgcttgtttcaagacagtttgttgacatgtctcgcataaggattgaaggattacttgcagctttccccaaactggttggaactgggaagcagcacacttatgttgagactgaaaatgttcgctatgtttatcagccaatagaaggcctgtacttgctacttatcactaacaagcagagcaatattcttgaagatctggacaccttgaggctgctctctaagcttgtg

SEQ ID NO: 1924 - DNA, 336 bp, Artificial
  Synthetic
aattcggcaccagaagtgttcttcactctggtggtatacgatctattgcctaagatctgattcagcaaaatctactaagcagcgaagatggttgttcttgcggcttcgataatttctaaatctggcaaagcacttgtctcgaggcagtttgttgatatgtctcgtataagaattgaagggtatcttgcagctttccccaaattggttggtacaggaaagcagcatacatatattgagactgacaatgtgcgatatgtttatcaaccgatagagtctttgtacttgctacttgtgaccaacaaacagagcaacattcttgaagatcttgagacactg

SEQ ID NO: 1925 - DNA, 588 bp, Artificial
  Synthetic
gaaccatctggacatcccaccaaagcctcccccagattgctcttcagtgcacgacacgtcattgccaaaatggttgttctcgcggcctccatctgcacccgaggcgggaaagctgtcctctcgagacagtttcgagagatgcccagatcccgcattgaggctctccttgcgtcgttccccaagctggccgacagcggcactcagcacacaatcgtcgagcaggacaatgttcgattcgtctaccagcctctcgacgagctctacatggtgctcatcaccaaccgacagtccaacattctgcaagacatcgactccctgcacctgttcgcccaggtcgtctccagcacttgcaagacgctagacgagagagaaattgtccgaaatgcttacgagcttctcagcgcatttgacgaactggtcacactgggctaccgagagaacctgaccatcagccagatcaggacctttttggaaatggagagtcatgaggagcgcatccaggaaatcattgcacggaacaaagagcttgaggctactgaggagcggaaacgcaaggcgaagcagctggagatgcagcgcaaggagtcc

SEQ ID NO: 1926 - DNA, 623 bp, Artificial
  Synthetic
cccacgcgtccggcaaaaaattgagaaccaaagttgtgatggggcacaagtgaagttgctaggcttttggtatagtccatttactcacagagttaagtgggctctaaagataaagggtgtgaaatatgaatatatagaagaagatcgagataataagagctctctacttcttcaatccaatcctattcacaaaaaagtccctgttctcattcacaatggaaaacccattgttgagtctctggtcattcttgagtacattgatgagacatttgaaggcccttccatttttcctaaagacccttatgatcgagctttagctcgtttttgggctaagttccttgacgacaaggtgactgcagtaccgaatattttccgtcgcaaaggggaggagaaagagaaagctaaagaggaagtatgtgagatgtataaagttcttgacaatgagttcaaggataagaagttttttgtgggtgagaaatttgggtttgctgatattgctgcaactttggtggcattttggcttggagtttttgaagaaacctctggaattgttttagtgacaagtgaaaaatttccaaatttttgtaagtggagaggcgaatacattaactgcagccaaatca

SEQ ID NO: 1927 - DNA, 423 bp, Artificial
  Synthetic
ccccccccaagtgcatcagcagcgagttgcagccatggcagcagacaagggagtgaaggtgttcggcatgtgggcgagccccatggcgatccgtgtggagtgggcgctccggctcaagggcgtcgactacgagtacgtcgacgaggacctcgccaacaagagcgaggcgctgctccggcacaacccggtgaccaagaaggtgcccgtgctggtccacgacggcaagcctctcgccgagtccaccgtcatcgtcgagtacatcgacgaggcctggaagcacggctaccccatcatgccctccgaccccttcgaccgtgctcaggcgaggttctgggccaggttcgctgaagagaagtgcaacgctgctctgtacccgatcttcatgacgaccggagaggagcagagaaagctggtgcacgaggc

SEQ ID NO: 1928 - DNA, 463 bp, Artificial
  Synthetic
cccccgaaccaccaaacagaacagagctcgcaactcacaagctgatacagagcagagaccatcggagttcagagttcagacacgagaaagccatggccggaggaggagacgagctgaagctgctgggcatgtgggcgagcccgtacgttctgcgagtgaagctcgcgctcagtctcaagggcctcgactacgagtacgtcgaggaggatctcaagaacaagagcgagctcctcctcagctccaacccggtgaacaagaaggtgcccgtcctcatccacaatggcaagccagtctgcgagtcgcagatcatcctgcagtacctcgacgaggcgttccccgatgccggcgccaccctgctccccgccgacccccacgaacgcgccgtcgctcgcttctgggccgcattctgcgacgacacgatcgcgaaggcgtcgcagcaggcgtcgtcgggaaagacggagga

SEQ ID NO: 1929 - DNA, 651 bp, Artificial
  Synthetic
aaagatgggtgaaagggtgaagctcatcggtgctttcgccagtgcatacggccaccgcgcagaggtggcgcttcgcctgaaaggcgtgcgatacgagctcatcctggaagacctccgcaacaagagcgacctgctgctcaaccacaaccccgtccacaagctcgtccccgtcctcctccatggcgaccgctccttgagcgagtccctcgtcatcctcgagtacatcgacgagagcttccatggtccacccatcctcccaaccgatccgtacgatcgagccgtggcgcgtttctgggcgcagttcatcgatcagaagtttggtaggttcaatttctggatcccgttcgtgcaaatggagggcaacatgcaggattgtttcgtgagggaagcaaaggagaatctggcgcttcttgaagggcagctcaaggggaggagattcttcggaggcgacgccatcgggttcttggacatagcagcgtgcttgatagctcactggcttggtgcgttcgaggaggtatgtgggggtgaccttggccacggatgaggagttccctgctttgtgcgagtggaggagacgctacgtcaacgatgaggccgtgaagccgtgcctgccgaatagggacgaactcgttgcgtattaccgtgaacgca

SEQ ID NO: 1930 - DNA, 546 bp, Artificial
  Synthetic
gaattcaagtcctcttcttctcaaaatgaacccacttcataaaaaaatccctgttctgattcataatgaaaaaccaatttccgaatccttactaatcgtccaatacattgatgaaatttggaaagataaatctccacttttacctaatgatccatatgaaagagcttcagagagattatgggctgattatgttgacaaaaaggtatttgaaatcgggaggaagttatggatgactaaaggagaagaacatgagaaagctaagaatgatttcattgaatgtatgaaggtattagaaggagagcttggagataagatttactatggaggtgacaaaatggggtttttagatgtggcttttgttccttactacagttggttttactcttatgaaacttgtggcaagtttagtatggaagaaatttgtcctaaattgatggaatgggcaaagaaatgtatggagaaagatagtgtctctgaatcacttcccgaatcacaaaagatttatcaattcgttttgaaactcaagcagaggtatggaattgttga

SEQ ID NO: 1931 - DNA, 521 bp, Artificial
  Synthetic
caaaaactctcagaaccaaagtagtgatatggcagaagtgaaggtgcttggtctttggtatagcccttttagtcacagagttgagtgggcactgaagattaagggcgttgagtatgaatatatagaagaagatctaaaaaacaagagctctctgcttcttcaatccaatcctgttcacaagaaaatccctgttctcattcacaatggaaagccaatagctgagtcaatggtcattcttgaatacatagatgaggcttttgaaggtccttccatcttgcctaaagacccttatgaccgtgctgtagctcgtttctgggctacgttttttgaagaaaaggcgatatcagtgggggattcgttctatgaaaaaggagaggagcaagagaaagctaaagtgcaagttttggaaatgttgaaagttcttgataatgagcttaagaataagaagttctttgtgggtgataaatttgggttcgctgatattgctgcaaatgctgcggcactttggctgggagttcttg

SEQ ID NO: 1932 - DNA, 740 bp, Artificial
  Synthetic
agaggggcattgaagcattagcagcacagcaacaatggcgagcgacagcgtgaaggtcctcaacttctggccgagcatgttcggcttgcgcgtccactacgctctggacctcaaaggtgtgccttacgagtacaaggaggaggacttggcggacaagagcgaagagctcctcaaggcgaatcccatctacaccaagatcccggttctcatccacaatggcaagcccatctccgaatccctcatcatccttgactacatcgatagcgtctggcccagttctcccaagctgctcccaaaagatccatacgacaaggccgtggctctcttctgggcggatttcgtcgataaaaaggtgtatgatgctggacattggatcatcagagctactggagagcagcacaagaaagccggcgaggatttcaagtgggcgctgatgaagatcgatgaagctctcggcactgttgctccaggcaagcctttctttggcggtgacgccatgaacattgcggatgtgagccttgcaccgtttatatgctggttcgaggggtaccagaaggtgggaggattccagcttccaggtcccgaggagtggcctcgtctctacaagtggattgatgctgtcaattccgtggaagcgatcaagaaatctactccaagtcgggagaagatggttgagtttatcgagctctataggaaacgaatggcaggcgctgcataagagaaatatcactgatcggtga

SEQ ID NO: 1933 - DNA, 613 bp, Artificial
  Synthetic
ggaagagggagtgaaactcttgagcttctggtcgagtccttatgcttgtcgagtgaggctagctctgggtctcaagggcatcgagtttgagctccaggaggaagatctgtacaatgcaaagagtgagctgctgctgaattccaatcccgttcacaagaagatcccagttctcatccacaatggcaaggccatctgcgagtccgtcaacatcattgagtacgttgacgaagtctgggcggatcgaagccccaattttctccctcgggatgatgcgtttgctcgagctactgctcggttttgggctgatttcgtcgacaaaaagtttatgagcaggacggcggcatcctaccgagcagcctattccagcgcaggtgaggaaaaagagcgagcaaacaatgagatgattcaagatttcatggcactggaggagtttcttgcgagacaggagatcgcgcggctccgcgtgcccggccccgatacctgtcctcgtctctgccgctggatggatgcagtcaaaggcaatccttttgccagagctgcctatcctgaccagagagaacttatggcctccactaaagtccgatttgagaaacgttttgtgaatgcaaatagg

SEQ ID NO: 1934 - DNA, 370 bp, Artificial
  Synthetic
cccacgcgtccgacgaacacttacaaaaaaaaatctctttgtgagctttagcgatcgtaacaatggcgaacgaggtgattcttcttgatttctggccgagtatgttcgggatgaggacaaggatcgcattgagggagaaaggtgttgaatttgagtacagagaagaagatctaaggaacaagagtcctttgcttctccagatgaatccgattcacaagaagattcctgttctcatccacaatggtaaaccggttaacgaatctatcatccaggttcagtacattgacgaggtctggtctcacaagaaccctatccttccttctgatccttacctgagagctcaagctaggttctgggctgatttcattga

SEQ ID NO: 1935 - DNA, 413 bp, Artificial
  Synthetic
gtgaacttcagagatcctatagcaatggcgaacctaccgattcttttggattactggccaagtatgttcgggatgagggctagagttgcgttgcgagagaaaggtgttgagtttgaatacagagaggaagatttctcgaacaagagccctttactcctccagagtaatcccattcacaagaaaatcccggttctggtccacaacggtaaaccggtatgtgaatctcttaacgttgtccagtacgtcgacgaggcttggcccgagaagaacccgttcttcccttccgatccttacgggagagctcaggctcgattctgggctgatttcgtggacaagaagttcaccgacgcccaattcaaggtatgggggaagaaaggtgaggaacaagaagcaggcaagaaggaatttattga

SEQ ID NO: 1936 - DNA, 307 bp, Artificial
  Synthetic
taacgttgtccagtacgtttacgagtcttggcccgagaagaacccgttcttcccttccgatccttacgggagagctcaggctcgattctgggctgatttcgtggacaagaatttcaccgacgcccaattcaaggtatgggggaagaaaggtgaggaacaagaagcaggcaagaaggaatttattgaggcagtgaagattcttgaatctgagctaggagataaaccttactttggtggagatagctttgggtatgtagacatttccttgattacattctcgagttggttccaagcctatgagaagttt

SEQ ID NO: 1937 - DNA, 227 bp, Artificial
  Synthetic
attctgttggattgttggtgcagtatgtatgggatgagggcaagaatagcacttgcagaaaaaggtgtgaagtatgagtacaaagaagaggatttgaacaataaaagcccactgcttttggaaatgaaccctattcacaagaaagtcccagtcttaattcacaatgggaaatcaatttgtgagtcacttgttatagtccaatatattgatgaagtttggaaaggaaa

SEQ ID NO: 1938 - DNA, 636 bp, Artificial
  Synthetic
gcagagagagagttgaggcaagaactatggcggagggagagggagatgtgaaggtattgagcagttggttgagcatgtttggcatgcgagttcttatcgcccttcatgagaagaatgtgccatttcaactcattgaggaggatctctctaacaagagtgaactcttgttgcagtcgaatcccatccacaagaagatccccgtgctggttcacaaggggaaagccatctgtgagtcaagcatcatcgttgaatacataaacgagacatggccttcccctcccctcttcaatccttccaccccctacaacacttcccttcatcgattttgggctgattacattgacaagaagttctatgatgcaggggcaagggttattaaaagtccaacaggagaagcccaggagtgtgcagttaaggatttggtggagagttacaagatgatggagaaggcattcgctgagatgagttgtgggattaagcctttctttggtggagactccatggggttagtggatgtcgtgtttgctccctatgtatcttggttctgtgtatatgagagcatagggggattcaagctcccaggggaggatgaatgcccactactaagtgcatggaccaagagagtgttgaaagtgc

SEQ ID NO: 1939 - DNA, 642 bp, Artificial
  Synthetic
aaaagagaaatgggggaagagggagtgaaactcttgagcttctggtcgagtccttatgcttgtcgagtgaggctagctctgggtctcaagggcatcgagtttgagctccaggaggaagatctgttcaatgcaaagagcgagctgctgttgaattccaatcccgttcacaagaagatcccagttctcatccacaatggcaaggccatctgcgagtccgtcaacatcattgagtatgttgacgaagtctgggcggatcggagccccagttttctccctcgggatgatgcgtttgctcgagctactgctcggttttgggctgatttcgtcgacaaaaagtttttgagcttgacggcggcatccttccgagcagccatttccagcgaaggtgaggaaaaagagcgagcaaatgatgagatgattcaagatttcatggcactggaggagtttcttgcgagacagggaacagtgtttttcagcggaagcgacacggacatgggctttgtcgatattgttgcctctttcatgccatggtggacgcccgcatacgtagagatcgctcggctccgcgtgcccggccccgatacctgtcctcgtctctcccgctggatggatgcagtcaaaggcaatctttttgccagagcc

SEQ ID NO: 1940 - DNA, 519 bp, Artificial
  Synthetic
cgcggagatttagaggagtgtttggttctttggataacaatatcccaaactgaaaatggctaagtcatatggagctatcttcctcttgaccctcattgtcctcttcatgcttcaaaccatggttatggcctcaagtggatctaatgtgaagtggagccagaaacgttatggaccaggaagcctgaaacgtacccaatgcccatcggaatgtgataggaggtgtaaaaagacacagtaccacaaggcttgcattacgttctgcaacaaatgctgcaggaagtgtctctgtgtgcctccgggttactatgggaacaaacaagtttgctcctgctacaacaactggaaaactcaagagggtggaccaaaatgcccttgaaaaaatctcccttcgttccctttttataataaaaattttcaactataactaaatttcctttgatcaatgttttatctactttattcctaatgttgtaatgttatgtcactccttttcggattttgcggccgcaattctcgagc

SEQ ID NO: 1941 - DNA, 461 bp, Artificial
  Synthetic
gagagatcgcagatgatgtccaggcagatttggaatccattaatgccaatcatccacaacgaaatttgcttcaagccatagactgtggaaatgcatgtgggcagaggtgtatcaagtcagggttagtgaagagatgcatctacttttgcaatctatgctgccagaaatgcaagtgtgtgccacctggcacctacgggaacaaggagagttgcccttgttatgcctccctcaagaactccaagggaaaggacaaatgcccatgattattattattagctaaacccatgtcatttagattagattaaatcttaaactaaacccaacttagtttaactgtggttttgggttgtaaatgaatagattatcatatgtcttgcccagttttgatccttgtgctcttctttaattactgtgtatagatccttaattttgtattataaaaaagcacatgaaagcaatcg

SEQ ID NO: 1942 - DNA, 580 bp, Artificial
  Synthetic
gtaagagtagtaagcatagacagcatagcattgcccaccacctctacctcagctttggagcagtgggcacttgctctctcttcctctctctctcagttatggctcgccttcatgcaattctcctactgttgcttgttctactcatcgctgtaactatgggatcccagggggtgaatttgaatagtggtgtgacctcatctgcaattggagatattaaggctcaggcaaggaacccatatagagtgcccctctcagggtgcccaaatgcttgcaacaaaagatgctcaggcacatccaaacgcaagccatgcatgttcttctgcaccaagtgttgtgcaacgtgcctctgtgtaccccctggtacatatggcaacaagcaagtatgcccttgctacaacaattggaagacccaacaaggaggacccaagtgcccttaattaggatcaccaatcacctcctcaccatccatgtcaagcattctcatgtggatggtacatgtgatatggctgagaagattattgctttttccacacaggtggaaccctataactactttataatagctcccctctcaagttag

SEQ ID NO: 1943 - DNA, 777 bp, Artificial
  Synthetic
tctttagacaaattatagcaatggctgcgaaactgagcattgtcttgtttgttattttggtagtttttttggcccaaaatcaggtttcaagggccaacctagtgcttgatgggaagcaacaaatgcagagaaataaccaaatgtatggtgttagtcagggaagcctccatcctcaagattgtctcccgaaatgcacatatcgctgctcacagacttcattcaagaaaccctgcatgtttttctgccagaaatgttgctcgaagtgtctgtgtgtgccccctggcacctatggcaacaaacaaacctgcccttgctacaataactggaaaaccaaggaaggtggccccaagtgtccctgattgtacccttccttccactattatctatatatccatctatatattgtgtgacagacacccaacttctgtcagttttcatctatctgtcaagtctattagtaactagcacttggttcaagtggtctgtgttagctagcaaatgatcaatttaagctccaatataaccactttttggcaaagccaggaagatgagttataatgcaatgacagtaactatgcgctagcaattgctcctagaaatctgtattctcgtcatactccatgcttgtatgcagcctattgacgagctatgtttatgagtagtagtagttcttatgctatttaatgcaatttcttaagaacttgtattttaagatatgtaatccatattctatttggtgttccttaccaatatgtgaatgatgccctatattaaagc

SEQ ID NO: 1944 - DNA, 600 bp, Artificial
  Synthetic
aaaacactaacaggcttatttgttctcaagaaaatcagcaatggccaaactcgtttcatttttccttttggcccttgttgccatatccatggttgcaaccactgttttggctgcagatgcccagtaccaccttgatacttcaaggtacggtccagggagcttgaagccatcacaatgcctgccacaatgcacgaggagatgtagcaagacacagtaccacaaaccatgcatgttcttctgccaaaaatgctgcaaaacatgtctgtgtgtcccccctggtttctatggaaacaaaggtgtttgcccttgctacaacaactggaagacccagcaaggaggacccaagtgcccttaattttactttatggaattcgttccccaatttaatttatgttgttgtttgtcggtattgttattaaatttgtcttgaatcaaaggtcataagttgtacgaccttgattctaattaagttacttttactgtattgctcctttgggccgaatactttttgtgttgcccgatgtgagagctctttgaccaattctttttggtctattgtacgttttaattactcttatctaatataacaaaatgttcttc

SEQ ID NO: 1945 - DNA, 643 bp, Artificial
  Synthetic
tgtgctccgccttcctctcaaaatgaaaattagggttttcttcgtcctggctcttctcctcttctcttcatcatttctccaagttgctagagctcaatccgaccctgaagcagaagtggttgagagtaccgaggaaggaggggatcttggaattgttggtgaggatgtccaagattttagcagtgagagttatagtcctgcacctgggattgaaacaatttgtgttttccctaaaaacccttctaaagtagtggcagctggtgaggagagtgagctttggttggaatgaaaaatgatggggaatcaaatctgaatatcattgccatccaagccagtgttcacctaccctttgatcatcgctatttggttcaaaatctttctgttcaggcttttaacaacgcaacagttcctccttctgctcaggctacctttccatatatatttgctgtcagcaaatttatgcagcctggaagttttgatctcgtgggcacaattatttacgagatagaccagaacgcttatcaaaatgtgttctacaatggaactattgaagtgactgaacctggtggtcttctcagtgttgagtctgttttcctgttttgtcttggagttgccctccttggtcttctcgggttctggatac

SEQ ID NO: 1946 - DNA, 581 bp, Artificial
  Synthetic
cgactgcgagccacacgcagccaccgcgcaaaacccacgcgaccccttcctcctccggctcgacccgatccgatctgagccagagccaaccatggcggcgactagggtttggctctccgccctcctcctcgccttcctcctcgccgccgcccccgtcgtccaagttgccagagctcagtccgaggaagaagctgctacagctgaagttgttgatggggctgatctaggaatcgtcagtgatgatacacaagtttccagcgatgggcctctaagtccggctcctggtgtggagacagtatgtgtttttcccaaaaacgctggcaaaattgtgctagcaggtgaagaaactgaactactggttggcctgcaaaacgagggtgaatcaactttgaatgttgttgctatccattcaactctccatcttccttttgaccataagatgtatggacaaaaccttactgttcagaacttcttcaatgcatcagttcctgtctctgtacaagcaacctttccggatacattcgccgtgagcaagttcttgcagcctggagcatatgatctagtgggttacatagtgtatg

SEQ ID NO: 1947 - DNA, 657 bp, Artificial
  Synthetic
gaattcagacaaacctcaaaagagaaaaagaagaaaaacattggttctcttttaccatcgatctaatcatcttcaccattcctatcaggtgtgaggtgtcaagctgattcagaggctgatttggatgatgttgtggctgatgttatcaaaggacatgaggaagctgaaactgttgatgaagatattcctgatttcaagagttggccttcagctccaggagttgatactgtctgtatcttccctaagaattttgccaaacttattccagctggtgaagagagtgaagtactagttggattgaagaatgagggtgaatcaaaattgactgtcattgcccttagagctagtctgcatcttcccttcgatcataatctgctggtgcaaaatctcactgttcagcaattttacaacggttctgtaccagtttcagctcaggctaccttcccctaccttttctctgttagcaagtacttgcagcctggaacatttgaccttgtaggaaccattatctacgagattaatcagaaaccctaccagagcactttctataacggcactgttgaagttgttgaggctggtggccttctcagcatcgagtctgttttccttatctgccttggactgggtcttctcgctctttctggcctgtgggtttat

SEQ ID NO: 1948 - DNA, 605 bp, Artificial
  Synthetic
caattcctgaaaagtccaaaagatggcacaatgtgagaaaaatttggaagcagaactggaagtactgagagagacatttaaatctgagaaaacaagagaagaatgttggagaagatcacagttacaaaatttgctcagacttcttgaagagaaagaagatgatatatacaaagcccttaaacaagacttgggaaaacaccacgttgaagcttacagagatgagattggaacattaataaaatctgtgaattatgcactggatggcttaaagcaatggatgtgtggcaagaaggccaaattgccaattgctgcatttcctgcttcagcggagttggttcctgagcctcttggtctagtcctcattatttcctcttggaattttccttttgggatatcattggaaccactaattggagcaatagcagctggaaatgtggttgttttgaaaccctcagaacaggctcctgcatcatcatcagtgttagctaagacaatctccacttacttggataataaagctattaaagtcattgaaggtgataattccgttggtgacaaactgttgcaacaaaaatgggacaagattttctttacagggagtacaa

SEQ ID NO: 1949 - DNA, 494 bp, Artificial
  Synthetic
attcacctcatgttctgcttgcaaagtttcaatacactggagtgagtcagtgaggttggtgaagcagagtgaggaaaggaggatgggaagggtggcgcctagcgtcgaggaggtcgggggcgagcagccgccgcccgcgcttgggcccggcgagaccgtgagcgggacggtggccgagctgagggcggcgtacgagagcggcaggacgcggagcctggagtggaggcagtcgcagctccgggggctcctccggctcttggcggaggaggaggccgccgcgttccgggcgctccgcgaggacctcggcaagcaccaagccgaggcctacagagacgagatcggcgtgcttgtcaagtcggcgaacgccgcgctgcgtgaggtcgggaaatggatggcgccggagaaggtctgggtgccgctaatcgcgttcccggcaagggcgcagctggagccgcagccgctcggggtcatcctcgccttctcttgctggaatg

SEQ ID NO: 1950 - DNA, 645 bp, Artificial
  Synthetic
attcacctcatgttctgcttgcaaagtttcaatacactggagtgagtcagtgaggttggtgaagcagagtgaggaaaggaggatgggaagggtggcgcctagcgtcgaggaggtcgggggcgagcagccgccgcccgcgcttgggcccggcgagaccgtgagcgggacggtggccgagctgagggcggcgtacgagagcggcaggacgcggagcctggagtggaggcagtcgcagctccgggggctcctccggctcttggcggaggaggaggccgccgcgttccgggcgctccgcgaggacctcggcaagcaccaagccgaggcctacagagacgagatcggcgtgcttgtcaagtcggcgaacgccgcgctgcgtgaggtcgggaaatggatggcgccggagaaggtctgggtgccgctaatcgcgttcccggcaagggcgcagctggagccgcagccgctcggggtcatcctcgtcttctcttgctggaatgtcccgttgggcctctctctggagcctctcgttggagcattggcggccggcaatgcggtcgcgctgaagccatcggagctggcgccggccaccgctaagttcctcggcgacaacgtcggcaaatacatggacgccacggccgtgaaggtcat

SEQ ID NO: 1951 - DNA, 436 bp, Artificial
  Synthetic
ggtagctaactactccatctagctaagacccgtagtgtatagtagtcaagatcaatggcgtcccgacgccttgccccgctgctggtcctactgctctcgtccagcctcgccgccggccagagcaccggcgacaccgtcgtgttctggggccggaacacggaccagctcgaggggtccctccgtgaggcgtgcgacaccggcctctacaccaccgtcatcatctccttcctcagcgccttcggctacatcccgggcacctacaagctggacatctccggccacaccgtctccgccgtcggccccgacatcaagcactgccagtccaggggcatcctcgtcctcctcgccatcggcggccagggcggcgagtactccctgccgacctcccaggcggccgtcgacctcgaggactacctctggaacgccttcctcggcg

SEQ ID NO: 1952 - DNA, 425 bp, Artificial
  Synthetic
ccaattaagcgtaagatcgatcatggcgccgcgatgcctggctgctcttgcacccctggccgtgctgctgctgctctcctcctgcctcgccgccgctccggcgacggcgcagcagagcagcagcatcggcgacaccgtggtgttctggggccggaacaaggccgagggctccctccgtgaggcctgcgacaccggcctctacaacaccgtcatcatctccttcctcagcgcgttcggccgcggcagctacaagctcgacctctccggccaccccgtcgtccccgtcggcggcgacatcaagtactgccagtccaagggcaagacagtcctcctcgccatcggcgggcagggcggcgagtactacctcccgtcctcccaggccgccgccgacctggacgactacctctggaacgccttcctcggcg

SEQ ID NO: 1953 - DNA, 552 bp, Artificial
  Synthetic
gtcgagccacgcgtccgaagttcacaacccaacacccaaaagcaaaagaaaagcagcaaccaaagatgtgcggcggagcgatccttgcggagctcataccgagcgcgccggcggcgaggcgcgtcacggcgggccacgtctggccgggcgacgccaacaaggccaagaagaagggcgcgcgcgccgacgacttcgaggccgcgttccgcgacttcgacaacgactccgatgacgaggagatgatggtggaggaggcggaggaggaggaggcgacctccgagcacaagccgttcgtcttccgcgccaagaaggcggcggcggcggcgtcgagcaggcgcaggaagccggcgcagtacaggggcgtgcggcgccggccgtgggggaagtgggcggcggagatccgcgaccccgtcaagggcatccgcgtctggctcggcaccttcaccaacgccgaggccgccgcgctcgcctacgacgacgccgcgcgcgccatccgcggggacagggccaagctcaacttcccttccgctaccacccctgacacccgcaagc

SEQ ID NO: 1954 - DNA, 560 bp, Artificial
  Synthetic
cccgatcacaagctcacaagttcagggcccaacacccaaaagcaaaagaaaagcagcaaccaaagatgtgcggcggagcgatccttgcggagctcataccgagcgcgccggcggcgaggcgcgtcacggcgggccacgtctggccgggcgacgccaacaatgccaagaagaagggcgcgcgcgccgacgacttcgaggccgcgttccgcgacttcgacaacgactccgatgacgaggagatgatgctggaggaggcggaggaggaggaggcgacctccgagcacaagccgttcgtcttccgcgccaagaaggcgaggaaggcggcggcggcggcggcgtcgagcaggcgcaggaagccggcgcagtacaggggcgtgcggcgccggccgtgggggaagtgggcggcggagatccgcgaccccgtcaagggcatccgcgtctggctcggcaccttcaccaacgccgaggccgccgcgctcgcctacgacgacgccgcgcgcgccatccgcggggacagggccaagctcaacttcccttccgctaccacccctgacacccgc

SEQ ID NO: 1955 - DNA, 635 bp, Artificial
  Synthetic
ctcactttccaccaaccactcccctttctctctatctctataattacagttaattcttcgtagagtcactccgacaagtatagaaattaccggataaaagaaatcggcaacaatggcagctacatttgctacagtgtcgaatttaggctcactctcagctcctcgagctactgtgaaccctacatatgcttctcctaagttggtgaaatcttcattctcatcgtcaagtttcttttctggctcgttgcgcctttctacttcatccaaccgtttggttcacaaaaaaaccagcggtttatccggctccattcatgccgcagtgcaggtggccgaggtgcaatccaaagtgacacacaaagtttattttgatattagcattgggaatcctgttggaaagcttgctggacgaattgtaattggattatatggtgatgatgtgccacaaacagcagaaaatttccgtgcactctgcacaggtgagaagggctttggctacaaggattctgcatttcatcgtgttattaaagatttcatgattcaaggaggtgatttcgataaaggaaatggaaccggtggtaaaagcatatatggtcgtacctttaaggatgaaaacttcaagttgactcatactggac

SEQ ID NO: 1956 - DNA, 755 bp, Artificial
  Synthetic
cccccccggagcgagagagagagaaagggtctcctcctcaacatcaacaatggcggtcgcaacctccttcgccacactcgccatcgcgcggccggcggcggagcgggccctcctcgcctccaaaaccccctcgccgctcctctccatccgcaccggcaccggcaccgcacgcctcccctcatcggccgtctttggaggtttcactcctgcgctttccgctgctcacagccgcgcgcgcttcgtctcctccgccaccgctgaccccaaggaagtggacctccagtccaaaatcacaaacaaggtgtactttgacataagcatcggaaaccctgttgggaagaacgttgggagggtcgttattggcctatacggggatgatgttccccagaccgcagagaacttccgtgctctttgcactggagaaaaagggtttggttacaaggggtccagtttccaccgtgtcattaaggacttcatgattcagggaggagactttgacaagggcaacggtactggagggaaaagcatatatggccggaccttcaaagacgagaacttcaaattggttcatactggacctggagtggtcagcatggccaatgctgggccaaacaccaatggcagccagttcttcatctgcactgtcaagacaccttggttggatgggaggcacgtcgtgtttgggcaggttattgaaggcatggacatcgttaagatgatcgaatcgcaggagactgacagaggggaccgcccga

SEQ ID NO: 1957 - DNA, 592 bp, Artificial
  Synthetic
agggtctcctcctcaacatcaacaatggcggtcgcaacctccttcgccacactcgccatcgcgcggccggcggcggagcgagccctcctcgcctccaaaaccccctcgccgctcctctccatccgcaccggcaccggcaccgcacgcctcccctcatcggccgtctttggaggtttcactcctgcgctttccgctgctcacagccgcgcgcgcttcgtctcctccgccaccgctgaccccaaggaagtggacctccagtccaaaatcacaaacaaggtgtactttgacataagcatcggaaaccctgttgggaagaacgttgggagggtcgttattggcctatacggggatgatgttccccagaccgcagagaacttccgtgctctttgcactggagaaaaagggtttggttacaaggggtccagtttccaccgtgtcattaaggacttcatgattcagggaggagactttgacaagggcaacggtactggagggaaaagcatatatggccggaccttcaaagacgagaacttcaaattggttcatactggacctggagtggtcagcatggccaatgctgggccaaacacca

SEQ ID NO: 1958 - DNA, 527 bp, Artificial
  Synthetic
agaaaggtttgaggaaaaagaagagggagggaagaaaggggaggttcttcttgctattgtaatggcgactatccccgtgaacccgaagcccttcctgaataaccttaccggcaagcctgttatcgttaagcttaaatggggcatggagtacaaaggttatcttgtctcaatcgactcatacatgaacttacagcttgcgagcactgaggaatatatcgatggaaaactgacaggcaaccttggagaagtgctaatcaggtgcaacaatgtgctctatttacgaggtgttcctgaagatgaagatatcgatgaagcggaataacaagatgtaattcttgatcagcagctgagttgggaatgatctggagtgttccggaactttgtgtacgatgcaaaacaatttgggatgcggttgtgaaaacccctattttaggagttggacttagaaaaagacccattaacatacacataagagtagtgctaccacatgtaaaagacactttttgaaatttaagtcttttttattg

SEQ ID NO: 1959 - DNA, 530 bp, Artificial
  Synthetic
cacgcatccccgaccagcaccggcaccggcggcggcgggggctaccccccttcaatggcgactgtgccagttaacccgaagcctttcttgaacaacctgacagggaagcctgtcattgtcaaacttaagtggggtatggaatacaaaggatatcttgtttctgtcgactcttatatgaatctgcagctggctaatacagaggagtatattgatgggcaattctctggaaacttgggtgagatactgataaggtgcaacaacgttttgtatctccgaggcgttccagaggataccgagatagaggatgcggaatgagatagcccgggccatgtccagattgattattgtaatatgctgctgacatgaacaattaagtgtcatgtacaactgatgcagattgacctggatctttaactatgccatgatatggtaatgttatgcgttgaaactgtcgttgctcggaatgtgtgagatcatatttcgtaagaaaataccatttgcctgtcatgattagccaaattagataagct

SEQ ID NO: 1960 - DNA, 738 bp, Artificial
  Synthetic
gggctctcgtgttctctcactagatccctctttccaaagctttcttcagggatccttaagaagaaagagaaatggggctgacattcaccaagcttttcagccggctatttgccaagaaggaaatgcgtattctcatggttggtcttgacgctgctggtaagaccaccatattgtacaagctcaagttgggcgagatcgtcaccactattcctactattggtttcaatgtggagactgttgagtacaaaaacatcagcttcacagtttgggatgttgggggtcaggacaagatccggccattgtggaggcactatttccagaacactcagggtctcatttttgtggttgatagcaatgacagagaccgtgttgtggaggcaagagatgaattgcaccggatgttgaacgaggatgagcttcgggatgctgtgctgcttgtttttgctaacaaacaagatcttcctaatgcaatgaatgctgctgaaataactgataagcttggactccactccctcaggcagctgtcactggtacatccagagcacttgtgcaacttctggagagggactttatgaggggcttgattggctttctaacaatattgctaacaaggcctaaaccaacgtagagttgttgcgggttgatcctggatgcagtcgggtttttatctagttctttttcctttttcccccattctcagaatctgtgtggttatgaatatcccttgaaagtgatttg

SEQ ID NO: 1961 - DNA, 756 bp, Artificial
  Synthetic
agccttttctctttctcttgcgcagaaggaaaaaaaggggagcgaggccaacaaacgaccctcacctttctctctgctctgccggatcgccggatcgaatccgcccccaacccccccagatcgccgatcctcgttgcgcggatctgtggagaatcgtcattgtcggccttctcttcctttctctcttgcccttgcccctgcccttctcctgccggaggagaagaagccgtcgccatgggcctcagctttgggaagctcttccaacgcctcttcgctaagaaggagatgcggattctgatggtgggactcgatgccgccggaaaaaccaccatcctctacaagctcaagctgggggagatcgtcaccaccatccccaccattggtttcaatgttgagactgtggagtacaagaacatcagcttcactgtgtgggatgtcgggggtcaagataagatccgacctttgtggagacactactttcaaaacacccaagggttgatttttgtggtagacagcaatgatagggaccgtgccatcgaagcacgagatgaattacacagaatgctgaatgaggacgagcttcgggatgccgtgcttcttgtctttgccaacaagcaggatctaccaaatgctatgagtgctgccgagattactgataagctcggccttcattctttacgacagcgccactggtacattcagagcacatgtgcaacatcaggagagggattatacgaaggtctggactggctctca

SEQ ID NO: 1962 - DNA, 665 bp, Artificial
  Synthetic
ggcataggcagctttcggccccctttccctgtgaagagaagagaagagatggtggtgatatgatataggcctgggatcgattcctgttcccgcctgcccatccggatccgatctcccccgatctgtgtgtgctgttggtgaagaagaaaaagatgggtctctccttcggtaagctgttccagcgcctctttgccaagaaggagatgcgcatcctgatggtgggccttgatgccgctggtaaaaccaccattctttacaagctcaagctcggggagatcgtcactactatccctactatcggtttcaatgttgaaactgtggagtacaagaacatcagcttcactgtgtgggatgttggaggtcaagataagatccgacccttatggaggcactattttcaaaacactcaaggtttgattttcgtgatagacagcaatgatagggaccgtgctgttgaggcacgagatgaattacacagaatgctgaatgaggatgagcttcgggatgcagtgctgcttgtctttgcaaataagcaggatctaccgaatgccatgagtgctgctgagatcactgataaacttggccttcattctctacgacagcgccactggtacattcagagtacttgtgcaacatcaggagagggcttgtacgaaggtctggac

SEQ ID NO: 1963 - DNA, 592 bp, Artificial
  Synthetic
agagctcgaagcacaacagggggaaggaagatggggctgagcttcacgaagctgttccagaggctgtttgcgaagaaggagatgcgcatcctgatggtgggtctcgacgctgctggaaagaccaccatcctttacaaactcaagctcggcgagatcgtcaccaccatccccaccattggttttaatgtggagactgtggagtacaagaacatctctttcactgtttgggacgtggggggccaggacaaaataagacccttgtggaggcattactttcagaatacccaaggcttgatattcgtagtggatagcaacgacagagatcgtgccgtggaggcacgtgatgagctacataggatgttaaatgaggatgagcttcgggatgcagttcttcttgtatttgccaacaaacaggatcttccaaatgccatgagtgctgcagaaatcacagacaagcttggccttcactctctacgccaaaggcactggtatattcaaagcacttgtgccacatctggagaaggcttatacgaaggcttggactggctctccaacaacattgctagcaaggtatagaagatgttatatctcg

SEQ ID NO: 1964 - DNA, 636 bp, Artificial
  Synthetic
ctttccgatcactacatattttccagcgttaatctcaggtttgtcctctcattagatccctcctccaaaagctcttttcagggatcatcaacaaggaagctaaatggggctgacattcaccaagctcttcagtcggctttttgccaagaaggaaatgcgcattctaatggttggtcttgatgcagctggtaagactaccatattgtacaagttgaagttgggagagatcgtcactaccattcccaccattggtttcaatgtggagactgttgagtacaagaacatcagcttcactgtttgggatgtcgggggtcaggacaagatccgtccattgtggaggcactacttccagaacactcagggtctcatctttgtggttgatagtaatgatagagatcgtgtcgtagaagcaagagatgaattgcataggatgttgaatgaggatgaacttcgggatgctgtgctgctagtttttgctaacaaacaagatcttcctaatgcaatgaatgctgctgaaataactgataagcttggactgcactctctcaggcagcgtcactggtacatccagagcacttgtgcaacatctggagaggggctttatgagggacttgattggctttctaacaacatcgc

SEQ ID NO: 1965 - DNA, 800 bp, Artificial
  Synthetic
cagtatttggcgttaatctcaggcttccatttctctcattctctctctacattttctccttctctcttcgttagatccctctttcaaaagcttctttcagggatcatcaacaagaaggggaaatggggctaacattcaccaagcttttcagccggcttttcgccaagaaggaaatgcgaattctcatggttggacttgacgcagctggtaagaccaccatattgtacaagctcaagctgggggagatcgtcactactattcctaccattggtttcaatgtggaaactgttgagtacaagaatatcagcttcactgtttgggatgttgggggtcaggacaagattcgtccattgtggaggcactatttccagaacactcagggtctcattttcgtggttgatagcaatgacagagaccgtgttgttgaggcaagagatgagttgcacaggatgttgaatgaggatgagcttcgggatgctgtgctgcttgtttttgctaacaaacaagatcttcctaatgcaatgaacgctgctgaaataactgataagcttggactgcattccctcaggcagcgtcactggtacattcagagcacgtgtgcaacatctggagaggggctttacgagggtcttgattggctttctaacaacattgccaacaagtcctaaggcgacggagagtttttgcgggttgatcctggatgcaggcgtatttttatctagtttcttttcccaagtctggctatgaaccattgtcttgacaggcattttgcatcttgttagggcttaatgaaatggctc

SEQ ID NO: 1966 - DNA, 864 bp, Artificial
  Synthetic
gaattcagaagaagaagaagaagaaagaagatctctgtctttctctccatccccctgtatacacctctttccctgcaaagatggggctgtcattcaccaagttatttagtaggctgtttgccaagaaggagatgagaattcttatggtaggtctagatgcggctggtaagactacaatattgtataagctcaagttgggagagattgttaccaccattcctaccattggatttaatgtggagactgtagagtacaagaacatcagtttcactgtgtgggatgttggaggtcaagacaagatccgacccttgtggagacattacttccaaaacacccaaggtcttatcttcgtggttgacagcaacgatcgtgatcgtgttgttgaagctagagatgaactgcataggatgttgaatgaggatgagttgagagatgctgtgcttctagtgtttgctaacaaacaggatcttccaaatgcaatgaatgctgctgagatcactgataagcttggtcttcactctcttcgtcaacgacactggtacatccagagtacatgtgcaacttcaggagaagggttgtatgaaggtcttgactggctctccaacaacattgctaacaaggcatagaagtctcaacattgatattttggcctatgttggttgaatgttgaattatttagtattttcgtcatcataaatgtcgttactgtatgtgtcttcttgttcgtatatttctctccccctgttaattgttgagaaaggaattgttcttaatacctttcttatgtgaatgatttctatgttacagactacatttgtttctctttagatccataataattgcagagcatattaaaaaaaaaaa

SEQ ID NO: 1967 - DNA, 434 bp, Artificial
  Synthetic
tctctctctctctcttcttcttctttaatacacagagagagagagacagacactcagagagagagaggatggggctgaccttcacgaagctcttccagcgcctctttgccaagaaggagatgcggatcctcatggtgggcctcgacgccgccggaaagaccaccatcctctacaagctcaagctcggagagattgttaccaccatccccaccattgggttcaacgtggagacagtggagtacaagaacatcagcttcacggtgtgggatgtggggggccaaaacaagatccgaccgctctggagacactacttccagaacacgcagggtcttatctttgtggttgatagtaatgacagacaccgcgccattgaggcccgtgaggagctgcacagaatgctcaacgaggatgagctccgtgatgctggcctcctc

SEQ ID NO: 1968 - DNA, 661 bp, Artificial
  Synthetic
cccacgcgtccgatccctgctcctccccaacccatcgcttcccccctccacccgtctcctccgtctccggcgccggcgccggcgagctcgccccccgcgattcgtgccctccgatcagaggcgaggcgggagaagagatggggctcacgttcaccaagctgttcagccggctattcgccaagaaggagatgcggatcctgatggtgggtcttgacgcggccggaaagaccacaatcctctacaagctcaagctcggcgagatcgtcaccaccatccccaccatcggattcaatgttgaaaccgtggagtacaagaacatcagcttcaccgtctgggatgtggggggtcaggacaagatcaggcctctgtggaggcattatttccagaacacccagggtctcatctttgttgtggacagcaatgatagggaccgtgttgtcgaagccagggatgagctccacaggatgctgaacgaggatgagctacgtgatgctgtgctgcttgtctttgctaacaagcaagatctgccaaacgctatgaatgctgctgagatcactgataagcttggactgcactcccttcgccagcgacactggtatatccagagcacttgtgctacaacaggtgagggattgtacgagggcctggactggctgtccag

SEQ ID NO: 1969 - DNA, 685 bp, Artificial
  Synthetic
atttttattctctaaatccctttccttcgtcaaaaaggcagttctcagatcaaagatcaattattcaactttatttcctcaccaatcaaattattgatcttcgactctaattctgataatcgcgatctggatttttaatcaattttttggatcagatctataaattatgggaggtttcatatcgagattctggttcatgatgttcccagcgaaagagtacaagatcgttgtagttggattggataacgctggtaaaacgacgacgctttacaagttgcatttaggagaggtcgttactacaaatcctactgttggtagtaatgttgaggagcttgtttacaagaacatacgatttgaggtctgggatcttggtgggcaagaaagactgagaacatcatgggcaacatactatcgtggaactcatgctgtcattgcagttatcgatagtactgacagagcccgtatctccattatgaaagatgagctgttcaggttgctcccacacgaggatcttcaaagtgcagttctactagtctttgcgaacaaacaggaccttaaagatgccatgacccctgcagagataaccgatgcgctttcccttcatagcatcaagaaccatgattggcatattcaagcctgcagtgcactgactggtgacggtttatacgatggtttagggtggatt

SEQ ID NO: 1970 - DNA, 581 bp, Artificial
  Synthetic
gtctcctccgtctccggcgccggcgccggcgagctcgccccccgcgattcgtgccctccgatcagaggcgaggcgggagaagagatggggctcacgttcaccaagctgttcagccggctcttcgccaagaaggagatgcggatcctgatggtgggtcttgacgcggccggaaagaccacaatcctctacaagctcaagctcggcgagatcgtcaccaccatccccaccatcggattcaatgttgaaaccgtggagtacaagaacatcagcttcaccgtctgggatgtggggggtcaggacaagatcaggcctctgtggaggcattatttccagaacacccagggtctcatctttgttgtggacagcaatgatagggaccgtgttgtcgaagccagggatgagctccacaggatgctgaacgaggatgagctacgtgatgctgtgctgcttgtctttgctaacaagcaagatctgccaaacgctatgaatgctgctgagatcactgataagcttggactgcactcccttcgccagcgacactggtatatccagagcacttgtgctacaacaggtgagggatt

SEQ ID NO: 1971 - DNA, 613 bp, Artificial
  Synthetic
ctatctcctctccctctccgcccatttctcctctccacctgcgatccatccgcgcccgcgaggaggagggagccggacgccgccgcggggagagcaggggagagaaggagaggaggagatcgccgtcgccgtcgccgtcgtcgatctcgagcgggagcggagatggggctcacgttcacgaagctgttcagccgcctcttcgccaagaaggagatgaggatcctcatggtcggtctcgatgcggccggtaaaaccaccatcctctacaagctcaagctcggcgagatcgtcaccactatccccaccatcggttttaatgtcgaaactgttgagtacaagaacattagcttcaccgtttgggatgttggtggtcaggacaagatcaggcccctgtggaggcactatttccagaacacccagggcctcatttttgttgtggacagcaatgacagagagcgtgttgttgaggccagggatgagctccaccgtatgctgaatgaggatgagctacgtgatgctgtgctgctggtgtttgcaaacaaacaagatcttcctaatgccatgaacgctgctgagatcaccgacaagcttggtctgcactccttgcgccagc

SEQ ID NO: 1972 - DNA, 575 bp, Artificial
  Synthetic
gatccaaaccaaaccctccaatttccagatctccacatcgcgcttgaaaaaactctacctataactattactaaagaagatatattagggagatcgaaagatctcaatatagattctaccggggagaaagaaggggagcaattaccaccgttggatctgtctctgaatttcatgctcatctgattacttgtttgcctctaactgaaacaaacaatgggcattctggttactaaaatgtcctcttctgtttttggtaacaaagaagctcggatccttgttcttggccttggcaatgctgggaaaactaccattctctatcgtcttcgaatgggagaagtagtatcaacaattccaacaattgggtttaatgtggaaacagttcaatataacaatatcgaatttcaagtctgggatcttggtggtcagacaagtattagaccctattggagatgctatttcccaaatactcgagcaattatctatgtgatagatgccagtgacactgataggattgcaatagcaaaagaagaatttcacgctatattggaggaggatgagttaaaaggtgcagttgt

SEQ ID NO: 1973 - DNA, 610 bp, Artificial
  Synthetic
aggctttttcttccacatagatcagatccaatattgccaaaagaggactgagattccagatcccattctctctctccttgtctgtgtgaagcaggggagagactgagcctagccatcatggggctcaccttcaccaagctcttccagcgcctcttcgccaagaaggagatgcgcatcctcatggtcggcctcgacgctgccggaaagacaacgatcctttacaagctcaagcttggcgagatcgtcaccaccattcccaccattggttttaatgttgaaactgttgagtacaagaacatcagcttcacggtgtgggatgttgggggccaagataagatccgtccattgtggaggcattatttccagaatacccaaggcctcatatttgtggtggatagcaatgacagggatcgtgccatcgaagctcgagatgaactgcaccggatgctcaatgaggatgagcttcgggatgcagtgctccttgtttttgcgaataagcaagatttgccgaatgcaatgaatgccgcagagatcactgacaaactaggcttgcactctcttcgtcaacgccactggtacattcagagtacctgcgcaacttcaggggaag

SEQ ID NO: 1974 - DNA, 638 bp, Artificial
  Synthetic
aagaggatggggctgctgacgatcatccgcaaggtaaagcggaaggagaaggagatgcgcattctcatggtgtaagatctctgctttgatctgtcgctcgacctctctttcttctcgctgtgcggcagaggattggacaatgcgggcaagacgaccattgtcaagcgaatgaatggcgaggacatcagcgatatcagccctactcttggatttaacatcaagacgatgcgttatggcaaactgaacatatgggacgttggtggccaaaagactttaagatcgtactggaggaactactatgagcaaacagatggtttagtgtgggtggtggatagcgctgatttgcgtcgcctcgacgactgcaagaaggagctacacaatcttctcaaagaggagcgtcttgccggagcttccctactgatactggcaaacaagcaggacatagatggtgctttgaacgtcgacgagatctcaaaggtactgcggctcgatttgatggacaaaagcaggcattctcgaactgtcgggtgcagtgcagtcactggtgatggattactcgaagcattcgactggctggtctcggacataggctcgcgtatttatctcctggactaggtggatgcttgcacgaaggaaag

SEQ ID NO: 1975 - DNA, 591 bp, Artificial
  Synthetic
gagagagagagagagagagagagagcgcatttgcatttccgtttgcgtttgcatttggatttggatttggatttgtgagattcgtttgtggccttcccccttctccctctgcaggatttgagcttcccttctctcaagcaagtgattattcacacttacatctgtattgcaaaacggccccatctcaaccgatcttgatttagagcagattcctggacagatctttctgacgaatttctgagaatgggggctattatgtcccgcctctggttccttctgtttccgtcgaaagagtataaaatggtcgtggtaggattggacaatgctgggaagacaaccactctctacaagctgcacttaggggaagtggtggtcactcaggccactgtgggaagcaatgtcgaggagatcatctataagaatatcaagtttgaggtatgggatttaggtggccaagaacgtcttcggagatcttgggtgacgtattacaaagggactcatgcggtcgtgatggtgatcgacagcacggatcgtgctcgtatctctatcgtgaaagacgagctgttccggcttctccagcacgaggacctc

SEQ ID NO: 1976 - DNA, 454 bp, Artificial
  Synthetic
ttccaggccagtctaggagagacagacagacagagagagagagcgataccaggagagagagacagagatagagagatagagagaaggtgaggccaggagagagagagaaagagacagagagaaagatggggatcaccttcgggaggctgttcgagcggttgtttgcaaagaaggagatgcggatcctgatggtgggcctcgacgctgccggaaaaaccaccgtcctctacaagcttaagcttggcgaagttgtcaccaccatccctaccattggtttcaacgtggagacggtcgagtacaaaaacataagctttactgtgtgggatgttgggggtcaggacaagatcagacctttgtggaggcattactttcagaacacacaggggttgatatccgttgtggatagcaatgaccgagaccgtgcagtggaggcccgtgatgagcttcataggat

SEQ ID NO: 1977 - DNA, 652 bp, Artificial
  Synthetic
gcgagaacagaacatccatagctttcgcattttattgtcatttctaaagggcagagtcttttctagatctgcccctctttctcgctctctcctgattcgttgttcatcactgcattgagaaaagatgggtttatcattcgggaagcttttcagtcggctgtttgccaagaaggagatgcgtattctgatggtcggtcttgatgcagctggtaaaaccaccatattgtacaagctcaagctgggagagattgttaccaccattcctaccattggattcaatgtggagactgttgaatacaagaacataagcttcactgtctgggatgttggtggtcaggacaagatccgaccattgtggaggcattacttccaaaacacacaaggacttatctttgtggtcgatagtaatgatcgtgatcgtgttgttgaggctagagatgagctgcaccgaatgttgaatgaggatgaactgagggatgctgtgctgcttgtgtttgctaacaagcaagatcttccaaatgctatgaatgctgctgagattactgacaagcttggtcttcactctctccgccaacgtcactggtacattcagagcacttgcgctacctctggagaagggttgtatgaggggcttgactggctctcaaacaca

SEQ ID NO: 1978 - DNA, 643 bp, Artificial
  Synthetic
ccccaccgcacccgcaagcgcaagcccagccgcctcgtcgtgttcgcgttcgtcgcgcggctccgacctccaaagccgccgctacccttcccgtcttcgtcgtcgccgcgcacgcagatcgcgaaccagcccgcgcgccgcgcagcagcgccgcggagaggaaaggagagctccgccgcgcaccccccgccaccatctcgtagggagagatggggctcacgttcacgaagctgttcagccgcctcttcgcgaagaaagagatgaggattctcatggtcgggctcgatgcagccggtaagaccaccatcctctacaagctcaagcttggcgagatcgtcacgaccatccccaccatcggatttaatgttgaaaccgtggaatacaagaacatcagcttcactgtttgggatgtcggtggccaggacaagatcaggcccctgtggaggcactatttccagaacacacagggactcatctttgttgtggacagcaatgatagggagcgtgttgttgaggccagagacgagcttcacaggatgctgaacgaggatgagctgcgtgatgctgtgctgcttgtatttgcaaacaaacaagatcttcctaatgccatgaatgcagctgaaatcactgacaagcttggttt

SEQ ID NO: 1979 - DNA, 687 bp, Artificial
  Synthetic
cccctctctctccccatctatctcctctccctctccgcccatttctcctctccacctgcgatccatccgcgcccgcgaggaggagggagccggacgccgccgcggggagagcaggggagagaaggagaggaggagatcgccgtcgccgtcgccgtcgccgtcgccgatctcgagcgggagcggagatggggctcacgttcacgaagctgttcagccgcctcttcgccaagaaggagatgaggatcctcatggtcggtctcgatgcggccggtaaaaccaccatcctctacaagctcaagctcggcgagatcgtcaccactatccccaccatcggttttaatgtcgaaactgttgagtacaagaacattagcttcaccgtttgggatgttggtggtcaggacaagatcaggcccctgtggaggcactatttccagaacacccagggcctcatttttgttgtggacagcaatgacagagagcgtgttgttgaggccagggatgagctccaccgtatgctgaatgaggatgagctacgtgatgctgtgctgctggtgtttgcaaacaaacaagatcttcctaatgccatgaacgctgctgagatcaccgacaagcttggtctgcactccttgcgccagcggcactggtacatccagagcacatgtgctacctctggtgaggggttgtatg

SEQ ID NO: 1980 - DNA, 804 bp, Artificial
  Synthetic
actaccccaaatcctgttgacgccatcgtcgctccatttacatcttttgcacaccacctgagaaagataataaaattcgcctcactgctttttttctccgtttcaacttgactttgcctgcttacgcgtagcatcaaacaggacctttttttttctcttctattcacatattcgacgtttgttaggccgcgtcgccgccagtcgcaatcatgggtctcgccttttctaagattttcgacaagctgtgggggaagaaggagatgagaattctcatggtcggtctcgatgccgccggtaaaaccaccattctgtacaagctgaagcttggtgaaatcgtcaccaccatccccactattggcttcaacgtcgagactgttgagtacaagaacatccagttcaccgtgtgggatgtcggtggtcaggacaagatccgtcctctgtggagacactacttccagaacacccagggcatcatcttcgtcgtcgacagcaacgatcgggatcgtatcgtcgaggcccgagaggaacttcagcgtatgctgaacgaggatgagctgcgagatgccatcctgctcgtcttcgccaacaagcaggatctgcccaacgccatgaacgctgccgagatcactgacaagctcggccttcacagcctgaggcaacgtgcctggtacatccagtcgacttgtgccacatccggagatggtctgtacgagggtctcgaatggctcgccaccactctccgaaaggctggtcaccagtaaacagactaccccaggaccctctaccggtagagcctcccgctct

SEQ ID NO: 1981 - DNA, 732 bp, Artificial
  Synthetic
acgcgtcggttcttggctgtctagggcgatcgatctctccatcgccgctgcggatcgaagctcgccgccatggggctcaccttcaccaagctcttccagcgcctcttcgccaagaaggagatgcgaatcctcatggtgggtctggatgccgcgggtaagaccaccatcctctacaagctcaagctgggcgagatcgtgacgaccattcccaccatcgggtttaatgtggagactgtcgagtataagaacatcagcttcaccgtgtgggatgtcggaggtcaagacaagatccggccattgtggagacactatttccagaacactcaaggtctgattttcgtggtggacagcaacgatagagaccgtgttgtggaggccagggatgagctccacaggatgctcaacgaggacgagctgagagatgcggtgttgttggtgttcgccaacaagcaagatcttcccaacgccatgaacgcggccgagatcaccgacaagctcggcttgcattctctccgccagcgccactggtacatccagagcacttgcgccacctctggagagggtctctacgaaggactcgactggctgtcgaacaacatcgcgaacaagggctgagtgatcagtaccgatcgatccatttgaagttttgcgctttcatcatcatgactatctacaatatatagattacaaaaatgtggcttttgttctcttaggtctagatataaatttgtg

SEQ ID NO: 1982 - DNA, 677 bp, Artificial
  Synthetic
cacccacaccatcaccagcacgcacaggctctcttgaatatcgcccgttcgagagtcttttcaccgcctctacaccttcctccctacacaccacacacccgccaatatgggtctcacattctcgaagcttttcgataagctatggggcaagaaggagatgcgcattctcatggtcggtctcgacgctgccggaaagaccacaattctctacaagctcaagctcggtgaaatcgtcaccaccatccccaccattggtttcaacgtcgagacagtcgagtacaagaacatctccttcaccgtgtgggatgtcggtggtcaggacaagatccgtcctctctggaggcattacttccagaacacccagggtatcatcttcgttgtcgacagcaacgatcgcgaccgtgttgttgaggcccgtgaggagctccagaggatgttgaacgaggacgagctgagggacgcccttctcctggtcttcgccaacaagcaggatttgcccaacgccatgaacgctgctgagatcactgacaagcttggccttcacagcctccgacaacgcgcctggtacatccagtcgacctgcgctacatccggtgacggtctgtacgagggtctcgagtggttgtccaactccctccgcaaggccggtcacaactaagctcctctaccccgtacgt

SEQ ID NO: 1983 - DNA, 577 bp, Artificial
  Synthetic
ggctttttcttccacatagatcagatccaatattgccaaaagaggactgagattccagatcccattctctctctccttgtctgtgtgaagcaggggagagactgagcctagccatcatggggctcaccttcaccaagctcttccagcgcctcttcgccaagaaggagatgcgcatcctcatggtcggcctcgacgctgccggaaagacaacgatcctttacaagctcaagcttggcgagatcgtcaccaccattcccaccattggttttaatgttgaaactgttgagtacaagaacatcagcttcacggtgtgggatgttgggggccaagataagatccgtccattgtggaggcattatttccagaatacccaaggcctcatatttgtggtggatagcaatgacagggatcgtgccatcgaagctcgagatgaactgcaccggatgctcaatgaggatgagcttcgggatgcagtgctccttgtttttgcgaataagcaagatttgccgaatgcaatgaatgccggagagatcactgacaaactaggcttgcactctcttcgtcaacgccactggta

SEQ ID NO: 1984 - DNA, 356 bp, Artificial
  Synthetic
cccacgcgtccgattgctctttcaaatttcttcgagtctctctcgctctctccgtttcttcgcgggctctctctctcagatctctccgaaacattcttcgtagtgaagcaaaatggggttgagtttcgccaagctgtttagcaggctttttgccaagaaggagatgagaattctgatggttggtcttgatgctgctggtaagaccacaatcttgtacaagctcaagctcggagagattgtcaccaccatccctactattggtttcaatgtggaaactgtggaatacaagaacattagtttcaccgtgtgggatgtcgggggtcaggacaagatccgtcccttgtggagacactact

SEQ ID NO: 1985 - DNA, 789 bp, Artificial
  Synthetic
aagcagacccttgagctttctctgaagtaaagcaaaaggggggcaaatgggattagtgttttcgcgattgttctcatcgttatttgggaataaggaagctcggatcttagttcttggactcgacaatgctggaaaaacaaccattctctatcggcttcagatgggtgaagtagtttcaactattccaacaattggatttaatgttgagacggtgcagtataacaatataaagtttcaagtttgggatctagggggtcagactagtatcaggccatactggagatgctattttcctaatacgcaagctataatctacgttgttgactcaagtgacactgataggctcgtggttgctaaggaggagttccatgccatattggaggaggaagagttaaaaggcgctgttgttctcgtatatgctaacaagcaggatcttcctggtgcacttgatgatgctgcagtgaccgaggccttagagttgcacaagattaaaaataggcaatgggctatttttaagacttctgccatcaaaggagagggcctttttgagggtttggactggttgagtaatacactcaaatccggaggtagatgcagctaatttttaagacaagacagacaaacgcgaacttggtataatgtgtgaagagataccggctccgacattttctaattgtcatagtttctgaagtgaactgctctgatatagtgttaatacttgtcacagataatgagaatacgatgttttatttttgcctctcttcatagattacagctattccgtttctc

SEQ ID NO: 1986 - DNA, 947 bp, Artificial
  Synthetic
cctaatttatctctctttccgtgccagagcagagggaaacgcggctaacgacagctccattcctagatctacatactcaattttccgatcgtcgatctccgttatacagagatggggctgtctttcggtaaacttttcagtcgcctctttgctaagaaagaaatgcgtattcttatggttggtcttgatgctgctggtaaaaccacaattctttacaagctcaagttgggggaaattgttaccactatccctactattggcttcaacgtggagactgttgaatacaagaacatcagctttactgtgtgggatgttggaggtcaagacaagattcgaccactatggaggcattatttccagaacacacaaggcctcatctttgtggttgatagcaatgaccgagatcgtgtagttgaggctagggatgagcttcataggatgttaaatgaggatgaattgagagaggctgtgctgcttgtttttgcaaacaaacaagatcttccaaatgcaatgaatgcagctgaaatcaccgataagcttggccttcattctcttcgacaacgacactggtatatccaaagtacgtgtgccacttctggagaaggattgtacgaaggactagattggctttcgaacaatatttcaaacaaggcataggtcatcccatgaggttgcactccagcccacgttccttaatttggagtacaaatgttaaacaccatagcttttatcattatctcttagtttggtggtttagacttctgtttcatatcttctgtggtcatagaagtgattaaactctgaaaatcacccgcctttctttcatttttggttttcttattaatgaaatctcattgtcaacaatacttgtgggtcagctaccacattgctggatgtgcacatttgtaatgtgaacacactttagtacaatactggctttcgtatcc

SEQ ID NO: 1987 - DNA, 460 bp, Artificial
  Synthetic
gggtggctaggtcgtgatctggcgcggatcgaatttccgggcggcgatgttctcgctgttgtatgggctgttcaagtccatacaatatctcttcagcaaggcggagttccacgttttgatcctcggcattgacaaggcggggaagactacgctgctggagaagctcaaaacgatctactcggatttcgagggcctgccgccggatcgaatcgttcccactgtcggcctcaatattggccgcgtccaagcttaccagtcgaagcttattttctgggatctaggaggacagctaagcctgaggacgatctgggagaaatatttcgaagaagctcatgctattgtctttctggttgatgccacaaaccatgctcgatttgacgatgcaaagtcggcccttgagaaagctctgagacacaaggatttgcaagacgctccattgctcatctttgctaacaagcag

SEQ ID NO: 1988 - DNA, 463 bp, Artificial
  Synthetic
cccccccgacggatccattctttattggtggcatcatcattatccaattctcaccgatccatcgaacgaacgatccaacaactaaatcaacagtacatagctaggaagcatggcccgtgcacagttgagagttggacgccctggtggcagaatctgctcctcgccgcccacgcacgccgacgtggccatacacctgcggccaggtcaactccgccgtcgggccctgcctgacctacgcccgcggcggcgccgggccgtcggcggcctgctgcagcggcgtgaggagcctcaaggcgggagcaagcacgaccgcagaccggggcaccgcctgcaactgccacctagtagattctgcctgggtcgatgtgtggagccgaattctgtatccagcactagtagtatcatatctgcattctggaataaaagatgagctagctaaggtctcgatcaatcaccatgcatg

SEQ ID NO: 1989 - DNA, 619 bp, Artificial
  Synthetic
gaattcagagataacagataacaaaagaaagggtcggtttactaagaaatggcaaactccagcaacaatgcagtcaaggttgtgagtactttggtgttgatgtgcatgttaatcagtgcaccatatatggctgaagctataacttgcggtgaagttgtttcgtctctggctccttgtattatgtacttgaccggaaaaggtgccttaacatcaggatgctgcggaggagtaaaaagtttaaacagcgcagccaaatcaacacccgacagaaagactgcttgtaattgtttgaaatcttcagccggtagtattaagggaattaactacggtcttgctggtagcctcccaggcaaatgcggtgttagcattccttacaagatcagcccttctaccgactgtaccaaggtggtgtaagaagcttgatgagacttgtacgcaatatcccaccgtctgatatatggatcgcgtggatgagaataagcaacggagcttccttgatcgttgaatgctcctgcattagagcatcttagagtttctttgagtttgaactacttatattctgttgtgtaatgtcatgttgtcgattttcctattatggatatattgatggcaaagtttt

SEQ ID NO: 1990 - DNA, 598 bp, Artificial
  Synthetic
cccacgcgtccgcccacgggtccgctcacctgcagcagcaaacgagcaccacacaccagcagcagcagcaagtcgatcgatcgtcagcacacacgaccaagatcgagatggcccgtgcacagctggtgttggtcgccctcgtggcagcggctctgctcctggcgggcccacacaccaccatggccgccatcagctgcggccaggtcaactccgccgtgtcgccctgcctcagctacgcccgcggcggctccggcccgtcggcggcctgctgcagcggcgtcaggagcctcaactccgccgccagcaccaccgccgaccgccgcaccgcctgcaactgcctcaagaacgtggccggcagcatcagcggcctcaacgccggcaatgccgccagcatcccctccaagtgcggcgtcagcatcccctacaccatcagcccctccatcgactgctccagcgtgaactaatctgatcgatcgatcgctaccggccggagggtgtgacatcgcaggccgtacatgcacctgtcgtcgtctcacgctttgtatcttgtgttatctgtgtttatgctgaataaaatgagagctagctagctaggtcg

SEQ ID NO: 1991 - DNA, 637 bp, Artificial
  Synthetic
cccacgcgtccgatctcatggtcagcaaccaattcgcaccgatcgatcgatcgatcgatccagcaactagatcaacagtactagctaggaagcatggcccgtgcacagttggtgttggtcgccctggtggcagctctgctcctcgccgccccgcacgccgccgtggccatcacctgcggccaggtcaactccgccgtcgggccctgcctgacctacgcccgcggcggcgccgggccgtcggcggcctgctgcagcggcgtgaggagcctcaaggcggcagcaagcacgaccgcagaccggcgcaccgcctgcaactgcctcaagaacgcggcccgcggcatcaaggggctcaacgccggcaacgccgccagcatcccctccaagtgcggcgtcagcgtcccctacaccatcagcgcttccatcgactgctccagggtgagctgagccatcgatcagagagacggatcatatatatacagcagcgcgccggttgccacctagtagattctgcctgggtcgatgtgtggagccgaattctgtatccagtactagtagtatcatatctgtattctggaataaaagatgagctagctaaggtctcgatcaatcaccatgcatgcatgtgtgtgcatccatg

SEQ ID NO: 1992 - DNA, 639 bp, Artificial
  Synthetic
cgatccatccatcatccatctcatcatcagcaaccaattcgcaccgatcgatcgatcgatccagcaactagatcaacagtactagctaggaagcatggcccgtgcacagttggtgttggtcgccctggtggcagctctgctcctcgccgccccgcacgccgccgtggccatcacctgcggccaggtcaactccgccgtcgggccctgcctgacctacgcccgcggcggcgccgggccgtcggcggcctgctgcagcggcgtgaggagcctcaaggcggcagcaagcacgaccgcagaccggcgcaccgcctgcaactgcctcaagaacgcggcccgcggcatcaaggggctcaacgccggcaacgccgccagcatcccctccaagtgcggggtcagcgtcccctacaccatcagcgcttccatcgactgctccagggtgagctgagccatcgatcagagacggatcatatatatacagcagcgcgccggttgccacctagtagattctgcctgggtcgatgtgtggagccgaattctgtatccagtactagtagtatcatatctgtattctggaataaaagatgagctagctaaggtctcgatcaatcaccatgcatccatggttgatcgggccggtca

SEQ ID NO: 1993 - DNA, 696 bp, Artificial
  Synthetic
ccccccgatccatctcatcagcaacgaaccaattcacaccgatcgatcgagcaacagtagtaggaaccatggcccgtgcacagttggtgttggtcgccgttgtggcagctctgctcctcgccgccccgcacgccgccgtggccatcacctgcggccaggtcaactccgccgttgggccctgcctcacctacgcccgcggcggcgccggcccgtcggcggcctgctgcagcggcgtgaggagcctcaaggccgcagccagcagcaccgctgacaggcgcaccgcgtgcaactgcctcaagaacgcggcccgcggcatcaaggggctcaacgccggcaacgccgccagcatcccctctaagtgcggcgtcagcgtcccctacaccatcagcgcttccatcgactgctccagggtgagctgagctatcgatcggatggatcatttatatgcatacagaagcgcgacggtgggtcgatgtgtggagccgatcgaattctgtatccaatattagtagtatctgtacgtattctggaataaaaagatgagctagctaaggtcgatcaatcaccatgcatgcatgtgtgtgcatccatggttgatcggcccggccggtcaggctagctagctttcttcttcttgtgtgttcatctcgtacgttttgctccttctcgaggtgtacgtgtaccagagagagctag

SEQ ID NO: 1994 - DNA, 846 bp, Artificial
  Synthetic
cccgatcgatcgatctcacctgcagcagcaaacgagcaccacacaccagcagcagcagcaaagtcgatcgatcgtcagcacacacgaccaagatcgagatggcccgtgcacagctggtgttggtcgccctcgtggcagctctgctcctggcgggcccacacaccaccatggccgccatcagctgcggccaggtcaactccgccgtgtcgccctgcctcagctacgcccgcggcggctccggcccgtcggcggcctgctgcagcggcgtcaggagcctcaactccgccgccaccaccaccgccgaccgccgcaccgcctgcaactgcctcaagaacgtggccggcagcatcagcggcctcaacgccggcaatgccgccagcatcccctccaagtgcggcgtcagcatcccctacaccatcagcccctccatcgactgctccagcgtgaactaatctgatcgatcgatcgctaccggccggagggtgtgacatcgcaggccgtacatgcacctgtcgtcgtctcacgctttgtatcttgtgttatctgtgtttatgctgaataaaatgagagctagctagctaggtcgatcgatcgatcgccatgcatgacgagactagctagcattgctgctagatcgatgcatgcatatggttgatcgcccggtcactacgctatctgtttccttaatttattcgtcgatcgactacgtacgtacctgagagctagacatcagtttttgtaccatgcatatgcatatgaacttctgcatgtacatgcagtactacttgtactacgtgcgtgtacgttgtggattatacattatatagacagcttcttttggtatac

SEQ ID NO: 1995 - DNA, 594 bp, Artificial
  Synthetic
attcatcacatagcacctgtcaacggctgggcagcatgattgctacccgcctgataccccgaagtgccatccgcacgctgcccagcaggcaattgaccctgtcacgatggagtcgaggatttgcctctgcttctgaggagaaggacctgatcatcatcggtggtggtgttgccggatatgtggccgccatcaaggccggacaggagggcatgaaggtggcctgcattgaaaagcgtggcaccctcggcggtacctgcttgaacgttggctgcattccctcaaaatcgctgctcaacaactcccacctgtaccaccagattctccatgactcaaaaaaccgcggtatcgaggtcggagaggttaaactcaacctcgagactttcatgaaggccaaggaaaccgccgttaccggcctgaccaagggtgtcgagttcctcctgaaaaagaacggcgccgagtacatcaagggcaccggttccttcatcaacgagaacgaaatcaaggtcgaactcaatgacggcggcgaatccgtcatccgcggcaagaacattctcatcgccaccggctctgaagccactcccttccccggcctca

SEQ ID NO: 1996 - DNA, 1474 bp, Artificial
  Synthetic
tgaagttctcttccgttgaggtagatcttcctgccatgatgggccaaaaagataaagctgtggctaacttaacacgaggtattgagggtctattcaagaagaacaaagtgaactatgttaagggctatggcaaattcctttctccttctgaagtttctgtcgacactgtggaaggtggtaatactgttgttaaggggaagaatattataattgccactggttctgatgtcaaaagtctacctgggctaactattgatgagaagagaattgtatcatccactggagctttagctttgaccgaagttccaaaaaagctggttgttattggtgctggctacataggccttgaaatgggatctgtctggggccgtcttggctcagaggtgactgttgttgaatttggacctgatattgttccatccatggatggtgaagttcgcaagcaattccaacgttctcttgagaagcaaaagatgaagttcatacttaaaactaaggtagtatcagttgagactgttggcgatggtgtgaagttgacccttgaacctgcagctggtggtgatcaaactactcttgaggctgatgttgttcttgtttctgctggtagaattccgttcacttcagggcttggattggacaagataggtgttgaaactgacaaggctggtcgaatcttggtcaatgaacgttttgcaactaatgtcccgggggtacatgcaattggtgatgtcattcctgggccaatgctggctcacaaggcagaggaggatggtgttgcttgtgtggaattcattgcaggcaaggagggtcatgtggactacgatttggtccctggtgttgtttacacgcacccagaggtggcttctgttgggaaaactgaagaacaagttaaggcacttggcgttgattatcgtgtaggaaaatttcccttccttgcaaacagtagggccaaggcaattgatgatgctgagggaattgtaaaagtacttgctgagaaggagactgacaaaatcttgggtgttcatattatgtcaccaaatgcaggggagcttattcacgaggctgtcctggctttgcattatggagcatcaagtgaggacattgctcgtacatgccatgcacatccaacaatgagtgaggctctgaaagaagcagccatggccacttacgacaagcccattcacatataaaaatagtgtcatatatttgtttttgtttttcctctgagtatcttgaatacttagagcatattttctaattgccacctcatcactcaagtatctcttgaacagatatttcctccctcttctctaattatccaaagtacttccaacttaatgtttctgttctgcatattcatatctgtaataaagtcaggagctgtatgtcaaagtttaaatgccatcgatttgagtttcattgagttttgatcagcgttgagcacaaaacaaaaaacaaaaaaaaaaaagggggg

SEQ ID NO: 1997 - DNA, 727 bp, Artificial
  Synthetic
aagcaagtaaagattggggaccctttagaaaaaggtaccttacttgggccactgcatactcgcacttctagggaaaactttcaaaagggaatccaaaatatcaagtcccagggtggaaagatcctcacagggggttcagtcatagaatctgagggtaactttgtgcatccaacaattgtcgaaatatcttcaaaagctgaagttgtgaaggaagaattgtttgctccagttctttatgtaataaagtttaagactttcgaagaagcagttgaaattaacaactctgtccctcaaggtttaagtagttccatcttcacccgaaatccacaaattatgtttaagtggattggagctcaaggaagtgactgtggcattgtcaatataaacataccaacaaatggagctgaaattggtggtgcatttggaggtgaaaaaggtactggtggtggtcgtgaggcaggaagtgactcttggaaacaatatatgaggcgctcaacttgtacaatcaattatgggaatgaactaccattggctcaaggaatcaactttggctaacgaaattgatgcagaacttcgcggtctgcccttggactatcgtgcttttaagtgcgtccatggtttgatacttcaagtacacttgtaattcgtcccgaatcacttaaatgtacttccctacttcaagagttgttaacctaatctcataactagaaaacaacacttgcattat

SEQ ID NO: 1998 - DNA, 427 bp, Artificial
  Synthetic
ttgagtgtaaacaatgcaatcatagtcatggacgatgctgatatacagttagcggctcgatctgttctattcgctgcggttggaactgctggtcaacgttgcacaacttgccgtaggctgcttttgcatgagagtgtctatgacaaagtactcgagcaactgcttacctcatacaaacaagtcaaaatcggcaatcctcttgagaaagggacattgttaggaccattacatactcctgaatcaaaaaagaactttgagaaaggaattgaagtcatcaaatcccagggtggtaaaatactaacgggaggtaaagcagtcgaaggtgaaggaaactttgtggagcctacgataatcgagatatcagcagatgctgctgtcgtcaaagaagagctatttgatcaagttctatatgttaaaaagtttaagt

SEQ ID NO: 1999 - DNA, 561 bp, Artificial
  Synthetic
cccccccttataccgaacatttcttgatcaacttgttgaggtttataaacaagtccgaattggggatcctttggagaatggtacgttactggggccattgcacactcctggttcaagagacgccttcttgaaaggcatccaaaccatcagatctcaggggggaaaaattctttatggaggatctgcaattgaatctgagggaaactttgttcagccaacaattgtggaaatttcaccctctgcaccggttgtgagaaaaaaactctttggtcctgttctttatgtgatgaaagttcaaaatctgaaggaagcagttgaaatcaacaattctgttcctcaaggattgagcagttctatatttacaaagagaccagatattattttcaagtggattgggcctcatggtagtgactgtggcattgttaatgtaaatattcccacaaatggtgctgaaattggtggagcttttggtggagaaaaagctactggtggtggacgaaaaccagggagtgattcgtggaagcagtacatgagggagggccacttgtacgatcaactatg

SEQ ID NO: 2000 - DNA, 657 bp, Artificial
  Synthetic
gaattcagaggagagagagagacacacagagaaagggtggcgatggcaatggcacttcgtaggctctcatcttcttcaatcaacaaacctatccgtcctctcttcaatgccgattcctactattgcatgtcatctcttccaagtgaagctgttggttatcctggtgctagatactatggaggaaacgagtacattgatatggcagaaactttgtgccagaaacgtgccttggaggctttccgtttggatcctgctaaatggggagttaacgtgcaatctttgtctgggtcccctgccaatttccaagtctacactgcactattgaagccccacgagagaattatggcacttgaccttccacatggtgggcatctttctcatgggtatcagactgacaccaaaaagatatctgctgtatctatattttttgagacaatgccataccgattggatgagagcactggttacattgattacgatcagttggagaagagcgctacactcttcaggccgaaactgattgttgctggtgcaagtgcttattcacgcttctacgattatgcacgcattcgccaggtgtgcgacaagcaaaaagctatattgttggcagatatggctcacatcagtgggcttgttgctgctggtgtcatcccatct

SEQ ID NO: 2001 - DNA, 653 bp, Artificial
  Synthetic
gaacacatctccaccatgtcttcatacgccctttccaacaaccataaggatctcattgaagcctccctccacgacctcgaccccgaggtcgagggcatcatgaaggacgagattgaccgacagaagcactccatcgtcctcattgcctccgaaaacttcacctccaagtctgttttcgacgcccttggatctcccatgtgcaacaagtactccgagggataccccggcgcccgatactacggtggtaaccagcacattgaccgaatcgagactctgtgccagaaccgagccctcaaggccttcggcgtcacccccgacaagtggggcgtcaacgtccagaccctgtctggctctcccgcaaacctccaggtctatcaggccatcatgaagccccacgatcgactcatgggtcttgatctgccccacggaggccatctttctcacggttaccagaccgacaaccgaaagatctccgccgtctccacctacttcgagaccatgccctaccgagtcgacctcgagaccggcatcatcgactacgacatgctcgagaagactgccatcctctatcgacccaaggttctggttgccggaacctccgcttactgccgactcattgactacaagcgaatgcgagagattgccgacaaggt

SEQ ID NO: 2002 - DNA, 675 bp, Artificial
  Synthetic
gggaagatcgatcgatggcgctagcttcggcggcggtgctgcggcgattgtcgaggtttcgcgcgtccacagcgctcgcgatcagcgtgaacagggctctcggtgacgccggatcgatcttctcgcgcaatgcgtcgactgcggtggccaatgaggaggtttactcgcgattcgagagctcaaaggacaagtcccatgtcacttggccaaaacaactcaactctccactggcagatgtcgaccccgaaattgctgatattattgagctagagaaaaatcgtcaatggaagggacttgagctcattccctcggaaaattttacctcgacttcggtcatgcaagccgtgggatcgataatgacgaacaagtatagtgaggggtatccaggagctcgttactacggtggaaatgagtaggttcattgatatggccgagagtttgtgccagaagcgagcgctagaggcctttcgactcaacccggaagaatggggagtcaacgtgcagtctttatctggatctccggcaaactttcaagtatatacagctctgcttaaaccgcatgacagaattatggctctagatttaccacacggaggccatttgtcgcatggatatcagacagacactaagaagatctcgggcgtttcgatcttctttgagacaatgccgtataga

SEQ ID NO: 2003 - DNA, 610 bp, Artificial
  Synthetic
gaattcatgttaagagcagtaaggattagggcgactgttggtggaggattgcaagatcctgtaaccataaaaaaacctaactcaacaaaacccacaacaccaaactcttacaatactaatgtgttaaccctatcaacacatactcgcggtggttcatcagttaataataatcaagttttattatcatcaccaacatcatcagcttcagtttctaatgcttcttcgtctagatattcatcatcttgttcatatttatatgattctactgatgaatgggagtgggaaactgttgacaaagatggtgaggaaaacaaagatgatttggttttatcaaatggatattatgatatctttggcgctgttccttctatggatgaagttagagatgcggtttctaatcttcaacaattttcttcggctgcatcagacgaggattgggtcgaacctgctttacaggttaataatccaagaacattgaggtctcatggatatgaaagggtttatactgctttccatttattgcagacagatccgagtgttcagagaatggtagtttctttatctaccgataaagctctatgggatgctgttttaaataatgaagctgttc

SEQ ID NO: 2004 - DNA, 705 bp, Artificial
  Synthetic
cccccccccccgatattatatcaagaagggctttgatccctccttcttctctgtttgttcccttgccctttcttcctctgcatctacaactacataaactgcaccatattacacagatctgtcacttaccaaattatgtcacttgaatgttgagtcacattttctgagttgggctttgtttttttgtttttccttgaaaatatacgatgggtgttgaatatcatgaggaatatataaggaattcaagaggtgttcagctttttacttgtagatggttgcctttttcttctccaaaggcccttgttttcctttgccatggctatggtatggagtgcagtggattcatgagaggcgttgggacaaagcttgcgaatcatggatatgcggtgtttggaatagattatgaaggccatggacggtcattgggttcccgctgttatatcaaaaggtttgacaacattgtcaatgactgcagtgactttttcaagtccgtttgtgcgcgggaggagtacagagagaaaacaaggtttttgtatggggagtcgatgggtggggctgtggctcttttaatacacaagaaggatccttccttttggcatggtgctcttctggttgcacctatgtgtaagatatcacagaaagtgaagccacatccaatggttataagcttactaactaaagtggaggatgtcataccaagatgga

SEQ ID NO: 2005 - DNA, 435 bp, Artificial
  Synthetic
gtcgaccgacgcgtccgagcctcctccggtcctcctcttcttcttcctcattctcctcctccgtggcgaggccggccgagatatcaatggaagtcgaataccacgaggagtacgtgcggaactcgagaggggtgcagctcttcacctggggctggctgcccgccaaaacgtcgcccaaggccctcgtcttcctctggcacggctatgccatggagtgcagcggctacatgagagagtgtgggatgcggctggcggcggcggggtacggggtgttcggcatggactacgaggggcacgggaagtcgatgggcgcccgctgctacatccgcagcttccgccgtctcgtcgacgactgccaccgcttcttcaagtccatctgcgacatggaggagtacaggagcaagagccggttcctgtacggcgagtccatgggcg

SEQ ID NO: 2006 - DNA, 789 bp, Artificial
  Synthetic
gaattcaaagcgaagaaagcgagggtgtatgggacaaaaaatgaatccacttggttttagacttggtacaacccaaaagcaccattccctttggtttgcacaaccaaaaagttattctgagggtctacaggaagatcaaaaaataagggattgtatcaagaattatgtacaaaaaaatatgagaatatcttcgggtgtacagggaattgcgcgtatacagattaaaaaaagaatcgacctggtccaggtcataatctatatgggatttccaaaatggttaatagagggtaaaccgagaggaattgaagaattacagatcaatgtacaaaaaggttttaattctgtgaaccgaaaactcaacattgctattacacgaattgcaaaaccctatggagaccctaatattcttacggagtttatggaatagattatgaaggtcatggaaaatcttcaggactacaaggtttcgtccctagtttcgacagagttgtcgacgattgttctgaccattactcaagcatttgcgaaaagaaagaaaacaaaagaaagttaagatatctactgggagaatccatgggaggtgcagttcttcttcttttacacaggaagaaaccacagtactgggatggtgctatcttagttgctcccatgtgtaagcttgcagatgatatgaaaccaccagcactggttgtgagtgttttatcaatgctcacccatgtcataccgacatggagaattgtcccaacaactgatattatcgatatcgccttcaaactaccttccaaaaga

SEQ ID NO: 2007 - DNA, 638 bp, Artificial
  Synthetic
ggaagcgtgtttcgcgtggtcgtgccataactccagtatccaagctgcagagctatggccccggcaacttctctggacaagcccgcctactactggggcgacgacatctccccagacgacttctacaagcagcaaggcgtccgccactccgagtcctacttcaccacaccgcacggtacgctcttcactcagtccttcctcccgctggacgagtccgccaccccgcgagctctcgtctgcctcacccacggctacggcagcgacagcggctggctcttccagtccatcgccatggccttcgcgcagtggggatgcgccgcatactgcgtggatctcctcggccacggccgctccgacggactccacggctacgtctgggacgtgaacgctttcgccgatgcgaatctccgcttcttccagtcggtccgggacaagcccgagtactcgggcatcaagaagttcctgtttggcgagtccatgggtggcggactcactctgctgatgtgcttgagggatcccaaaggatgggatggagtcatggtgactgcgccgctgatcgtcatcccggagctcatgcagccgtcgaggatccatctgtttggatacggtctccttctcgggctggccgagtcgtgggc

SEQ ID NO: 2008 - DNA, 754 bp, Artificial
  Synthetic
gatgcaggtgtggaaccctaatttccgtcaaaggatataaattctaggcgagagggatagactggagagagatcgattgatcaatcggttctacgaggaggaatcgcatgcgccagcggtatgatcgtcacggtgatgcacggttttgtagcaatgatcgtccatggggcggctgacgtctccgcccgggccaggtcgtggagcactgccggggcgctgcttttcttcgcgtggatcgccctagcggtgctgctgccgccaatcttgaggaggatcgagggcgattcggtggtgttggaggatgggcggcggctgcggcatctggactgggcggcggacaggaggaatatctttgccgagtatgagaaagtgaggaggagcttcaacatagctggacccgctgccggcgttgtaacatcagaagagtttaaggtaaattcgcgcggtgttgagctatttacaaagagctggctgccggaaactgggaagccgaaaggactgatcttttactgccatggatatggtgatacaatctcctattttttcgaaggaattgctcgaaagcttgctcgagctcaatacgcggtgtttggaatggactatgagggattcggtctctcatccggcctacacggctacattgagaactttgatgttcttgtggatgatgtaatcgagcactactcatcgattcgagccaaggctttatctaaaagaccgaatcacttgtacgtggcagaacggatagagttcg

SEQ ID NO: 2009 - DNA, 633 bp, Artificial
  Synthetic
aagcatccagttgcagaagcgaacgaggtgagcccattcgggtcattgaaccccgacgagttctattctcaccactcagtgagtcaaggctccgagttcatcgctaattctcgaggtctcaaactcttcacccagtggtggaccccactccctcccgctaaccccatcggcgtcgtctgcgttgttcacggattcaccggcgagtccagttggttcgttcaactcacctccgttcacttcgccaagcacggtttcgccgtctgtgcaatcgatcaccaaggccatggcttctccgatggcctcgtggctcatatacccgacattaatcccgtcgtcgatgactgtatctccttcttcgattctttccgtcagcgccacgcgccgccgtatctcccgtcatttctctacgctgaatctctcggcggcgcaattgcacttctcatcactctccggcagggagattctgctcttaataggccttttgacggcgtcgttttgaatggggccatgtgcggtatcagcgctaagttcaagccaccgtggccattggagcatcttctggacattgcagcatttctcattcccacatgtcgcgttgtacccactcgcggctctattcctgaaatctcattc

SEQ ID NO: 2010 - DNA, 420 bp, Artificial
  Synthetic
acgagcgcctcgtctcgcgtctcgtccacatcgccgccgccgcgagcgccgcggcgcaattcatcgcgcacggatccggcggggccagcaagcggcgatggatcgcgtcagctacgccgaggaattcgtctataattccagaggaaccaggctgttcacttgccgatggatccctctccgccaggacgtgaagggattggtcttcctctgccacggtatggcgataatctttgctgctgtgtcgagatctcgcttgaaatgcgtgtccttggatgtgtgttcatggaccgcgaaggctatgggatggaatgtacccagttcatgagaggaactggtcagcgcctttcaagagctggatacgcggtgtttggcatcgactaccaaggccatggaaagtctgacggccggcgatgctatatt

SEQ ID NO: 2011 - DNA, 608 bp, Artificial
  Synthetic
taccccattacccacctcgtcttttcatactcattctctccttcttccatttctagctccgccctctctctttctctctgtcaaagtaaatagttcttggcaggaataaggaattagattacattgatcaggaaaatggattctgcggccctgactagcgtttgtggcaaatctgctcttcgctccactccgggtttatttctggggagaacgaatggtattaggagctcgcagtgtagctttatggcaggaaacaagataaactttccgcggcagagagctcaagcatatagagttagtactaaatctagcaaatgtggcggtgctcttgctgcaacatgtcgcgccgagaagattctggtggcaaatcgaggagagattgctgttcgtgtgattcgaactgcccatgagatgggaattccttgtgttgctgtttattcgaccatagacaaagatgccttacatgtgaagctagctgatgaatctgtttgcattggtgaagcaccaagcaatcaatcatatttagtgatcccaaatgtcttatctgctgctatcagtcgtggatgtacaatgttgcatcctggatatggtttccttgctgaaaatgc

SEQ ID NO: 2012 - DNA, 384 bp, Artificial
  Synthetic
cccacgcgtccggtagccatggcttcggctactttctctgtggccaaaccatctcttcagggtttttctgagttctcaggacttcgaaactcctctgctcttccctttgccaagagatcttcttccgatgagtttgtttccttcgtcagtttccaaacttctgcaatgagaagcaatggtggatacaggaaaggggtgaccgaggccaagataaaggtagccatcaatgggttcggtaggattggtaggaacttcttgaggtgttggcatggtcgtaaggactctcctcttgatgtcgttgtcattaacgacactggtggtgttaaacaagcatcacatctcctcaaatacgactcaactcttggaatctttgacgctgatgtc

SEQ ID NO: 2013 - DNA, 366 bp, Artificial
  Synthetic
cccacgcgtccgcaaaccttaacttggattctttctggtcaccatggcttcgggtactttctctgtccccaagggtttcactgaattctcaggattgcgaagctcctctgcttctcttcccttcggcaagaaactttcttccgatgagttcgtttccatcgtctccttccagacttctgcaatgggaagcagtggtggatacaggaaaggtgtgactgaggccaagcttaaggtggccattaatggattcggtaggatcgggaggaacttcctgagatgttggcatggtcgcaaggactctcctcttgatatcattgccattaatgacactggtggcgtcaagcaggcttcgcatttacttaaata

SEQ ID NO: 2014 - DNA, 516 bp, Artificial
  Synthetic
gatttgaaccctgagaccagtgcctgagctagtgccagccatggctgactgcttcccttgcttcctctcctaagcccacccctctttcccaggtttctggtaaggggctttctgagtactctggattgaagagctccagctgtgtcccctttggaaggaagaatgatgacctcctttccagagttgcacttctcaccactgctgtttctagctctggtgcaaagaggggagtagctgaggccaagatcaaggtggccatcaacgggttcggaagaattggacgaaactttctcaggtgttggcatggtcggaaggattctcccctcgatgtcgtcgtcatcaacgacaccggcggtgtgaaacaggcctcccacctcctcaagtatgactctatgttgggcacctttgaagccgacgtccaagttgccggcgaagatggaatttcggttgatggaaaggtcatcaagatcgtttctgataggaacccagcaaacctaccatgggaggcctatggaa

SEQ ID NO: 2015 - DNA, 677 bp, Artificial
  Synthetic
atggcttctcatgcagctttggctccttcaagagttcccacaagcacaaggcttcctttcaagaactcacactctttccctactcaatgcttctccgagaaatttgaagtagccgagttctctggtcttcgatcaagtggatgtgtgacattttcgaacaaggagtcgtccttctttgatgttgtgtctgctcaactcactcccaagaccacaggatcagctcctgtgaagggagaaactgttgcaaaattgaaggttgctatcaatggttttggacgcattggcaggaatttcctccgttgttggcatggccgcaaagattcaccactggatgtcatcgtcgtcaatgacagtggtggtgtcaagaatgcatctcacttgcttaagtacgattccatgctcggaacattcaaagctgatgtgaaaatagtggataatgaaacaattagcgttgatggaaagcacattaaggttgtttctagcagggacccccttaagcttccttgggctgaacttggcattgacattgttattgagggaaccggtgtgttcgttgatggtccaggtgctgggaagcacattcaagctggtgccaagaaagttattatcactgctccagcaaaaggtgctgatattccgacctacgttgttggagtgaatgaacaagactactctca

SEQ ID NO: 2016 - DNA, 826 bp, Artificial
  Synthetic
caccttataccttccatatttctttaactttccacaccaaataccacattcttctgctgcatttctaaaaagaacaatggcttcggctgctctctcagtagccaactcttctcttcaggtcagcaacagaggattctctgaattctcagggctgcgcacctcatcagcaattccattcggaaggaaaaccaacgatgacttgctctctgttgttgcctttcaaacctctgttattggaggagggaacaacaagaggggagtagtggaggccaagttgaaagtggccatcaatggatttggaagaattggaaggaatttcttgaggtgttggcatggtaggaaagactctccccttgatgtcattgccatcaatgacactggtggtgtcaagcaagcctctcaccttctcaaatatgactccacccttggcatctttgatgctgatgtcaagcccgtcggcactgacggcatctccgtcgacggaaaagtcatccaagtcgtctccgaccgcaaccccgtcaacctcccatggggagatcttgggattgacttggtgatagaaggtaccggagtgtttgttgacagagaaggcgccggaaaacacatccaggccggagccaagaaggtgctcatcaccgctcccggaaaaggtgacatccccacatatgttgttggtgtcaatgctgatctctacaaccctgatgaacctatcatcagcaatgcctcttgcaccaccaactgccttgctccttttgtcaaggttcttgaccaaaaattcggaattatcaagggaaccatgacaactactcactcttacactgttgac

SEQ ID NO: 2017 - DNA, 563 bp, Artificial
  Synthetic
  misc_feature (504)..(504): The residue at this position can be any nucleotide.
gcggattgggcgcaatttcatccggtgctggcacgggcgcaaagactccccccttgacgttgtcgtcgtgaatgatactggcggtgtcaagcaggcctcccacctccttaaatatgactccatgcttggtacttttgacgccaatgttgcggctgccggtgatgatggtatctccatcgacggcaaggttatcaaggttgtctcttttcgcaaccccttggacctcccatggaaggaacttggcatagacctagtgattgagggcacaggtgtgtttgtggaccaagaaggagccgggaagcatatcactgcgggagcaaagaaagtgttgattactgcccctgggaaaggtgcgatccctacttatgttgtgggtgtgaacgagcaactatatagccatgatgatgtcatcatcagcaacgcatcatgcaccaccaactgcctggcaccattcgtcaaggttctcgacgagaaattcggaattgtgaagggcaccatgacaancacccactcatacactggagaccaacgtttgcttgatgcaagccaccgcgatttacgga

SEQ ID NO: 2018 - DNA, 699 bp, Artificial
  Synthetic
cacacaccctaatatccatgccccaaatttaatagtcaaacctctcaaccccatcgatccatttccgatcaatggcgaaacgagccctacccgttctcaagcacctcctcaagtcctcatccccatccccatccccatcccatggggtttcccattcattaacgtcagcccgatcggtcacctacatgccccgacccggtgatggcacaccacgcgccgtcactctcatccctggtgacgggatcgggccgcttgtcaccggcgccgtcgaacaagtcatggatgcgatgcacgctcctgtgtatttcgagcgatatgaggttcacggcgacatgaagagtgtgcctccggaggttatggaatcgatccggaagaataaggtttgtttaaaaggagggttgaaaactccggtggggggtggtgttagttcccttaatgttcagcttaggaaagagcttgatctatatgcttcccttgttcactgcttcaacttgcaaggattaccgactcgccatgagaacgttgatattgttgtcattagggaaaacacggagggtgaatattccggcctcgagcatgaggttgttcccggtgtccgtggagagcctaaaggtgatgacaaagttttgctcggaacgaattgcaaaatatgcctttgaatatgcatacctcaacaatcgcaaggtagtgactgctgtg

SEQ ID NO: 2019 - DNA, 585 bp, Artificial
  Synthetic
actcatcgtcacaatgctggccattcgggctctctccaaccctgccaggcactgcctgcgagcagctccccgcgctgccgccacctggtccgtttcgaacaagcgattctactcccaggagcgtgttgcaaagtatgagggaaccaaggactccaacggcaacttcctcgtcagcttaatcgagggtgacggtatcggtcctgagattgcccagtccgtcaaggacatcttctccgctgccaagaccccaattgcttgggagcccatcgatgtcacccccatcatcaaggacggcaggaccgccatccccgacgccgccattgagaacatcaacaagaacaagattgctctcaagggtcctctggctacccccgttggcaagggccacgtttccctcaacctgactctgcgacgaacctttaacctgttcgccaacctgcgaccttgccgatccgtcgccggcttcaagaccccctacgacggtgtcgacactgtcctgatccgagagaacaccgagggcggagtactctggcattgagcacgttgtcgtcgacggtgttgtccagagcatcaagctcatcaccg

SEQ ID NO: 2020 - DNA, 624 bp, Artificial
  Synthetic
tgcacctctacttgcttagcatcaggctgaaactatcgtctcttttgtcacgatgctgtcacgaagctctctccggaccgcccaggtccttcgcgccgctgcccagccccagcagctcagccgatccttcgccaccgtccagtccgacatcttcaagcctgccaagttcggcggcaagtacaccgtcaccctgatccccggagacggtatcggtggagaggttgccgagtccgtcaagaccatcttcaaggccgacaatgtccccgtcgagtgggagcagatcgaggtgtccggtgtcgaggagagcgccctgcgaaccgaggaggccttccgcgagagcgtggcctcgctcaagcgcaacaagctcggcctcaagggtatcctgcacacgcccgtcagccgctccggccaccagagcttcaacgtggccatgcgccaggagctggacatctacgccagcatctccctgatcaagaacatccccggctacgagacccgccacaaggacgtcgacctgtgcatcatccgtgagaacaccgagggcgagtactctggcctcgagcaccagagcgtccccggcgtcgtcgagtccctcaagatcatcacccgcgccaagtctgagcg

SEQ ID NO: 2021 - DNA, 798 bp, Artificial
  Synthetic
gaattcaggaatggcaagaagaagcttaccgatcttaaagcaacttttgcagagatcatcatcagaatcttcatcggcttcatctttgttgaatcctagtattgttggaggaggattattaggtacaagatatgaaccaaagagatctgtaacgtatatgccaagaccaggtgatggaacaccaagagcagtaaccctaataccaggagatggaatcggaccattagtaacaggtgcggttgaacaagtaatggaagcgatgcacgcacctatttactttgagaaatttgaagtacatggtgatatgccaaaagtacctgatgaagttatggaatcgattaagaaaaacaaagtttgtttgaaaggtggattagcaacaccagttggtggtggtgttagttctttgaatgttgaattgaggaaagaacttgatctttttgcttctcttgttaattgttttaatcttcctggtttggctactagacatgagaatgttgatattgttgtcattcgtgagaatactgaaggtgaatatgctggtcttgagcatgaagtcgttgatggtgttgttgaaagtcttaaggtaatcacaaagctctgttcagaacgtattgcaaagtatgccttcgaatatgcttatcttaacaacagaaagaaggtaacagctgtccacaaagccaacattatgaagcttgccgatggattgttcttagagtcttgccgtgaggttgccaagaagtatcctggaatacaatataatgagattattgtggacaattgctgcatgcaacttgtctc

SEQ ID NO: 2022 - DNA, 561 bp, Artificial
  Synthetic
tctctctctctctcctcctcctcgccgccgaccgccgccgccgccgcgagtcgccttcgccgtccgggtagcagcaggaagagggaggaagggggggcatggcgctacggaggctgctccaggggagcgtcctgccgcggatggcgggcagagccgccgcggcgccgttctcgacggcgtccggggagaccgtccgcgccacgctcttcccaggcgacggcatcgggccggagatcgccgagtcggtcaagcaggtattcaatgttgcaggggtaccaatagaatgggaagaacactatgttggtacagaagttgatcccagaacagagagttttctgacttgggaaagcttggagtcggtgcggagaaacaaagttggcttgaaaggtcctatggctacgcctattggaaaaggccaccgttcattgaatcttacactaaggaaagagcttggtctttatgcaaatgttagaccttgcaacagcctcccaggatacaagactcgatatgatgatgtgaaccttgtgactattcgtgaaaataccgagggagaatatagtg

SEQ ID NO: 2023 - DNA, 347 bp, Artificial
  Synthetic
cccacgcgtccgtcttcttcttctctttcgatcaaatcttttcagattcaacccaaaattgaagacaaaaatgtctcgcagatcgctaactctcctcaagaatctagctagaaacgcgaatggatcaggtattcaaacccgatccgtgacttacatgcccagacccggtgacggagcaccacgcgcagtgacgctgatccccggagatggaatcggtcctctggtgacgaacgccgtggaacaggtgatggaagcgatgcacgctccgatcttcttcgagaagtacgatgttcacggagaaatgagccgtgtgccgccggaagtgatggagtcgataaggaagaata

SEQ ID NO: 2024 - DNA, 514 bp, Artificial
  Synthetic
gcaacatcttgtcgtctaatcgaaaacatatccacatccacaatgcttcgaaccgcctacctggctaaggccgcctcggctctccccaagcgaaccctcgctaccaacgctcgaaccatgttccagcccaaggagtacggatccaagtacaccgtcaccctcatccccggtgatggtatcggtaacgagattactgacgctgtcaagaccatcttcaagactatctccgtccccattgactgggaggttgtcaatgtcaccggtgttggcgagaaccatctcgacggctacgaggaggccattcgatccatcaaccgaaacaaggttgccatcaagggtatcctccacacccccgttgagaagcacggtcacacttctttcaacgttgccctgcgacgagagctcgacattttggcttctctcgttctcatcaagaacatccccggtgtccagacccgactcgacggcattgacatggctctgatccgagagaacactgagggtgagtactccg

SEQ ID NO: 2025 - DNA, 735 bp, Artificial
  Synthetic
ggcgatccatggcaccaccacggcgctgccgccgctaattcggatcagggctgtgcgcattgcggctggacaagagtgtgagcgtgtgagagagagagagagagagagaagggtgcgatcgcgatcgcgatcgcgatgctccgacgaggtgtggtaccgctgctgcggcgggcggcgggacagcgacaattgcagcagcagcagcagcagtgttttgcgagcaatgatgggtcggttgttcctccgcatggtgaattagggttttgtggatcgcatcgtaatatcacgtacatgcccaggcctggcgacggtgccccgcgtgcggtcacgctcctgcccggcgacgggatcgggcccctcgtcaccggagctgtggtggaggtgatgaaggcgctgcacgcgcccgtctacttcgaggcgtacgaggtgacgggcaagatggacaaggtgccgcgcgaggtgatggactccatccgtaagaacaaggtgtgcctcaaaggcgggctcgccacccccgtcggcggaggtgtcagctccctcaacgtgcagctgcgcaaggagctggatctctttgcctcgctggttcactgcttcaacctcccgggcctcaagacccgccacgacaacgtcaacattgtggtcatcagggagaacaccgagggggagtacgccggcttggagcacgaggtcgtccccggcgttgtcgagagcttgaaggtgatcaccaagttctgc

SEQ ID NO: 2026 - DNA, 583 bp, Artificial
  Synthetic
agaagaaggaagcgcatcgtaaatcgagggggtgtggagttttttgaaagaaaaattatagatgggagacggagatgatgctccagataccagtgcgattcccgctgtgattgctgcttcgagcaccactgaagtgtctgtggtggttccatgctcgatccaagacggtcaaaaggactcgcctttggtggttccttgtgctattccagcacgccaagaagctgtgcaagacagggactataagttcctctccaaggctgtggacgaggcctacaaaggcgtccattgcggcgatggcggtccatttggagctgtggtcgtccaaaacaatgagatcgtcgtcagctgccacaacatggtgctcaggcacactgatcccacggctcatgccgaagtcacggctgttcgagaggcatgcaagaagctgaaccgattcgagctgtccgactgcgagatatttgcctcttgtgaaccatgtccaatgtgcttcggagcaattcacttagcacgaatcaaacgcctggtgtatggtgccaaagccgaggccgccatcgcgattggcttcgacgacttcatcgccgac

SEQ ID NO: 2027 - DNA, 356 bp, Artificial
  Synthetic
cccacgcgtccggcataataacgaggttgtcgctagctgccacaatatggttttgaaatatactgacccaactgcacatgctgaagtcactgccattagagaggcatgtaagaaacttaacaaaatcgagttatcagaatgcgagatttacgcatcttgtgagccatgtccgatgtgcttcggagccatccatctctcgagactcaagaggttggtttatggagccaaagccgaagcagctatagccatcgggtttgatgacttcatagctgatgctttgagaggcacgggggtttaccagaaatctaatctggagatcaagaaagcagacgggaatggcgctgcgattgcggagc

SEQ ID NO: 2028 - DNA, 738 bp, Artificial; identical to SEQ ID NO: 294
  Synthetic

SEQ ID NO: 2029 - DNA, 676 bp, Artificial
  Synthetic
agcccatccatccctgcaagcgacgaacacatctcatcacacccgtcacctctcctctcccccaaatctcgcgctccgctcctgctcctgctcctgccatggaggaggctcaggttgtggaatccaaggacggaacgatctcagttgcttcagcatttgctggtcatcaggaagccgtacaagacagggatcacaaatttttgtctaaagcagttgaagaagcttaccaaggagtagattgtggccatggaggtccatttggtgcagttgttgtccgtaatgatgagatagtagttagttgccataacatggttttggattacactgatccaactgcgcatgctgaagtaactgcaataagagaggcttgcaaaaagcttggaaaaattgagttgtcagactgtgaaatgtatgcatcatgtgaaccttgcccaatgtgtttcggcgctgtgcatctatcacggattaagaggctggtgtatggagccaaggcagaagctgctattgccattggattcgatgacttcattgctgatgctttgaggggaactgcttactaccagaaggccaacttggagataaggcgggcagatggcaatggagccctgattgctgaacaagtcttcgagaacactaaggagaagtttcggatgtactaattgtaagtaaatacatt

SEQ ID NO: 2030 - DNA, 623 bp, Artificial
  Synthetic
gaattcaaagaaggacaaggaagggaaggagagagatggaaaggagaagaaagaaaaaggaagctaagaaggaaaagaaagacaaagaagttaaaaaagataagaaagacaaggagaagaaaaatgaaggtctagaagatgaagaaggcgaagacaaaaagaaagagaagaagaagaaaaagaaagacaaagatggcgaagaagaactgaaggaaggggacggcgaaaagaaagaaaagaagaagaagaaagacaaggatggagaagaagaattgaaggagggggaagacgaaaagaaagaaaagaagaagaagaaaaacaaagatggccaagaagacagcaaggatgaaaagaagactaaagacaaagatgaaaaatcaaagaagaaggagaaggatgaaggcactgacatgaaagaagaaaaaaagaaggacaaggaagggaaggagaaagatggaaaggagaagaaagaaaaagaaaagaaggacaagagcaaagatgagaaagatggcagcagcaagaagaaagaaaaggatggggaatcaaaggaagagaagaaggagaagaagaacaaggatgaagataaagagaagaagaagaacaagaacaaggaaagtgaggaa

SEQ ID NO: 2031 - DNA, 570 bp, Artificial
  Synthetic
gaattcagaggaaacctctgacttcgtaaagtaaccaaaatataaaatcccacacagaacgttcagtttttaccgagaaatagtttattggaaaaaaaaagaagaagaagaaaaaatggatcatgctgctgaggctcatatgactgatttgatgaccattactcggtttgttcttaacgaacaatcgaagcatcctgaatcacgtggagatttttctatcttgcttagtcatattgttctgggttgcaaattcgtttgtgctgctgttaacaaagctgggctcgcaaaactcatcggacttgctggggagaccaatgttcagggcgaagagcaaaagaaactggatgttctttcaaatgatgtgtttgttaaggctctcgtaagcagtggaagaacgtctattctagtatcggaagaggatgaagaagcaacttttgtggatccagcattgcgtggaagatactgtgtggtttttgatcccttggatggttcttctaacattgactgtggtgtttccatcggaactatattcggaatttatatgatgaaagcaaacgaggaaccacatct

SEQ ID NO: 2032 - DNA, 714 bp, Artificial
  Synthetic
gaattcaacatcagttgattcagactagctagggggggatcaattgcagcaacggcttctcatcagcttctattctctagcactactacctctgctcaccgctcctcatcatcatatgcatcatcctctgctcgagtactctttgatgtctctaagcagtcgacaaacccaataaccaggaaattatcactcagtaatgaagtcaggtgtgccgcagttgggacaacaacacctgagactgcaacggtaacccccaaaaggagcaagtatgacatagtgactttgacaagttggttattggaccaagagaagtctgggaatatcgatgcagaacttaccgttgtgctgtctagtatttccatggcttgtaaacagattgcttctttggtacagagagccagcatttctaacctcactggaggtcaaggtgccgttaacattcaaggtgaagaccagaagaagctcgatgttatctccaatgaggtgttctcaagctgtttgagatcaagtggaagaacagggatcatagcttcagaggaagaggatgtacctgttgcagtggaggaaagttactcagggaactacattgttgtatttgatccccttgacggctcatccaacattgacgctgctgtatcaaccggatccatctttgggatataccatcctaacgatgaatgtcttgctgattttggccgatgatgtgtccgctct

SEQ ID NO: 2033 - DNA, 557 bp, Artificial
  Synthetic
aacaagtccatcacatttcacaatggaagccaaccccgaaatccagaccgatatcatcacgctgacccggttcattctgcaggaacagaacaaggtgggcgcgtcgtccgcaatccccaccggagacttcactctgctgctcaactcgctgcagtttgccttcaagttcattgcccacaacatccgacgatcgaccctggtcaacctgattggcctgtcgggaaccgcaaactccaccggcgacgaccagaagaagctggacgtgatcggagacgagatcttcatcaacgccatgaaggcctccggtaaggtcaagctggtggtgtccgaggagcaggaggacctcattgtgtttgagggcgacggccgatacgccgtggtctgcgaccccatcgacggatcctccaacctcgacgccggcgtctccgtcggcaccattttcggcgtctacaagctccccgagggctcctccggatccatcaaggacgtgctccgacccggaaaggagatggttgccgccggctacaccatgtacggtgcctccgccaacctggtgc

SEQ ID NO: 2034 - DNA, 273 bp, Artificial
  Synthetic
agaggatcagaagaagcttgacgtcatctctaatgaggtgttttccaactgtttgagatcaagtggaagaacgggaatcatagcctcggaggaagaggacgtgccacttgcggtggaggagagttactccggcaactacgtcgtcgtgtttgaccctcttgatggttcctccaacattgacgctgccgtctctactggttctatcttcggtatctatagccccaatgacgaatgcattgtcgacgactccgacgatatctcagctcttgggtc

SEQ ID NO: 2035 - DNA, 702 bp, Artificial
  Synthetic
gaaaatcacaatggcagcatcatcagcaacagcaacaacttcatttctatgtgctttagataaaaagactccatttttatgtactctagacaaaaagggaactcaatttctatgcccaaaaggcaacagcacaaagagaaggtcatttaatggaggagtgaagtgcatggcaatagagacagcagcaggggctacagagacaaggaaaagaagtggctatgagttgcaaactttaacaagctggctattacggcaagaacaagctgggactattgatgctgaacttaccattgtgatttcaagcatttctatggcttgtaagcagattgcttctttggtccaaagagctggaatttctaaccttactggagttcaaggtgctgtcaatgttcaaggagaagaccaaaagaaacttgatgttgtctctaatgaggtattctcgaattgtctaaggtcaagtggaaggacagggattatagcatcagaggaagaggatgtaccagtggcagtggaagagagttactcaggcaactacattgtggtgtttgaccctcttgatggatcatcaaacattgatgctgctgtttctactggttctatttttggaatatacagcccaaacgatgagtgcctcgcagatcttggagatgattccacgcttgacaatgttgaacagaggtgtattgtgaatgtatgccaacc

SEQ ID NO: 2036 - DNA, 670 bp, Artificial
  Synthetic
aaaagtaaagcaaaactaccaatggcagtttcaactaccacagtaccaacttcaaacctgagcttctctagctttcattccatttctcgcctctctctttttcaattatgtgctttacacaaaaagacttcatttttgtacaccaaaaacagtatataaaaatggtgtggagatgggggattgaggtgcatgatgattgagagaggtgcaacagaggctataaaaaccaagaaacagaatggatataagctgcagacattgactagctggttgttgatgcaagaacaagatggggttattgattctgaacttactattgttatttcaagtatttctttggcttgtaagcagattgcttctctggttcagagagctggcatttcaaaacttgctgaggtcaaggtgctgttaatgttcgaggagaggaccaaaagaagcttgatgttgtttctaacgaggtattctctaattgtctaaggtaaagtggacggatagggattatagcatcagaggaagaagatgtaccagtggcagtagaggagagttattatggaaactacattgtcgtgtttgatcctcttgacggatcatcaaatattgatgctgctttatcttctggcgctatctttggaatatacagcccaaatgatgattgcctcgtcgatcttga

SEQ ID NO: 2037 - DNA, 807 bp, Artificial
  Synthetic
aattttctctctttcatttcttcctctcaattttcttcttctgccacttttaattttcctctaatggatcccgtttcagtttggggcaacgaacctctctccgccgtagatcccgaaatccatgacctaatcgaaaaggaaaaacgccgccaaagccgcggaatcgaactaatcgcatcggaaaatttcacatcattcgccgtaattgaagctctcggcagtgctttaaccaacaaatactccgaaggaattcccggtaaccgttactacggtggaaatgaatacattgacataatcgaaaacttgaccagaagccgtgctttaacggcttttcatttagatccaacaaaatggggagtaaatgttcaaccctattctggtagcccagcgaatttcgctgcgtatacagctgttttgaatccacatgataggattatgggattggatttaccatctggtggacatttaactcatggttattatacttctggagggaagaaaatttctgctacttcgatttattttgagagtttgccttataaggtgaattcaacaaatggatatattgattatgataggttggaagagaaggctttggattttaggcctaaattgattatttgtggaggtagtgcttatcctagagattgggattataagagatttagagaaattgctgataaatgtggagcccttttgctttgtgatatggctcacattagtggccttgttgctgctcaggaagccgccgatccctttgaatattgtgacttggtcactaccaccactcacaagagcttgaggggt

SEQ ID NO: 2038 - DNA, 732 bp, Artificial
  Synthetic
ccccgaccgagcgagccgcatacgcattccgtcgaacacctcacccgcacccaccaccaccaacctcccaccccacaacccacatccatgtgcacgcgcgccctcctctcctcctccgctatatatcccctcctctccacccctccccaccactcccctctcctcccgcctcgccgccgcaaccaccgccgcctcgccgcagcatcacccgcagccgccgccgccgccgccatggactccgtcgcgtcgtgggggctgaccccgctcgccgcggccgacccgctcgtccacgacctcctcgagcgggagaagcggcggcagcggagcggcatcgagctcatcgcctcggagaacttcacctccttcgccgtcatggaggccctcggctccgcgctcaccaacaagtactccgaggggatgcccggggcgcgctactacggcgggaacgacgtcatcgacgagatcgagaacctgtgccgcgaccgcgccctcgccgcgttccgcctcgacgccgcgtcgtggggcgtcaacgtgcagccctactccggctcgccggccaacttcgccgcctacacggcgctcctcaacccgcacgaccgcatcatggggctcgagctcccctccggtggccacctcacccatggctactacaccgcgggcgggaagaagatctccgcgacgtcgatctacttcgagagcctcccctacaaggtgagcgccgccacggggtac

SEQ ID NO: 2039 - DNA, 1106 bp, Artificial
  Synthetic
gaattcgagagaaatctttttttggggttgagaggagagagagagacacacagagagaaaaaatggcgatggcaatggcacttcgtaggctctcatcttcttcaatcaacaaacctatccgtcctctcttcaatgccgattcctactattgcatgtcatctcttccaagtgaagctgttgatgattctaaggataaatctcgtgttcaatggccaaagcaattgaatgcaccattagcagaagtggatccagagattgctgacattattgagcttgagaaagctaggcaatggaagggtctggaattgattccttcagagaatttcacatctgtgtcggtcatggaagctgttggttctatcatgactaacaaatacagtgaaggttatcctggtgctagatactatggaggaaatgagtacattgatatggcagaaactttgtgccagaaacgtgccttggaggctttccgtttggatcctgctaaatggggagttaacgtgcaatctttgtctgggtcccctgccaatttccaagtctacactgcactattgaagccccacgagagaattatggcacttgaccttccacatggtgggcatctttctcatgggtatcagactgacaccaaaaagatatctgctgtatctatattttttgagacaatgccataccgattggatgagagcactggttacattgattacgatcagttggcgaagagcgctacactcttcaggccgaaactgattgttgctggtgcaagtgcttattcacgcttctacgattatgcacgcattcgccaggtgtgcgacaagcaaaaagctatattgttggcagatatggctcacatcagtgggcttgttgctgctggtgtcatcccatctccgtttgagtatgccgatgtggtgaccactacaacacataaatcccttcgtggaccacgtggggcgatgatattttacagaaagggattgaaggaagtcaacaaacaaggcaaagagatcatgtacgactatgaggacaaaattaatcaagctgtctttcctgggcttcaaggaggtccacataatcatacaattactggattagcagttgcactgaaa

SEQ ID NO: 2040 - DNA, 1402 bp, Artificial
  Synthetic
gaattcaagggtgcagcgagttagattgagattggagtgttgctggttgtgtatgcttgctgggacttaagctggagtaatgcattgacagtggctggtggaaatgagcagaagaacaaggttatggaagtgaagctgaactgcaattggtcgtggtttggcacggcaatgaacggaatggcagctgaagcaatgagttgaagctgcgggagaagttgcagttcagaagattgagctgaatggccgcggacaaggagttattataggataataatctgaaggttgcaatgtttcctggagttaaagcaatgacagttgatggaaatggcaggataagagttcgagcagtgaagtgatgttggctgagtcgtagaaacgagtgttgcaagcatgctacaatgcagctggaaaaggattgatactggacttgaaatgtattgttacagggaagtgagcaggaaaaggaaaatgatggaattggttagtagaacaatgctgttaccataaaatctcaagttactactactgaagctgctgcacctgtaaagaaggtagaaaagatctccaagaaggatgaggaaggaattgttgtaaacaaattcaaaccaaagaatccttacattggtagatgccttcttaacactaagattactggtgatgatgcccctggagaaacatggcatatggttttcaccactgagggtgaagttccttacagagaaggacaatccattgggattattcctgatggagttgacaagaatgggaagccacataaactcaggttgtactcaattgctagcagtgctattggtgattttggagactccaaaactgtttcattgtgtgtgaagcgactagtttacaccaatgatcaaggtgaagaagttaagggagtttgttcaaatttcctatgtgacttgaaacctggatctgaagtgacaatcacagggccaattggaaaagaaatgcttatgcctaaagatccaaatgccacaatcataatgcttggaactggaactggaattgctcctttccgttccttcctgtggaaaatgttctttgaaaaacacgaaaactacaagttcaacgggttggcttggctctttttgggagttcccacaagtagctcattactgtacaaggaggaatttgagctgatgaaggagaaagcacctgaaaacttcaggctcgacttcgcagtgagcagagaacaaacaaatgacaagggagaaaagatgtacatacaaacccgtatggctcaatacgcagaggagctatgggaattactcaagaaagacaacactttcgtatacatgtgtgggttgaaaggaatggagaaaggaattgatgacattatggtttctttagcggctaaagacggtattgattggcttgaata

SEQ ID NO: 2041 - DNA, 711 bp, Artificial
  Synthetic
tagtcatggcaggtgcactcactgctgctgtatctattccagcatccaattcatcgtctctccaaaccagaacttctatgtcttcctcggaacgagtcagcttcaacaagagctgtttgtattctaggaatggctgtgccagcagaagggtgttttctgtcaaagccgaggttactacagacactactccacctcctaaagtagagaagatttcaaagaagtatgaagaaggtgttgttgtcaacaagttcaaacccaagaacccttacactggcaaagttcttctcaacaccaagatcacagctgatgacgctcctggagaaacctggcacatggtcttccacacagacggtgaggttccatacagagaaggacaatcgattggtattattccagagggcattgacaaaaacggaaagccacacaagctgagattatactcaattgccagtagtgctcttggggatctgggagactccaaaactgtttctctttgtgtcaaaaggctggtgtacaccaacgaccaaggcgaagaagtcaagggagtctgctctaatttcctatgtgatttgcaaccagggagtgaggtgacgattactggacctgttggaaaagaaatgcttatgcccaaagaccccaatgccaccattatcatgcttgcaacaggtacaggtattgctcctttccgttcattcttgtggaaaatgttct

SEQ ID NO: 2042 - DNA, 605 bp, Artificial
  Synthetic
aatcctctcctctcctctcctctcctctccttcctttgtcgcgagtcacaggcacacagacatggccgccgtgaacacagtgtcgtcgctgccctgtagcaaagctggcgccgccgtagccgggggagctccgaggccgtcgacctgctccgtattctaccctcctcgttgctggtccaagcgaagcagcggtaatggcgtgcgggcgcaggcgtcgacgacggagacgaccgcagcgccggctgcggaggtgactactaaggtggagaaggtgtcgaagaagcaggtggatggcgtggtgacgaacaagtacaggcccaaggagccgtacacggggcggtgcctcctgaacacgaggatcaccggcgacgacgcccccggtgagacgtggcacatggtgttcagcaccgacggcgagatcccctaccgcgaggggcagtccatcggcgtcatccccgacggcatcgacaagaacggcaagccccacaagctccgcctctactccatcgccagcagcgccatcggggacttcgccgactccaagacggtatcgctgtgcgtgaagaggctggtgtacaccaacgatcagggagagatcgtcaaag

SEQ ID NO: 2043 - DNA, 326 bp, Artificial
  Synthetic
tgctgctataagtgctgcagtctctttaccttcctccaagtcatcctctctcctcaccaaaatctcctctgtatcccctcaaaggattttcctcaagaagagcacagtgtgttacagaagagttgtgtcagtgaaggctcaggtgacaacagatactaccgaggcaccaccagttaaagtagtcaaggagtctaagaaacaggaagaagggattgttgtcaacaaattcaaacctaagaacccttacactggtcgctgccttttgaacaccaagatcaccggtgatgacgctcccggtgagacttggcacattgtcttcaccaccg

SEQ ID NO: 2044 - DNA, 1193 bp, Artificial
  Synthetic
tataggcaagcgcagcttgtccctcaaccggcagatatggcggcggtggcggcgattcattcatcgcattcgctggggcaattgccactggcagagcgaagtgatcgacttcctgccgccattgcaaccaagtcatcctttcatggaggcaagatcgcattatcagatctaacgtatagctacaggccactgaatggcaaggtctccgtgagagcatcggcagtgtccaccgagactgtggagaaggtgaagaagaaagccgaagaaggtgtcgtcacaaacttgtttaggccaaaagaaccttatattggtcgttgcctcctcaataccaaaatcgtcggagatgatgcaccaggagagacttggcatatggttttcagcactgaagggaaaattccatacaaagaaggccaatccatcggaattatcccaccaggagtggatgcgaaaggaaagcctcagaagctccggctttattccattgcgagcagtgcccccggggactttggtgattataaaactgtctctctgtgtgtgaagcggctcgtctacttgaatgataaaggagaggaagtcaagggcgtctgctcgaactttctctgtgatctaaagccaggagaggaagtgagcataactggacctgttggaaaggaaatgctcatgccagttgatccaaacgcgaccattatcatgctcggtactggtactggtatcgcacctttcagaggcttcttgtggcggatgttcttcgagaagcacgaagattacaagtttaacgggcttgcttggttgttcctgggagttccaaccagcagctcactgctgtacaaagaggagttcgagaagatgaaagaaaagttcccagacaacttcaagctcgacttcgcagtgagccgcgagcaaaccaacgccaaaggcgagaagatgtacatccagacgagaatggccgagtatgccgaccagctctgggagctgctcaagaaggacaacaccttcgtttatatgtgcggattgaaaggaatggagaaaggaatcgacgacatcatgaccggcctcgcagcgaaagacgggattgactggatggagtacaagagacagctaaagaaggcggagcagtggaatgttgaagtctactaaaaacagtgctcgcatttgtcgaaagctcgcaatgtaaactacaccgtacaacgtaa

SEQ ID NO: 2045 - DNA, 602 bp, Artificial
  Synthetic
cggacgcgtgggtttttaccagaatcctcgtgggataactcttaactccgccggcgaacactctgcctctattactccgtcactgaatctcgccggagcaataaaatggtaacgtctgccatcaccggaacgtcaattattccagtctctttccggcagcaaacgtcttcttcgtctctgttttcatctagatgcttaaggaagcagatagtttctgttctccgaagtccgtattctgattcatcagctattggattgtctcacaagactctgaaaaccccgttaaagctcaatgagcacgaatccagcggtcttaccaattcaagctatggtgttatcgaagcaaaaaaggggaatccacccgtcatgcctgctgtgatgacaccaggggggcctttggatctctctactgtgttattcaggaatcgaattatcttcattggacaaccaatcaactccgcagttgctcagagagttatatcacaacttgtgaccctcgcaactatcgatgaaaatgcagatattttgatctatcttaattgtcctggtggaagtacctattctgtcttggcaatatatgactgcatgtcatggataaagcc

SEQ ID NO: 2046 - DNA, 538 bp, Artificial
  Synthetic
tctccacaggcagtcccgtcgatcacatggcaatggctgacgtgaaggagaacgatacgtaccaagatgacctcctcgactatgaagaagaagaagaggttgcccctgatgctggtgctgcaaaggttgcagcggaagcggtcaggcggggctatgttggaattcacagttcgggcttcagagatttcctcctcaaaccagagctgcttcgagccattgtcgattgtgggtttgaacatccctctgaagtgcaacacgaatgtattcctcaggctatgttatggatggacgtgatatgtcaggcaaagtctggaatgggaaaaactgctgtgttcgttctgtcaacattgcaacaaattgagccagttgcagggcaagtggctgcactagtgcttagtcatactcgagagcttgcataccagatttgtaatgagtttgaaaggtgcattacataccttcctgacatcaaggtggcagtgtcctatggtggtgttactataaagacgcacaaggagttgttgaagaatgaatgccccca

SEQ ID NO: 2047 - DNA, 582 bp, Artificial
  Synthetic
aacaatgtcccacgaaggcgaagaagaactcctcgactactccgatagcgaagaaatcgctctcccctccaccaccgtggagtctggctccaacggcgatgccaaggccgagaccaccaccgtcaaggaggagaacaccgagcagaagggctcctacgtcggaatccactccaccggtttccgagacttcttgctcaagcccgagctcctgcgagccattgtcgactgtggtttcgagcatccctctgaggtccagcaagtgtgtatcccccagtccattcttggaactgacgttctctgtcaggccaaggccggtgtgggtaagaccgccgttttcgttctctccaccctgcagcagctggagcccgtgcccggcgagtgctccgttgtcgttctgtgtcacacccgagagctggcctaccagatcatgaacgagtacgcccgattctccaagtacctgcccgacgtcaagaccgccgtcttctatggaggttcccccatccagaaggacattgagctgatccagaacaaggagacctccccccacgtcattgtcgctacccccgggcgactgcacgccct

SEQ ID NO: 2048 - DNA, 596 bp, Artificial
  Synthetic
atcccttctaacttcttccaaacctacttttaactccaaatggcagaaaataacgaagatttgattgcctactccgacgatgatgaccataacgacgtcaaagtcaaaaagggtgacggaaacaagaacgccaccggcggtggtatttcaactctccacgctactggattcaaagacttcttgctcaagtccgagctcattcgagccatctccgaagccggcttcgaacatccatctgaagttcagattaattgcattcctcgtgctattgaaggaaaggatatcctctgccaggctaaatctggaatgggaaagactgctgtattcgtgctttcacttctacagctattggacagcaagaacccagagccactcgctgcacttgttctttgccacaccaaagagcttgcccaccagattaaccgagagatcgtcagattaggaaagtaccttcctagcatcaagtccgcatcaatcgttggtggtgactcgattgaagaccaaatcaaaatgttgaagaccaatccaccaaacatcgttgtaggaactcctggaagaatcttggatctcgtaggcaagaagcacctcgatatctc

SEQ ID NO: 2049 - DNA, 621 bp, Artificial
  Synthetic
cggacgcgtgggtggcaccagagggttctcaatttgatgctcgtcagtatgacgccaaaatgacagagctgcttggtactgaacagcaagaattcttcacatcatacgatgaggttcacgaaagttttgatgccatgggtttgcaagaaaaccttctgaggggcatttatgcctatggttttgagaagccatctgctattcagcaaaggggcattgttcccttttgcaagggccttgacgttatccagcaggcacaatctgggactggaaagactgcaactttctgctctggaattctccagcagcttgattacagtttagttgaatgtcaggctctggttcttgcaccaacccgtgagctagctcaacagattgagaaggttatgcgggcacttggtgactatctaggtgtgaaggttcatgcttgtgttgggggtaccagtgtccgtgaggatcagcgtatccttcagagcggtgttcatgttgtggttggtactccaggccgtgtctttgacatgctgcgcaggcagtctcttcgccctgacaacatcaagatgtttgttttggatgaagccgatgaaatgctctctagaggtttcaaggatcagatttatgatatat

SEQ ID NO: 2050 - DNA, 711 bp, Artificial
  Synthetic
gcatggctaggttttacagatcaggttttctctcttcttcttcttgcacaaaatcatggctggaatggcaaacgagggcacgcagttcgatccgagccagtacgacaagaaaatggaattcgccttggaatccggcgaagaggccatctcaagctgggaagaggttaacgaatcgttcgattcgatgggcctccacgaaaacctcctgcgaggaatctatgcctatggtttcgagaagccatcggcgatccagcagcgaggaatcgttcccttctgcaagggcctggacgtgatccagcaagcccaatcaggaaccggaaagaccgccaccttctgcgctggtatcctccagcagctcgagttcaacctcaacgaatgccaggctctcgtccttgccccgactcgcgagctcgcgcagcagatcgagaaggtgatgcgagctctcggcgactacttacagaccaaagttcacgcctgcgtcggcggcaccgacgtccgccaggaccagaagatcttgcaggctggcgtccacgtcgtggttggaactccaggccgcgtctatgacatgcttcgccgccgcgctctccgcgccgactacatcaagatgttcgtcctggacgaggccgatgagatgctctcgcgtggattcaaggaccagatctacgatattttccagctgctgccttccaaggtcaagtcgggctcttctcc

SEQ ID NO: 2051 - DNA, 836 bp, Artificial
  Synthetic
attactcgaccacgcgtcgatccttctacttcttccaaacctacttttaactccaaatggcagaaaataacgaagatttgattgcctactccgacgatgatgaccataacgacgtcaaagtcaaaaagggtgacggaaacaagaacgccaccggcggtggtatttcaactctccacgctactggattcaaagacttcttgctcaagtccgagctcattcgagccatctccgaagccggcttcgaacatccatctgaagttcagattaattgcattcctcgtgctattgaaggaaaggatatcctctgccaggctaaatctggaatgggaaagactgctgtattcgtgctttcacttctacagctattggacagcaagaacccagagccactcgctgcacttgttctttgccacaccaaagagcttgcccaccagattaaccgagagatcgtcagattaggaaagtaccttcctagcatcaagtccgcatcaatcgttggtggtgactcgattgaagaccaaatcaaaatgttgaagaccaatccaccaaacatcgttgtaggaactcctggaagaatcttggatctcgtaggcaagaagcacctcgatatctccaagctgaaattcttcgtcctggacgaatgcgatgtcatcctcgaacaaattgatatgagaaaggacatacagaagatcttcacagagactcctcaagacaaacaagtcatgatgttctcagcaactatgtccggcgacacaaagaaagtctgcagaaagttcatgcaaaaccaagaagacattttcatcgatgacgaggctaagctgacacttcacggtctg

SEQ ID NO: 2052 - DNA, 807 bp, Artificial
  Synthetic
ggggtttttcctatttttgtcctaacattttttctgcagacgcttccgaaaccctagccctaatttccccgaccaagatccaacttttctctgagattttgtaagtaatagttcgtagcaaaagaatgggagataacaaggagaacgatgcatatgaagaggaactactcgactatgaagaagatgatgaaaaactccctgattccgtcaccggaaaagtcaatggcgagtccgccaagaagggttatgttggtattcatagttcgggtttcagagattttcttctaaagccagagctattgcgggctattgtggactctgggtttgagcatccttccgaagtgcaacatgagtgtattccacaagctattcttggaatggatgtgatttgccaagctaaatctggaatggggaaaaccgctgtttttgttctttcaactctgcaacagattgaacctgttgctggtcaggttgctgccctggttctctgtcacactagggaattagcttatcagatctgtcatgagtttgagaggttcagcacatatctgcctgatatcaaggttgctgttttctacggtggtgtcaacatcaaactccacaaagagctgctgaagaatgagtgtccgcatattgtcgttggaactcctggaagagtacttgcattggcaagagacaaggacctgtctttgaggaatgtgaggcattttatactagatgaatgtgacaagatgcttgaatcacttgacatgaggagagatgtgcaggaaatcttcaaaatgactcctcatgacaagcaagtcatga

SEQ ID NO: 2053 - DNA, 766 bp, Artificial
  Synthetic
tgcagacgctacaaaccctaaccctatttcgccgcaagaactcagcttttccgataggctccagctgagttaagtagcaaaaatgggagagaacaaagagaacgatgcttacgaggaagagcttctcgactacgaagaagatgatgagaaggcccccgattccgtcaacggaaaagttaacggcgagtccgccaagaagggttatgttggaattcacagctccggattcagagactttcttttaaagccagagctactgagggctattgtggattcagggtttgagcatccctctgaagtgcaacatgagtgtattccacaagctattctgggtatggatgttatttgtcaagccaaatctggaatgggcaaaacggctgtttttgttctttctactctgcaacagattgaacctgttgctggtcaggttgctgccttggttctatgtcatacaagggaattagcttatcagatctgtcatgaattcgaaaggttcagcacatatttgcccgatatcaaggttgctgttttctatggtggtgtgaacatcaaacttcacaaggagcttctgaagaatgaatgccctcacattgttgttggaactcctgggagagtactttcattagctagagataaggacctatccctaaggaatgtgaggcattttgttctggatgaatgcgataagatgcttgaatcacttgacatgaggagagatgtccaggaaattttcaagatgactccccatgacaagcaactaatgatg

SEQ ID NO: 2054 - DNA, 619 bp, Artificial
  Synthetic
acaaggtatatttgataaaaaacaccaattgaaaacaaaatggccgacggactcaccgacatcgattcttcccagatcaccaccaactacgacgaggttgttacctctttcgacgaccttggactcaaggacgagctgctccgaggtatctacggttacggttttgagaacccttcctccattcagcagcgagccatcctgcccgtcatcaagggtaacgatgtccttgcccaggcccagtctggtactggtaagactgccaccttctctatctctgctctgcagaacattgacgagaagattaagaagccccaggctctgatcattgcccccactcgagagctggcccaccagatccagaaggttgtccttgcctttggcgagtacatgaagattgagtgccacgcctgcattggtggtacctccgtcgccgaggacatccgagtcatccaggagggtgtccacgtcattgtcggaacccccggtcgaatccacgatatgattgagcgacgaatcctcaagaccgacctcatcaagatgttcatccttgatgaggccgatgagatgctttctcgagagttcaaggaccccatctacgatatcttcaccaccctccccg

SEQ ID NO: 2055 - DNA, 609 bp, Artificial
  Synthetic
agaggaagagatttgcagcgttagggtagcggcagctctaaatctctctctcgcgaagacaagggccaccgcatctccggtcgcgaatctggaaatgggagaagccaaggagaacgacacctatcaagaggagcttttggactacgaggaggaagaagaggcggcccccgacgccgttgcagctaaggctgccacagagactgtcaaaaagggatatgttggtattcacagctccggttttagagatttcctgctcaaaccagaacttgttcgggctatcgttgattgcgggtttgagcatccatccgaagtgcaatttgagtgcatcccgcaagccatacttggaatggacgtcatctgccaagcgaagtccggaatgggaaagaccgccgtgttcgtgctttcgacactgcagcagatagaaccactcaaggggcaagttgctgctctggtcctgtgccacactcgagagctagcatatcagatttgccacgagttcgaaagatttagtacataccttcccgatatcaaggttgcggttttctacggtggtgtcaacatcaagacccacaaggacctgctgaaaaatgaatgcccgcacatcgtggt

SEQ ID NO: 2056 - DNA, 627 bp, Artificial
  Synthetic
acagggcgtagggtttggagattctccgccgcgggatcgctactccggaagtggagaatgggagggatttgctgggccttcagaatgtggcgtgattccagtgagatctagagctcgagaggcacgattagatgcggactttgtgcgatgtctgcgaatcagccccggcgaagctcttttgtgcggcggacgaggccgccctgtgcacgaagtgtgatgaaaaggttcatggatgtaacaagctagctagccgtcatgtccgcctccagctcgcggaagccagagctgtgcctcgatgtgatatctgcgagaatgctcctgcatttttctactgcggcattgatgggacctcactctgcttacaatgtgacatggatgtacatacgggaggaaagaaaactcacgagagatatctcatgctgggacaaagagtagagcttcgtacttgtaactctcagccagaagataccggtgtacaatcaaacgatcaccgcggacgtaaccattaccacccgccaaagcgggtggccgtgaccaaatccaacaacagtgacgcccccgctgttgccatcgctgttggtgatgccgaagcgcagcagtccaagagcgatcaagccgtctcaaaca

SEQ ID NO: 2057 - DNA, 623 bp, Artificial
  Synthetic
agaaagctcaagctactgtaatttgctgtgctgatgaggctgctttgtgtgctaaatgtgatattgaagttcatgctgcaaataaactggcaagtaagcatcagaggcttcatcttcactgcctctccaacaagcttcctccttgtgatatttgccaagataaagcagccttcatcttctgtgttgaggatagagctctcttttgcaaggattgtgacgaagcaattcattcagctagcagccttgctgctaaccaccagcgcttcctagccactggaattcgagtagctttgagctcaagctgcaataaggaagcagtaaaaacccaattggagccaccacaaccacctcagcagaactcccaacaagttggtttgaaaatgcctccacatcaattgtccggtatcacgtcaccgtcttggcctgttgatgatttactaggatttccggattatgattcgactgacaagaaggaactacttgaacttggtgaactggagtggttgggggacattgatctctttggtgaacaaacagcagctgaagtacccgagctatcagtatctcagtcgagcaacacacataatatttacaagcaaaccagatatcaaatgtcttacaag

SEQ ID NO: 2058 - DNA, 501 bp, Artificial
  Synthetic
tttccttcttaaaaactctcctccatttctgatcttttctctctattctcatttcttctaaaaacttcttcttcaatcttacaatcttgatatataggaacaagaataacatatctgaaaaatcaaatgaagatccagtgtgatgtttgtaaccaaaaccaagcctcagttttttgtgttgcagatgaagctgccctttgtgattcttgtgaccatcgtgttcatcatgccaataaacttgctggcaaacaccaacgtttttctcttctccaaccttctcctaaacaagtccctctttgtgatatttgtcaggaaagaagggcctttttattttgtcaacaagacagggcaattctatgcagagagtgtgatacttcaatacacaaagctaatgaacatacacagaagcataatagatttcttcttactggtgtcaagctttcagcaaactctgcccttcactcttcaacagaatctcaatcaacaacttcctctaccaat

SEQ ID NO: 2059 - DNA, 948 bp, Artificial
  Synthetic
ccccccggttttcactcatccgccgctgagctctatctatctactagttagtttacccgccttgagggtaaatcgagctttgggggcggctttgaggggagtacatcggcatgaggatccagggcgacgcgtgcgaggccgcggcggccacggtggtgtgctgcgcggacgaggcggtgctgtgcgcgcgctgcgacgtctagatccacgccgccaacaagctcgccagcaagcaccagcgcctcccgcttgacgccgtgctccccgccgtcctcccgcgctgcgacgtctgccaggagaaggcggcgttcatcttctgcgtggaggacagggcgctcttctgccgggactgcgacgagcccatccacgtcccggggacgctctccggcaaccaccagcgctacctcaccaccggcatccgcgtcgggttcagctccgtctgtagcgccaacgccgaccacctcccgccgccagcgcccaaggggaactccaagccgccggcaagcggcatcgctgctgctgctgctcccaagccggccgtgtccgcggcggcgcaggaggtgccgtcgtcaccgttcttgccgccgtcgggctgggccgtcgaggatctcctgcagctctccgactacgagtccagcgacaagaagggctctcctattgggttcaaggatctggagtggctcgatgacatcgacctgttccatgtccagtcgccggccaagggaggcagcacggcggcggaggtgcctgagctcttcgcctcgccgcagccagcgagcaacatggggctctacaaggcgagcggtgcacgccaaagcaagaagccacgggtggagatacccgatgacgacgaggacttcttcatcgttcctgatcttggatgagatgttgttatgtaacagtaatgctatgcaagtgatgtaattttggatgtatgcaaagaacact

SEQ ID NO: 2060 - DNA, 619 bp, Artificial
  Synthetic
gagaagttccgtgtgctgcatactccgactgccttcggaaaccatcctgacatattctagcgagcaacagtttagaagtaggagtaggactgctggtattgccaagatagcgtaaagagagagaaaaagctattgtaggaaggaagatatagtataggtggggaagttagaggtgggacttttgaggtggtggggggagaatctttgccttagtagaaatggggatacctttaccatacgaatccgatggtgacgttgaagagaacaagcttggccatttcgaggggtttgagaagcggctggaagtggaattttacccctgcttatctacttgcgaagtaggccaaggattgagggatttaacccgggagcagctcgatgaaatgctcgatgctgcgcaatgcaccattgtggcacagttgagcaatgatcattttgactcgtatgtgctttctgagtcaagcctatttgtttaccctaattacatggtcatcaagacatgcggaactacaaaccccctaaacgctatacctttgctgctatgctatgcttcggggttgggcctgaaggtgcggcggtgcaagtacacccggggggcgtaccttttccctgaggatca

SEQ ID NO: 2061 - DNA, 709 bp, Artificial
  Synthetic
gaattcaaatcaaaaggtttctaatctgttcttggggctgttcaaagttcgatagcatcttatttacccagtttctagggtttgtttcttttgaagaaaaggaggatttgccaaaggtcttcgtttcgatcagaaatctttttagcgttgaaaaagactgaatgatattacccaactaatggaggctaaaggtggtgaagattctagtagtaaatccttagtttatgaagctcctctaggttacagcatcgaagacatccgaccagctggtggaatcaagaaattcaagtctgctgcttactgcaactgctccaggaaaccatcctgatatcttttaagccgtctttcgaccactttcagtggaattttctttaggtgttcagtttccttcattgttttttaatactctttcccaacctcaaattttcacctcatttgtcaacaacctacttctttttaagaaatggcctcaccaacctctgcaatcggtttcgaaggtttcgagaaaagactcgaaatctcattctttgagcctggggtatttgctgacccagcaggcaatggccttagggctctaacaaaatctcaactggacgagatactagaaccagctgagtgcactattgtagggtccatgtccaatgctgatctcgactcctacatactctctgagtctagcttctttgtctacccatacaagatgatcatc

SEQ ID NO: 2062 - DNA, 830 bp, Artificial
  Synthetic
gttcgacctgccggaggcgtgaagaagttccagtctgctgcttactccaactgcgcgaagaagccatcctgatagccctttcggcttctccatcctagtagtttaggatttcttgcaattccattttggcacttttcttctgacctatttctctggctgctgcttcctgataatcgaccagttctctagtcttgctccctgcactcctccctcctccatctccggcacagtgttctgaccaacctgctccaatgggtgtcttgtctgctgctgaccctcccccagtctcagcaattgggtttgagggctatgagaagcgccttgagatcactttctctgaggcacctgtctttgctgaccctgatggtcggggtttgcgcgccctctccagggcccagattgactctgttctggatcttgcacggtgcaccattgtgtccgagctgtccaacaaggactttgactcctatgtcctctctgagtccagcctgtttatctattctgataagattgtgattaagacctgtgggactacaaagctcctgctcacaattccaaggattcttgagcttgctgaagggctttctatgccacttgctgctgtgaagtactcccgcgggatgttcatcttccccagtgcacagcctgctccccacaggagcttctctgaggaagttgctgtcctcaaccgctactttggccatctgaaatctggtggtaatgcttatgtgattggagatccagcaaagcctggccagaagtggcatatctactatgctactcagcacccggagcaacctatggttacccttgaaatgtgcatgaccgga

SEQ ID NO: 2063 - DNA, 661 bp, Artificial
  Synthetic
gaccagttctctagtcttgctccctgcactcctccctcctccatctccggcacagtgttctgaccaacctgctccaatgggtgtcttgtctgctgctgaccctcccccagtctcagcaattgggtttgagggctatgagaagcgccttgagatcactttctctgaggcacctgtctttgctgaccctgatggtcggggtttgcgcgccctctccagggcccagattgactctgttctggatcttgcacggtgcaccattgtgtccgagctgtccaacaaggactttgactcctatgtcctctctgagtccagcctgtttatctattctgataagattgtgattaagacctgtgggactacaaagctcctgctcacaattccaaggattcttgagcttgctgaagggctgtctatgccacttgctgctgtgaagtactcccgtgggatgttcatcttccccagtgcacagcctgctccccacaggagcttctctgaggaagttgctgtcctcaaccgctactttggccatctgaaatctggtggtaatgcttatgtgattggagatccagcaaagcctggccagaagtggcatatctactatgctactcagcacccggagcaacctatggttacccttgaaatgtgcatgaccggactggac

SEQ ID NO: 2064 - DNA, 667 bp, Artificial
  Synthetic
gaattcaagcaaaagaaatatctaagtgaaggcaaaccggagtcatcttgaacccagttacatcctcaaaaatacatatttgaatcatcgtgaatgttttaatggagtcgaaaggtggtaaaaagtctagtagtagtagttctttacaatacgaagcacccctcggatactgcattgaagacattcgaccaaacggaggaattgaaaagttcagatctgctgcatactcaaactgcgtgaggaaaccatcctgataggaccttatatgttttcaaacgtagagtaggatttccctatttccagtttaatcttaaatcctgcaaaatataatcttacaaatcaatttctctggctttcttattttcttctttttcttcaataatcacaccaagaaacagtctttcttcttcctccacttaatctttctaaaagctttcaatttcaatcacaatgggtgtctacgctaacccaccatctccaattggtttcgaaggatttgaaaaacgtcttgagattactttctctgaagctccaatttttgttgatccacaaggactcggtctccgagccttgactcgtcctcagattgatacaatccttgatgctgctaagtgcactattgtcgatcaactatctaactcagagtttgactcgtatgttctgtctg

SEQ ID NO: 2065 - DNA, 1005 bp, Artificial
  Synthetic
tgatattccctaagctttcatccttaacgcgtcaatagacgcgacccaaaaaaaacaaaaaaaaatttctgctttcattttattttgcgccctcactccttttcttccttcttttactactttctgcttttgtgctcattgctcggaacattttcctctttaacttgttttgctgccgtgaaccattttcatcatggatatggccttgccagtctctgccattggttttgaaggttttgagaagaggcttgaaatttctttcttcgagcctggtctgtttgctgatcctaacggaaaaggacttcgatctctctcaaaggcacaattggatgaaattctcggacctgctgagtgcaccattgttgattccctatcaaatgacgatgttgattcctatgtcctctccgagtcgagcctctttgtttattcttacaagataatcatcaaaacctgtggcaccacaaagttgcttctcgcaattccgcccatcctaaagttggctgagaccctgtctctcaaagtacaagacgtgaggtatacccgtgggagcttcattttccctggtgctcagtcttttcctcaccgtcacttttctgaagaagttgctgtactcgatggctattttggaaagcttgctgccggtagcaaggctgtgattatgggcagtcctgataaagcacagaaatggcatgtttactctgcctctgcaggacctattcagtctaatgaccctgtttacactcttgagatgtgtatgactggtttggacagggagaaggcatctgtcttttacaagactgaaggaagctcgtctgctcatatgaccgttcaatctggaataaggaagatcctccccaattctgagatatgcgattttgagtttgaaccctgtggttattccatgaattcgattgaaggagctgcactctcaaccattcacattaccccagaagatggctttagctatgctagctttgaagcagttgggtatgatatgaaaaccat

SEQ ID NO: 2066 - DNA, 701 bp, Artificial
  Synthetic
tggcatgtctattctgcttcagctgaatctgctaatgccaataacccgaatccagtttatacactggagatgtgcatgactaatctggacaagaataaggcatccgtatttgtcaagactcaatcaagcactgccgctgagatgactgaagtttcaggcattcggaagatccttcctgaatcaaacatatgcgactttgactttgacccttgcggttactcaatgaacgctatcgaggggccagcaatctctacaattcacgtcacgcctgaggatggattcagctatgcaagttttgaagcagtaggttatgatttcaaagccgtaaacttgactgccatgattgagagggtgttgtcctgcttcggacctgctgagttttctgtatcactacactgtgacactcctgggaaggaactttatactgagtccggcctggacattattggatacgcctctggagaaaagactactgaagtgctttgtgagggaggatcacttacgtacctcacattcagtagcaatggtagctgtggatcccccaggtcgatcttccattgcagttggagcgagagcgaggatgaggaaatggagaagatatattaatgagaaattggtttattctccgttttagtatgcaatactatagctggtatagatccagccatgcttttcttattggtttatgaattatgagtcta

SEQ ID NO: 2067 - DNA, 859 bp, Artificial
  Synthetic
gaaagatgcagttaggaacaccttttggtgcatttcttgatcctgtggctgacaagcttatggtagctgcaacattagtgttgctgtgcaccaaacctttggaaatttcactgctcagagatgggccatggcttctaacggttcctgccattgctattattgggagagagatcacaatgtcagctgtgagagaatgggctgcgtctcagaataccaaagttcttgaggctgtggcagttaacaatttggggaagtggaagaccgcaacgcagatgacagcattgactatcctccttgcgagcagagacaaaagtcttcctgcacaagatgctctggttacttccggcatcgcattgctttatgtatcagctggacttgccatatggtccctagtggtgtacatgagaaagatatggcggatacttctaaaatagccgtagcacatagtgtaatagaaggaacaggagcaagccagcaaggtgatattacatttcaagagcatacaatttttgaactgcggagttgattgatggacctagaattggttgagatcctcagctacttacgcattgtctcagtttggcggattagttgctaagttgctgtgcctgcaagatctccgtagaaacaaaaaacatagtagcaagtagtatgttgcccgggtgattacttcttcgaaagctattttcagagcctatcacggctcgagtgttggacactgggtgtaatgatctgcaaaactgaaaaatgcagaagattgtaaccgtatacgaatacaaaaccatgaggtttgagtgtgtgactctggggtttctatagtttctaccattgtaagtttacccatatgatatgtcagaag

SEQ ID NO: 2068 - DNA, 624 bp, Artificial
  Synthetic
attctctgtatttttgtaccacaaacaaactacacaccattgctctctgctaaatatgaaagcagaattttcgtaccgttcatcgagtttgtactcttcttcttgttattaggagtattattatattactattgtaattcagcaactggctttgatcaaatagaataaaaggaaattgatctttttattcaaagttaatggagagtacagattcatcaagcggctctcatcagcagcctcaccttccacctggcttccgttttcaccctacagatgaagaactcgtcgttcactacctaaagaagaaagctgcttctgttcctcttcccgttgctattattgctgaagttgatctttacaaatttgatccctgggaactccctgctaaggcaacgtttggagaacaagaatggtattttttcagtccaagggataggaagtatccaaatggggcgaggccaaacagagcggcaacttctggttactggaaagctacaggaacagataagccggtgctcaccgccggtggaactcaaaaagtgggcgttaaaaaagcactggttttctatggaggtaaacctcctaaaggggtgaaaaccaattggatcatgcatgaatatagac

SEQ ID NO: 2069 - DNA, 575 bp, Artificial
  Synthetic
ccccccccccgattcgagaaatccctcacaggccacaacattttcaaacaacgcaaagcagtagcagcagcgagaagcaagcaagaagcgatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcccaatgggtcacgccccaaccgcgccgccggcaacgggtactggaaggccaccggcgccgacaagcccgtcgcgccgcgtgggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgct

SEQ ID NO: 2070 - DNA, 565 bp, Artificial
  Synthetic
cccgcacacccgcgacaagctcagctcggctaggccaagacggtggcgagcggcggcgatctggtggtctgcttgggttgagttcttgattttgccgaggtgtatcgatggagacgacggcggcgaataagctgccgccggggttcaggttcaggcccaccgacgaggagcttgtggtgcactacctccgccgccgcgcgctcggctcccctctcccacccgccgtcgacatccccgatgtccgcctcctcgcgcatgacccctccgacctgcttcctccaggtgagtcatgagccagctcgccgccgtcgcgcggcgtcgtcggagcgtggccggccggcgctgacgaggtcccgtgcgtgcagggtggagtgagcaggagaggtacttcttcacgtgcaaggaggccaagtatgtcaaggggcgccgcgccaaccgcgccacgggcgccgggtactggaaggcgacggggaaggagaagccggtggcggtgtccgtggcggcggcgccgaggagccaggcccgccgccgtcgtcgtcggcatgaagcgctccctcgtgttcta

SEQ ID NO: 2071 - DNA, 474 bp, Artificial
  Synthetic
  misc_feature (88)..(88): The residue at this position can be any nucleotide.
ctcctctcctcttcccaacactagtaggataaagccacagagagagcagtagtagtagcgagctcgccggagaacgggacgatcaccnggagaagggggagagagatgagcggcggtcaggacctgcagctgccgccggggttccggttccacccgacggacgaggagctggtgatgcactacctctgccgccgctgcgccggcctccccatcgccgtccccatcatcgccgagatcgacctctacaagttcgatccatggcagcttccccggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaag

SEQ ID NO: 2072 - DNA, 684 bp, Artificial
  Synthetic
aacccacaacattttcaaacaacgcaaagcagtagcagcagcgagaagcaagcaagaagcgatggggatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcctaatgggtcacgccccaaccgcgccgccggcaacgggtactggaaggccaccggcgccgacaagcccgtcgcgccgcgggggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgcc

SEQ ID NO: 2073 - DNA, 429 bp, Artificial
  Synthetic
ccgcctctactccccgcacacccgcgacgggctcagctcggctaggccaagacggtggcgagcggcggcgatctggtgctctgcttgagttgagttcttgattttgccgaggtgtatcgatggagacgacggcggcgaagaagctgccgccggggttcaggttcaggcccaccgacgaggagcttgtggtgcactacctccgccgccgcgcgctcggctcccctctcccgcccgccgtcgacatccccgatgtccgcctcctcgcgcatgacccctccgacctgcttcctccagggtggagtgagcaggagaggtacttcttcacgtgcaaggaggccaagtatgtcaaggggcgccgcgccaaccgcgccacgggcgccgggtactggaaggcgacggggaaggagaagccggtggcggtgtccgtgg

SEQ ID NO: 2074 - DNA, 626 bp, Artificial
  Synthetic
cccacgcgtccggtatttagacatcccagcaaaaaaaaaaagtttaaaaaaaaaaaagaggcaagggagagtaaattgattgcgaaaaaaaaataaaaaaaaatcacagcagcagagttgcaattacctccaggtttcagatttcacccaactgatgaagagcttgtgatgcactatctatgccgaaagtgcgcctcccagccaattgccgtaccaattattactgaaattgacctctacaagtatgacccttgggatcttcctcatttggcattgtatgggcagaaagaatggtacttcttttcacctcgagatcgaaagtatccgaacggttcacgcccaaatcgagctgctggaactggttattggaaagcgactggtgccgataagccgattggacatccgaagccaatgggaattaagaaagcattggtgttttacgccggcaaggctcccaaaggagagaagactaattggatcatgcacgaatatagacttgctgatgttgatcgatctgctcgtaagaataacaatagcttaaggctggatgattgggttttatgccgaatatacaacaaaaagggctcgattgaaaagaatcaactcagtaaccggaaaatgaacac

SEQ ID NO: 2075 - DNA, 648 bp, Artificial
  Synthetic
gaattcaagaacatcaccagcataattcttcgggtcaaaaagcagtttcgtcggtttcacaaaacagataaatattgatagatttgagatataaatatagatttattgtgagatttactaaaaacatacagttgagagatagagatttagagaaacagaaaaaaaaaacagaggataattaatacagtttcattattgttagagagacagagagtccgagagaaggaaggaaaacagaggtagaagagagtatcttgatggtgaaagaagtggagaaattgggaatgcgacttggaaaatacgagcttggtaaaactcttggtgaaggaaatttcgcgaaagttaaatacgctcagaatcttgaatctggacagatttttgctgtcaagattttggagaagaagaaaatcattaacctcaaagttaacgatcagattaagaatgagattggaacattgaaactgttgaagcatccaaatgttgtcagattacatgaagtcttagcaagtaagacaaagatatacatggtgcttgaatatgtaggaggaggtgaattgtttgacagaattgcaacaaaagggagggtttcggaagctgttggtcggaagcttttccaacagttgattgatggtgtgagttactgtcata

SEQ ID NO: 2076 - DNA, 615 bp, Artificial
  Synthetic
cctgcattccatgaatctagttacaatctttacattaacccaaatgccgaactaatcccttaattttcccaatcctttcttcttcaatttcataccaccgcttctctgcatagctcttctctttacgttgcttttcaacgcagcttcatcgctccacgccggaaaatggatggatcaacagtccaaggtgggagcagcgtggagtcatttctgcggaactataagcttgggaaaactcttggcattggatcattcggaaaagttaaaatagctgaacataccttaacagggcataaagttgctgtcaagattctcaatcgtcggaaaatcaagaacatggatatggaagaaaaagtgagaagggaaattacaatattgagattgttcatgcatcctcacatcattcggctgtatgaggttgtagagacaccatcagatatatatgttgtgatggagtatgtgaaatctggtgagctgtttgattacattgtggagaagggcaggctacaagaggatgaagctcgtaaattcttccagcagataatctctggtgtggagtactgccacaggaacatggtggttcatagagatcttaagcctgagaacctccttttg

SEQ ID NO: 2077 - DNA, 610 bp, Artificial
  Synthetic
gttcaacaaagttcagagaggaagactaaaggaagatgcagcaaggaagtacttccaacaactgatttgcgctgttgacttttgccacagcaggggtgtttatcaccgtgatttgaagccagaaaatcttcttcttgatgagaacagcaatctgaaggtttcagattttggcctaagtgctcttgctgattgcaaaagacaggatgggctgctccacacaacctgtggcacacctgcttatgttgctccagaagtgatcaacagaagaggctatgacggtgctaaggctgacatatggtcttgtggagtgatactctttgtgctattggccggctatctacctttccatgataagaacttgatggatatgtataagaagattgggaaagcagaattcaaatgtccaagttggtttaataccgatgttcgaaggctcttgctcaggatacttgatcctaacccaagtacaaggatctcaatggacaaaatcatggaaaatccttggtttaggaagggtctcgatgcaaagctgctcagatataatctacaaccaaaggatgcaattcctgttgatatgagcacagattttgactccttcaatagcgctcca

SEQ ID NO: 2078 - DNA, 641 bp, Artificial
  Synthetic
ccccccggctcctccaacctggctcagtggcctcctgttcttgagagaactgaatctgctgtccagctgctgctccggctggtctctgagttgaaggtacttgaataacttgaaggttcctaggaaccttcatttgttggaagatgtatagggctaagagggctgcattatctccaaaggtgaagcgccgtgtagggaagtatgagctcgggcgcaccattggagaaggaacctttgcaaaggtccggtttgcgaagaacactgaaaatgacgaaccagttgctatcaaaatccttgacaaggagaaggttcagaagcacagattggttgaacaggcgtgaaatttgtactatgaagttagtaaagcatcctaatgttgttcggctgttcgaggtcatgggaagtaaagcaagaattttcattgttctggaatatgttactggaggagagctctttgaaatcattgcaactaatggaaggttgaaggaggaggaagcacgaaaatactttcaacaacttatcaatgcagttgactactgccacagtaggggtgtgtaccacagagacttgaagttagaaaatttgctgcttgatgcttctggaaacctgaaagtatctgactttggtttgagtgctttaac

SEQ ID NO: 2079 - DNA, 639 bp, Artificial
  Synthetic
attgattctctggtttctttctgtaaaccctagctaaaaataccctaattctctttcgggaatgcagagagatgagaggttatcggttttctgatccccttttgactgccggaaaaatccaaaaaccagtcgccggcggcaggaattgccaccggaaacacgtagaagacgggtgaatcaatcacccatttcgcccctttctgtcaaccatttccttttttctttacagaaacagacaccgttttcattctttagcctcttttttacaaatttaaccaaaatcttttccttttccaaaaaatggcacctgaggagaaatgcatggctttgtacggaaaatacgagctcggccgccttttaggccatggaacttttgccaaagttttccatgcacgtaacgtgcaaaatggcaaaagtgtggctatgaaagttgtgggcaaagaaaaagtgattaaaattggtatgatggatcaaatcaaacgagaaatctctgttatgaaaatggtaaaacacccaaatatcgttgagcttaacgaagtcatggcgagtaaaacaaagatttacttcgccatggagttcgttagagggggtgaattatttgcaaaaatagccaaaggcaggttaagggaagatgtggct

SEQ ID NO: 2080 - DNA, 422 bp, Artificial
  Synthetic
atcgtttagctggggcttggagaggcgatggatcaggagcagcagctggcgcagcagcagccggcgaggaggaatgaattcctgcactacaagctcggcaaaactctgggcattggatcgtttggcaaggtgaagatcgcggagcatatactcaccgggcacaaggtcgcgatcaagatcctcaaccggaggaagatcaaagccatggaaatggaagagaaagttcgcagagagattaaaatcctgaggttgtttatgcatccacacatcataaggttgtatgaagttgtggagacgagcacagacatttacgtggtcatggagtacgtcaagtcgggagagctcttcgactacattgttgagaatgggcggcttcatgaagatcaagctcgacgtttctttcagcagattatatcaggcgt

SEQ ID NO: 2081 - DNA, 619 bp, Artificial
  Synthetic
gcaaagtgttagaaccagagtcggtaagtatgagatcggcaggacactcggggagggtacttttgcgaaagtcaagttcgccaagcacatcaaaactggacatggtgtggctatcaagattttggacagagatagggttctcaagcacaagatggtcgagcagatcaagcgagaaatttcgacaatgaaacttgtgagacatccgaatattgttcaaataaaggaggttatggccagcaagtcgaaaatctatattgtcttggagcttgtcacaggcggtgaactctttgataagatcgtccatcaaggcaggctcaaggacgacgaagcaaggaaatattttcagcagctgatcaacgcggtggactactgccacagtcgtggagtataccaccgtgatttgaagcctgagaatctgctgctagactcaagcgggaatcttaaaatatcggattttggtctgagcgctcttcctcagcaactccgggccgacggcttgctgcatactacttgtggaactccaaactacgtgtcgcccgaggtgatcaatgacaaaggttacgacggagcgaaagcagacttatggtcctgcggggttatcccttttgtcctcatggct

SEQ ID NO: 2082 - DNA, 1032 bp, Artificial
  Synthetic
ctcaaacatagcctttcgtattcagcttctcatatactcttcgatctgaatagtttattataatatttgagttctctttaatcttttttaatctttttattttggaaaagtttaagatgagtgtatccaagtcccaggtttggcaaccttgtaaaaagaagaggatttagcttaaggcttaatccagaagtaaaaaaaataaaagaagatttttttatagggaagaaaaaaaagaggatggtctttgtattgatttagggtagggatttaataagattgtaggatctgtaagaaatagaaagtttggagatagatgggttcaagatcaaataatggaagtgggaggactacagtgggaaggtatgagatagggaggacagttggggagggtacttttgcaaaggtcaaatttgcaaggaatgttgagactggtgataatgttgccattaagattcttgataaagagaaggtcatgaagcacaagatgatcggtcagattaaacgggaaatatcaacgatgaaacttataagacaccccaatgttatccgaatgtatgaggtcatggccagcaagtcgaagatatatattgttttggaatttgttactggtggcgaactgtttgacaaaatttctagtagaggtaggctcaaagaagatgaagcaagaaaatactttcagcaacttataaatgcagttgactactgtcatagtagaggtgtattccacagagacctcaagcctgaaaacttgttgctggatgcaaatggtgttcttaaagtttcggattttggactgagtgcactgcctcagcaagttcgcgaagatggactactacatacaacatgtggaacaccaaattatgtggctcccgaggtgatcaacaataaaggttatgatggagctaaggctgacctgtggtcatgtggtgtaatcctttttgtacttatggctggttatttgccttttgaagagtcaaatctcatggcactatataagaagataccataaagctgaattttacatgtccaccc

SEQ ID NO: 2083 - DNA, 611 bp, Artificial
  Synthetic
gtaaaacgtagaaaggtgctgtagcatagtctgtgctttcccctcttttcccttccttccttccttccttccaagtgcgaagaacggagaaggagtttgcctttcatcttggtgaaaacccggtgctgtaagaacaacgagtgatgagtctgcagagtgtgcggacgagggttgggaagtatgagctggggcgaaccctgggggaggggaccttcgcaaaggtcaagtttgcacggaatatggagacagacgaaagtgtggccatcaaggtcattctcaaggataagatcctcaaacacaagattgccgaacagataaagcgtgaaatatcaatcatgaagctgataaaccatccaaatgttgttaatttgcacgaggtgatggcgagtaaaacaaaaatctatattgttcttgagtttgttaatggaggcgaattgttcgataaaattgtccatcaagggaaactcaaagaagatgaagccagaaggtatttccaacaacttataaatgcggtggatttttgccacagcagaggagtttgtcatagagatttgaagccagaaaacctgcttctagatgcacgaggcactcttaagatttcagactttggt

SEQ ID NO: 2084 - DNA, 634 bp, Artificial
  Synthetic
  misc_feature (158)..(158): The residue at this position can be any nucleotide.
gaacaatgtcgggagcagaagaagacaagaagcccgccggcgatcaggctggtcacatcaatctcaaagtcaaaggccaggatggcaatgaagtattctttaggatcaaaagaagcacccagctgaagaagctgatgaatgcttattgcgacgatagntggtggatttcaattcaattgctttcttgtttgatggccgtcgtcttagagcagaacagacaccagatgagctggagatggaagatggtgatgaaattgatgcgatgttgcatcaaactggaggcacaattctttgagtcttctcttccgtttgtggacctagactttatgcgtgtttcaaggtggtatggactcggtgaaaatgtaggttgttcaactttagggcctgtagtgtgtaatgaatgtcatcatgtttgcttcatgttgactagctcggctgaacttcatcgctactgtaacttgatatgaaagtcattacttccttaaccgtttagttttctaaagatgacatgaattcaaagtcttggtttgtttcaaataaccccctcccccaaccttcatgaaataagaagcttggcaacacgaagtagctccagtgtaccctgctgggcacctcgtatatcacagtttggttc

SEQ ID NO: 2085 - DNA, 367 bp, Artificial
  Synthetic
cacgcgtccgcgcgaatctctcttatggcttcgcttatatcgcagatcgaagttcttgtttccaatcgccgaccgtataatctgataataaagtaagatgtctgctactccggaagaagacaagaagcctgaccaaggagctcacatcaatctcaaagtcaagggacaggatggtaatgaagtcttctttaggatcaagagaagcactcagctcaaaaaactgatgaatgcttactgtgaccgtcagtctgtggatttcaactcaattgctttcttgtttgatggtcgtcgtcttcgtgccgagcagactccagatgagcttgaaatggaagatggagatgagatcgatgcaatgcttcatcagact

SEQ ID NO: 2086 - DNA, 622 bp, Artificial
  Synthetic
tgcgaattacagagagagagagagaggaagagagagagaagaattccggcagctatggcggaggccacgaacaactatgccggagctccgaaggctgaggaggaaaagaagcctctcgaccagcacctcaacctcaaggtcaagggtcaggatggcaacgaggtctttttccggattaagcattcaactcagctacggaagttgatgcatgcttattgtgagaggcaatctatcgacttcaatgcaatcgcttttctatttgatggccgccgcttgcgagcagagcagactccggcagagttggaaatggaagatggtgatgaaatcgatgcgatgcttcatcagactggtggggcctgctgataataatctccaccttgccagtggttctctcttatgtatttttaactcgtataactgctgctcctttttgaaatcttaatcaacgtggtgtacttgtaccaaggatttctttgtttacttggggggcacaccaggtctgaagaaaaacactgcatttttcttctctacagtcatgatatatatttgtgcccaagagttgaactaaagttaggaaatccaaagatgtacctatgatttaacttgtgcacgtaaaagattc

SEQ ID NO: 2087 - DNA, 693 bp, Artificial
  Synthetic
aagcaaaggaatcggaatcaccaacctctcgaaaccgcatctgtaaaaagatacgcacgcgcgcatataaaaaccacacagaaaacatgtccgaaaacgataccaaccagtccccaggcgatcgccaggaccctccccccaacaccgagcacctcaacatcaaggtcaccgacaacaacaacgaggtcttcttcaagatcaagcgcagcaccaagctcgagaagctcatgacggccttttgcgagcgccagggcaagtccctcaactcggtgcggttcctgttcgacggcacgcgagtgcagccgacggataccccggacgcgctcgagatggcagacggcgacactctcgaagtgcatcaagaacaggtcggaggatgtctgcgaggatgacgctacaaaaagaccaagggcggacgggagatgatgataccaagtcggagaggagagaagcagaaagatagaagatggagggacatgtgcgtcagaactgggtaatttgggtcgcattctacctcccacactatctaccgtggtttgtgtaatacattagagcagagcagagagagagagagtcagagagggaacccgctattctacgacgtcgatcccaagagccaaaacggctctttctttacgccctttcggcctttcttgttttcctttctctcttccataatacggcagcggcgca

SEQ ID NO: 2088 - DNA, 618 bp, Artificial
  Synthetic
cccgaccagcacagggtcgtcgtcgtctccttcctctcgccagtgccaccacagctcaagcgtgatccagcgtcgggccgcgcgtgcgagcgagcgagcgtgcgagatgtcggccgccggggaggaggacaagaagccggcggggggagagggcggcggcgcccacatcaacctcaaggtcaagggacaggatgggaacgaggtattcttccgcatcaagagatctacgcagctgaagaagctgatgaacgcctattgtgaccgtcagtctgtggatatgaatgctattgcattcctatttgatggtcgtaggctccgtggcgagcagacccctgacgagctcgagatggaagacggggacgagatcgacgccatgctccaccagactggaggctgcctgcctgcctagaagcttaggagttcttgcagcctcgtaaaattgtgcctttagtaggctcaatatctagaagtacatgaaaaaaaagaagcctaaaagaacttgtgaggctttggtcctgtgccatagctgaaggacattagaagagctttgtttggcaaaaatattttggtacttcggctgttatgactcgtttatccataccctaatatgtccatcgt

SEQ ID NO: 2089 - DNA, 497 bp, Artificial
  Synthetic
gcggcggcgcccacatcaacctcaaggtcaagggacaggatgggaacgaggtattcttccgcatcaagagatctacgcagctgaagaagctgatgaacgcctattgtgaccgtcagtctgtggatatgaatgctattgcattcctatttgatggtcgtaggctccgtggcgagcagacccctgacgagctcgagatggaagacggggacgagatcgacgccatgctccaccagactggaggctgcctgcctgcctagaagcttaggagttcttgcagcctcgtaaaattgtgcctttagtaggctcaatatctagaagtacatgaaaaaaaagaagcctaaaagaacttgtgaggctttggtcctgtgccatagctgaaggacattagaagagctttgtttggcaaaaatattttggtacttcggctgttatgactcgtttatccataccctaatatgtccatcgttgctggtgcttggcatgttttcttttgcatc

SEQ ID NO: 2090 - DNA, 647 bp, Artificial
  Synthetic
gaaagagaaagagaagaaatcgatggcagatgggacgaagagtgaagggagtcaccaacgcagctgatgacaagaaacccctcgaccagcacctcaacctcaaagtcaaaggacaggatgggaatgaggtattcttccggatcaaacgcagtacacagttgaaaaaacttatgaatgcctattgtgaaaggcagtcgattgacctcaactcgattgctttcctctttgatggtcgtcgcttacgtggggagcagactcctgatgagctggagatggaggatggtgacgaaatagatgctatgctgcatcagacaggtggttgtgtaagacaactaaattactaaggtgcttaaacagtgactcgctcatccgaatcctgttctaattgtttgcgtttgactttattgggtttctaaagaattggaaatccagggactcgacatagtagccgctagaactctaatcttattatgatggaaccaaaatgcttgttatctaaaattcctggtaagattgaagtgaaaaaggatctgccccctatgaaatgttttgtttgcctatatattggatcgtaggtgctccttttgtggatgaagttgacatcgtaaatatacactttgtactcggttttatggcagttgtttatg

SEQ ID NO: 2091 - DNA, 641 bp, Artificial
  Synthetic
gagcaatagaggggtggaatgatggctagtgtttcttctgtaccaattccggcttcttctctctcaagctcgtttagggtatcccggccactgtccttcatggttccctcttccgcctcctcgtgcccccctttgccctcgataacctgcgcattggcttctgaaggcgctgtccgcatccagaaccttcctcgccctgattcctctggtcgcttcggcaagtttggaggcaaatatgtccctgaaaccctcatcgctgccctcgatcaactcgagaaggcttactctgaagtcactaatgattcttcgttccagcaacaactttctagtattctcaaggattatgttggacgagagtcacctctttatttcgccgaaagattaacggaacattacaaaaatagctctggtgaaggtcctctcatatatctgaagcgagaagatctgaaccacacaggtgctcacaagatcaataatgctgttgggcaagctttactagcaaagtggattgggaagaaacgcatcattgcagagacaggcgccgggcagcacggtgtagcaactgcaacagtttgtgctcgctttggcttgaattgcgtcatttatatgggtgcccgagatatggagaggcaatccttgaa

SEQ ID NO: 2092 - DNA, 642 bp, Artificial
  Synthetic
tccactgctcaaacaacttcacctctatcctccaaacattgttgccgcctatcttcctccgcctcctcctccgcttcgtacttccctaaattccaaatacccttcaaattcaacaaaattacatctggcccttcctctatttcctgtgtccttaccaaacagaaatcaatggcagctcaagaggctgctgaaccggtggttcccctgcgtcctgattcgtttggccggtttggtaaatttggcgggaaatacgtacctgaaaccctaatgcacgctcttgacgagctcgagaccgccttcaaattgctcgctacagacgaagcttttcagaaagagttagatggaatactgaaagattatgtaggcagagagagccctctttattttgcagagcgccttactgagcactacaaacgtccagacggcgaaggtcctctgatctacctgaaaagggaagatcttaatcacactggagcccacaaaatcaataatgccgtcgcccaagctttgcttgccaagcgcttgggcaagaagcgcatcattgctgagacaggggcaggtcagcatggtgttgctactgctactgtttgtgctcgctttggtttggaatgtattatctacatgggtgctcaagatatggag

SEQ ID NO: 2093 - DNA, 668 bp, Artificial
  Synthetic
ggcgatgcttggcacggcggcggcgtcacggcgattcattgcttctcctccttccgatcagctcggcacggaggtggagttgccggcgaggatcaatctaccgcggcgtagcgttcgggcagcgatctcgtcccagggcgccgtggcgccggcggaggaggaggaggtgttgcatgctgagtatggagggttccagcggccggatgcgtttggaaggtttgggaaattcggtggtaagtatgttccggagacgctaatggcggcgctggcggatctggaggccgcgtatcgattgcttgttggcaagcccgaatttcagcaagaattggctggtattctcaaagactacgttggacgagagtctccactctactttgccgagcgcttgacgcagtactacaagaacgccaatggcagtggacctgatatatatctcaagcgagaagatctaaaccacaccggtgctcacaagatcaacaatgccgtcggccaagccttgctcgccaagcacattggcaagaagcgcatcatcgccgaaactggagccggccagcacggagttgccacggccactgtctgtgctcgctttggactggaatgcgtcgtttacatgggtgcacaagacatggaaaggcaagctctcaacgtgtatcgtatgcggcttctcg

SEQ ID NO: 2094 - DNA, 767 bp, Artificial
  Synthetic
gatggcaggaggtagggtttccgggattctcgtccttctcgcggtatggggcttgattgctgtggctgcgccggcgatggcgcgggtcgcggtgccgctcaagaagaagccgctgtcgacagagcgcttgaggcttgcggtgagagatattcctcgtagggcgcaggcgctaggctacccggatgtccgggacgcgaattctcgcgctggaaatggcagcgttccggattacgagcccctcaagaactacctcgacgcgcagtactatggcgagattgggattggaacccctccgcagctcttcacggtcatcttcgataccgggagctccaatctatgggttccctcgtcacgatgcattttctcgcctgcttgctggttccaccaccgctacaagtccaagaggtctaccacataccagccggatggtacttctatcgctatcaagtatggaacaggccagatggctggatttttgagcaccgattccgttactattggcgacattgtggtcaaagatcagacgtttgctgaagcgacaagggagccaggacttgttttcgttattggcaagtttgatggcattctcgggctcggattcaaggccatctcccagggacaagttactcccgtctggtataatatgttgtcccagaaattgatatcagaaccagtgttttccttctggcttaaccgagatgcttcggacgacgaggatggtggtgaaatcgtcttcggaggagtgaacaagaagcgttttaagggag

SEQ ID NO: 2095 - DNA, 686 bp, Artificial
  Synthetic
aaaaccgttcttcctttttctcccgtatcgatcctctgtgctaagcatgggtactacatatggaacctgtttaattgcattgtgtttgttgcttcttttatcccctatggcgttttctgtatcaaatgatggactgatcagagttggaattaagaagaggaagttggatcagatcagccaggcttttgggggtattgattctaatggagcaaattctgcaagaacttatcatcttggcggaaatataggagatgcagatactgatattgttgcactaaagaactacttggatgctcagtattttggtgagatttgcgttggatcaccacctcaaaagttcactgtgatctttgataccggaagttctaatctttgggtgccctctgcaagatgttatttttcacttgcttgttatttgcaccccaagtacaagtcaagtcattccagtacctacaaaaggaatggcacatctgctgcaattcgctatggaactggatctatttctggatactttagcaatgacaatgtgagagttggtgatcttattgtcaaagatcaggactttattgaggcaactcgagaaccaggcatcacctttttggcagccaagtttgatggtattcttggtcttggatttcaagagatatctgtggggaaagccgtccccgtctggtacaatatggtaa

SEQ ID NO: 2096 - DNA, 627 bp, Artificial
  Synthetic
gttttcttgcttcatcaaactggtcaatatgggagcaaaagcttttcttgtcaccattttactctcatcgctgttatttcctttggccttgtctacatcaaatgatggcttggttagaattggactgaaaaagataaaatttgatcaaaacaatcgacttgctgcgcgagtcgagtccaaggagggggaggctttgagggcctccattaggacgtataataacttccgtggtaatcttggggcctctaaggatacagacattgtagcactgaagaactatatggatgctcagtactttggggagattggtataggcactccccctcagaagttcactgtcatctttgatactggtagctctaatttgtgggtgccttcatcaaagtgctacttctcagttccctgttttttccattccaagtataagtcgagccaatcaagcacttataagaaaaatgggaagtctgctgccatacgttatggtactggagcaatatctggatttttcagtcaagatagcgttaaagttggtgatctggttgtgaaaaatcaggagttcattgaggcaaccagagaacccagtgtgacttttttggtagccaagtttgatggtatattgggtcttgg

SEQ ID NO: 2097 - DNA, 444 bp, Artificial
  Synthetic
ggtcgcccttctcctgctggtttcctccgtctcttccttgccttccccgcagctccgtcgcgtcggcctcaagaagaagcctgtcgatgaggacaccctccgtgccgccaagatgcggctccgctccaagtacgctcaccgagacagcgccctcctccgtagccctctcctcaaggagcaggatgtcgagctcgtcaactaccttgacgcccagtactatggcgagatcggcattggaacccccccgcagaacttcacggtcatctttgacactgggagctcccaacctctggggtccctccgccaagtgctacttctcgctgtcatgttatttccatccgaaattcaaggggagcaagtcagagacatacaaagtgaatggacaagaatgtgacattcaatacggaagtggggctgtggctgggtttctttccgaggatactg

SEQ ID NO: 2098 - DNA, 710 bp, Artificial
  Synthetic
cgagcgtgggggcaaatagcagtatccatccattctcctgagtactactcttctccatacctgttaattactgctttctactctctaaaagtttctcctacatttctggggtttcatcattaagacactccgcgaatatggaaaggaaacatctctgggctgctctccttttatggaccattgcgtgctttgtacttcctgtttactctgataatttgcttagagttggtttgaagaagcaacccctggacattaatagcataaatgctgcaagagtagccagactacaggacagatatgggaagaatgtgaatggcatagaaaagaaattgggtgactcagatttggatatagtctccttaaagaactacttggatgcccaatactatggagagattggtgttggttcacctcctcagaaattcaaagttatctttgatacaggaagttctaacctctgggttccatcatcaagatgctatttctctattgcatgctggatccactccaagtacaaggcgggcaagtccagtacatatacaagaaatggggaatcttgttcaatccgctatggaactggatcaatctctggccatttcagtcaagacaatgttcaagttggtgatctcgtagttaaagatcaggtgtttattgaagcgacgagagaaccaagtattacatttataattgcaaagtttgatggtatacta

SEQ ID NO: 2099 - DNA, 639 bp, Artificial
  Synthetic
ccccccccgctttcctctaccttgactttggcttccccactctctcttcttcttgggaggctgggagctaccagcacaacacaccaaggaagctgaggtgcgttgatttcttgatatcatggccaagaggcacctcttgttggtgacaacttgtttgtgggctctgtcatgtgccttgctgcttcatgcttcctctgatgggttcctgagagtcaacctcaacaagaagagattggacaaggaagatctcactgccgccaagttggcgcagcagggcaaccgtcttctgaagaccggcagttcagacagtgatcctgtccctctggtggactacctcaacacccagtactatggggtgattggcctcggctcaccgccgcagaacttcacggtgatatttgacactggaagctccaacctgtgggttccttcagcaaaatgctatttttcgatagcatgctacctccacagcagatacaactcgaaaaagtcgagctcttacaaagcagatggagaaacttgcaaaattacatacggttctggggcaatttctggattcttcagtaaggataatgtgttggttggagaccttgtagtgaaaaaccagaagttcattgaggcaacacgcgaaacaagcgt

SEQ ID NO: 2100 - DNA, 612 bp, Artificial
  Synthetic
gctgttgctgctgctgctcctcccgttttccgatcgcagccatgggaacccgcagcgtggccttggtgctcctcgcggccgtgctgctccaagccctcctccccgcttcggcggcggagggtttggtgcggatcgcgctgaagaagcgcccgatcgacgagaacagccgcgtcgccgcgcgactctccggcgaggaaggggcgcgccggctgggcctccgcggcgccaactcccttggcggcggcgggggtgagggcgacatcgtggcgctgaagaactacatgaacgcgcagtacttcggggagattggcgtcggcactccgccgcagaaattcaccgtcatcttcgacactggcagctccaacctctgggtgccgtcggccaagtgctacttctcgattgcgtgcttcttccactctcgctacaagtccggacagtcgagcacttatcagaagaatggaaaaccagctgccattcagtatggcactggttcaattgctgggtttttcagcgaggatagtgttacagtaggtgatctggttgtgaaagatcaggaattcattgaagctaccaaggagccaggtcttactttcatggttgcaaaatttgatg

SEQ ID NO: 2101 - DNA, 632 bp, Artificial
  Synthetic
ccccaacttgtttgtgggctctgtcatgtgggttgctgcttcatgcttcctctgatgggttcctgagagtcaacctcaacaagaagagattggacaaggaagatctcactgccgccaagttggcgcagcagggcaaccgtcttctgaagaccggcagttcagacagtgatcctgtccctctggtggactacctcaacacccagtactatggggtgattggcctcggctcaccgccgcagaacttcacggtgatatttgacactggaagctccaacctgtgggttccttcagcaaaatgctatttttcgatagcatgctacctccacagcagatacaactcgaaaaagtcgagctcttacaaagcagatggagaaacttgcaaaattacatacggttctggggcaatttctggattcttcagtaaggataatgtgttggttggagaccttgtagtgaaaaaccagaagttcattgaggcaacacgcgaaacaagcgttacctttatcatcggaaagtttgatggaattcttggtcttggctaccctgaaatctctgttgggaaagctcctccgatttggcagagcatgcaggagcaggaactgcttgcagatgatgtcttctcattttggctg

SEQ ID NO: 2102 - DNA, 184 bp, Artificial
  Synthetic
cccacgcgtccgcgcggagtttcttggaacctactttttggtattcaccggttgtgcatcggtggttgtaaacatgcaaaacgacaatgtcgtgactcttccagggatcgctatcgtttggggactcaccatcatggtcctcatttactctcttggtcacatctctggtgctcatatcaatcct

SEQ ID NO: 2103 - DNA, 653 bp, Artificial
  Synthetic
aaaaaaaaatgaaaaaagaagttgtcccatcttcctttctttttctctttctttattaactttttcaaaattaattttgtataaataggataaatcctgctctttgttgtctcatattcttatgtgctcttcttttcttgagcatatcatttacagcttaataaaactaaggattttctatggctgatcagatagcaggaggggctaatgggaatcatgttgtaactttgaatagtaaagaagatgatgattcttcttcaagttgcagctttcttactgttcctttcattcaaaaggttatagcagaaatgttaggaacatatttcttgatattggctggctgtggatcagtggtggtaaatgcagataaaggaatggtaacatttccaggaatagcaataacttggggactggttgtaatggtcatggtttactcagttggccacatttctggtgcacattttaatccttctgttactattgcctttgccacagtcaaaaggttcccttggaaacaggtaccagcttatgtagcagcacaagttcttggagcaaccctagcaagtggaacttttacgactaatatttaatggaaaacacgatcatttcgctggaactctacctacagggactgaatttcaatcgttcgtagt

SEQ ID NO: 2104 - DNA, 691 bp, Artificial
  Synthetic
ccaaatattcctcggacacggtcacttttttttcatctcggtttcttgctcactttttattcatcttaatcttcaatattagctacaatgtatcaagcagcagagtcatcttgggctggaaattaccacaacaacatagcgacaaggcgtggatcgtcatcgtcgtcagacccgttggagagggttgtgaggctggcgtcaggaagcgctgtggtgatattcagcgtgagcacatgttgcatgtgtcatgcagtgaagaggctgttttgtggaatgggagtgcaccctacggtgtacgaattggaccaagaccccaaaggcaaagaaatggagagagcactctctaggcttttaggcaacgctcctgcagtccctgttgtcttcattggtggaaaactaattggagcaatggatagagttatggcttctcatattaatggcactcttgtcccacttctcaaggaagccggcgctctctggctttgatttgactaaagaatagcaggattaggttgatggatggattattcctccattttttatttttggtttctttaattaatgtgctttaagttttgtagctaagtatgttatagttgatataatgcgtcaatttaactagtaactgtttaatttcatggcaaccttgtagttgatgcgctgatgcatgtatttgatgattaactatctc

SEQ ID NO: 2105 - DNA, 573 bp, Artificial
  Synthetic
ccccccccggatgagaatggccgcgccgcagcaagtgggtgtgcgtgccgccccgctcgcgcgcgcgctccgaactcgcgtcgccgccgccgccgcgtctgcgagctctcccgaacgcgcgctcctcggcctctccgaaccagatctccggcagctcgccgtcgacctcggccagcaaagttacagggggaagcagcttcacgacctcctctacaagtccagggccaagcaaatccaagaatttagccacgtaccaaaggtgttccgtgaggccttggtcggcgctggctggaaggttggccgctcgccagtgcaccatgctgtgacggcctccgatggcactaccaagatacttctcaagttggaggataacagattgatcgaaacagtagggatccctgtcgatgatgacaaaggcccgtcaagactcactgcctgcgtttcatcacaggttggctgccccttgcgttgctcattttgtgccactggcaagggagggtttgcaagaaaccttcatgcacatgagattgtggagcaggttttgggcatagaggagacgttccaacacagggt

SEQ ID NO: 2106 - DNA, 694 bp, Artificial
  Synthetic
tttttgagtttcctcaccacaaaatgattccaagaaagcattggtttttatttattacattatagccatatttattccaaaattaatgttggctcaaaactgtgggtgtgcagaaggtttatgctgcagcagatggggttactgtggcactggaaatgaatattgtggtcaaggctgcaaaggagggccttgttttatttcagcaaattatggaatttcatcagtttctgaaattgtttctgaaccatttttcaatggaattgctaatgaagcggctccaaactgtgaaggcaaaggattttacacaagatctgcttttcttgaagctctcaggtcttatcctacatttggaactgatgcttcttctgatgataataagcgtgaaattgctgctttctttgctcatgttacccatgagactggacaaatgtgctacagaaatgagataaatggtgcatctagggactattgtgacgagacaaatgcagagtacccatgtgttctcggcaagaaatattacggtcgaggaccgatacaattgtcatggaatttcaactatggaccggcggggaaagacaatggattcgacggcctgaacgaccctgatatcgttgctagagacagtctgatatcattcaaaactgccctgtggtactggatgaacaattgccatgctctcataacttctggacaa

SEQ ID NO: 2107 - DNA, 542 bp, Artificial
  Synthetic
gccagagccagtgctccggcagctgcggcggcggcggcccgaccccgccctccggcggtggcggcagcggcgtcgcctccatcgtgtcgcgctcgctcttcgaccagatgcttctccaccgcaacgacgcggcgtgcccggccaagaacttgtacacctacgacgccttcgtcgccgccgccaacgccttcccgagcttcgccacaaccggcgacgccgccacccgcaagcgcgaggtcgccgcgttcctggcgcagacgtcgcacgagaccacgggcgggtgggcgacggcgcccgatggcccctactcgtggggctactgcttcaaggaggagaacaacggcaacgttgggtccgactactgtgtccagagctcgcagtggccgtgcgccgccggcaagaagtactacggccggggacccatccagatctcctacaactacaactacggcccggcggggcaggccatcggctccaacctgctgagcaacccggacctggtggcgtcggacgccaccgtctccttcaagacggcgttctgg

SEQ ID NO: 2108 - DNA, 650 bp, Artificial
  Synthetic
cacccacgcctccgcaaagcggtgctttcacaaaaatctccttagtccttcttctctgcctcttaggtttcttttctgaaactgtcaagtctcaaaactgcggttgcgctccaaacctctgttgcagtcagttcggttactgtggtaccgaccatgcatactgcggtgttggatgccgatcaggtccttgtagaggtagtggaacccctaccggagggtcggtcggtagcattgtgacacaaggtttctttaacaatattatcaaccaagctggtaatggttgcgcggggaaaagattctacacccgtgactctttcgttaacgccgctaatactttccccaactttgccaattctgttaccagacgtgaaattgctaccatgtttgctcatttcactcacgagaccggacatttctgctacatagaagagattaacggagaaacacgtaactactgccatagcagcaacacacaatacccatgtgcaccgggaaaaggctacttcggtcgtggtccgatccaactatcatggaactacaactacggagcgtgtggtcaaagtctcggtcttgaccttctacgccagccctaacttgtgggtagcaacccaactgtagctttcaggacgggtttgtggttttggatgaat

SEQ ID NO: 2109 - DNA, 763 bp, Artificial
  Synthetic
tcttcagctccgagttctcttcctcctgctcgcgatcttagctgccgctgccgaagactgcggacgacaaggcggcggaagaagttgtccgcctggaaactgctgcagcaggtggggatggtgcggtgacactcccgaccactgcggcgaaggctgccagagtcagtgcggtggagtaacaccgccgcctggtgacggtgtcggatctatcatcacgagttccatcttcgagagcctgctcaagcaccgcagagactcgggatgtgccggtggcttctacacgtacagtgcgttcctcacggctgccagatctttcccgcggtttggaaacgaaggctcgctggagcagaggaagcgagagctcgctgccttcctggcacagacatccaaggagaccacaggtggatggccgactgctcctgacgggccttatcgatggggctattgcttcgttgaggaacaaaataaggacatctactgcagcgcttcggcgacatggccatgtaatggcagcaaaagatactttggtcgtggtcccattcagcttacatggaactacaactatggcctggcaggatcacaagtcggcttcgacggcatcaacgatccggacatcgtttcgcgagacgcggtggtgtcgttcaagacagcgatctggttctggatgacgccacagaacccgaagccttcgtgtcacgacgtaattctggggaaatggaggccatccagtgccgacttagcagcgggaaggactgcgagctat

SEQ ID NO: 2110 - DNA, 855 bp, Artificial
  Synthetic
gcacccccgtgctatagatcttacatcgcagcagctgcaacagtaggaaaagaaaaacaatggccgctcagatcccgcagctctcgctgggactacagcagcagcggcaaaatctgtttttgggggataagccccagtgcttgaatttcaagagaaacagtagctctgcctcgaattgtctctcgtcatcaaatcaaggacatgtgagcagtgcgagagcgatggatatggcgagggatacgagctccaatctggtggtgtgtttcggagagatgcttatagactttgttcccacagtcgggggtgtctccctggcggaggctccggcgtttaagaaagctcccggtggagctccggcaaatgttgcggtcgggatctctcgccttgatggaaactccgcattcatcggtaagcttggtgaggatgaattcggcttcatgcttctggacatcctgaaggacaacaatgtagagagcaaaggcatgcgttttgatcccggtgcccgtactgctctcgcgtttgtgacgctccgcaaggacggcgagcgtgagtttatgttttaccgcaatccaagtgccgacatgctgctaaagccggacgaactggacgaagaccttatcaaacaggcctccattttccactacggttccatcagcctcatcgcagagccctgcagatcggcccacttggccgcgatgaaaatcgccagagaagccggggcgatcctttcgtatgatcccaacttgaggcttccattgtggagctcggcagaggcagcccggagcgggatcaaaagcatctggaacgaagccgacatcatcaagataagtgaggaggagatcactttcctgactg

SEQ ID NO: 2111 - DNA, 663 bp, Artificial
  Synthetic
gcaacatacgtcttttctaaatcattacatttgaagaagagaaacaaaaacagagcggaatgccgaatttgtttctcttctcgattcaaccatccgaaaacaagaatacaaaaagagaagataatcgcggaaacagattacgtaatagaagcttgagttgttttgtttctatttcttttcgagaaagctccgaacttcagcatctgagggaagagctggaatggctccttttttggtcgttgtgattgctccacaagcatttgcgaatctcagcactttcctcaatctctcttcgtcctcgagaacggatcgatcatcgacaatctggtttagaagagcaccgacaaaggaatctccagctccggttgtgtccacagcgttcacatggaaagggtcaacggctcctttgaaagtcttggtgtaataccgacagcccttttcaccaagagtgactaacaacagcttcaagttgggatgccacaaggtcaacgcggtctcatcatcaatcttgttgcttccagttagaaactcaagctcaacatcgctcaccttgatgatctcagctttgtcccaaatgctcatgatctgtgttttggcttcttcttttgatggccacagaggctccctgaggtttgggtcataggaaagaagagctcctgcgcg

SEQ ID NO: 2112 - DNA, 1225 bp, Artificial
  Synthetic
gttgtttccctgttatccttgaccgatccatgaaaagcagcttcaagctatccaagagttcttcttctgataagctcaataaaagcaagagctttatctgttcaccaacatctctatcaacgaagaaaagggagcaggaaaacaatcacctggttgtatgtttcggggagttgttgattgacttcgttcctactgtatctggagtttcacttgcagaagcgcctggatttgagaaagctcctggtggagctccagctaacgttgcagttggtatagcaagattaggaggttcttccgcctttattggcaaggtgggtgcagatgaatttggttatatgttatctgatatattaaaacagaaccatgtcgacaattctggcatgcgtttcgatacccatgcaaggacagcattagcatttgtcactttgagagcagatggcgagagagaattcatgtttttccgcaatccaagtgctgatatgcttcttacaaaggaagagctggacaaagatctcattcagaaggcaagaatatttcactatgggtcaatctctttaatcgcggaaccgtgtaggtcagctcatcttgcagccatggagattgccaaaaaagctggctgcattctctcttatgacccaaatctaaggttgcccttatggccatccgcagatgctgctcgtaaaggcatcttgagcatttgggaccaagccgacgttattaaggtaagcgaagacgaaatcacattcttgacagacggtgaagacgcctacgatgacaatgtggtgatgactaagcttttccacccaaaccttaagcttttgctggttaccgaagggggagaaggttgcagatactatactaagaattttcacgggagagtgaatggcattaaagtaacagcagttgataccacaggagcaggtgatgcatttgttggcggacttctcaacagtatggccacagatccagacatttatcaggatgagaagaaactaaggaatgcactcctttttgccaatggttgtggagctataactgtgacagaaaaaggagcaattcctgcattgccaacaaaagcagcagtgcttaaaatcttggatggtgccacagctaactgatccaatcaaattccccccacccacagaaaagcctcctaatctccaccccttgtaagacactacactagtacttcgtgtacaaattatcatatatactggaatttact

SEQ ID NO: 2113 - DNA, 589 bp, Artificial
  Synthetic
atactttacatttatacatatattctctctattcatcgtcgctatggcagctaacggcgttagttctggtttaattgtgagcttcggcgagatgttgatcgatttcgtgccgacggtctccggtgtatcccttgccgaggctccgggtttcttgaaggctcccggaggtgcaccggcaaacgtcgccatcgcagtgactaggcttgggggaaagtcggcgttcgtcgggaaactcggcgacgatgagtttggccacatgctcgccgggatactaaaacaaaacggcgtccaagcggacgggatcaactttgacaagggcgcgagaacggcgttggcattcgtgaccctacgcgccgacggagagcgtgagttcatgttctacaggaatcccagtgccgatatgttgctcactcccggcgagttgaatcttgatgttattagatctgctaaggtgttccactacggttcgataagtttgatagtggagccatgcagatcagcacatttgaaggcgatggaagtggcaaaggaggcaggggcgctgctctcttatgacccaaacctccgattgccgctgtggccgtcggca

SEQ ID NO: 2114 - DNA, 463 bp, Artificial
  Synthetic
aacgaggagaagctgagggaggcgctcaagttttcgaacgcgtgcggagccatctgcaccaccaagaagggtgccatcccggcgctgcccaccgtcgccgtcgcgcatgagctcatcagcaaggcagccaactagagctcctcggtttcgtcgtcgatcgccgccattgggggcctcggaattttaggtcgatttaatttagttgctgcttcgttttagacaaggaagaggaggggcttgggtgtgttcatgtctgtcttttgtgtgctaagttagttgcttccgtgtgagaacttttggcgtttatttttactattattattaataagaagctcttggatttgcggtggatattttggtctgaatttgtgtaatgaggcagctacttggcgaaatttattgtgtcatgtctttgttcagaggaaaagaaaatcttttcgtgtgctctgtttcaaatcagtta

SEQ ID NO: 2115 - DNA, 545 bp, Artificial
  Synthetic
gccgccaagtagctgcctcattacacaaattcagaccaaaatatccaccgcaaatccaagagcttcttattaataataatagtaaaaataaacgccaaaagttctcacacggaagcaactaacttagcacacaaaagacagacatgaacacacccaagcccctcctcttccttgtctaaaacgaagcagcaactaaattaaatcgacctaaaattccgaggcccccaatggcggcgatcgacgacgaaaccgaggagctctatttggctgccttgctgatgagctcctgcgcgacggcgacggtgggcagcgccgggatggcacccttcttggtggtgcagatggctccgcacgcgttcgagaacttgagcgcctccctcagcttctcctcgttgtggaagatggagtcgtccttggcgacgttgacgaggagggagccgacgaaggcgtcgccggcgccggtggtgtcgacggtgttgacggagaagccggggacggagcccttgaagtccttggtgaagtacctgcatcccttctcgccgtcg

SEQ ID NO: 2116 - DNA, 604 bp, Artificial
  Synthetic
ccccccccgatcgcttctcatcgcaaatcgcatcgacttcgatgcgcttcgtttcgttctcgctgttgatttgttcgtgagatttgaattctagcaatggctcctctcggtgacggagcggcggcggcggcggcggcggagcccaacctggtggtgtcgttcggggagatgctgatcgacttcgtccccgacgtctccggcgtctcgctggccgagtccggcggcttcgtcaaggctcccggcggcgcccccgccaacgtcgcctgcgccatctccaagctcggtggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgcca

SEQ ID NO: 2117 - DNA, 611 bp, Artificial
  Synthetic
cccccgatcgcttctcatcgcaaatcgcatggacttcgattcgcttcgtttcgttctcgctgttgatttgttcgtgagatttgaattctagcaatggctcctctcggtgacggagcggcggcggcggcggcggagcccaacctggtggtgtcgttcggggagatgctgatcgacttcgtccccgacgtcgccggcgtctcgctggccgagtccggcggcttcgtcaaggctcccggcggcgcccccgccaacgtcgcctgcgccatctccaagctcggcggctcctccgccttcgtcggcaagtttggtgatgatgagttcgggcacatgctggtggacatcctgaagaagaacggggtgaacgcggaggggtgcctgttcgacgagcacgcgcgcacggcgctggcgttcgtgaccttgaaaagcaacggcgagcgcgagttcatgttctaccggaacccgagcgccgacatgctcctgacggaggcggagctcaacctggacctgatccggcgcgccaagatcttccactacggctccatctccctcatcaccgagccgtgccgctccgcccacgtcgccgccatgcgcgccgccaagtcggccggcat

SEQ ID NO: 2118 - DNA, 468 bp, Artificial
  Synthetic
ctcgagcttgcggccgctccaaactcacccccacaactttcatttctatcaaccaaacccaaatgggtccaagttcgagcctcaccaccatcgtggcgactgttcttcttgtgacattgttcggttcggcctacgcaagcaacttcttcgacgagtttgacctcacttggggtgaccacagaggcaaaatcttcaacggaggaaatatgctgtctttgtcgctggaccaggtttccgggtcaggtttcaaatccaaaaaagagtatttgttcggtcggatcgatatgcagctcaaacttgtcgccggaaactcggccggcaccgtcactgcttactacttgtcttcacaaggagcaacacatgacgagatagactttgagtttctaggtaacgagacagggaagccttatgttcttcacaccaatgtctttgctcaagggaaaggagacagagagcaacagttttatc

SEQ ID NO: 2119 - DNA, 769 bp, Artificial
  Synthetic
  misc_feature (580)..(580): The residue at this position can be any nucleotide.
ttatctaaaccattctcattctttacagttgtgaaaaatggtttctttttctatggcgtttagttgtgttgtctttggtatttctctaatgatgatgggtttggttagctcttcaagatttgaggagctgtatcagcccagttgggctacggatcatttgacaaatgaaggagaaattctcaggatgaaattggacaacctttctggtgctggattttcatcaaagaataagtatatgtttgggaaagttactgttcagattaagcttgtagaaggtgactctgctggaactgtcactgctttctacatgtcatcagagggaccaacccataatgagttcgattttgagtttctaggtaacacaactggtgaaccatactccgtacagaccaatgtttacgtaaatggtgtgggtaacagagaacaacgactgaacctttggttcgacccatccaaggaattccattcctattccatcttgtggaaccaacgccaagttgtattcttagtagacgacaccccagttcgtgtacactcaaatttggagcacaagggaattccatttccaaaggaccaagcncatgggtgtgtacagttcaatatggaatgcagatgattgggctacacaaggcggaagggtcaagactgattggtcacatgcaccctttgttgcatcctacagaggatttgagattgatggctgtgaatgtccagcaactgttgcagctgctgagaattctaagcggtgcagcagcactgctgagaaaag

SEQ ID NO: 2120 - DNA, 569 bp, Artificial
  Synthetic
ccccccccgatcccattccagtgaccaatccacactgatcccagtagctctcattgtcctcacgcttcgactcgcttgctagatcttggggttcttgtgtgttgtgatcgcgcaatgaggacggcggcgcttggcattgtggcgatggcctgcctggtggccattgcccatggaggcaacttcttccaggacgcggaggtgtcgtgggggcagggccgcggcaaaatcgtcgatggtggccgtgggctcgacctcacgcttgacaggagctccggctctgggttccagtccaagagcgagtacctcttcggcaagatcgacatgcagatcaagctcgtccccggcaactccggcggcaccgtcaccaccttctacttgtcgtcgcagggttcgacccacgatgagatcgacttcgagttcctggggaacgtgaccggcgagccgtacacgctgcacaccaacgtgttcacgcaggggcaggggcagcgcgagcaccagttccgcctctggttcgaccccacccagtccttccacacctactccatcatctggaacccacagcacgtcat

SEQ ID NO: 2121 - DNA, 383 bp, Artificial
  Synthetic
ggggtgcccatcattcttggatgcaaggaaatgatcttcagcttgtccttgatcaatccgcaggttcaggtgtacaatcaaaaggagcatttctttttggaagcatagaaatgcaaatcaaattagtatctggaaattctgctggaacagtcacagcatactatttgtcatctacaggtgacaagcacgacgagatcgacttcgagtttttaggaaatgtatcagggcacccatatattatccacacaaatatttttactcaaggtgcaggaggcagggaacaacaattctatccatggtttgatccaactgctgattaccataactataccattcattggaaccccagtgcagttgtatggtacgttgacggtataccaatc

SEQ ID NO: 2122 - DNA, 718 bp, Artificial
  Synthetic
tataaaaggactccttacgcaacctaaagaattatatatcatctactcatactcttatcttctcttcatcatttcaatggcttcttattgcttctaatttccattctaatgggcagcctagtcgctgcatcagctaattttaataatcttgcagagatcacttggggcgaaggacgtggtaaaataacagaaggaggcaaaggtctttctctgtcccttgacaaactttctggttcaggttttcaatccaagaatgagtatttattcgggaaatttgacatgcaactcaaacttgtacctggaaactctgctggcactgtcaccaccttctttttatcttcacaaggagaaggacatgatgagatcgacttcgagttcttgggtaatacgactggcgagccctacactgtccacaccaacgtgtattctcaaggaaagggaaacaaagaacaacaattccacctttggttcgacccaactgcagcatttcacacctacaccattgtgtggaacgctaaacgtatagtgttcttggtagataacatcccacttagagtatacaacaaccatgaaagcaatggcattccattcccaaagagccaaccaatgaaagtgtactgcagcttatggaatgcagatgattgggctacacaaggaggcagagtcaagactgattggacacatgctcctttcactgcttactacagaaacttcatat

SEQ ID NO: 2123 - DNA, 576 bp, Artificial
  Synthetic
tctagcagtagtagtgtgaaggtgatctagcctctattattagctatggctacatatttagcttctcaatgcattattgctctcatcttagtaatggcctcatcctcatcctcaatactaaaagtagctatggccaactttcatactgacttctttatcacatggtctccttccaaagtcaagctcctaaataatggccaagaccttcaactaaccttagatagtagctcagggtcagggttcgcatctgcaaacggttttatgtatggcaacattgatatgcagattaagcttgtgtcaggaaactcagcgggaacagtcactgcctattatctatcatcagaaggggtgagcagggacgagctggatttcgagtttttgggaaatgcgtcaggtgagccgtacatagtgcagacgaatgtgtattcttcaggagtgggcaatcgagagcagcgaatatttcttgggtttgaccccactgcagatttccacacttactcaatttcatggaacaaacaacgcatcatcttccttgttgatggaacaccgattcgcgcttattccaacaacgaagca

SEQ ID NO: 2124 - DNA, 721 bp, Artificial
  Synthetic
aactagtagcccatcattcattcgcatcactataactgacaaaatggcaaggcctggtagtggtaacatcccaggatcagcatgcattcctcttctgattctgctgctgctgctgctgctgctactgcatccatcagaagctcagccttctcctggctactacccaagcaagatgttcaggtcgatggccttctatgaagggtacagcaccctgtggggcccacagcaccagaccctgtcccaggatcagaagtctctcaccctgtggatggaccgtagctcagggagcgggttcaagtcgacacggtcgtaccggaacggctacttcggggcgtcgatcagggtgcagccgggctacaccgccggcgtcaacacggccttctacctgtcgaacacggagcagtacccggggcgccacgacgagatcgacatggagctgctggggacggtgccgggggagccgtacacgctgcagacgaacgtctacgtgcgcggctccggcgacggcaacatcgtcggccgcgagatgcgcttccacctctggttcgaccccaccgccggcttccaccactacgccatcctctggaaccccgaccaaatcttgttcttggtggacgacgtgccgatcaggaggtacgagaagaaggtggaggggacgttcccggagcgggagatgtgggcgtacggatccatctgggacgcctccgactgggccaccgac

SEQ ID NO: 2125 - DNA, 683 bp, Artificial
  Synthetic
tttacttaagttaagaggggggggggaagtgtgctctcaaggattaacactgcaaggccgaaatgaagaagaagaagaccgcgtcgatgctgggtttggcgtttgggatgttggtgatcatgctggcgtctccaaaattagcaatggcaggtttctatggggactttgatgtagaaacggctcccgaccacgtgataatccaaagcgatagcctcctccaactcaccatggataagaactctggtagctcagttgtctccaccggtaaatatctgtttggctacttcaacatgaagatgaagctcatatcaggcaactctgcagggacagtaaccacattctatatcttctctgaggaagcaaaccatgatgagatagactttgagttccttggcaactattcaggggatccttatcttttgcatactaatatttttgcaagtggtgttggaaatagagaacaacaattttttctgtggtttgaccctacagctgacttccatgattatacaataatttggaaccctcaacaaatattgtttcttgttgatggaagggctgttagatcttttccgaataatgaggctataggtgtcccttacttaaaaagtcaatggatgaatgtacatttaagtctttggaatggcgagacttgggccacactaggagggttgagaaggata

SEQ ID NO: 2126 - DNA, 421 bp, Artificial
  Synthetic
ctcatcttcttttagtttccaaactcacccccacaactttcatttctatcaaccaaacccaaatgggtccaagttcgagcctcaccaccatcgtggcgactgttcttcttgtgacattgttcggttcggcctacgcaagcaacttcttcgacgagtttgacctcacttggggtgaccacagaggcaaaatcttcaacggaggaaatatgctgtctttgtcgctggaccaggtttccgggtcaggtttcaaatccaaaaaagagtatttgttcggtcggatcgatatgcagctcaaacttgtcgccggaaactcggccggcaccgtcactgcttactacttgtcttcacaaggagcaacacatgacgagatagactttgagtttctaggtaacgagacagggaagccttatgttcttcacac

SEQ ID NO: 2127 - DNA, 999 bp, Artificial
  Synthetic
gccattacggccggggacacaaacaaacatcaaacattctaattactacaagtaaaattttatataagctaagggctaaaatggggtcaagaattttcttgattttagcacttgtgtttagttcttgcatggtttgttttggtggaaatttttttcaagaatttgactttacttggggtggaaatagggctaagattttcaatggaggtcagcttatgtctttgtctttggacaaagtttctggttctggttttcaatctaagaaagagtatctctttgggagaattgatatgcaaatcaaacttgttactggaaattctgctggaactgtcactacatactatttatcttctcagggacccacgcatgatgaaattgactttgaattcttgggaaatgttactggtgaaccttatattctccacacaaatatttatgctcaaggcaaaggaaacaaagagcagcaattctatctttggtttgatcctaccaaaaattttcacacctactcaattatttggaaaccccaacacattattttcttggtcgacaacacaccgataagagtttacaaaaatgctgaatcaattggtgtgccatttcccaagaatcagcccatgagaatttactctagcctttggaatgctgatgactgggcaacaagaggaggcctagtgaaaactgattggtctaaagcaccatttacagcctactatagaaatttcaattctcaaacttttggcagttcacagttttcaaatgaaaaatggcaaaatcaagaacttgatgctaatggtagaagaagactcagatgggttcagaggaatttcatgatttataattattgtactgattttaaaagatttcctcagggttttcctccagaatgcaaaagattctgagtgatattagtttgtttttgtgaaattcttttatgtgtttgtggttttattttgttagtttatagcgatcaaaataaatattgtatctttccccttt

SEQ ID NO: 2128 - DNA, 666 bp, Artificial
  Synthetic
tttgttttatacaaaaaatgatttcctcttccttaaaatattcaactgtcattgtaatattgctatatgccttgacattttcattttcagtgagtgcacgacccgccacttttttacaggactttaaagtggcatgggctgactcgcacatcaagcaaatcgatggcggcaaggctattcagcttatactcgaccaaaactcaggatgtgggtttgcttccaaaagtaaatacctctttggacgtgttagcatgaagatcaagctcgttcctggtgactctgctggaactgtcacagccttttacatgaactcggacacagataatgtaagggacgagctagacttcgagttcttgggaaacaggtcaggccagccgtacactgtccaaacgaatgtttatgttcatggaaagggtgacaaggaacaaaggatcaacctttggttcgatccatccgctgattttcatacctacacaattctttggaaccaccatcacactgtattctacgtggaccaagtacccattagagtgtacaaaaataacgaagcaaaaggaatcccattccctaaattccaacccatgggggtgtactcaacattgtgggaagccgatgactgggcaacaagaggtggattagagaaaataaattggagcaaatctccat

SEQ ID NO: 2129 - DNA, 1068 bp, Artificial
  Synthetic
cccacgcgtccggacaaagcaagcaagtacagtagccatggcgaagcatctcgcgctgtccgtggccgccgcggtggccgtgtcgtggctggcggcgtcgtcggcggcggcggcggggttctacgagaagttcgacgtggtgggcgccggcgaccacgtgagggtggtgagcgacgacgggaagacgcagcaggtggcgctgacgctggaccggagctccgggtccgggttcacctccaaggacacctacctgttcggcgagttcagcgtccagatgaagctcgtcggcggcaactccgccggcaccgtcacctccttctacctctcctccggcgagggcgacggccacgacgagatcgacatcgagttcatgggcaacctcagcggcaacccctacgtcatgaacaccaacgtctgggctaatggcgacggcaagaaggagcaccagttctacctctggttcgaccccaccgccgacttccacacctacaagatcatctggaatccccaaaacatcatattccaggtggacgatgtgccggtgaggacgttcaagaagtacgacgacctggcgtacccgcagagcaagccgatgaggctgcacgcgacgctgtgggacggcagctactgggcgacgaggcacggcgacgtcaagatcgactggagcggcgcgccgttcgtggtgtcgtaccgcgggtacagcgccaacgcgtgcgtcaacaacaaccccgccggcgggtggtcgtcgtcgtcgtgccccgagggcacgtcggcgtggatccaccgcgagctcgacggcgccgagctcggcaccgtcgcgtgggccgagcgcaactacatgtcctacaactactgcgccgacggctggcgcttcccccagggcttccccgccgagtgctaccgcaagtgatgatgaacaaatcctccattgatgagttcttgaatgatttgtaattgcttcttgttcttgttcgtcttcgtcttcgtcttcttcttcttcttgatccatgtacattttgccatccattcgttctccattcgttacagttacagagacaggttgatggt

SEQ ID NO: 2130 - DNA, 627 bp, Artificial
  Synthetic
gttgaaacaaaagatggatttcatgagaaagaagatatgtctgtctgtcttcttgtttttccatgtctgctttattacagctgatgctgcccttaatgtctccaccataccttttagcgatggcttcagccatctctttggcgaaggaaacattcttcatgctactgatgataagagccttcaacttcatctcaaccaacgcacaggttcagggttcaagtcttctgacctctacaaccacggtttgttcagtgctaagataaaattaccatcagattatactgcagggatcgttgttgctttctatacgacgaatggtgatttatttacaaaaacacatgatgaactggattttgagtttctgggaaatataagaggaaaagcatggagatttcagacaaatatgtatggaaatggaagcacaagtagaggaagagaagaacgatattatctttggtttgacccttctaaagaatttcatcgttacagtatcctgtggaccagcaaaaacatcatattttatatagatgatgttccaattagagaaattgtacgtaatgatgcaatgggaggagactatccatcaaaaccaatgggattatatgcaacaatatgggatgcttcaga

SEQ ID NO: 2131 - DNA, 907 bp, Artificial
  Synthetic
tctgctgtagagactgagacctctctcagttgtctcatttgcttatgcattacaactccatacaaatactccacaaacacaactcaattttgtgttcataactgatcaaagaatactaaacccctcaataaaggggcaaaaatattaagaaaatggtgaactattatcttgttattgtcatatttttctccgttgttgaattggtttatgggtcttcaagaaatttgccaattttagcgtttgatgaaggctactcccatctctttggtgataataaccttatgatccttaaagatggaaaatctgctcatatttctctagatgaaagaacaggggctggatttgtgtctcaagacctatatcttcatggattcttcagtgcttctattaagcttcctgctgattacactgctggtgtggttgttgcattttatatgtctaatgtggacatgtttgagaagaaccatgatgaaattgactttgagttcttgggaaatattagaggtaaagactggagaattcagaccaatatttatgggaatggtagcactaatgttggtagagaagaaagatatggactccggtttgacccttctgaagatttccatcagtacagtatcctttggactgagaattttatcatcttttatgtagataatgtccccataagagagatcaagaggacagaggctatgggtggggacttcccatctaagccaatgtctttgtatgctacaatatgggatggttctggttgggctaccaatggtggaaaatacaaagtcaattacaaatatgccccgtatattgccaagttctctgatttcgtcctccacggatgtgcagttgatccgattgaattatcatccaaatgtgacattgcaccaaaaactgcatcaatccctgc

SEQ ID NO: 2132 - DNA, 715 bp, Artificial
  Synthetic
tggggaaagaatggcgggcggtggcggcgtcgaagaatctcgccccggcgaggaggtcgcggcgcaggcagcgtcgattttcaaggatacggcagccccgacgatattcgacaagctcatatcgaaggagatcccttccaagatcgtctacgaggacgataaggttttggcgtttagagacttaaacccacaggcaccgacgcatatcttgctcattcccaagcacagggatggattaacgcagctttccaaggctgaagagagacacaaagcgattttgggtgaactactctatgtttcgtctgtggttgccaaacaagagaaattggacgatggctacaggattgttataaacgatggccctcaaggatgccaatctgtgtaccaccttcatgtccatctcgttggaggacgccagatgaaatggccccctggctagaccagtaaacgttcaattttacaaagaatgcccaggaatggaaagtttcttttctctatgaacttggggcagtggaatcctgtgctgcgaaatccgggtaccttttcttcgtcaagccgtgaagccaccgagcaaacactccctcactggattccgtggaagcaatgtgggggtagatcacctcggccttgaactcggcaatctccttctcgaacaacttgagcgacacctcgtcgtgactttccgcaaacctctggttgtaagcggtgtacaagc

SEQ ID NO: 2133 - DNA, 624 bp, Artificial
  Synthetic
gccctggagaaaggacgggaaaggttggaggtgctgagctctcatctggcactgccaatggcacaagaggaggccgctgccaagcttgctgcccctcttcactcccaagaagattccgaatatacacctaccatctttgacaagattctcaagaaagaaatcccatcaaattcagtctatgaggatgaactagtatatgcattccgagacatagctcctcaggctcctacccacatagtgataattcccaagaacagggatggattgacacagttatcaaaggctgaagagaagcataaggagatactcggacatcttctctattctgcaaagctgatcgctagtcaagaggggctctcaaatggctatagggtggtaataaatgatggaccagatggatgtcaatcggtgtatcatatccaccttcatctcatcggaggcagacgaatgacctggccaccgggctagtgagactgtggggtgtatcggttattgtttttgatgcttccggactggacaataaaactagactttaagcacttaaatcaaatattaggatgcttgaagtggcatttttgcccatactctgttgtctcttatattgcttttttagagagatgctat

SEQ ID NO: 2134 - DNA, 636 bp, Artificial
  Synthetic
cccccccccgggggaagttcgatcgatccctcaccatggcgtcggagaaggaggcggcgctcgccgccgtgcccaacgacaaccccaccatatttgacaagatcatcaagaaggaaataccttccactgtggtatttgacgatgagaaggttctggctttcagagacataaatcctcaagctccgacccacattgtgatcattcccaaagtgaaggatggattaactggcctatcaaaggcagaagagaggcatgtagaaatactcggttacctcctctatgttgccaaagttgttgcaaagcaggagggacttgaagatggctaccgtattgtcatcaatgatggccccagtggatgccaatctgtttaccacatacatgtacatctcctcggaggcaggcagatgaactggccgccgggctaacgagtgcccgtctgttgaactgccttcatggcaaggatgtcacactgcctctccgttgaataattcctgtaactggcataacaattggtgccctgaacttatgctatatgtttgtggatgttaccaggacaggacatgaccatcctgctatgatttatggacaagatacattgcgttctcactagttattactgctttttttttcaaaaaa

SEQ ID NO: 2135 - DNA, 614 bp, Artificial
  Synthetic
gagacttgagtatcgagtgaagaagaagatggcgagcaaagacgtggaattggtgagtcatgggagtgggaaggattacacagatcctcctccggctccgcttttcgacaccagtgaattcgccaagtggtcgttttacagagcttgcatagcggaattcgtagctactctgctctttctctacatcacagtagctactgtcataggggatcaaaacaatgtagcgaattgcgggaacgtaggggttctcggcatagcctgggctttcggtggaatgatcttcattctcgtttactgcactgccggaatctcaggtgggcatatcaaccctgctgtcacttttgggttgttcctcgcacgcaaggtttcgctccttcgtgccgtcgcctacatcgtggcgcagtgccttggtgccatttgtggcgctggtctcgttaaggggttccagcagggttactatgtccgatatggtggcggtgctaactctgtggctgaaggttacagcaaaggtgttggccttgctgctgaaattattggaacttttgtccttgtttacaccgtcttctctgcccactgaccccaaacgaagtgcccgtgactcacatgtgccgata

SEQ ID NO: 2136 - DNA, 300 bp, Artificial
  Synthetic
cccacgcgtccgaagaagaaaaaaagcaaagaacacttgacgttttctagatagagatggaagggaaagaagaggatgttcgagtgggagctaacaagttcccggagaggcaaccgataggtacatcggctcagacggacaaagactacaaggagccaccaccagctccatttttcgagccaggcgagctgagttcgtggtccttctacagagccggaatcgccgagttcatagccaccttcctgtttctatacataacagtattgacagtgatgggagtgaagagagcaccaaacatgt

SEQ ID NO: 2137 - DNA, 813 bp, Artificial
  Synthetic
ccccccgaagctctccgctcagctaagctctgcaccattgcttgcaaagctggtcgtgtcactcctcccgttaagcttcccgcggcggcgagagcaagctaagctaggtcgggcatggggaaggacgaggtgatggagagcggcggcgccgccggcgagttcgcggccaaggactacacggacccgccgccggcgccgctgatcgacgcggcggagctggggtcgtggtcgctgtaccgcgccgtcatcgccgagttcatcgccacgctgctgttcctgtacatcaccgtggccacggtgatcgggtacaagcaccagacggacgcgtcggcctccggcgccgacgcggcgtgcggcggcgtgggcgtgctcggcatcgcgtgggcgttcggcggcatgatcttcatcctcgtctactgcaccgccggcgtgtccggcgggcacatcaacccggcggtgacgttcgggctcttcctggcgcgcaaggtgtcgctggtgcgcgcggtgctctacatcgtagcgcagagcctcggcgccatctgcggcgtcgggctcgtcaaggggttccagagcgccttctacgtgcgctatggcggcggcgccaacgagctcagcgacggctactccaagggcaccggcctcgccgccgagatcatcggcaccttcgtgctcgtctacaccgtcttctccgccaccgaccccaagcgcaacgcccgcgactcccacgtccccgtgcttgctcctcttccaattgggttcgcggtgttcatggttcacttggccacgatcccgatcaccggcaccggcatcaac

SEQ ID NO: 2138 - DNA, 644 bp, Artificial
  Synthetic
gaattcaagaaacagaagaaatggaaggcaaaggagaagatgtgaggttgggagctaacaagtactcagagagacaaccaatcggaacagcagctcagatgactgaggacaaagattacagagagccaccaccagctcctttctttgaaccaggagaattaggttcatggtctttctacagggctggtattgctgaattcatagctacttttctgttcctatacatctccgtcttgactgttatgggtgttgctggtgccaaaaacaagtgccagtcagttggtattcaaggtatcgcttgggcttttggtggtatgatctttgcccttgtctactgtaccgccggtatctcaggaggacatatcaaccccgcagttacattcggtttgttgttggcaagaaaattgtcagtgacaagagcagtgttctacatgatcatgcaatgtcttggtgccatctgcggtgccggtgttgtcaaaggtttccaaccaagtaaataccagatgctgaacggtggtgccaactttgtagctcctggttacaccaagggagatggtcttggtgctgaaattgttggtacttttgttcttgtttacaccgttttctccgctactgatgccaaacgtaacgccagagactcccat

SEQ ID NO: 2139 - DNA, 611 bp, Artificial
  Synthetic
ctcatcttcttcagaaaatcagaagaaaggaaaaatgtcaaaggacgtgatagaagaaggacaagttcatcaacaacatgggaaagattacgtggacccaccaccagctcctttgcttgattttgcagaactcaagctctggtctttttacagagctcttattgctgagttcattgctactcttcttttcctttacgttactgtcgccactgtaattggtcacaagaagttgaatggtgctgatcaatgtgatggggttggtattcttggtatttcttgggcttttggtggcatgatatttgttcttgtttactgcactgccggtatctctggtggacacattaacccagcagtgacatttgggttattcttagcaagaaaagtgtcattattaagggcagtgggatatattattgcacaatctttaggtgcaatttgtggtgttggtttggtgaaaggtttcatgaaacattactacaacacgttaggtggtggtgctaattttgtgcaacctggttataacaagggcacagctttgggtgctgagattattggaacttttgttcttgtttacactgttttctctgctactgaccctaaaagaagtgccc

SEQ ID NO: 2140 - DNA, 734 bp, Artificial
  Synthetic
agtcctctcttttctcccataaatacctatccatttttcactgacttctcatcatccatatcccctgtttaaaagcttctttccttttggttagccatgactaaagaagttgaggtcgcaacagagcaaccaacagagttttcagcaaaagactatactgaccctccaccagctcctttagtagacttcgaggagctgacacaatggtcactttacagagctgttatagctgagtttattgccactttgcttttcctttatgttactgttttgactgtgattgggtataaggtacagtcagatgtcaaagccgacggtgatatctgtggcggcgttggtattcttggtattgcttgggcttttggtggcatgattttcattcttgtttactgcaccgccggtatctccggaggacacataaacccagcagtgacatttgggctgtttttggcaaggaaagtatcattgatcagagcagtattgtacatggtggcacagtgtttgggtgcaatatgtggtgtgggttttgtgaaggcattccagagtgcttattatgttaggtatggtggaggtgctaatgtcatggctcctggccataccaaaggtgttggattagctgctgaaattattggtacttttgttttggtttacactgtcttctctgctactgaccctaagagaaatgctagagactcccatgtccctgtgttggcaccacttccaattggatttgc

SEQ ID NO: 2141 - DNA, 618 bp, Artificial
  Synthetic
acagtctccactcacacgcattgcagaggagaggcgacaatggaggggaaggaggaggacgtgcggctgggggcgaacaggtactcggagaggcagccgatagggacggcggcgcagggcgccggggacgacaaggactacaaggagccgccgccggcgccgctgttcgagccaggggagctcaagtcgtggtctttctaccgggccgggatcgccgagttcgtcgccaccttcctcttcctctacatcaccatcctcaccgtcatgggggtctccaagtcctcctccaagtgcgccaccgtcggcatccagggcatcgcctggtccttcggaggcatgatcttcgcgctcgtctactgcaccgccggcatctccggaggacacatcaacccagcagttacttttgggctgttcttggccaggaagctgtccctgacccgggccatcttctacatagtgatgcaatgcctaggggccatctgcggagctggagttgtgaagggcttccagcagggtctgtacatgggcaatggcggtggtgccaatgtagttgccagtggctacaccaagggtgacggtcttggtgctgagattgttggcaccttcatcctggtctac

SEQ ID NO: 2142 - DNA, 674 bp, Artificial
  Synthetic
cccacgcgtccgagcacacacaaaaaaaaaaaacagcaaaccaaaaactcaaaactcttctccttcactgccaacttctaaacagaagtacttttactttcatcaaaaaaaacatgtcaaaggacgtaattgaagaaggacaaactcatcaacatggaaaagactatgttgaccctccaccagctcctcttcttgacatggctgagcttaccaaatggtccttttacagagctgttattgctgagtttattgctactcttctcttcctttacgtcaccgtcgccactgtcattggccacaagaagttgaacgctgctgaccattgtgatggtgttggcattcttggtattgcatgggcttttggtggcatgattttcgttcttgtttactgcactgctggtatttctggtggtcatattaacccagcggtgacatttgggttgttcttggcaaggaaagtgtcattaataagagctgttgcatacataatagcacagtcacttggtgctatttgtggtgttggttttgttaaagcttttatgaaacattactacaacttagaaggtggaggtgctaactttgtacaacctggttacaacaagggtacagctttaggtgctgagattattggaacctttgttcttgtttacactgttttctctgctactgaccct

SEQ ID NO: 2143 - DNA, 912 bp, Artificial
  Synthetic
cccacgcgtccgaaacaagaaaaatccttctagtgtgtgtctgtgtgtgtgaaaaaaatggcagaaaacaaagaagaagatgtgaatcttggagcaaacaaatacagagaaacacaacccttaggaacagcagcacaaacagaaaataaagattatgttgaaccaccagcagcaccattatttgaacctggtgaattatcatcttggtcattttacagagctgggattgctgaatttatggccactttcttgtttttgtatattacaatcttgactgtaatgggacttaagagatcagatagtttgtgttcttctgttggtattcaaggtgttgcttgggcttttggtggtatgatctttgctcttgtttactgcactgctggtatctcaggaggccacattaatccagctgtgacatttggtctgttcttagcaaggaaactttccttaaccagagcagttttctacatggtaatgcaatgccttggtgctatatgtggtgctggtgttgttaaaggttttatgaaaggtccataccaaagacttggtggtggtgctaatgtggttaaccctggctatactaaaggtgatggacttggtgctgaaattattggtacttttgttcttgtttacactgttttctctgctactgatgccaagagaaatgccagagattcacatgttcctattttggcacctcttcctattggatttgctgtgttcttggttcatttggccacaatcccaattaccggaactggcatcaaccctgccaggagtcttggagctgctattatcttcaacaaaaaacaggcatgggatgaccattggatcttttgggttggaccattcattggagctgctcttgctgcagtttatcaccaaattattatcagagccattccattcaag

SEQ ID NO: 2144 - DNA, 812 bp, Artificial
  Synthetic
atttacagagagagaaaacttagttgagtgactgaagaaacaaaaaatggcagagaacaaggaagaagatgttaagctaggagcaaacaagtacagagaaactcaacccttgggcacagcagctcaaacagacaaggactataaggagccaccaccagctcctttgtttgagccaggggagttgtcgtcatggtctttttacagagctggaattgcagaattcatggctactttcttgttcttgtacatcactatcttgactgttatgggtctcaaaaggtcagatagtttgtgttcttctgttggtattcaaggagttgcttgggcttttggtggtatgatctttgctcttgtctactgcactgctggtatctcaggaggacacattaacccagcagtgacatttggtctgttcttggcaagaaagttgtctttaacaagggctctgttctacatggtgatgcagtgccttggtgcaatctgtggtgctggtgttgttaaaggttttatggtgggtccatatcagagacttggtggtggggccaacgtggttcaacctggctacaccaaaggtgatggacttggtgctgagattattggcacctttgtccttgtctacactgttttctctgccactgatgccaagagaaatgctagagattctcatgttcctattttggcacctcttcctattggattcgcggtgttcttggttcatttggccaccatcccaatcactggaaccggcatcaaccccgcccggagccttggagctgctatcatcttcaaccacgaccaggcatgggatgatc

SEQ ID NO: 2145 - DNA, 717 bp, Artificial
  Synthetic
aaggttccaagttcgaggctctctatgacctctcccatctgtcggaaagtttcttgtcctagagagaccctcctcctctctccctcttaggtcgcctacccctcagagccatcatggccagcaaggatatggacacgccggagccgcggactgggaaggactacacggagcccccccctgtcgccctctttgacgctgctgagttcagtctctggtccttctaccgtgcctgcatcgctgagttcattgcgactctgctcttcctctacatcactattgccgctgtcatcggtaacaaccacaatatcactggctgcaacaacatcggtgtgcttggcatcgcctgggccttcggtggaatgatcttcatccttgtctactgcactgctggaatctcaggagggcacataaacccagcagtgaccttcgggctgtttcttggacggaaagtgtcactgccccgggctatctgctacatggtagcgcagtgccttggggccatctgtggtgctggcctggccaagggtttccagacttcatactatgtgcgatatggaggaggtgccaacatggttgcccctggctacaccaagggggttggtcttgccgctgagatcattggcacctttgttcttgtctataccgtcttctctgccacagaccctaagaggaacgccagagattctcatgtccctgtgctggctccactgccaatag

SEQ ID NO: 2146 - DNA, 693 bp, Artificial
  Synthetic
ccccccgacaagctctccgctcagctaagctctccaccattgcttgcaaagctggtcgtgtcactcctcccgttaagcttcccgcggcggcgagagcaagctaagctaggtcgggcatggggaaggacgaggtgatggagagcggcggcgccgccggcgagttcgcggccaaggactacacggacccgccgccggcgccgctgatcgacgcggcggagctggggtcgtggtcgctgtaccgcgccgtcatcgccgagttcatcgccacgctgctgttcctgtacatcaccgtggccacggtgatcgggtacaagcaccagacggacgcgtcggcctccggcgccgacgcggcgtgcggcggcgtgggcgtgctcggcatcgcgtgggcgttcggcggcatgatcttcatcctggtctactgcaccgccggcatctccggcgggcacatcaacccggcggtgacgttcgggctcttcctggcgcgcaaggtgtccctggtccgcgccatcctctacatcgtggcgcagtgcctcggcgccatctgcggcgtcggcctcgtcaaggcgttccagagcgcctacttcaacaggtacggcggcggcgccaacaccctcgccgccggctactccaagggcaccggcctcgccgccgagatcatcggcaccttcgtgctcgtctacaccgtcttctccg

SEQ ID NO: 2147 - DNA, 600 bp, Artificial
  Synthetic
agagaagagagaggtagagaagagagagcagagctaagctagctcagagtgagtagcgtgttgagcttgctgaagggagcggcaatgtcgaaggaggtgagcgaggagccggagcacgtgcggcccaaggactacaccgacccgccgccggcgccgctgttcgacgtcggcgagctccggctgtggtccttctaccgggcgctcattgcggagttcatcgccacgctcctgttcctatacatcaccgtcgccaccgtcattgggtacaaggtgcagtcgtccgccgaccagtgcggcggcgtcggcaccctcggcatcgcctgggccttcggtggcatgatcttcatcctcgtctactgcaccgccggcatctccggagggcacattaaccccgcggtgacgttcgggctgctgctggcgaggaaggtgtcggtgattcgcgcggtgatgtacatcgtggcgcagtgcctgggcggcatcgtgggcgtgggcatcgtgaagggcatcatgaagcaccagtacaacgccaacggtgggggcgccaacatggtggccagggggtactccaccggcaccgccctcggcgccgaaatcatcggc

SEQ ID NO: 2148 - DNA, 768 bp, Artificial
  Synthetic
aaagtagagagatggaggggaaggaggaggatgtccggctgggagccaacaagttctcggagaggcagccgatcggcacggcggcgcagggctccgacgacaaggactacaaggagccgccgccggcgccgctgttcgagccaggggagctcaagtcgtggtccttctaccgcgcagggatcgccgagttcatggccaccttcctcttcctctacatcaccgtcctcaccgtcatgggggtcaacaactccacctccaagtgcgccaccgtcggcatccagggcatcgcctggtccttcggcggcatgatcttcgccctcgtctactgcaccgccggcatctccggcggccacatcaacccggccgtcaccttcggcctcttcctcgccaggaagctgtccctcaccagggccctcttctacatggtgatgcagtgcctcggcgccatctgtggcgccggcgtcgtcaagggcttccagaagggcctgtacgagaccaccggcggcggcgccaacgtcgtcgcgcccggctacaccaagggcgacggcctcggcgccgagatcgtcggcaccttcatcctcgtctacaccgtcttctccgccaccgacgccaagaggaacgccagggactcccacgttccgatccttgccccactgccaatcgggtttgcggtgttcttggttcacctggccaccatccccatcaccggcaccggcatcaacccagcgaggagccttggcgctgccatcatctacaacaggggccatg

SEQ ID NO: 2149 - DNA, 600 bp, Artificial
  Synthetic
agctcactcacacagtctccactcacacgcattgcagaggagaggcgacaatggaggggaaggaggaggacgtgcggctgggggcgaacaggtactcggagaggcagccgatagggacggcggcgcagggcgccggggacgacaaggactacaaggagccgccgccggcgccgctgttcgagccaggggagctcaagtcgtggtctttctaccgggccgggatcgccgagttcgtcgccaccttcctcttcctctacatcaccatcctcaccgtcatgggggtctccaagtcctcctccaagtgcgccaccgtcggcatccagggcatcgcctggtccttcggaggcatgatcttcgcgctcgtctactgcaccgccggcatctccggaggacacatcaacccagcagttacttttgggctgttcttggccaggaagctgtccctgacccgggccatcttctacatagtgatgcaatgcctaggggccatctgcggagctggagttgtgaagggcttccagcagggtctgtacatgggcaatggcggtggtgccaatgtagttgccagtggctacaccaagggtgacggtcttggtgctg

SEQ ID NO: 2150 - DNA, 485 bp, Artificial
  Synthetic
gaattcgaaaccaaagaaaattttcatttcttgacagaaatggtgttgaaatggagggcaaataagaggatgttaagttgggagcaaacaagttctcagagagacaaccaataggaacttcagcacagaacacagataaagattacaaggaaccaccaccagctccattttttgagcctggtgaactaaaatcatggtcattctggagagcaggaattgcagagttcatggctactttcttgtttctttacatcactgttttgactgtcatgggtgttgctggtaacaagaataagtgtgcaactgttggtatccaaggtattgcttgggcttttggtggtatgatctttgctcttgtctactgtactgctggtatctctggtggtcacatcaaccctgctgttacctttggacttctattggcaaggaaattgtctctaacaagagctgttttctacatgataatgcaatgtcttggagcaatc

SEQ ID NO: 2151 - DNA, 771 bp, Artificial
  Synthetic
ccacccagccagctcgagcgagcgaagccagcagcagaagcagtagagagaaagtagagagatggaggggaaggaggaggatgtccggctgggagccaacaagttctcggagaggcagccgatcggcacggcggcgcagggctccgacgacaaggactacaaggagccgccgccggcgccgctgttcgagccaggggagctcaagtcgtggtccttctaccgcgcagggatcgccgagttcatggccaccttcctcttcctttacatcaccgtcctcaccgtcatgggggtcaacaactccacctccaagtgcgccaccgtcggcatccagggcatcgcctggtccttcggcggcatgatcttcgccctcgtctactgcaccgccggcatctccggcggccacatcaacccggccgtcaccttcggcctcttcctcgccaggaagctgtccctcaccagggccctcttctacatggtgatgcagtgcctcggcgccatctgtggcgccggcgtcgtcaagggcttccagaagggcctgtacgagaccaccggcggcggcgccaacgtcgtcgcgcccggctacaccaagggcgacggcctcggcgccgagatcgtcggcaccttcatcctcgtctacaccgtcttctccgccaccgacgccaagaggaacgccagggactcccacgttccgatccttgccccactgccaatcgggtttgcggtgttcttggttcacctggccaccatccccatcaccggcaccggcatcaa

SEQ ID NO: 2152 - DNA, 625 bp, Artificial
  Synthetic
gaattcagagctcagaaacacaaacacaggggagagatttgaaaaattagggtttggttactgagagatgacgaaagatgtggctcaccacgaggaaggagttcatcatagcggaagagactatgtagatccaccaccagctccattgtttgacatgggtgaacttaaactctggtcattttacagagctttgattgctgagttcattgcaactcttctcttcctttacgttactgttgctacagttattggtcacaagaaacaaactgttgagtgtgctggtgttggtcttttgggtattgcttgggcttttggtggtatgatctttgttcttgtttactgcaccgccggtatctcaggaggacatatcaatccagcagtgacatttggtttgttcttggctcgtaaagtctcattgttgagagctgttttctacatgatagctcaatgtttgggagctatttgtggagttgggcttgtaaaagcattcatgaagcatgactacgttgctcaaggaggtggtgctaactcaattgcaccaggttactctaaaggtgcagctcttggtgctgagattattggaacttttgttcttgtctacacagtcttctcagctaccgaccct

SEQ ID NO: 2153 - DNA, 907 bp, Artificial
  Synthetic
cgaccaaacttggtttttgcactatccacttagcacaaaaaaaagagaaaaacaagctaagtttagtgagtgttcaaatggcagaaaacaaagaagaagatgttaagcttggagctaacaaattcagagaaacacagccattaggaacagctgctcaaacagacaaagattacaaagaaccaccaccagctccattgtttgaaccaggggagttatcatcatggtctttttacagagctggaattgcagaatttatggctactttcttgtttttgtacatcactatcttgactgttatgggtctgaaaagatctgatagtctgtgtagttcagttggtattcaaggtgttgcttgggcttttggtggtatgatctttgctttggtttactgcactgctggtatctcaggaggacacatcaacccagctgtgacctttggattgttcttggcaaggaaactgtccttaaccagggctattttctacatggtgatgcaatgccttggtgcaatttgtggtgctggtgttgtgaagggattcatggttggtccataccagagacttggtggtggtgctaatgttgttaaccctggttacaccaaaggtgatggccttggtgctgaaattattggcacttttgtccttgtttacactgttttctctgctactgatgctaagagaaatgccagagactcacatgttcctattttggcaccacttcccatcggattcgcggtgttcttggttcatttggccaccattcccatcaccggaactggcatcaaccccgctaggagtcttggagctgcgatcatccacaacaacgaccatgcatgggacgaccactggatcttttgggttggaccattcattggagctgcacttgctgcagtttaccaccaaataat

SEQ ID NO: 2154 - DNA, 674 bp, Artificial
  Synthetic
tctctctctctcatagtattagtcaagaaaatagtaatctaaatttagaatagtgagaaaatggcaaagaacgttggtagtgaagggtcgttcacgacgaaagactaccaagatccgccgccagcaccgctgattgacccagaagagctaacccaatggtctttttacagagcactcattgctgaattcatagccactcttctcttcctttacataacggttctgaccgtcattggttacaagagccaaagtgctacggcaacggatccttgtgctggtgttgggatccttggtattgcttgggcatttggtggcatgattttcgttcttgtctactgcaccgctggtatttctggtggtcatataaatccagcagtcacatttggactattcctggcgaggaaagtatcgctaataagggcagttatgtatatggtggctcagtgtttgggagcaatttgtggggttggattagttaaggctttacaatcagcttactaccaccgctatgacggcggagccaatatgctctccgacggatacagtcacggcgtcgggttgtcggcggagatcatcggaacttttgttcttgtttacactgttttctctgccactgatcctaagaggaatgctagagattctcatgtccccgtgttggcaccactccccattgg

SEQ ID NO: 2155 - DNA, 623 bp, Artificial
  Synthetic
aaaagctgcattctgttgcattctcttgaagaaagctagaagctaagaatggaggggaaagaagaggatgtgaaggtaggagcaaacaagtattcagaaaagcagccattagggacctcagcacagagcaaggactataaggaaccaccaccagcaccattgtttgagcatggtgagctccattcttggtccttttggagagctgggattgctgaattcatggctactttcttgttcctttacatcactgtcttgactgtcatgggttactctagggctaacagcaaatgtagtactgttggtgttcaaggtattgcttgggcttttggtggtatgatttttgcccttgtttactgcactgctggaatctcaggtggacacattaaccctgctgtgacatttggtctctttctggcaaggaaattgtccctaaccagggcagttttctacattgtgatgcaatgccttggtgcaatctgtggtgctggtgttgtcaaagggttccaaccatctttgtatcaggttaagggtggaggtgccaatattgtgaatcatggttacaccaaaggagatggccttggtgctgagattgttggcacttttgttcttgtctatacagtctt

SEQ ID NO: 2156 - DNA, 722 bp, Artificial
  Synthetic
cccacgcgtccgaaaaaacagagcatcctctgtttctttctacagagtattttacttttttcttttctaagttatgactaaagaagtagaggcagtatctgagcagcctgcggagtattccgctaaggattacactgatccgccaccaactcctcttgttgattttgaggagttaactaaatggtcactttacagagcttgtattgctgagtttattgctactttgttgtttctttatgtaactgttttgactgtaattgggtacaagcatcagtcggatactaaagatggaggcgatatatgtggcggcgttggtattcttggtattgcttgggcttttggtggcatgatctttgttcttgtttactgcactgccggtatatctggtggacacatcaaccctgctgtgacatttgggctatttttggcaaggaaagtatcattgatgagggcattattgtacatggtatcacagtgcttgggtgcaatatgtggtgtgggttttgtgaaggctttccagaaagcttactaccatagatatggtggtggtgttaatgttatggcaggaggccacaacaaaggtgttggtttgggtgctgagattattggtacctttgttttggtctacactgtcttctctgctactgaccctaagaggagtgctagagactcccatgtccctgtattggaccacttccaatcggattcgctgtcttcatggt

SEQ ID NO: 2157 - DNA, 679 bp, Artificial
  Synthetic
cgtcgggttcgaaccctcctatctgtcaatctctctctccccttatacactacaagaaggccatggagtcgaaggaggaggatgtgagactaggtgcgaacaagtacccagagaggcagccactgggcacggcagcgcagacacggaactacagtgagcccagcccggcccccctcattgagccctcggagttctcctcctggtccttctggagagccggcatcgccgagttcatcgccaccctcctcttcctctacatctccatccagaccgttatgggatggaagcgctcagtcgaggccgagaccgccaaattccccaacgaccagaacatctgtcctcagggtgtcggcgtccagggcattgcctgggcctttggcggcatgatctttgccctcgtctactgcaccgccggcatttcaggtgggcacataaacccggcagtgacatttggactattcctggctcggaagctgtctctaccgcgggcgttgctatacataatagcacagtgccctgggagccatctgcggggcgggcatcgtgaaggggttccaggaggcagactaccagcgctttggaggtggtgctaactcagtggcccatggctacaccaaaggggatggcttgggggctgagatcattggcacttttgtcctcgtctacaccgtcttctctg

SEQ ID NO: 2158 - DNA, 554 bp, Artificial
  Synthetic
ttcttcatcttcttcttcttcttcctccttggtccatatatacacaccaagctaggtgtggttggcttggttgtctgagttgtgtgttgggtgggttggtaccatagtgtgtgttggttggttagttgtggtgttggcaggagggggattattatggagtccaaggatgaggatgttagactcggggccaacaagtaccccgagcggcagcccattggtaccgctgcccagacccgcgattacaccgagccccgcgctgcccctttcgttgagttctcggaattctcctcctggtccttctggagagctggtatcgctgagttcgtcgccaccctcctcttcctctacatctccgtccaaaccgtcatgggatggaaacgctccgttgcggcctccaacctgaaattccccggtgatgtcaacatttgcccgcaaggtgttggggtccaaggcatcgcttgggcctttggtggcatgatcttcgccctcgtctattgtaccgctggtatatcaggtggacatattaacccagcggtcaccttcgggctcttcct

SEQ ID NO: 2159 - DNA, 833 bp, Artificial
  Synthetic
agtggggccaacctctacgttaaaagatggagcttctctttaactttgcttaggcagcttatccagcagcagcatcttccttttctctctctctttcccttctctctctctcatccctttccagacacttctcggggtttaatcagggcacgcgagagatatcgagaggtagagagttaagttcttcctgtgttccaaagcttggaagctagactagatcgatcatccgatggaaggcaacagggaggatgttcatgttggtgtggcaaagtatcacgagcgagagctgggaaccgcggcacaggccgagaaggactacgttgagccggccccgacccgactgatcgagccgtccgagttctcgtcctggtccttctggcgagccggaatagcggagttcttcgcaaccttcctcttcctctacatcaccattctcacggttgtggggaacgttaaccgtactagctgcaacggggtggggatccaaggcatagcctgggcctttggaggcatgatctttgctctcgtctactgcaccgctggaatctctggtggacacatcaatcctgcggtgactttcggcctcttcttggctcgaaaggtgtctctgcctcgaaccattctctacatggttgcacagtgcctgggggcgatttgcggtgccggcgtcgtcaaaggcttccagagggcgatgttcaacgctgctggaggaggagcgaacttcgtccagcatggttacacacttggagatggtctaggagctgagattgttggaacttttgttctcgtctacaccgtcttctcggctactgatgctaagagaattgccagag

SEQ ID NO: 2160 - DNA, 488 bp, Artificial
  Synthetic
gtagttttccttttggaactcatccaattcacgagggagaggtagaactgatcaagagaaagagatggcgaaggatgcaggaaaagagtccgaagccttcgtcaccgccaaggactacgaagatccaccgccggtgcggctcgtagatccaaaagagtttgcttcctggtccttctacagggccggcattgccgagttcgtcgccacgctcttgttcctctacatcaccgttcagacggtcatcggccactcgcgaaaccaggcaaactgcggtggcgttgggttgctaggaatcgcatgggcctttgggggcatgatcttcgttctcgtctactgcactgccggaatctcaggaggacatatcaacccggctgtgactttcggactcctcgtggctcgcaaggtctccctgcctcgcgcgatcttctacatgatcgcgcagtgcctgggagcgatcgtcggctgcggcctcgccaaggggttccaga

SEQ ID NO: 2161 - DNA, 386 bp, Artificial
  Synthetic
caacaaactaaagttggtggtgatagagtgagagagaaacatggaaggcaaagaagaagacgtcaatgttggagccaacaagttcccagagagacagccgatcggtacggcggctcagacggagagcaaggactataaggaaccaccaccggcgccgtttttcgaacccggcgagctcaaatcttggtctttctacagagcagggatagctgagttcatagccactttccttttcctctacgtcaccgttttgacagtcatgggtgttaagagagctcccaatatgtgtgcctctgttggaatccaaggcatcgcttgggcttttggtggcatgatctttgctcttgtttactgtactgctggaatctcaggaggacatattaatc

SEQ ID NO: 2162 - DNA, 351 bp, Artificial
  Synthetic
cccacgcgtccgtaaccactctactttctcaaatcccacactcagagaagaagaagaagaaaaaaaacagagctttacaatttctctctacagagatcgaagatatggaaggcaaggaagaagacgttagagttggagctaacaagttcccggagagacaaccaatcggaacatcagctcagagtgacaaggactacaaggaaccaccaccagctccgtttttcgaacctggtgagctttcttcatggtctttttggagagctgggatcgctgagttcatcgctacttttctctttctctacatcactgtcttgactgttatgggagtgaaaaggtcaccgaacatgtgtg

SEQ ID NO: 2163 - DNA, 403 bp, Artificial
  Synthetic
aaagaagaaaaaaagcaaagaacacttgaacgttttctagatagagatggaagggaaagaagaggatgttcgagtgggagctaacaagttcccggagaggcaaccgataggtacatcggctcagacggacaaagactacaaggagccaccaccagctccatttttcgagccaggcgagctgagttcgtggtccttctacagagccggaatcgccgagttcatagccaccttcctgtttctatacataacagtattgacagtgatgggagtgaagagagcaccaaacatgtgtgcctctgttggaatccaaggcattgcttgggctttcggtggcatgatctttgcccttgtctactgtactgctggaatctctggtgggcacataaacccagcggtgacattt

SEQ ID NO: 2164 - DNA, 353 bp, Artificial
  Synthetic
cacagaaaaacctagaaagctctagagagaaagagagagagagatggaaggtaaagaagaagatgttagagtcggagctaacaagtttccggagaggcaaccgatcggaacttcggctcagagtgacaaggactacaaagagccaccacctgcgccgttgttcgagcccggcgagctagcttcatggtccttctggagagctgggattgctgagtttatagctacgtttttgttcctgtacatcactgttttgactgttatgggtgtgaagaggtcaccgaacatgtgtgcttccgtcggaatccaaggtatcgcttgggctttcggtggtatgatcttcgctctcgtctact

SEQ ID NO: 2165 - DNA, 531 bp, Artificial
  Synthetic
  misc_feature (393)..(393): The residue at this position can be any nucleotide.
ggttcgaaccctcctatctgtcaatctctctctccccttatacaatacaagtagaaggccatggagtcgaaggaggaggatgtgagactaggtgcgaacaagtacccagagaggcagccactgggcacggcagcgcagacgcggaactacagtgagcccagcccggcccccctcatcgagccctcggagttctcctcctggtccttctggagagccggcatcgccgagttcatcgccaccctcctcttcctctacaatctccatccagactgtcatgggatggaagcgctcagtcgaggccgagaccgccaaattccccaatgaccagaacatctgtcctcagggtgtcggcgtccacggcattgcctgggcctttggcggcatgatctttgncctcgtctactgcaccgccggcatttcaggtgggcacataaacccggcagtgacgtttggactattcctggctcggaagctgtctctaccgcgggcgttgctatacataatagcacagtgcctgggagccatctgtgg

SEQ ID NO: 2166 - DNA, 731 bp, Artificial
  Synthetic
gtcggaaagttcttgtcctagagagaccctcctcctctctccctcttaggtcgcctacccctcagagccatcatggccagcaaggatatggacacgccggagccgcggactgggaaggactacacggagcccccccctgtcgccctctttgacgctgctgagttcagtctctggtccttctaccgtgcctgcatcgctgagttcattgcgactctgctcttcctctacatcactattgccgctgtcatcggtaacaaccacaatatcactggctgcaacaacatcggtgtgcttggcatcgcctgggccttcggtggaatgatcttcatccttgtctactgcactgctggaatctcaggagggcacataaacccagcagtgaccttcgggctgtttcttggacggaaagtgtcactgccccgggctatctgctacatggtagcgcagtgccttggggccatctgtggtgctggcctggccaagggtttccagacttcatactatgtgcgatatggaggaggtgccaacatggttgcccctggctacaccaagggggttggtcttgccgctgagatcattggcacctttgttcttgtctataccgtcttctctgccacagaccctaagaggaacgccagagattctcatgtccctgtgctggctccactgccaatagggtttgcagtgttcatggtccatctggccacaatccccatcactgggacaggcat

SEQ ID NO: 2167 - DNA, 682 bp, Artificial
  Synthetic
aaccgtcaaaaccaaatctaagatcgtcggaacgcagagtgagagcagtaggtagcccatctcgccggcgccggtcagcagattcaccggcgatcaaattccccgttgctgctagaaatacaggtggattaagtggaaaaagaggaaaccagatataaattatggtgttctctatggtgatgagttgttcacctcatatctgtcttccaaaaagccgcatggttatgcagaaaacaatccagtgctctgcttctgttttgacggcgtctgagtccatccaatttgatcttaagaattattggacaactctaatttgtgatatcaaccagaagcttgacgaggcggtcccagttaagtacccaaatcagatttatgaggccatgcgctactccgttctggccaagggtgctaaaagatccccgcccatcatgtgtgttgccgcttgtgagcttttcggtggaaatcgcctcgctgcctttcccactgcctgtgctttagagatggttcatgctgcttcgttgattcatgatgatctaccttgcatggatgatgacccaactcgacgaggactgcctgcaaaccacacagtttttggtgtagatatggcaattttagctggggatgccttgttccctcttggattccagcatattgtgtctcacactccaagcgatctcgttcc

SEQ ID NO: 2168 - DNA, 270 bp, Artificial
  Synthetic
gatcccattaagcagcttctgctctcttacggagaaaccccacactcttcctatgaaactctctcccgctgcaatccgatcttcatcctcatctgccccggggtcgttgaacttcgatctgaggacgtattggacgactctgatcaccgagatcaaccagaagctggatgaggccataccggtcaagcaccctgcggggatctacgaggctatgagatactctgtactcgcacaaggcgccaagcgtgcccctcctgtgatgtgtgtggc

SEQ ID NO: 2169 - DNA, 695 bp, Artificial
  Synthetic
cttcttcttctctctctaaatctctcttttcagaagacctaattttttgctgcttttgcatagtggtttattattaaggtcagcttcatttccggtagaatggattttttctttaggaatgtaaatgatgattcttcaactatccagcaagatattattaggtgcccatttttgcggaacatcaatgagccaacaaacttttccttctcaagctccatggctttcccacttcccgtacgtgaggggaaaggtcctatctttgaggatggtcctaattttgacatggcgttcaggcttttccacgggcagaatggtgttgttccactttcagggagaccatccatgaagccagatgctgcacctgcatcacctaatttcaaccctctggcagcaaaagcagcaaccataagcctctcggcttttggatctggaggtccttttggttttgatgcattctcagagaagtggaagaaattgaactccaaatcaaataaaaaagactcttcttccaagggaggagactcaaaacatgaagcgctaagcaatgagtggttgcagagtgggaattgtcctattgcgaagtcctaccgtgcagtgagtaatgtccttcctcttgtggcaaaggcttttcagcccccacctggtatgaacctcaggtgcccccctgcgatagttgctgcgcgtgctgctctagc

SEQ ID NO: 2170 - DNA, 705 bp, Artificial
  Synthetic
gtagagacttagggttctttgattccagcagcagccagcggcagaagaaaatggagtgcgacagcagcatcatcgccgagggcgtggagcgatgcccattcttgcggaacattggcgagccaacttcctttaacttcggcagcttcccccccatcaagttccccagcccgcttcgtggatccagaggaccgattttcgaggatggccccggatttgagaccgcatttcggttgttccatgggcaagacggtgtgattccactgtcccagaagaaggctgaggatggaagcgagagtgtggaagcggcccccaaaatgagcttccatccactggcagcatccgcggctacgataagtctctctacgtttggggccggccagtttaactttgacgcgtttatggcgaatcaagagaagaagaagcaacagcaaaagaagaaggaagcagagtctaaccacagacaggaccatctccatgaagcgctcggctccgaatggctggccactggaaactgtccgatagcacgctcctgtcgagcagtaagcggagtgctaccgctcgtcgcaaagtggctcaaaccacctgcgggaatgaagtaccggtgtcctccggccatcgtcgctgctcgagctgcgctggcgagaactgccttcgcgaagaacttgaggcctcaaccattgccatccaaactcttggcaatcggtt

SEQ ID NO: 2171 - DNA, 622 bp, Artificial
  Synthetic
gcagcccatctcgccggcgccgatctgcagattcaccggcgaatcaaattccccgttgctgttaggtggattaagtggaaagagaggaaccagagataaattatggtgttctctacggtgatgagttgttcacctcatatgtgtcttccaaagagccgcatggttatgcagaaaacactccggtgctctgcttctgtttcaacagcgtctgagtccatccaatttgatcttaagaattattggacaactctaattcgtgatatcaaccagaagcttgacgaggcagttcctgttaagtaccccaatcagatttatgaggccatgcgctactccgttctggccaagggtgctaaaaggtccccgccaatcatgtgtgtcgcggcttgtgagcttttcggtggaaatcgccaggctgcctttcccactgcctgtgccttagagatggttcatgctgcttcattgattcatgatgatctgccttgcatggatgatgacccaactcgtcgagggctgcctgcaaatcacacagtttttggtgtagatatggcaattttggccggggatgccttattcccgcttgggttccagcatattgtgtctcacactccaagtgatctcgttc

SEQ ID NO: 2172 - DNA, 363 bp, Artificial
  Synthetic
cccacgcgtccggtcagattcatccaaaaataagggaggaaaccacgaagccatgggcgacgaatggcttaaaacaggaaactgcccaatagcaaaatcatatcgagctgtaagtggtgtggcaccacttgtggcaaagatcctgcaaccccctccaggcatgaaatttaaatgccctcaagcaatagtcacagctcgagcagcgatatcaaaaacacctttcgccaagaacctccgtccacaacctttaccagctaaagtactagtgatcgggatgctgggcatggcgttaaatgtgcctttaggggtctggagagagcacactgaaaagttttcggcatcttggtttatagctcttcacgc

SEQ ID NO: 2173 - DNA, 653 bp, Artificial
  Synthetic
tcttctgtttccctctattacaggcgacatttcctgtggctactcaagcaagtagctggtagagaagggctttctctctttcatctctttgctgcaaaatggaggggaggcggattggggtggctatggacttctcgcccagcagcaggcacgccctcaaatgggctctctgcaacatcgcccgaaagcacgaccatttgatcatcatcatcgtcaacaagaaggagatggaatcgggtgacatgctcctctgggagcaatctggttctccattgatacccttctgtgattacgctgaaccggccgtcacccacaagtatggaattcagcatgatgttgacctcttctcacttgttgaagacgagaaaaatatgaaggaactcactgtagttttcaaagcgtattggggtgatccccgcgagaagatatgcgacgcttctgtagaccttccccttgattgccttgtgatgggaagtcgaggacttggaaccttgaaaagagcccttctagggagtgtcagtaactatgtagtcaacaattgcccatgcccggtcactgtcgtaaagtttccagccgacgatgtgcattcctcttgaccaattccaacatacaaggaggaaataagaactgaggtacatcaacatataaataaa

SEQ ID NO: 2174 - DNA, 551 bp, Artificial
  Synthetic
accccgactacgagcagggcgagaccctcctctgggaggccaccggctctccattgattcctctctcggatttctctgaacctacaattgcaaagaaatatggagcaaagcctgatgccgaaacattggacatgcttaatactgtggccaggcagaaggaggttgtggtggttttcaaagtcctttggggagatccccgtgagaagctatgccaagccatcaacgaaatccccatgagctgcttggttattggaagcaggggtcttggcaaactcaagagggtgctgttaggtagcgtcagcgactatgtcgtgaacaacgccacttgcccagtcacagttgtcaagacagccgatggctgatcctattgtcaaaaatatccatatatgtgttatatagtctgcttaaatctttgttcacctatttgaaacatattgaaccaccatgcagtgtaattgtaataataaacaaagtcagctgaagacgctcagttgtactttgtgcttgcactctctcagcctgagtatgaattggatccagctgtttttctt

SEQ ID NO: 2175 - DNA, 640 bp, Artificial
  Synthetic
cggacgcgtgggcggacgcgtgggttcgccgcgcgcgtcacacgagcaagggagcaagcgaggagagaggagaggcttagcgagagaggtgaggagaggagaggatttggaacttttgatctttgggatcgcgagacgacggagatggccggtggcggcagggccgatgacgagcgaaggatcggggtggcgatggactactcggcgagcagcaagagggcgctggactgggccatcgccaacctgctccgccggggcgaccacctcgtcgtcctccacgtcctgcatcacggcggggaggaggccaagcacgccctgtggggcaagtccggatccccgctgatccctctctccgagttccgggatccgacggcgatgcagcagtacggcgtgcactgcgacgccgaggtgctcgacatgctcgacacggcggcgcgccagttggagcttaccgtagtggcgaagctgtactggggcgacgccagggagaagctctgcgacgccgtcgaggagcagaagatcgacacgctcgtcatgggcagccgcggcctcggctcgatccagaggattcttctggggagtgtgacaaactacgtgctgtcaaacgcatcatgccctgtaacagtcgtcaaggggaagt

SEQ ID NO: 2176 - DNA, 665 bp, Artificial
  Synthetic
atttctcagcatgcagcaagaaagctctgaaatgggccattggcaacatccttcgtaaaggggatcaccttattctggtcactgttcgtcctgaaggtcactatgaagaaggcgagatgcagctctgggaggccactggttctcctttaattcctttatccgagttttgcgatgcccacacaatgaagaagtatggggttaaccctgacccagaaacattggatatggtaacccttgctgctagacagaaggagataatggtagtgctgaaaatttactggggagatgctcgagagaagttatgtgaagcaatcgacaaaactcccttgagctgtctggtcatagggaacagagggcttggaaagctcaagagggctatcatgggcagcgttagcaactatgttgtgaataacgctacgtgtcctgttactgttgtgaagcatgcagatgactaattgcgggtttattttgtcattgaaatctaagtttatattaaaataatcttgtttgttttctaagcttgatgttggatcaagcatctatatttgtgtgtattttgaacatgtcgatgctgtgtgtgtattatgtaccctcatgttgaacctctgtaattccgatcaccacgagttgctgcagtaaataaacattttggaactctacaaaaa

SEQ ID NO: 2177 - DNA, 608 bp, Artificial
  Synthetic
atagttcctatcataatgagcaaggtgcagttcaactgtgggaacagagtggttcaccgctcatccctctggcagagttctcagatccccatgtcgccaagacatatgctgtgtcacccgacaaggaaacactagaaatcctgaatcaaatgtcgaatcagagaggggttgaagtccttgcaaagatactctacggtgaccctgcaaagaagctgtatgaagcagttgacctggttcccctcaactgcttggtggttggaaacagagggctaagcacactcaagagggctctgatgggaagcgtcagctcctacatcgtgaataacgcgacctgcccagttacggtcgtcaaggagaacatatagctcctcaatagttaactgctctgataggaagcagtaaactgcaagaacagacagcatcagtatctaagtatctaacatatacaacagtatagcagattgaataaattgtgcttgacatgcactggcagtcactcagctcagctgcccttgcctctttacctggaaagatctttcttgatgtaaaccgttcagtatttattatgcatgtaataatataagcgggaaccatacgtgtgtttcagt

SEQ ID NO: 2178 - DNA, 583 bp, Artificial
  Synthetic
atttcctgtggctactcaagcaagtagctggtagagaagggcattctctctttcatctctttgctgcaaaatggaggggaggcggattggggtggctatggacttctcgcccagcagcaggcacgccctcaaatgggctctctgcaacatcgcccgaaagcacgaccatttgatcatcatcatcgtcaacaagaaggagatggaatcgggtgacatgctcctctgggagcaatctggttctccattgatacccttctgtgattacgctgaaccggccgtcacccacaagtatggaattcagcatgatgttgacctcttctcacttgttgaagacgagaaaaatatgaaggaactcactgtagttttcaaagcgtattggggtgatccccgcgagaagatatgcgacgcttctgtagaccttccccttgattgccttgtgatgggaagtcgaggacttggaaccttgaaaagagcccttctagggagtgtcagtaactatgtagtcaacaattgcccatgcccggtcactgtcgtaaagtttccagccgacgatgtgcattcctcttgaccaattccaacatac

SEQ ID NO: 2179 - DNA, 739 bp, Artificial
  Synthetic
gttcttttgttttcagttttcacacgcaagaaagttctctgcatctctttttaaagaagaaaaaacaaagaagaagaaataagtaagcgaaaatggtgaaagacagaacgattggtgtagcaatggatttctcaaagagcagtaaaactgctctaaaatgggccattgataacttagctgacaaaggcgacaccttttacatcatccatatcaagactcattcttctgatgagtcacttaacaagctctgggccaaatctggttctcctttaattccgttggtggagtttagggagcctgaagtgatgaagaaatatgatgtggagactgatattgatgttcttgatttgcttgatactgctactaggcagaaagagataaatgttgtcaccaaactgtactggggagatgctagggagaaactatgtgatgctattgaagatctgaagttggattctttggttatgggtagcagaggccttactaccatccaacggatattcttggggagtgtgaccaactatgtaatgtctcatgcgacctgccctgtgactgtagtcaaggatccagatttccacaagcactgatcaacaactttgggttgaatgcgagtaactaattgcgacttatgatgcccgttgaataagatgaaaagctttaaatgtatatttattttctcttttgataagatcttgtttctggttccaataagcagagagagattgatgattttctctta

SEQ ID NO: 2180 - DNA, 414 bp, Artificial
  Synthetic
gaatatcggaatcgccatggatttctcagagagcagcaagaacgctctgaaatgggcgatcgagaacttagcagacaaaggagacacgatttacatcatccacactctaccactctctggcgatgaatctcgtaactccctctggttcaaatccggttctcctctcataccgttggcagagtttagggaaccggagattatggagaaatacggtgtcaaaaccgacatcgcatgtcttgatatgctcgacactggttcgaggcagaaagaggtgcatgtagtgaccaagttatactggggagatgcaagagagaagcttgttgatgctgttaaagatcttaaactcgattctattgtcatgggaagcagaggactcagtgctcttcaaaggataataatgggaagcgtgagcag

SEQ ID NO: 2181 - DNA, 480 bp, Artificial
  Synthetic
agagaatcagctttcagagattaaagtatacctacagatagagttatggcggagagtggtggacgaaggatcggagtggcggtggatttctcggactgcagtaagaaggctctgagctgggcgatcgataacgtggttcgcgacggagatcatctgatcctaatcactattgctcacgatatgaattacgaggaaggcgagatgcagctctgggagaccgttggatcaccttttattcctatgagtgaattctctgacgctgctgtgatgaaaaagtatgcattgaagccagatgctgaaacccttgacattgtcaatactgccgataggaagaaaacgattacagtagtgatgaagatatattggggagatcctcgtgagaagatttgtgcagcagctgaacagattcctctctcaagccttgtgatgggtaacagaggccttggtggtcttaagaggatgattatgggaagtgtaagc

SEQ ID NO: 2182 - DNA, 501 bp, Artificial
  Synthetic
ttgaagacggcgacaccgtcctcttgattcacgtccaaccacaaaacgccgatcatacccgcaaaatcctcttcgaggaaaccggttcaccgctaattcctttggaggaatttagagaggttaatttgcctaaacagtatggacttgcttacgatcctgaggttcttgatgttcttgatactctctctagggctaaaaaggtgaaggttgtaccaaaggtgtattggggagatccaagggagaaactttgtgatgctgtccaaaatctaaaactcgattccattgttcttggcagtcgaggtttgggttctctcaaaaggatcttgctgggtagtgtgagcaatcatgtggtgacaaaatgcaacatgtcctgtcacagttgttaaggctaattaaagtgtctcttgttctttaattggacccagctaataacattagtagttacgtgtgtcactcatgcattgttttgacatttatacgtttgttgccttctacaaattt

SEQ ID NO: 2183 - DNA, 681 bp, Artificial
  Synthetic
acgcgtcgctcttcctcccactcctcttctgtccacggtagccacttggccttgccttcccggaacgtacctaggccccgcctttcatccccttcctccgctgtcgcttccctctactctgacccttcctatgacctctccgacttcaccttctcccccatcaaggagtccatcgtctcccgcgaaatgactcgacgatacatgactgatatgatcagctatgccgataccgacgtcgtcattgtcggcgctggctcggctggactctcctgtgcctacgagctcagcaagaacccagatgtgcgggttgccatcatcgagcagtccgttagccctggcggcggcgcgtggctcggaggtcagctcttctcggcgatgatcgtgcggaaacctgcccacctgttcctagatgagattggcgtgccatacgatgagcaagagaactacgtcgtcatcaagcacgcagcactgttcacctccaccatcatgagcaagctcctagcgaagccgaacgtgaagcttttcaacgcagttgccgccgaggatttgatcataaaggaggggagagttggaggcgtggtgaccaactgggctcttgtgtcgatgaaccacgacacacagagctgcatggatcctaatgttatggagtcgcgcatcgtggtgagctcatgcgggcacgat

SEQ ID NO: 2184 - DNA, 1372 bp, Artificial
  Synthetic
aaaaaactcatctctcaagatctcaagctttgtctatggcaaccatggcatcaaccttggcatcctctgttgttaccaagaccaatttcttggacacccacaaatcatctttctctggtgtccctcttttttcacaagctagacttaaacctgttaaatctgcccagcaaaacatgaccatttccatgtctgctgattcctctcctccaccttatgatcttaacgctttcagttttaacccaattaaggaatccatcgtttctcgcgagatgacacgtaggtacatgactgacatgatcacctatgctgacactgatgtcgtcatcgttggcgctggctctgctggtctctcttgtgcttatgagatcagcaagaaccctaacgtccaggttgccatacttgagcaatcagtgagccctggtggaggtgcctggctaggtggacaactcttctcagccatggttgtgaggaagccagcacatctcttcttgaacgagctcggcatagactatgacgagcaagataactacgtggtcatcaagcacgctgccttgttcacctcaaccatcatgagcaagcttttggccaggccaaacgtgaaactcttcaatgctgttgcaacagaggaccttattgtgaagaacggaagagttggtggtgttgtcacgaactggtctttggtttctcagaaccacgacacacaatcctgcatggaccccaatgttatggaggctaagattgtggtcagctcttgtggccacgacggtcccatgggtgccactggtgttaagaggcttaagagcattggcatgatcaatcatgttcctgggatgaaagctttggacatgaacgccgctgaggatgctattgttagacttacaagagaggttgtacctggaatgattgtcacagggatggaagttgctgaaattgacggagcaccaagaatggggccaacttttggagctatgatgatatcagggcagaaggcggcccaccttgcgctaagggcattgggattgcccaatgcactcgacgggacagcagagtcgaccattcatccggagcttatcttggctgcagcggataatgctgagacagcagatgcttaaaatcttgaatgtataatatttctcttaaaaaaagattagtttttcctagatgagcgtggtttgtggttgggagaaattggcaaagggggatgaataaaagtctgcaggatgaatgtcaatgtgtacctttggctgtttcatgtctattcttcttttcttttgatttacttctacttcaaaactttgatgtgaaaaagttgtagattgtagttttcattgaataatcctatgggctttttggcgtcgttttggtaaaaaaa

SEQ ID NO: 2185 - DNA, 626 bp, Artificial
  Synthetic
gccattacggccggggaaaacaatctttcattcttctaaggtctcaaaacaaaatctcctttctcagaaccatgacacacaatcttgcatggaccccaatgttatggaggctaagattgtggtcagctcttgtggccacgacggtcccatgggtgccactggtgttaagaggcttaagagcattggcatgatcaatcatgttcctgggatgaaagctttggacatgaacgccgctgaggatgctattgttagacttacaagagaggttgtacctggaatgattgtcacagggatggaagttgctgaaattgacggagcaccaagaatggggccaacttttggagctatgatgatatcagggcagaaggcggcccaccttgcgctaagggcattgggattgcccaatgcactcgacgggacagcagagtcgaccattcatccggagcttatcttggctgcagcggataatgctgagacagcagatgcttaaaatcttgaatgtataatatttctcttaaaaaaagattagtttttcctagatgagcgtggtttgtggttgggagaaattggcaaagggggatgaataaaagtctgcaggatgaatgtcaatgtgtacctttggctgt

SEQ ID NO: 2186 - DNA, 684 bp, Artificial
  Synthetic
  misc_feature (559)..(559): The residue at this position can be any nucleotide.
acctacaattaacatggccccacctcctgctgtcgttgcccaccccctctcctctcaggctactggtcttgatatggtccatgagttcaaccagaagctcactaagtctgatgagcacacttgggagtctttcaagttcgcccccatccgtgagtccactgtctctcgagctatgactcgacgatactttgaggatcttgacaagtacgctgagtctgatgttgttatcattggagctggctcctgtggtctctctgctgcctatgttcttgccaagagccgacccgacctcaagattgccatcgttgaggctggtgttgctcccggaggaggtgcttggcttggaggacagctcttctctgccatggttatgcgaaagcctgccgagcagttccttgaagagatcggtgtcccttacgaagatgagggagactacgtcgttgttaagcacgctgcccttttcacctctactctcatgagccaggtgctcaagttccccaatgttaagctcttcaacgctactgccgttgaggacctcattacccgaaaggatgcccanggcaaccttcgaattgcaggtgtcgtcaccaactggaccctagtttccatgcaccatgatgaccagtcctgtatggaccccaacaccatcaatgctcctatcatcatctccaccactggtcatga

SEQ ID NO: 2187 - DNA, 578 bp, Artificial
  Synthetic
gaattccagatcccatcaagactccaacccggccgatcaacttcccaaaacaacactacatcatcaatctctatgtcatcaacttttctctgctatgattgttcgtaaaccagctcacaaattcctcgatgaactcgaaatcgagtacgatgagcaagacacctatgttgtcatcaagcatgctgccttgttcacttccaccatcatgtcaaagttgttggccagaccaaacgtcaagttgttcaatgctgttgcagcagaggatttgatcgttaagaacaataaagttgccggagttgtcaccaactgggcgttagtctcaatgaaccatgacacacaatcttgcatggaccctaatgtcacggaagccaagattgttgtcagttcatgtggtcatgatggtccttttggtgctactggtgttaaaaggttgaagagtattggtttaatcgactcagttcctggaatgaaagctcttgacatgaacgccgctgaagatgccattgttaaactcactagagaaattgttcctggtatgattgttactggaatggaagtggctgaaattgatggtgccc

SEQ ID NO: 2188 - DNA, 1049 bp, Artificial
  Synthetic
gtcggcgccggctccgcggggctctcctgcgcgtacgagctctccaaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaaggagggccgcgtcggcggcgtggtcaccaactgggcgctggtgtcgatgaaccacgacacgcagtcgtgcatggaccccaacgtgatggagtccagggtggtggtgagctcctgcggccacgacgggccgttcggcgccacgggcgtcaagcggctgcaggacatcggcatgatcgacgccgtgcccggcatgcgcgccctcgacatgaacaccgccgaggacgagatcgtccgcctcacccgcgaggtcgtccccggcatgatcgtcaccggcatggaggtcgccgagatcgacggcgccccgagaatgggcccgacgttcggagccatgatgatctccggccagaaggcggcgcacctggcgctgaaggcgctcggccggccgaacgccatcgacggcacgatcaagaaggcggcggcggcggcggcggcgcacccggagctgatcctggcgtcgaaggacgacggcgagatcgtggacgcctgagcgaatagaacagggtaaaaaaaaatccgcaagacgtggtggtgacacggaggcgttggggacgagaagaagatgtggactttcccctgtgttttttttttcgggatttgctttgatccccttgtttgttttagctctggatgttgattagcgtcttgttcatagcaattccactgccaccgtgtgtgtgtgctctgcttgcctgatgagggcaagaaaacttccatggatccgtctctctgggagga

SEQ ID NO: 2189 - DNA, 309 bp, Artificial
  Synthetic
ctttttttttttgagaacttaaaccctaaaatccaagcaaaaccaaaccacataaaaacatccttcacataagaaagaaaaaacaaaagaacaaccatgaacagcagacagactatttgattgacggatttctcttaacctacagtactcatcaacatcatcatcatatccttgctctgctctctttttattaatttatgcaattttagatgataatttccttatcatcaacagtctcaacattactttatttcttaagcttcagcagtctcagctgattcagcagctgcaaggataagctctggtaca

SEQ ID NO: 2190 - DNA, 985 bp, Artificial
  Synthetic
gaattcgcagaacctaagaaatcttctttctaatggcaaccatggcaatgaccctttcttcacccctttctaaaacacctttcctagaaactcaatcttctttccatgggatccagatcccatcaagattccaacccatccgatcaacttcccaaaacaacactacatcatcaatctctatgtcatcaacttccggttatgatcttacagatttcaagtttgcaccaatcagagaatcaatagtttctcgtgaaatgacccgtcgttacatgatggatatgattacttacgccgataccgatgttgttgtcgttggtgctggttcagctggtttatcatgtgcttatgaaatcagtaagaaccctaacgttaatgttgcacttattgaacaatcagtttctccaggtggtggtgcttggttaggtggacaacttttctctgctatgattgttcgtaaaccagctcacaaattcctcgatgaactcgaaatcgagtacgatgagcaagacacctatgttgtcatcaagcatgctgccttgttcacttccaccatcatgtcaaagttgttggccagaccaaacgtcaagttgttcaatgctgttgcagcagaggatttgatcgttaagaacaataaagttgccggagttgtcaccaactgggcgttagtctcaatgaaccatgacacacaatcttgcatggaccctaatgtcatggaagccaagattgttgtcagttcatgtggtcatgatggtccttttggtgctactggtgttaaaaggttgaagagtattggtttaatcgactcagttcctggaatgaaagctcttgacatgaacgccgctgaagatgccattgttaaacttttctctgctatgattgttcgtaaaccagctcacaaattcctcgatgaactcgaaatcgagtacgatgagcaagacacctatgttgtcatcaagcatgctgccttgttcacttccaccatcat

SEQ ID NO: 2191 - DNA, 520 bp, Artificial
  Synthetic
ccccccgaacaaaaacaaaagcactcgagtcgactcgtgcgccgccgcgcgcgcgcacgcacgcacactccggcctcgctcgcatggcggcgtccacggcatccgccccgttcacgccgctcctccaccggcggcgagcgagcgtccacggccggcgcgggagcgggagggcgttcgtcgccgtcgtcgtcgcggcggcggcggggggcgcgccggagacggagccgtccccggctacggcggccggggcggcggcgcaggggaagaagaagacggtggacacgaggatacactggtcggacccggacgaagggtgggtcggcgggaacgccaagaaggacggcggcggccggaagaaggagccgctcggtgggaggttcgccgacctcatcaacaacccgtccgagtctcactaccagttcttgggggtggaaccgaaggcggacatcgaggagataaaggcggcgtaccggcggctgtccaaggagtaccacccggacacgacgtcgctgccgctgcg

SEQ ID NO: 2192 - DNA, 741 bp, Artificial
  Synthetic
tctcccttctctttttgcaagacttaataattctccagcttcctcccatcatcaccccactttgagagagaagacatggcaaagggaagttacgagaaggccattgtttcactccagaacctcctcagtgagaagggagaactggaaccgattgtagcagaaagaattgatgaaatcacagctgaattacaaacgtcaggcttccaatcagtccaccctgttgacagaatcaagactggctttgattatttcaaaaaagagatatatgacaaaaatccagaactgattgatgaactcaagaaaggacaggaacccaagtttctggtgtttgcatgctccgattcacgagtgagcccatctcatgtgctgaattttcagctcggtgaggcttttatggttcgaaacattgccaacatggtccctccttatgacaagacaaaatactcgggagtaggagctataatcgaatatgctgttctctttcttaaggtagaaaatattttagtcattggccatagtgcatgtggaggtattaaggctctcatggatctcccagaaaatggttctgaatcaaccgattttattgagaattgggtgaaaattggactaccagccaaggcaaaggtactagctgaacatggggacaaaacttatgaagagaaactcaaatactgtgaaatggaagctgtgaatgtatcactagctaatttgctgacatacccatttgtgagtgatgctttg

SEQ ID NO: 2193 - DNA, 684 bp, Artificial
  Synthetic
attactcgctttcttccttatctcttttgcttttgctttgccttagaagggtgattagagatgggccatgacgatgctgaatgctgctacgaggaggctgttgaggagctcaacatcgtgcttatgaaatgcccacagctcaaagagaaggcttgcaaagagattgagtcactaacaaagaagttggctttggaggccaaattagtggaagaagctcatgaattgaaggatcatcttaaacttgttgcccatgagctcaatcccattgataagatcaaagatggcttcctcaagttcaaaacccattttaagaaagagcatgagttgttccaaaacatggtggagtctgaacgtgcaaagattatgatcatttgttgctcagactcacgggtagatccttgcgctatcctcggcttgaaggttggagaagcgcatgtcctccgtaatataatcaattgcatacccacatggtgggatgagaaatacaaatcaggggtagcatccattgaatatgcggttgcccatttgaaggtggatcacatttttattattggacacaacaaatgtgagggtttgaaaaagctattgcagtctgctcaggaagaagtgaaggaagatactcacaagatgaaaggtcccttccacgaatggttgcttaccatttccaaacataagcacaagcat

SEQ ID NO: 2194 - DNA, 879 bp, Artificial
  Synthetic
cctggtgtgtagctactgctataaggagggcgccgtgcaccgcctctcacaatgtcgaccgccgccgccgccgccgctgcccagagctggtgcttcgccactgtcaccccgcgctcccgcgccacagtcgtcgccagcctcgcctccccatcaccgtcctcctcctcctcctcctcctccaacagcagcaacctcccggcccccttccgcccccgcctcatccgcaacacccccgtcttcgccgcccccgtcgcccccgccgcgatggacgccgccgtcgaccgcctcaaggatgggttcgccaagttcaagaccgagttctatgacaagaagccggagctcttcgagccgctcaaggccggccaggcacccaagtacatggtgttctcgtgcgccgactctcgcgtgtgcccgtcggtgaccatgggcctggagcccggcgaggccttcaccgtccgcaacatcgccaacatggtcccagcttactgcaagatcaagcacgctggcgtcgggtcggccatcgagtacgccgtctgcgccctcaaggtcgaactcatcgtggtgattggccacagccgctgcggtggaatcaaggccctcctctcactcaaggatggagcaccagactccttccacttcgtcgaggactgggtcaggaccggtttccccgccaagaagaaggttcagaccgagcacgcctcgctgcctttcgatgaccaatgcgccatcttggagaaggaggccgtgaaccaatccctggagaacctcaagacctacccgttcgtcaaggaggggatcgccaacggcaccctcaagctcgtcggcggccactacgacttcgtctccggcaacttggacttatgggagccctaaatccga

SEQ ID NO: 2195 - DNA, 606 bp, Artificial
  Synthetic
gggctaccccgacacagatcttgagtccgccattcaagccctaacccagctcttgcagcaatctccggggttgaaagcagaagcagtgaagaagattgaggaaatcacgtcagagctttcccttgttgaagaacataagaacgggaaggagatcgaccccgtgctcaagctcaagcatggcttctccaagttcaaatccttcttcaagaaagaagctgaattgttcaagagtcttgcggagtcacaacaccctaagtttatgatcattgcatgctcggattcaagagtagatcctgctgtcatccttaatttgggtctaggagaagccttcattgttcgcaatgtcgccaatatggtgccaccttactgggagagtgctggatcttccactgcttctgccctagagtacgcagttttgcacttgaagattgaacacctgatggtgatcgggcatagtaggtgtgggggcatcaaagccctcatgtcatccaaggaagatgggtcaaacaaattcagtgactatattgaagactgggtcaaccatggaagaggtgctgctaagaaggtgcaaaagtccctccccaacaacaattttgacgaccaatg

SEQ ID NO: 2196 - DNA, 828 bp, Artificial
  Synthetic
cccccccctcgccgggatggacgccgccgtcgaccgcctcaaggatgggttcgccagggtcaagaccgagttctatgacaagaagccggagctcttcgagccgctcaaggccggccaggcacccaagtacatggtgttctcgtgcgccgactctcgcgtgtgcccgtcggtgaccatgggcctggagcccggcgaggccttcaccgtccgcaacatcgccaacatggtcccagcttactgcaagatcaagcacgctggcgtcgggtcggccatcgagtacgccgtctgcgccctcaaggtcgaactcatcgtggtgattggccacagccgctgcggtggaatcaaggccctcctctcactcaaggatggagcaccagactccttccacttcgtcgaggactgggtcaggaccggtttccccgccaagaagaaggttcagaccgagcacgcctcgctgcctttcgatgaccaatgcgccatcttggagaaggaggccgtgaaccaatccctggagaacctcaagacctacccgttcgtcaaggaggggatcgccaacggcaccctcaagctcttcggcggccactacgacttcgtctccggcaacttggacttatgggagccctaaatccgaccgtccgtccgttcagttcgtcagtttacgccaacgcttttgcataagtactacctgaggatatcgtccccgatcatcgatgtgaacgcgtggagtactactacgtacgtaccggatggttcgatatatgtgaatgctgtattaagtaataacaagaaatatatctcctctactttttcctgacgcggagttgtact

SEQ ID NO: 2197 - DNA, 930 bp, Artificial
  Synthetic
caaaagctaaaaaggaagttgttgagccaaatgtcaactgcttccattaacagttgccttactatttccccagctcaagcttcccttaaaaaaccaactcgtcctgttgcttttgctagggttagcaactcttcttcttctccttttgttcccagtctcatcagaaacgagcccgtcttcgccgcccctactcccatcatcaaccccattttgagagaagaaatggcaaatgaatcctacgagcaggccattgctgcactcgagaaactcctcagcgagaaaggagaacttggaccaattgctgcagcaagagttgaccagattacagctgaattgcaatcatcagatggcagcaaaccatttgaccctgttgagcacatgaaagctggctttattcacttcaaaactgagaaatatgagaaaaacccagccttatatggagaactatcaaaaggccagagccccaagtacatggtctttgcctgctctgactcacgagtgtgcccatcccatatcctgaacttccaacctggtgaagctttcgtggttcggaacattgccaacatggtccctgcttatgacaagaccagatactctggagtcggagcagctatcgaatacgctgttctccaccttaaggtagaaaacattgttgtcattggccacagcgcttgtggaggtatcaaaggtctcatgtctctacccgcagatggttctgaatcaactgcctttattgaggattgggtgaaaattggtttacctgccaaggccaaggtgcagggcgatcacgtggataaatgttttgcagatcaatgcacagcttgtgagaaggaagctgtgaatgtgtcacttggaaatttgttgacctatccatttgtgagagaaggattggtgaagaaaacactagcattgaagggaggtcactatgat

SEQ ID NO: 2198 - DNA, 686 bp, Artificial
  Synthetic
  misc_feature (264)..(264): The residue at this position can be any nucleotide.
tctctgttctctctctcatccccaagcaaggcttctctctcatggtcatcagctagcccattgcctgccccaacaatggacctccatgtatagaaaattggccactctaccaccttcttctacctcatcctcctctcgattgcccaagattagtgcagtacaagaggctcttcacccaattgagaaaataaagcaaggatgtgttactttcaagcaaaccaaccttttgacaaggccagaagtgcatgaaccactgaagtctgnccaaaccccaaaggtgatggtgatctcgtgctcccgattcaagagtatgcccaacccaagtatttgcattggatgcaggtgaagcatttgtggttcgaagtgtcgccaacttgattccaccttttggagaggaaggcttccctggcactagtgcagctctagagtacggtgttctccatctcaaggtagaacatatctttgttgttggacacagcatgtgtggaggaatcaaagctctcatgtcaattccagatgatgcacctaaatccacatggttcatcgaagattggatcaagatcggaaagccagctcgaaatgcagtgctaagccgcttcgcctcctcccccttggatcaacaatgtagacatggtgaaaaggaagccgtgaatatgtcacttgcaaaccttatgagcttcctttca

SEQ ID NO: 2199 - DNA, 667 bp, Artificial
  Synthetic
gggttcgaaccggagcaccgccaatatgaaatagcttttgcgcttctgcaaatactattatgataaacgacacgaggttcgcgcagtctataaatggaggctgaacccaggaaggcttcaggaatgtggagttgctgccttcccttgaaatcttctcgagaaatcaaaccctccactgcagtctcagctctccctgctcagcagaataagatgggtcaattcgatagcagtgattctgaatacacttccgccattgaagccctctccaccctcttgaagaaatcccccagcttgaaggcaacagcagtccagaagattgaagagttgactagcgagctaagccagaacgcagagacctgcaaggacgatttagtcgatcccttgcataaactcaagctcggcttctccaagttcaaatctttctacaagaaagaggcggagatgttcaagagtttggcagaatcccagcaccctaagttcatgataatagcgtgctcagattcgagagtcgatcctgccgttatattgaacctgggtttgggagaagccttcatagttcgcaatgtggccaatattgtgccacccttctgggagagttctggatcatccacagcgtctgcccttgaatacgccgtcctccatctgaaggtggagcatctcatggtca

SEQ ID NO: 2200 - DNA, 711 bp, Artificial
  Synthetic
  misc_feature (657)..(657): The residue at this position can be any nucleotide.
attcaccacgcgtccgggtttcttccatgccttcgatgcagcggtcccaggcctccccagccccgaatttccgtcctgggatcgttcttccggtagctacgcgtctcggctctggaatgcggcggccggattggggagaaggacctgtttcttgcagcaggttgttcatcaggatggtcaccaggttgttcatcatcaggatggtcaccaggttgttcatcatcaggatggtcaccaggttgttcatcaccagaagacgctggcagcggaaaggattaagcggggttttcaagggtttaagcaagacacataccgtcaaaaaccggagctcttcggtcgattagctatcgggacagcatcccaagttcatggtgattgctttgctctgactctagagtttgtcccacgacgatcctgaggttccagccaggagaggcatttgtcatccgcaacattgcaaacatggtgcctcctccggaaaaggtacactgaccttgctttgtgctcgttcgctcagctcaaaggcaaggctttcaggctggctatccaggaaccagtgcagctctcgagtacgcagtcatggttctcaaggtcgagaacattctagtgattggacatagtcgctgcgccggtatcgaagctctgatgacacgcaanaccaagtggaggtcagtcttacgaagctacgtaccaaggactcgggctctttct

SEQ ID NO: 2201 - DNA, 661 bp, Artificial
  Synthetic
ggtccagatagcttcttcgtgaccccgggagctatacttgaccccttgtctggtcgattcatcgagagaacgaagtcgctgtccaattcaatcggtcttgaaagaatggcgccagagaaaacgttcgaggaggcgcaggagattcttctccacaagatcaagatctctccgaatctaaagccgattgccgcaaagaagctgctggatctcgccaaggagctggatggtggagaggaagaagagaaggtggcggatttatccctggtcgatgttccagcggcagagagaatcaagcagggatttacaaagtttaaaaacgggttctggctcaaaaatcagaagctttacgagaagctttcaactggccagtcaccgaagttcatgatcttcgcttgctccgattcgcgagtttctccaacgacgatcttgggtctacaacccggcgaagcattcgttgttcgcaacattgcgagcatgattccagcttgtggtgagactggatttccaagcactagcgctgctctcgagtatggagtcttacacctcaaggtggaacatattctagtgatcggtcacagtcgctgtggaggaatcaaagctttgctcaccactgaccccgagaacaaatggagtgacttcatccaagactggatcaaaatct

SEQ ID NO: 2202 - DNA, 883 bp, Artificial
  Synthetic
gccatcgccatcgtcgccatggcttcctctttgcgctgctgccaagcgttgcctgcctctgatttcctggccaggaaccagatctccaccgaagctctcccggtgaggctgccgcagccgagcaacgcagctgccaggcgaaagatctgctgctcgcagcggccacattttgttgtcgacaccaaggtgacggccgcggagaggatcaagcaaggcttccagaagttcaaggaggagacatacacgaagaatccggagctcttcaatgcgctctctgacggacaatatcccaagttcatggtgattgcttgctccgactcgagagtgtgcccgtccacagttcttggcttccagccgggagaggctttcgtcgttcgcaacgttgcaaacatggtgcctcctccagaacaggccggctaccctggaacaagtgccgctctcgagtacgcagtcacagctctcaaggtggagaacatcttggtgatcggacacagcagatgtggaggaatcaaagctctcatgactcagaaagacaatgcagcgaaatggagtgcgttcatcgaggactggatcgagatcggtcgccccgcccgttcctcaactctcaaatctgatgctgagcaaaagatcgagtctcagtgcacgaaatgcgagaaggaatctgtgaacgtttccttgtccaatcttctcgcgttcccgttcgtcaaagaggcagtgaccagtggcaaagtcgctcttcacggtggctactacaattttgtcgacggctcgttcgagtactggacgtatggagctgatggaaagcccagcgagatcaccaagttctaaaacagaacaagagagaaacagaaattatacatccataaacctgtaagaactcacc

SEQ ID NO: 2203 - DNA, 565 bp, Artificial
  Synthetic
tttcatgccttcgatgcagcggtcccagggcctccccagccccgaatttccgtcctgggatcgttcttccggtagctacgcatctcggctctggaatgcggcggccggattggggagaaggacctgtttcttgcagcaggttgttcatcaggatggtcatcaggatggtcaccaggttgttcatcaccagaagacgctggcagcggaaaggattaagcggggttttcaagggtttaagcaagacacataccgtcaaaaaccggagctcttcggtcgattagctatcggacagcatcccaagttcatggtgattgcttgctctgactctagagtttgtcccacgacgatcctgaggttccagccaggagaggcatttgtcatccgcaacattgcaaacatggtgcctcctccggaaaaggctggctatccaggaaccagtgcagctctcgagtacgcagtcatggttctcaaggtcgagaacattctagtgatcggacatagtcgctgtgccggtatcgaagctctgatgacacgcaacaccaagtggagttcgttccttgaagac

SEQ ID NO: 2204 - DNA, 327 bp, Artificial
  Synthetic
acgcttatccgtaacgagccagtttttgccgctcctgctcctatcattgccccttattggagtgaagagatgggaaccgaagcatacgacgaggctattgaagctctcaagaagcttctcatcgagaaggaagagctaaagacggttgcagcggcaaaggtggagcagatcacagcggctcttcagacaggtacttcatccgacaagaaagctttcgaccccgtcgaaaccattaagcagggcttcatcaaattcaagaaggagaaatacgaaaccaaccctgctttgtacggtgagctcgcaaagggtcaaagtcctaagtacatg

SEQ ID NO: 2205 - DNA, 698 bp, Artificial
  Synthetic
cccacgcgtccgctctggctcatcatcttcaaactgttaccacgtccatagggttgtcgaagagctaggaagagccttaccaagagcttcttcttcccctaacatttaggttggtaggagaagcaaaggaagagatcatttataatggctcctgcattcggaaaatgtttcatgttctgctgcgctaaaacctccccggaaaaagacgaaatggcaacggaatcgtacgaagccgccattaaaggactcaatgatcttctcagtacgaaagcggatctcggaaacgtcgccgccgcgaagatcaaagcgttgacggcggagctaaaggagcttgactcaagcaattcagacgcaattgaacgaatcaagaccggttttactcaattcaaaaccgagaaatatttgaagaatagtactttgttcaatcatcttgccaagactcagaccccaaagtttctggtgtttgcttgctctgattctcgagtttgtccatctcacatcttgaatttccaacctggtgaggcttttgttgtcagaaacatagccaatatggttccaccttttgaccagaagagacactctggagttggcgccgccgttgaatacgcagttgtacatctcaaggtggagaacattttggtgataggccatagctgctgtggtggtattaagggactcatgtccattgaagatgatgc

SEQ ID NO: 2206 - DNA, 731 bp, Artificial
  Synthetic
ttaaaaggaaattcttgagccaaatgtcaactgcttccattaacagttgccttactatctcccctgctcaagcttcccttaaaaaaccaactcgtcctgttgcttttgctagggttagcaactcttcttcttctccttctgttcccagtctcatccgaaacgagcccgtcttcgccgcccctactcccatcatcaaccccattttgagagaagaaatggcaaacgaatcctaccagcaggccattgctgcactcgagaaactcctcagcgagaaaggagaacttggaccaattgctgcagcaagagttgaccagattacagctgaattgcaatcatcagatggcagcaaaccattcgaccctgttgagcacatgaaagctggctttattcacttcaaaactgagaaatatgagaaaaacccagccttatatggagaactatcaaaaggccagagccccaagaccagatactctggagttggagcagctattgaatacgctgttctccaccttaaggtagagaacattatcgtcattggccacagtgcatgtggaggtatcaaaggtctcatgtctctacctgcagatggttctgaatcaactgcctttattgaggattgggtgaaaattggtttacctgccaaggccaaggtgcagggcgaacatgtggataaatgttttgcagatcaatgcacagcttgtgagaaggaagctgtgaatgtatcacttgga

SEQ ID NO: 2207 - DNA, 619 bp, Artificial
  Synthetic
aactcgacagcgtcgccacgcgtcgccacgcgtcgagccctttcctctatctctctctctcatcctctctgttctctctctctcatccccaagcaatggcttctctctcatggtcatcagctagcccatttgccttgccccaacaatggacctccatgtatagaaaattggccactctaccaccttcttctacctcatcctcctctccattgcctaagattagtgcagtacaagaggctcttcacccaattgagaaaataaagcaaggatttgagactttcaagcaaaccaaccttttgacaaggccagaagtgcatgaaccactgaagtctggccaaaccccaaaggtgatggtgatctcgtgctccgattcaagagtatgcccaacccaagtatttggattggatgcaggtgaagcatttgtggttcgaagtgtcgccaacttgattccaccttttggagaggaaggcttccctggcactagtgcagctctagagtacggtgttctccatctcaaggtggaacatatctttgttgttggacacagcatgtgtggaggaatcaaagctctcatgtcaattccagatgatgcacctaaatccacattgttcatcgaaga

SEQ ID NO: 2208 - DNA, 679 bp, Artificial
  Synthetic
ggtgaagtctgtggggaagaaatctagggttagaaggccgtgcgccaggaagcggcccaagggtagttagaaccagcacttcgcggcgcaccactgacgagttcttcgcgacttttttggtagcgtattggaatttggggcgattctagttctggcaatggcggcaacgcccagtggcctccagaccagggtcgggaagtatgagctgggaaagacgattggcgagggcaatttcgccaaggttcggcgagccaggaatctcgacactggcgagatcgtggcgatcaaggtcctcaacaaagaggaggtgatgaagcacaaaatggtcgagcagctcaagcgggagatttcgaccatgaagctagtaaagcatccaaacattgtccagctccacgaggttctggccagcaaaactaaagtttacatcgttttagagtacgtcactggtggagaactttttgacaagatcgtgaaacaaacccgcttgaaagaagacgaggcaaggaagtatttccagcagctcatcaatgcagttgactattgccacagcaggggtgtgtatcaccgcgacttgaagccggagaatttgcttctcgataaaaatggaaacttgaagatctctgacttcggtttgagtgcgcttccgcaacatcttcggccggatggtctacttcacact

SEQ ID NO: 2209 - DNA, 699 bp, Artificial
  Synthetic
tttgaagagatgagcttccaaagcaaagtgatgagaactcgcgtcgggaagtacgagctgggaagaactcttggagaggggacgttggcaaagttaagtatgccaggaactttgagagcaacgagagttttgcgatcaagattctggacaaggagaagatcttgaagcacaagatggtcgagcagatcaagcgagaaatctccaccatgaagctggtgaaacatcccaacatcatccagctctttgaggtcataggcagcaaaacaaaaatttatatggtgatggagtatgtcacaggtggagaaatgtttgacaaaattgcacgcgagggaaagctagatgaacataaagctcgaaagtatttccagcaattgattgatgccgtggattattgtcacagcagaggtgtttgtcaccgtgacttaaagccggagaatttgctcttggattcagatggaaatctgaaaatctcggacttcggattgagtgctcttcctgagcagtgccgaaaagacggccttcttcatacaacttgtggaacaccgaattatgtagcacccgaggtcgtcagtgacaaaggctacgacggtttcaaagcggatatctggtcttgcggcatcgtcttgtacgttatcctggctggatatttgccatttgacgagcctaatctggttgcattgtacaaaaagatgcatcgag

SEQ ID NO: 2210 - DNA, 688 bp, Artificial
  Synthetic
  misc_feature (560)..(560): The residue at this position can be any nucleotide.
gggccaaacgggctttttctctctctctccgcattttcgaagaactctgcttcttcaacacagggcttggcctctccttctctctcctccgccatccaaggaccccttcctgtacaagtgaagcgatggcggacggggcagaaacagacaagaacattgagatatggaagatcaagaagctgataaaggctctggagtctgcccgtggcaatggtaccagcatgatctctctcatcatgccccctcgtgaccagatctcccgtgtggctaagatgctcggcgatgagtatggtactgcctccaacatcaagagcagggtcaacagacaatcggtattgggtgccatcacctctgcccaacaacgtctcaagctctacaacaaggtccccccgaacggtcttgtcctctacacaggtacgattgttacagacgacggcaaggagaagaaggttacaatcgacttcgagcccttcaaacccatcaacgcatctctctatctttgcgacaacaagttccacacggaggccctcaatgcgctcctagagtcggacgagaagttngggttcattgttatggacggaaatggaacactttttggaaccttgagtggtaacacccgtgaggtcctccacaagttcacggtcgatctaccaaagaagcacgggagaggagggcaatctgcgcttcg

SEQ ID NO: 2211 - DNA, 654 bp, Artificial
  Synthetic
cttttttctctctcgcgttcttctctaaggtatgttccaaaggtctgtatacaatgtcggatggtcaggagagtgataagaacattgaaatatggaagataaaaaaacttatcaaggcactggaagctgctagaggtaatggcaccagcatgatttcacttatcatgcctccacgtgatcaggtatctcgtgttaccaagatgcttggagatgaatttggaactgcatcaaacattaagagcagagtgaatcggcaatctgtgcttggtgcaatcacatctgctcagcagaggcttaaactctacaacaaggtaccgccgaatggacttgtcctttacactggaacaattgtgactgatgatgggaaagagaagaaggtgacaattgattttgagcccttcaagcccataaatgcatcactctatctttgtgataataagttccacacagaagctttgaatgaacttttggaatctgatgacaaatttggatttatagtaatggacgggaatggtactctttttgggacattgagtggaaacacccgagaggtccttcataagtttagcgttgatttacccaaaaagcacggaagaggaggacaatcagccttgcgtttcgctcgtctccgaatggagaaacggcacaactatg

SEQ ID NO: 2212 - DNA, 590 bp, Artificial
  Synthetic
cgcacacgaacatcacctcaggcgctcgctcgccgcgccgcggcgcccggccatctcgctcgttcacgcaggcgaagagagctgtaaacactagccaagatgggcgagggacatgaaaccgacaagaacattgaagtatggaaggtcaagaaattgatcaaggcacttgatgctgccaggggcaacggaacgagcatgatttcgcttatcatgccacctcgtgatcaggtctcccgagtcaccaagatgctgggtgatgagtatggaactgcctctaacatcaagagcagagtcaaccgtcagtccgtgttggccgccataacttctgcccaacagaggctgaagctgtatagtcgagttcccgcgaatggattagtgctctatactgggaccattgtcaccgatgacggcaaagagaagaaggtcaccttcgactttgagccgttcaggccgattaacgcttcgctgtatctgtgtgacaacaagttccacacagaggcactgaatgagcttctggagtctgatgacaagtttggtttcataatcatggatggcaacggaacactgtatggtacacttagtggcaacag

SEQ ID NO: 2213 - DNA, 646 bp, Artificial
  Synthetic
gaattcagagagagttttcctcctcctctttctctctttactttcagttcttcttcatccaagaaggagaagaagaaagcttagacaggttagtgttcttcgtgcttggatatatttcaaatctcttgcaatgtcagacagtcaggatactgataagaatatcgagatatggaagatcaagaaattgaataaagcgctagaagctgctagaggtaatggtaccagcatgatttctctcatcatgccaccacgagatcaggttgctcgggtcactaagatgttgggtgatgaatttggtactgcctcaaacatcaagagtagagttaaccgtcagtcagtattgggtgcgattacctctgctcaacagagattgaaactttacaataaggtccctccaaatggtttagttttgtacacaggaactatcatgacagatgatgggaaggagaagaaggttacaattgattttgagcctttcaaggcaattaatgcatcattgtacctttgtaataataagtttcatacggaggctctaaatgaacttttggaatctgatgacaagtttggtttcatagtcatggatggaaatggtacactttttgggacactaagtgggaacacacgtgaagtgcttcataagttcaca

SEQ ID NO: 2214 - DNA, 722 bp, Artificial
  Synthetic
cgcgtcgcgaataacaaggatgtggcagaagaatatggtactgcgtccaatattaagagcagagtaaatcgtcagtccgtccttggtgcaataacgtccgcccagcagaggcttaagctgtataataaggtacctcctaatgggttggtcctttatactggaactataatgaccgacgatgggaaggaaaagaaggtaacctttgaccttacaccttttaagccaataaatgcgtctctgtacctatgtgacaacaagtttcacacggagcctctgggcgagctgttggaatcagatgagaagtttggtttcattgtcatggacggtaatggcactcttttcggaaccttaagtggcaacactagggaagtccttcataaattcactgttgaccttcccaagaagcacggaagaggaggtcaatcagctttgcgatttgctcgtcttcgaatggaaaaacggcataactatgtgaggaagacagcagagcttgctactcaattcttcattaatccagccactagccagccaaatgtatctggactaatacttgctgggtcagctgatttcaagacagagctgagccagtctgatatgtttgatcaacgcctacaaacaaagatacttaatgtggttgatgtgtcctatggtggggaaaatggattcaatcaggctattgagctatctgctgagattctcgcgaatgtgaagttatacaagaa

SEQ ID NO: 2215 - DNA, 342 bp, Artificial
  Synthetic
cctctcccattcgtggattggctcttggagaagaagggtttcgaggtttcttggccagtctatattctggcaagcggttgtgaaggtgggcattgctgtctctgaagggtctttacatcatcatcagggtaggtaacaatgtcaggagcagggcaacgtctaaatgtagtcccgacagtaacagttctaggtgtgattaaaactcgtttggtgggtgcaacgaaggggcatcagctactaaagaagaagagcgatgcattaacagtacagttccgtcaaatcctaaggcacatcgtacagactacagaggccatgggggactctatgaaagccgctgctttt

SEQ ID NO: 2216 - DNA, 723 bp, Artificial
  Synthetic
gaattccgaattcagtcattttctcgctcgctctcttgtttcgtaaaaattttctatcttgaattaagatctggggatggcgggacaaaatcaaagattaacagtagtaccaacagtcacaatgcttggagtaatgaaagcacgtttaataggagcaacaagaggtcatgctttacttaagaagaaatctgatgcattaactgttcaatttcgtcagatcttaaaaaacattgtttcagctaaagaatcaatgggtgatattatgaaaacttcatcatttgctttgactgaagctaaatatgtagctggtgagaatattaaacatactgttcttgaaaatgttcataacgcttcgttaaaggtgagatcgcgtactgagaatgttgctggagttaaattacccaagtttgagtatttcactgaaggtgaaactaagaatgatttgactggattagcacgaggtggacaacaggtgcaactttgtaaggctgcttatgtcaaagcaattgaagttcttgttgaacttgcttcgcttcaaacgtcttttttgactcttgatgaagcaattaagactactaatcgccgtgttaatgctctagagaatgttgtgaagcctaggattgagaatactattagttatatcaagggtgaattggatgaacttgaaagagaggatttctttaggttgaagaagattcaagggtataaaaggagagagatgga

SEQ ID NO: 2217 - DNA, 1016 bp, Artificial
  Synthetic
aaatcctcgcgatctttctctcccttaccgacgaatacgacttctaaagtagcttggcataatgtccggccaaagccagcgtttgaatgtcgttcctacagtaacaatgcttggtgtgatcaaagctcgccttgttggtgctacaagaggccatgctctgcttaagaagaagagtgatgctttgactgtgcagttccgtcagattctaaaggacatcgtgtcaacgaaggaatcaatgggagatgtcatgaaaacttcctccttcgctctgacagaggcaaaatatgcttctggcgagaacattaagcatgttgtccttgaaaatgtccagaatgcaaccattaaagttagatctcgccaagacaatattgcaggtgtaaagctcccgaaatttgagcatttctctgaaggagagacaaagaatgacctgactggattagctagaggggggcaacaggtgcaagcttgccgtgctgcttacgtgaaatctattgagttgcttgttgagcttgcctctctacagacatcattcttgacgcttgatgaggcgatcaagaccacaaatcggagggttaatgcattggagaatgttgtgaagccacggttggagaacacagtgctttacatcaaaggagaacttgatgaactggaaagggaagatttctttcgtctaaagaagatacaaggttacaagaagagggaggtagagagacagatgctggcttccaagcaatacgcagaggagaaggctgcagaagaaatttccttgaagagaggtatttcgctaggtacagcccataacttgctatcccatgcttcacagaaagacgaggacattattttctgataaggaggtcaaatgatttatttaaattgcattgcgtggcttgtttttatgtgtcctttattacgaatggataattgattagatggagagtcttttcgcatttaataagagctctatgcatgtttgtatttaaagttaatttatagacaatatgggtggttacctctta

SEQ ID NO: 2218 - DNA, 677 bp, Artificial
  Synthetic
aaagaggaggagagagatccggcgatgtcggggcagcagcagcgcctcaatgtggtgccgacggtcacggtgttgggcgcgatcaaggcgcggctgatcggcgccacgaaaggtcaccagctcctcaagaagaagagcgatgccctgacgatgcagttccggcagatcctcaagcgcatcgtccagaccaaggaagcgatgggcgacaccatgaagtcggcatcgttcgccctcacagaggtaaagtatacagccggcgacagcatcaagcacatagttctagagaatgtggacgtggcgacgatcaaggtacgagcaaagcaagacaatgtagccggtgtcaagcttccaaaattcgagcactacgtcgaggccgtggagacgaagaacgatctaaccggcttggccagaggtggccgacaggtccagctctgtaagtcgtcgttcatcaaggcggtggagctgctggtggagctggcgtcgctgcagacatctttcctgacgctggacgaggcgatcaagacgaccaaccggagagtgaacgctctggagaacgtcgtcaagccgaggatcgagaacaccattctctacatcaagggcgagctggacgagctcgagagagaagagttcttccggctgaagaagatccagggattcaagaagaaggaggtcgagag

SEQ ID NO: 2219 - DNA, 688 bp, Artificial
  Synthetic
  misc_feature (153)..(153): The residue at this position can be any nucleotide.
gttcttggcacagttgacccaactctcttcttctgccgagtttatctaatcaatctcctcctgatctccttcttctccgtgcgaaatctacttagtagtttagcaaaatgtccgggcaaagtcagcgtttgaatgttgtacccacagttccangttgggggtattaaagctcgccttgttggagcaacaagaggccatgctttgctgaaaaagaaaagtgatgctttgactgtgcaattccgtcagattctaaagaatatagtgtcaacaaaggaatcaatgggagaagtcatgaaagactcctcctttgctctgactgaggcaaaatatgctgctggtgagaacatcaagcacgttgtccttgaaaatgtccagaatgcaactcttaaagttcgatctcggcaggaaaatattgctggggtgaagcttcccaagtttgaacatttctctgaaggggagaccaagaatgacctgactggattagctagaggtgggcaacaggtacaagcctgtcgtgctgcttatgtgaaatctattgagttacttgttgagcttgcatcgctgcaaacatcattcttgactcttgatgaggcaatcaagaccacaaatcggagggtcaatgccttggagaatgttgtaaagcctcggctggagaatacagttctttacatcaagggggaacttgatg

SEQ ID NO: 2220 - DNA, 281 bp, Artificial
  Synthetic
cttacactctaatttcagtgatttacttgttaataactcaccttttgagaggcccagtggtgatatatggctggccaaaatgcgcgtcagaatgtggttcccactgttactatgctcgaggttatgaaagctcgtcttggtggcgctacaagaggccatgctctcctcaagaaaaagagagatgctttaactgttcaggttagggcacttctcaagaaaatcgacacagctaaggagtctatgggagatatgatgaagacatcgtcttttgctcttaccga

SEQ ID NO: 2221 - DNA, 704 bp, Artificial
  Synthetic
tctcctctcccattcgtggattggctcttggagaagaagggtttcgaggtttcttggccagtctatattctggcaagcggttgtgaaggtgggcattgctgtctctgaagggtctttacatcatcatcagggtaggtaacaatgtcaggagcagggcaacgtctaaatgtagtcccgacagtaacagttctaggtgtgattaaaactcgtttggtgggtgcaacgaaggggcatcagctactaaagaagaagagcgatgcattaacagtacagttccgtcaaatcctaaggcacatcgtacagactaaagaggccatgggggactctatgaaagccgctgcttttgccctcacagaggccaaatacaccgctggcgacaacatcaaacacgttgtccttgaaaatgttgactccgccacagtcaaagtccggtcaaagcaggacaacgtggcaggagtcaaacttccccgttttgagttcgtgacagaggcaggggagtcaaagaatgatttgactggtcttgctcgaggaggtcagcagatccacctctgtaaatcggcgtttatcaaatcagttgaggttcttgttgagttggcctctctgcagacatcgtttcttacccttgatgtggccattaagaccactaaccggagggtcaacgctttagagaatgtggtcaaacccaagttggagaacaccataag

SEQ ID NO: 2222 - DNA, 789 bp, Artificial
  Synthetic
gggaaccccgacagatagcgcgtttcgcgcgtactccgaaagggaatcgggttaaaattcctgaaccgggacgtggcggttgacggcaacgttaggaagtccggagacgtcggcgggggcctcgggaagagttatcttttctgtttaacagcctgcccaccctggaaacgactcagtcggaggtagggtccagcggctggaagagcaccgcacgtcgcgtggtgtccggtgcgcccccggcggcccttgaaaatccggaggaccgagtgccgtccacgcccggtcgtactcataaccgcatcaggtctccaaggtgaacagcctctggtcgatggaacaatgtaggcaagggaagtcggcaaaatggatccgtaacttcgggaaaaggattggctctgagggctgggcacgggggtcccattcccgaacccgtcggctgtcggtggactgctcgagctgctcccgcggcgagagcgggtcgccgcgtgccggccgggggacggactgggaacggttccttcgggggccttccccgggcgtcgaacagccaactcagaactggtacggacaaggggaatccgactgtttaattaaaacaaagcattgcgatggtccctgcggatgtttacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccc

SEQ ID NO: 2223 - DNA, 661 bp, Artificial
  Synthetic
catttcttttttttggtacgaggaacttatcatgaatccgctgatttctgccgcttccgttattgctgctggattggccgtagggcttgcttctattggacccggagttggtcaagggactgctgcgggtcaagctgtagagggtatcgcgagacagcctgaggcagagggaaaaatacgaggtacgctattgcttagtctagcttttatggaagctttaacaatttatggactggttgtagcattagcacttttatttgcgaatccttttgtttaatcttagcttagaaatatgaaaaataaatacatttttcatattttattgccttcgacttgtcgtttgctttttcaaattctatcaagatttccctcctccaattctttattatttgagaaaagaacctacgggaagggctgatttgcggatgaggaattagcatactgactcgctttcatccttcccgttcatagaccaagggaaactctttttagtaagtgttagtgttccaataaccaataaaagggctagttcattataatttataactaactcgaatattttttcttttttgactcaatttcataaaaaataaaagaataaataaaaagaggggtgaagtgctacaaaaagaactctgttcgattttttagtctatctata

SEQ ID NO: 2224 - DNA, 1275 bp, Artificial
  Synthetic
gaattcaacatatgtatatgtgatattagatattggctaggggggtatgaactatccatagatcttatttcctttacgatcccactatgaatttagatgaggattccaatagaagtccttccatttcgtctgtgacgaatgaataaacacatgaaaccaagagcatatagaagagaaaaataacgaagaattgaaaggatgctttggaactaaaaaatggaagaacttgggcctatggattgataattgataaagactcgatggatgggaacgaaaaacgagaaatcgaagtagttctgacgattcaataatataattacttcaattggatatatcttagtaatggaatcataaggcattatttattggttttgattgtatcattaaccatttatttattttggtgcgaggagcttaccatgaatccactgatttctgccgcttccgttattgctgctggattggccgtagggcttgcttctattggacccggagttggtcaaggtactgctgcgggacaagccgtagaaggtattgcgagacaaccagaggcagagggtaaaatacgaggtactttattgctgagtctggcttttatggaagctttaacaatttatgggttggttgtggcattagcacttttatttgcaaatccttttgtttaatcctaagaatagaaagtttttttctaaattttattgccctggatttcccacctgcttttttgaattctatcaagattttactcctacaatcactttttgattgagacaatatccgtgggaaggactgatttgaggatgaggaattagcagacctactcgctttcttccttcccgttcttagtccaacgaaacccttttttttagaaagcgttgcaaaagatgaggtatttcacgactgacatgagatctggacctaattctaataagtgtgtttctgagtaggaacttcaattgaaatatcaaaaaaatttcaaaatggaaaaaaataataaatcaaacaataaaaaaaggacgaattgatacaaactctgtttgattttgttagtcctatctataagaggagatcatatgaaaaatgtaaccgattctttcgtttctttgggtcactggccatccgccgggagtttcgggtttaataccgatattttagcaacaaatctaataaatctaagtgtagtacttggtgtattgatcttttttggaaagggagtgttaagtgatttattagataatcgaaaacagaggatcttgagtactattcgaaattcag

SEQ ID NO: 2225 - DNA, 581 bp, Artificial
  Synthetic
aaccggtggaagcacattcggcttgttggtgaccattagagaggggacaagcatgtcttcgacagggacagagacagaaacactacagaaagggttgcgtttgggtttaaagagagcccctagtgaaaagcctccattcaccttattgcagctcaagaaggcagtcccagctcactgtttccagcgctcgctgctacgctctggatcctatctggcctttgatttactcattgcaggtgtccttttctacctaacccgattccttgtgggtgatattggggtattaggttgggtcctctggcctgcctattggattgcacaggggtgtatcctaaccggggtttgggtaattgcccatgaatgtggtcatcatgcctttagcgattatacctgggttgatgatctggttgggctagtccttcattcatggcttcttgtaccttatctttcatggaaatacagccacagaaggcatcatagtaatactggtagtattgatcgtgatgaggttttcgtcccaaagcttctcgaagacatccctcttactgccactcgactgatgaataaccccttgggaacaa

SEQ ID NO: 2226 - DNA, 629 bp, Artificial
  Synthetic
caacttcaaaacccacttttacacttggtgatataaaaagggccataccttctcactgctttcgtcgatctcttattcgctcattttcttatcttgttcaagatctcgtacttatctccatcttttactacattgccacttttttcgacctctctcctttcccttataattatattgcatggatttcttattggatcgtccaaggtttagctttttctgcaatatgggtcattgcccatgaatgtggccacaatgcgtttagtgattaccaatgggtaaatgacactattggtttaatcctccattctgcacttttagtcccatatttctcatggagaaatggacatcaccgtcatcactctaacactggttcccttgaacgtgacacttttttcgtgccaaagcttacatccgaactaaggtggtactataaatacttgtacaatccattaggacaagtagtcacacttgccttcataatcattcttggcgagcctttgcacatggcattcaatgtctacggcaaacccagtgatctctttgcatgtcattttgatccatatgctcctatgtataatgaccgtgagagaaaacaaatttacatttctaatgcaggtctgattgcagct

SEQ ID NO: 2227 - DNA, 940 bp, Artificial
  Synthetic
gaattcatacttgtgtgtgtgtttcttctctctgagccctcccttcatctttgggagtttggatctcgtatccaataatggcgagttggttctcaccaaaatatggtcttagatccattcttcgtcttcccagaaccttgttctcctcagcttcagcaaacagagtgcacaagaacaatgaatatgcaaagataaatgaggttcaaaatgaagcggaggatgatgggtttaatccaggtgcaccacctccatttaagattgctgagatccgtaatgccattcctaaacactgttggatcaagaatccatggaggtccatgagttatgttctcagagatattcttgtggttgctgcattagctgcttctgctgagtattttaataactgggttttctggattttctattgggctgctcaaggaaccatgttctgggctatctttgttcttggccatgactgcggccatgggagcttttcaaacagtcagaaacttaacagtattgttggacatcttcttcattccttcattcttgtaccttacaatggatggagaatcagtcatagaactcatcaccagaatcatggacacgctgagaatgatgaatcatggcacccgttgcctgagaaggtttacagaaacatggatgatactagtcgaagccttcgattcaccgttccgttccccatgtttgcatacccaatttatctgtggcgcagaagtcccggaaagaagggttctcatttcgacccaaacagtgatttgtttgcaccaaatgagaggagttgtgtggttatctctaccctttgctggatgacaatggctgcatcacttgtagtatgttcttgtatagtaggtccaatccgagtcatcaagttatacggcattccatattggatctttgtaatgtggttggatatggttacctacttgcatcacca

SEQ ID NO: 2228 - DNA, 546 bp, Artificial
  Synthetic
gacccacgctcggggcgccgccgccgttcgggctcgcggagatccgcgcggccatccccaagcactgctgggtgaaggacccctggaggtccatgagctacgtgctgcgcgacgtcgtcgtggtgctcggcctcgccgccgccgccgcgcgcgtcgacagctggctcgtctggccgctctactgggccgcgcagggcaccatgttctgggcgctcttcgtgctgggtcacgactgtggccatgggagcttctcaagcaacgccaagttgaacagcgtggttggacacatactccactcctccatccttgtcccataccacggctggaggattagccacaggacgcaccaccagaaccacggtcatgtcgagaaagacgagtcctggcaaccgctgtctgagaggctgtacaatagcctggactatatgacgaagaaattgaggttcaccatgccgtttcccatgctggcattcccattatacttgtttgcaaggagtccagggaaaaaaggttcacacttcaacccaagcagtgatctgttccaac

SEQ ID NO: 2229 - DNA, 841 bp, Artificial
  Synthetic
cagaccactcgtttcctccacaaagagggagggaacaagggaagggtgtcgcccgccccccaccccgatctgcctccgccgctccgctcctccgcgcctgcgaaatctaccaacgctaactcagcaagatgggtgccggcggcaggatgacggagaaggagcgggaggagcagcagaagctgctcggccgcgccggcaatggcgcggccgtgcagcggtcgccgacggacaagccgccgttcacgctggggcagatcaagaaggccatcccgcctcactgcttccagcgctcggtgatcaagtccttctcctacgtggtccatgacctcgtgatcgtcgccgcgctgctctacttcgcgctggtcatgatccccgtgctgccgagcgggatggagttcgcggcatggccgctctactggatcgcgcagggctgcgtgctcaccggcgtgtgggtcatcgcgcacgagtgcggccaccatgccttctccgactactcggtgctcgacgacatcgtcggcctcgtgctgcactcgtcgctgctcgtcccctacttctcgtggaagtacagccaccggcgccaccactccaacaccgggtcgctggagcgcgacgaggtgttcgtcccgaagcagaagtcggcgatggcgtggtacaccccgtacgtgtaccacaacccgatcggccggctggtgcacatcttcgtgcagctcaccctcgggtggccgctgtacctggcgttcaacgtgtccggccgcccgtacccgcgcttcgcgtgccacttcgacccctacggcccgatctacaacgaccgggagcgcgtccagatcttcatctccgacgt

SEQ ID NO: 2230 - DNA, 616 bp, Artificial
  Synthetic
cccccccttttttgttcgtgtggggtttccgtattattgcattataatattgctcaaattgcaccttctgatcccactacaatattgcaatcgattctcctttctcatcacctgcgattgtgattgttgttgtaagcagcaagatgggtgccggcggcaggatgacggagaaggagcgggaggagcagcagaagctgctcggccgcgccggcaatggcgcggccgtgcagcggtcgccgacggacaagccgccgttcacgctggggcagatcaagaaggccatcccgcctcactgcttccagcgctcggtgatcaagtccttctcctacgtggtccatgacctcgtgatcgtcgccgcgctgctctacttcgcgctggtcatgatccccgtgctgccgagcgggatggagttcgcggcatggccgctctactggatcgcgcagggctgcgtgctcaccggcgtgtgggtcatcgcgcacgagtgcggccaccatgccttctccgactactcggtgctcgacgacatcgtcggcctcgtgctgcactcgtcgctgctcgtcccctacttctcgtggaagtacagccaccggcgccaccactccaacaccgggtcgct

SEQ ID NO: 2231 - DNA, 811 bp, Artificial
  Synthetic
ctacccctcgaccagcgtccggaaagctccaatccattggagcctctcaacaaataacatttacatagggagagaattggaacaatttaaggaagaaagagttaagctgtgtcaggttactgaacaatgggtgctggaggtcgaatgtcggttccatctgagggcaagaagtcccagtctgatgtcttccaaagagtaccccattcgaaaccacccttcactgttggcgagatcaagaaagccatcccaccccattgtttcaagcgatctgtcctacactctttctcctatgttgtttatgaccttacaatagcctttctcctctactatgccgcgaccaactatttccatctcctgccttacaatctttcctacatagcttggctgctttactggatctgccaaggctgtaatctaacaggagtttgggtcattgcccatgaatgtggtcaccatgccttcagtgactatcaatggcttgatgatactgttggccttgtcctacattctactctccttgtcccctatttctcttggaaatacagtcatcgtcgccaccattctaatacaggttctatggatcgcgatgaagtatttgtaccaaaggtgaagtcgcgtattagttggttctccacttatcttaacaatccaccgggcagaatccttatacttcttgtccagctcactctaggctggcctctatacttgatgttcaatgtttcaggccgaccctatgaccggttcgcctgccactttgatccgaatagccctatctacacagaccgtgagcgccttcagatctttgtttctg

SEQ ID NO: 2232 - DNA, 649 bp, Artificial
  Synthetic
atggggtctcttggattgaattctaaaaagggaaatgaagaaatggaattggaatttgatccaagtgcaccacctccatttaaattatctgaaattcgagctgctattcctaagcactgttgggttaaaaatccatggaaatctctaagttatgttcttagagattttactattgttgttgcatttgtatccatagccatttatttggacagttggaaattttggccactttattgggttgttcaaggtactatgttttgggcaatctttgttcttggacatgactgtggacatggaagcttttcaggtagtgcatttctgaatagtgtggttggacatattcttcattcttctatccttgtaccctatcatggatggagaatcagccataaaactcaccatcaaaaccatggaaatgttgaagctgacgaatcttgggtgcctatgccagaaaagctatataaagaactggattttgctaccaaattttttagattcaagattccttttcccttattagcataccctatgtacttgataagcagaagtccagggaaaaaaggttctcattttaatccatacagtgatttgtttcaacctaatgagagaaaatatgccataacatcaacattatgctggacaataatgg

SEQ ID NO: 2233 - DNA, 638 bp, Artificial
  Synthetic
tctaaaccgccccccttcacaatagcagaaatccgggcggccattcctaagcattgctgggtcaaggattcatggcgttccttgagctttgtttttcgagacattgccattgtagctctcctggctgtcgttgctgcctgctttgatagttggatactctggcccctctattggttctcgcaagggaccatgttttgggccctctttgttctcggccatgactgtggccatggaagtttctctaatagtaagaagcttaatgacttcgttggtcatttaacccacacgtttattttggttcccttccatggatggagaataagccacagaactcatcaccagaatcatggccatgctgaaaatgatgaatcctggcatccgcttaatgagagcacctaccgagaattggatcccttctctatgttcggcagattcactcccctgtctacgctggtgtatcctctgtatttgtggagaagaagccctggaaaatcgggatctcactttgacccagatagcccattgttcctcccatcagagcggaaggatgtcatcacctctactacatgctggtttgcgatgcttgccatccttattggatttagtattattgtgggtccattatggatgttgaagct

SEQ ID NO: 2234 - DNA, 640 bp, Artificial
  Synthetic
aaatacccaaaaaaataattagcctcttctctttccttaatagaaagagagagagagtgtgggggtgaaggctaaaggtaaggaggttcgggattgaagaggtaaaaggaagcgaaaatgggagctggtggtaatatgtctcttgtaaccagcaagactggcgaaaagaagaatcctcttgaaaaggtaccaacctcaaagcctcctttcacagttggtgatatcaagaaggccatcccacctcactgctttcagcggtctctcgttcgttcgttctcctatgttgtgtatgaccttttactggtgtccgtcttctactacattgccaccacttacttccacctcctcccgtccccatattgctaccttgcatggcctatttactggatttgtcagggttgtgtttgcactggtatttgggttattgcgcacgaatgtggccaccatgcctttagtgactaccagtgggttgatgacactgtcgggcttatcctccactctgctctgatggtgccctacttctcttggaaatatagtcatcgtcgccaccactccaacactggctcactcgagcgcgatgaggtttttgtgcctaagccgaaatcacaactcggatggtattccaagtacttgaacaatc

SEQ ID NO: 2235 - DNA, 674 bp, Artificial
  Synthetic
gagtcaccgtccataagcaaagcccgaggcagaaatgcgcgagtgacgaggcagtgaacggaatctattcaattgacagcaacatccaacaaatttcaaaatctgtccctatcgtttcagttttggccacatctgctgcaccattagcactagttccgtgtgagattctcatttccccctatttctttcctctcctctagaatcaaccaagttactctcctaacaaatggcggattggggaccagtgttaatagcggtggtgctgttcgtgctgttatcaccagggctgctgttccagttacccggccgtggaaaagtggtggagttcggtggtatgcaaacgagcggtgtagccattttggtccacaccgtcatttacttcggccttatcaccatcctcctcattgccgttggcgtccatgtctacaccggctaagtataccccaacttcacttgactaagctctactataagtgtctgctcggatcagaaatttttattttgttgttctctaattaaggtgtactttttctttgttcaagaattgttaaagtatggtgatggttcatcgatatttgctttttaattttcaaatttgctaagcagattatactagtaaagataatctggttgttgattttcttcgattagttgtatatggggtattttgcgtt

SEQ ID NO: 2236 - DNA, 612 bp, Artificial
  Synthetic
ccccccccccgggcatgttggaagaagcccttgagatagcaacagactctaattacagatttgacttggccgtgcagcttggtcggcttgaagttgcaaaggcaattgccattgaggcacaaagtgagtccaagtggaggcagttaggagagttagctatgtcaaccggaaagcttgatatggcagaggagtgtcttctacatgctatggacctcagtggtttattacttctgtattcatcccttggtgatgctgaagggctaacaaaattaacatctatggctaaagaacaagggaagaacaatgttgctttcctttgtttcttcatgctaggaaaacttgaagaatgccttcagttgttaatcgaaagtaatcgtataccagaagcagcattgatgtcgagatcttatcttccgagcaaagtccctgagattgtaacattatggaaaaaggatctccaaaaggtaaaccccaaagcagcagaatcattggcagatcctgacgagtacccaaacttgtttgaagactggcaaattgctctcaatgtagaagctaatgtcgcgcccaaaaggggtatttatccaccagctgaggagtacattatccatgctg

SEQ ID NO: 2237 - DNA, 630 bp, Artificial
  Synthetic
ccccccttgctaaccaaagccgtgtctatcttattgacaagcaatttaatgttgtgggggatactttactccttaccatgattgagtataaaacacttgtaatgcgtggagacttcgatcgtgcaaacgctcttttaccatctataccaaaagaacaacatgacagggtggcacgtttcttggaatcacagggcatgttggaagaagcccttgagatagcaacagactctaattacagatttgacttggccgtgcagcttggtcggcttgaagttgcaaaggcaattgccattgaggcacaaagtgagtccaagtggaggcagttaggagagttagctatgtcaaccggaaagcttgatatggcagaggagtgtcttctacatgctatggacctcagtggtttattacttctgtattcatcccttggtgatgctgaagggctaacaaaattaacatctatggctaaagaacaagggaagaacaatgttgctttcctttgtttcttcatgctaggaaaacttgaagaatgccttcagttgttaatcgaaagtaatcgtataccagaagcagcattgatgtcgagatcttatcttccgagcaaagtccctgagattgtaacattatggaaaa

SEQ ID NO: 2238 - DNA, 559 bp, Artificial
  Synthetic
gccattacggccgggggaggcaaggctccaaggaagcaggttgcaacaaaggctgcccgtaagtctgccccaacaacaggaggagttaagaagcctcacagatacagacctggaaccgttgctcttcgtgaaattcgcaagtaccagaggagtactgagctgttgatcaggaaattgccattccaaaggcttgttcgtgaaattgcacaggacttcaagactgatttgcgtttccagagtcacgctgtattggctttgcaagaagcagctgaggcctaccttgttggattgtttgaggacacaaatctgtgcgccattcacgccaagcgtgtcactatcatgcccaaggatatccagttggcccgaagaattaggggagaaagagcttagaatgatctgttctgccgtatcgtgcttagattgttgattttttttttgaattgccgtctttctgcatttttcttcttctttgttcttcatataggtagtttttactagatatgaatggctgtggcatactggaaatttgatactctctattatatagtcgaattttatt

SEQ ID NO: 2239 - DNA, 689 bp, Artificial
  Synthetic
cccacgcgtccgtcttcttcttcctcctcctcgcgctcccccgattcgaagcgtgaagagaggagcggcgcttgcgagaggagagagatggcccgtaccaagcagaccgctcgtaagtccacaggaggaaaggctcccaggaagcagcttgcaaccaaggctgctcgtaagtctgctcccaccactggaggagttaagaagccccaccgttaccgccctggaactgttgccctccgtgagattcgcaagtaccagaagagtactgagcttttgatcaggaagctgcccttccagaggcttgttagggaaattgcacaggacttcaagaccgatctgcgtttccagagccatgctgtccttgccctccaggaggctgcggaggcataccttgttggtctcttcgaggacaccaacctgtgcgctattcatgccaagcgtgtgaccatcatgcctaaggacattcagctggctaggaggattcgtggtgagagggcttaaattcccctcggcgactcctttgacaaatgaagcatgcgtcgtagtgttagtagtgggtttaatcttttgcttataagaacaatctgagtagggtgtattttgtggaacaatatgtttctctctgtgacatgatggtgctgtattcgtcttattggtggatctgtcaaaaatactcacaatattgtcagtgt

SEQ ID NO: 2240 - DNA, 712 bp, Artificial
  Synthetic
acaaatacaaaaagagagaagaagaagaagatttcataggaaatggctcgtaccaagcaaactgctcgtaagtctacaggaggaaaagctccaaggaagcaacttgctactaaggctgcacgcaagtctgctcctaccactggtggtgtgaagaagccacatagataccgccctggtactgttgctcttcgtgaaatccgtaagtaccagaagagtactgagctcttgatcaggaagcttcctttccagaggcttgtgcgtgaaattgcccaggactttaagactgatctgcgtttccagagtcatgcagtgctggctctgcaggaggctgctgaggcctatctggtgggtctctttgaggacactaacctttgtgccattcacgccaagcgtgtgacaattatgcctaaggacattcagcttgccaggcgaatcaggggcgagcgtgcttaatttgatctactagcttgtagcgttggtgtgatccttgtctttcttttctttgtaagacgtaaagacagtaactaaatctagtagtagggcttgttgcttttaatttgctggtggctggtggtgtgctgtaatttcttggtgttttcttttggagaagggggaaaacatgctattttgtttggatctctaatgttttgttgtcacactactggtgtcgaacaatgttttcatctagtgattagttgaagttattgtcgat

SEQ ID NO: 2241 - DNA, 538 bp, Artificial
  Synthetic
gcggacgcgtgggggcgcgtaccaagcagaccgctcgcaaatccacgggaggcaaggcgcccaggaagcagctcgcaaccaaggctgccaggaaatccgctcccaccaccggaggagtgaagaagccccatcgctaccgcccaggaacagtcgctcttcgtgaaattcgcaagtaccagaagagcactgagctcctcatccgaaagcttcccttccagaggcttgttcgcgagatcgctcaggacttcaagaccgatttgaggttccagagccatgcggtgctggccctccaggaggcggcggaggcgtacctggtgggactgttcgaggacaccaatctgtgcgcgattcatgccaagagggtgaccatcatgcccaaggacatccaattggctcgccggatccgtggagagagggcttaagagattcatcaatcttaagaaaactagcttcaccaatgtagatactactactactactactaatccctctgtttgatttgatttcagtgcaaatgcaaagtcttctggttgtttgt

SEQ ID NO: 2242 - DNA, 577 bp, Artificial
  Synthetic
cccacgcgtccgcaactttctctcatcttcaaattaaaatcaaacagtttcttaataacattttacctcatggctcgtaccaagcagacggctaggaaatcaaccggaggaaaggctccaaggaagcagctggcgacaaaagcggcgaggaaatctgctccggccaccggaggagtgaagaagccacacagattcagacccggaactgttgctttaagagaaatcaggaagtaccagaagagcactgagcttcttatccgtaaactccctttccagaggcttgtcagagagatcgctcaggacttcaaaaccgatcttcgtttccagagcagtgccgtcgccgctcttcaggaagctgctgaagcttacctcgtcggactcttcgaagacaccaatctctgcgccattcacgccaagagggtcacgatcatgcccaaggacatccagctcgcgagaagaatcagaggagaacgagcttagatctaagtattctggttactcttgtgttttgattagaaccataagattgtaaaatttcaagttaaatccaagggttataatattaattccaagcaaa

SEQ ID NO: 2243 - DNA, 513 bp, Artificial
  Synthetic
attctctctctctagaaactgtactctttctttctctagaagatctgaagcaatggcaagaacaaagcaaacagcccgaaaatccacaggaggaaaggcaccaaggaagcaattagccacaaaagccgcaaggaaatcagcaccagcaacaggaggagtgaagaagcctcaccgtttccgccctggtacagtggctcttcgtgagatccgaaagtaccagaagagcactgagcttttaatccgaaaattaccttttcaaagactggtcagagaaattgcacaggatttcaagacggatcttaggttccagagcagtgctgtagctgcactacaagaagctgctgaggcttacttggtgggtctctttgaggatacaaatctgtgtgctattcacgctaaaagggtgactattatgcctaaggatattcagttggctaggcgtattaggggtgaaagggcttaatgtttcattgttgtgttttttgtgtttagggttatggtgaatgtggtatg

SEQ ID NO: 2244 - DNA, 582 bp, Artificial
  Synthetic
gttttttttttgaaaatgtggagggagttttcaaactttgctaaggaaggaaagattttgatccgttaaatatcgaacaacataaacgcaaaacctaatccaaccctaaaacacgaaattagggaaaacgaaagatatacataaccataacgatcacagtctaaagtacttcaatctccttcttaagccctctcgcctctaattctcctcgccaattgaatatccttaggcatgatagtgactctcttagcatgaatcgcgcaaagattggtgtcttcaaacaatccaacgaggtatgcttcagccgcttcctgaagtgctgcgacggcgctgctctggaaacgcaaatctgttttgaaatcctgagcgatctcacaaaccaaacgctggaacggaagcttggggatcaaaagctcagggctcttctgatacttcctgatttctcttagggcaacagttccaggacggaatctgtgtggcttctttactcctccggtcgccggagctgatttcctcgccgcctttgttgcgagttgtctccttggggcttttcctccggtggatttccttgcggtttgcttg

SEQ ID NO: 2245 - DNA, 1536 bp, Artificial
  Synthetic
gaactgatgtgagagatgtagaagttttgagtgagatttatatctctatcaatgacaattacgaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatggcagcatacaccagcaagatctttgccctgtttgccttaattgctctttctgcaagtgccactactgcaatcaccactatgcagtatttcccaccaacattagccatgggcaccatggatccgtgtaggcagtacatgatgcaaacgttgggcatgggtagctccacagccatgttcatgtcgcagccaatggcgctcctgcagcagcaatgttgcatgcagctacaaggcatgatgcctcagtgccactgtggcaccagttgccagatgatgcagagcatgcaacaagttatttgtgctggactcgggcagcagcagatgatgaagatggcgatgcagatgccatacatgtgcaacatggcccctgtcaacttccaactctcttcctgtggttgttgtgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttaattaagcatggagaaggcgatcaacaggcagagggtgcttctcgcccacctggagcccgccgcgagtcccgccgccgccgcgccggccatcaccgcgagcgcgtgcgccgcgggggacagcgccgcgtaccaccgcggggcgtgcttcgcagacgacgtcgtcatcgtcgctgcctataggacagcaatttgcaagtccaagagaggtggtttcaaggatactcccgcagaggacctcttggttccagtattcaaggctttgatagataaaacgaagttgaacccaagtgaagttggtgatattgttgttggtactgttttagctcctgggtcccaaagggcaattgaatgcagaatggctgcattttatgctggattccctgataccgttcctcttatgactgtaaacaggcaatgttcgtctgggcttcaagcagttgcaaatgttgcttctaacattaaagcaggactttatgacattggtattgctgctggcctagagtccatgacagtgaaccaagttcgccttgatgggcaagtgaaccccaaagttgagctgttttctcaagcacgcgattgccttctcccaat

SEQ ID NO: 2246 - DNA, 431 bp, Artificial
  Synthetic
agcataataacactgtagtgccaacaatggcagcatacaagatcttggccctctttgcgttacttgctctttctgcaagcgccgctactacaatcaccaccatgccatatctccaaccaacaatagcaatgggcaatatggatccgagtacgcagtacatgatgcaaacgacgggcacagatagctacgcaacaatgttcatgccacaaccaattgctctcctgcaacaatagtgttgcatgcagctacaaggcatgatgccacagtgccagtgtgggtatggtactagttgccagatgatacagaacatgcaatatgctatctgtggtggcacttggccaacaacaaatgatgatgaagatggcgatgcaacttccaaacatgtgtatcatggcccctgcctacttccagctctctccctatggttgttg

SEQ ID NO: 2247 - DNA, 556 bp, Artificial
  Synthetic
acaccatctggaatcttgtttaacactagtattgtagaatcagcaatggcagcatacaccagcaagatctttgccctgtttgccttaattgctctttctgcaagtgccactactgcaatcaccactatgcagtatttcccaccaacattagccatgggcaccatggatccgtgtaggcagtacatgatgcaaacgttgggcatgggtagctccacagccatgttcatgtcgcagccaatggcgctcctgcagcagcaatgttgcatgcagctacaaggcatgatgcctcagtgccactgtggcaccagttgccagatgatgcagagcatgcaacaagttatttgtgctggactcgggcagcagcagatgatgaagatggcgatgcagatgccatacatgtgcaacatggcccctgtcaacttccaactctcttcctgtggttgttgttgatcaaacgttggttacatgtactctagtaataaggtgttgcatactatcgtgtgcaaacactagaaataagaaccattgaataaaatatcaatcattttcagacttg

SEQ ID NO: 2248 - DNA, 727 bp, Artificial
  Synthetic
agatgagcgccgttaaagtaaatctataccagaatgcactcctttcaccgttctggaacatcaacgctcacatattcatggcatcagcttcagacaagctcgtcctctcggccatcgtgctcgccgtcctcgccgccgtggtggcagcggcgtcgggctacggcgacgtcggcgagtactgccgcgtggggaaggcggtgtcccggaacccggtcccgtcgtgccggaactacatcgcgcggtggtgcgccgccgccgggggccgcatggactcccgcaagcagccgccgcgggagttcctggagccgtgctgccgggagctcgccgccgtgccgatgcagtgccggtgcgacgcgctgagcgtgctggtgcgcggcgtggtcacggaggagggcgaccgcgtctccgggatgatctcccagcacgcggcaccggggtgcgacgccgcgacgatcgccgggatggcgagcgcgctgacggactacggccggtgcaacctgcagcacacggccggttcctttgcctgcctcatgtttggtggtggcatggattagattaattatttcattagtgattaattaattaattaggcctttgcttaattaattatcgatgtttgctagtactagctagcagtatcatgtttggatgctgcttctctatgtttgtgataatgataataaaaagaaataaaatgaggaacggatgttcctctttgttgttattc

SEQ ID NO: 2249 - DNA, 706 bp, Artificial
  Synthetic
aaattttctaaattacaagcaaatcaaagctcatcgaagtatagctatggcattggcatcagacaagttcgtcctctccgccatcgtgctcgccgtcctcaccgtcgcggcagcggcggcgggctacggcggctacggcgacgtcggcgagtactgccgcgtggggaaggcggtgtcccggaacccggtcccatcgtgccggaactacatcgcgcggtggtgcgccgtcgccgggggccgcctggactccggcaagcagccgccgcggcagctcctggagccgtgctgccgggagctcgccgcagtgccgatgcagtgccggtgcgacgcgttgagcgtgctggtgcgtggcgtggtcacggaggagggcgaccgcgtcgccgggatgatctcgcagcacgcggcgcccgggtgcgacgccgcgacgatcgccgggatggcgagcgcgctgacggactacggccggtgcaacctgcagcacactggtttctttggctgccccatgtttgggggtggcatggattaacttccttagtaattaattaattaggcctttgcttaattaattatttaattagttatccgggttactggataattaattatcgatatttgctagtagcatctatcatgtttggatgctgctttctccgtgaatgtgatgataataataatcagaagaaataaataagaagagttggattca

SEQ ID NO: 2250 - DNA, 472 bp, Artificial
  Synthetic
gttgtttagttcgggtttcctgtttcgttctttgtgggccggggatctagcggaagacaccccgccgttctcgagcttcgaacagccgacgttgcctagctgggatacatggcggcagtggagtattcctgtttcgtcggaggcctggcatgggccaccgacgaccgcagcctcgagaccgccttccgccccttcggaaatgtcacagactccaagattatcaatgatcgtgaaactggaaggtctcgtggctttgggtttgttaccttctctgaggagcaatccatgctggatgcgatagagggtatgaatgggaaggagctcgatggaagaaacattactgtaaaccaagctcagagccgtggttctggaggtggaggtggtggtggcggtggtggattccgcagatctgaaggtggccgatcaggaggaggagggggatatggaggaggagggtatggaggaggaggag

SEQ ID NO: 2251 - DNA, 726 bp, Artificial
  Synthetic
gggctttgaggtgggttggcttctcctccccctctttaccttttcctcctcggttcggttccgtggttcgtctagggtttagtgggttgagatggcggcgccggatgtcgagtaccgctgcttcgtcggcggcctcgcctgggccaccgacgaccgctccctcgaggccgccttctccacctacggcgagatcctcgactccaagatcatcaacgacagggagacggggaggtcacgtgggtttggcttcgtcaccttctcctccgagcagtcgatgcgcgacgccatcgagggcatgaacggcaaggagctcgacggccgcaacatcaccgtcaatgaggcccagtcccgccgctccggcggcggaggcgggggctacggcggcggcggtggcggctacggcggcggtcgtggaggcggcggctacggaggaggtggcggcggcggctacgggcgccgtgagggcggctacggtggcggcggcggctacggcggcggccgtggcggcggcggcggcggctacggtggcagccgtggcggcggctacggcggcgactccggcgggaactggaggaactgattggtggggcccatcgtggccagttatccttagctatccgtgtcagaatcatcttatcatcgagtcgagtcgttatcgtgtccagtggctctctcgagtcgagaagccctctatccatccatccagtgttaggtgttcttcgtccg

SEQ ID NO: 2252 - DNA, 641 bp, Artificial
  Synthetic
tggttcttaaggaggagactcctccgacattttccccttcgttctggttcgtttttctctgtttggtttctctgttcggggttcggaaacatggggtctgagtaccgttgcttcgtcgggggtctggcttggtccactaatgaccaggctttggaatccgctttcagtcaattcggaactgtcatcgaatcgaaggttatcaatgaccgtgagactggaaggtctcgtggattcgggtttgttacattcgaggatgagcaagccatgagggatgcaattgaagggatgaatggaaaggatctagatggcaggaacattactgtaaatcaggctcaggacaggtcatcaagtggtggtggtggtggcggctaccgaggaggtggtggtggtggtggtggttaccgtggtggtggtggcggtggttacagtggcggtggcagtggataccgctcaggtggtggtggatatggtggtggtggccaacgtagggattctgggtacggtggagaaggtggtggctactctggcggtgggggctacggtggtggtggtggtggatacggtggaagtggtggtggtggtggtaacaacaggtggagggacaattaaccaacctatcaaaggatgtgtaactagctatt

SEQ ID NO: 2253 - DNA, 713 bp, Artificial
  Synthetic
gacaatgtctacgaaagaggaagttgaagctgctgaacaacaattcaatggatatgaaattgacgggagggcaataagggtgaacgcagggccagcaccagccaaaagggagaattcttcgtttggaggtggaaggggtggaaattcttcatatggaggtggaagggacaggaattcttcttttggaggtgcacggggtgggagaagtgttgacagaagcaatagagtatacgtaggaaacctctcgtggggtgtcgatgacctggcacttaaagaattgttcagtgagcaaggcaatgttgtggatgccaaagtagtctatgatagagatagtggtagatcaaggggctttggatttgtaacatacagttcgtccaaagaggtcaacaatgcaattgatagcttgaacggcgttgaccttgatggcaggtccatacgcgtaagcgctgctgaagaacagcccaggcgtcaattttgaatgtgttaaactacatctttttgactgaggaaaagcttgagggcttcgtggcgacacgaaaactgcagcaaagctcatgaattttttgcaccttcgacacctgctacttttacaccaaagttggtacaaaattttgtatctgcatctagactaatgagaactcacaagtatattaccttttacagtgtatgttctaaaattgcctcggggaaagattctgatctgtaatattata

SEQ ID NO: 2254 - DNA, 684 bp, Artificial
  Synthetic
ggcttaaaccctagccgctcctcatttgtttctctctctccttaaaccctcaaagattctccttcctcagatttgtcaatttatctgtacaaatggctttctacaacaaactcggtggtcttttgaggcagaacatttctggaaatgcagtaattgcaacaacaccaatgccgtcaatgcttgatgccttccggtgcatgtcgacaaagcttttcgttggtggtctttcatggggaactgatgatcagtcactgagagatgcctttgctacctttggtgatgttgttgatgcaagggtaatcgttgacagagattctggcagatcaaggggatttggatttgtgaacttctcagatgatgaaagtgccaatgaggctattaaagcaatggatggtcaggaactccaaggaaggaatattcgtgttagtattgcccaagagagagctcctcgaagtggtggttttggtggctctggtggtggatttggtggcggctatggtcaagctagagacaatgatggatactaagtcacttttatttttgataagctgtcaatgtgtgcatgataacttttatctaagtagaggactttggtgggatagctttgttgagtttatctatattaagacttcttttcgtgcaaggttttggtatcaataatttttcctgatttatgggtaaaaa

SEQ ID NO: 2255 - DNA, 954 bp, Artificial
  Synthetic
ttttcttcttatttttttgctaacaattataatcatggctactacatggttttcttttttcttgagtttccttttgcttttgcatggtaattttgctcaacaaaggtctcagcagcaatatggccagcagtgtcaaattaacagactcaatccacaagagccttcctttagaatggaagcagaagctggagttactgagttttttgacagaaataatgagcaatttcaatgtgctggagtttcactatttcgccatgttattcagtccagaggccttctcttgccttcttatactaattctccactgcttgcctatgttgttcaaggtcgaggattttatgggatcatgaactcgggttgccccgagacattccaatcatctcaacaaactcaacagagaattagaggcagaagatttctagatcgtcatcaaaagattgaacaatttaggcagggtgatattatggcatttcctgcaggtgctgcacattggctctataatgaaggaaatgaagaagttgttcttgttgttcttgaagatgcctctaacaatgccaatcaattggatcaaacctctcggaggttctttattgctggaaacccgcaacaaggacaacaacagcaaggaagacaatatggtggcagcacaacgcggagggagcaatttcgatcaggcaatgttttcaatggctttgacttagaaattctatcagaaacatttggtgttgacagggaaacggcaaggaggctacaaggacaagatgacatgagaggtcacattgttagtgttcaagaagggcttagagtgattaggccacctttttcacaagaacaagaggaacaacaagaacaaggacaatatggtcgtggtcctatgactaatggaattgaagagacaatttgtactgctaaggttaaagaaaacattgacaatcccgctcgtgctgatatata

SEQ ID NO: 2256 - DNA, 974 bp, Artificial
  Synthetic
aacaaatcaatcctaattagccatggcggtcactactagactcctcttagctttactcctctctgcttttctcttgtctgcaacaaatgcagttagagactatcagggccagcaaggccgtcaggagggtctgagaggcactcgtctcactgtagctcaacaatgccgtttaacaaggctcactgctagccaacccactaaccgaattgagtcagagggcggcgtcactgaactgtgggatgagaatgaggagcaattccagtgcgctggagttgctcccatgaggaatgtcatccgtcgcaactctctttctcttcccaatttccatcccatgcctcgcttggtttacattgagcgcggccagggattgattggcattacttaccctggctgtgctgagactttccagtctcagtcccagaccttccaggctggccgagagccaagggaagagaggggccaaggccgcagaagtgaccaacaccagaagatccaccgcattcgtcaaggagatgtcgtggcacttccagctggcgctgctcattggtgctataatgatggtgaggaagagcttgtcgccgtctctatcaacgacctcaaccaccggtccaaccagcttgatcagaacttgagggcattctacttggctggtggagtaccagaaagtggaaggcaacaaacccaagcaggtcaaagactacagagcaggcagaggttccagaacattttccgtgctttcgacacagaactgatggctgaggccttcaacataccagccgagattgtaaggaggatgcaagaaggtcagagcgagcgtgggctaattgtgaatgtgagggaaggaatgacaatgattaggcccgacgaagaagaaggagaattcgaagaagagcaagggcgaccacgacgaggacagcaatggtgggaggaagcaaccggaaatgggttggaagaaaacatttgcacaatgaaaa

SEQ ID NO: 2257 - DNA, 832 bp, Artificial
  Synthetic
atggcagtcactactagactcctcttagctttactcctctctgcttttctcttgtctgcaacaaatgcagtcagagattttcagggtcggcaagctggccagcggggtgagagaggcactcgtctgactgaagctcaacaatgccgtttaacaaggctcactgccactcagcccactaaccgaattgagtccgagggcggtgtcactgagctgtgggacgagaacgaggaacaattccagtgcgctggagttgctcccataaggagtgtcatccgccgcaactccctttctctgcctaatttccatcccatgccgcgcttagtttacattgagcgtggccagggaatgattggcattacttaccctggctgtgctgagactttccagtctcagtcccagaccttccaggctggccgagagccatgggaagagaggggccaaggccgcagaagtgaccaacaccagaaggttcaccgcattcgtcaaggtgatgtcgtggcacttccagctggcgcagctcattggtgctataatgatggtgaggaagagcttgttgccatctctgtcaacgacctcaaccatcgctccaaccaacttgatcagaacttgagggcattctacttggctggtggagtaccagaaagtggaaggcaacaaactcaagcaggccaaagactacagagtaggcagcggttccagaacattttccgtgctttcgatacagaactaatggctgaggccttcaacatccctgccgagattgtaaggaggatgcaagaagagcagagcgaacgtggcctaattgtcaatgtgagggaagaaatgagaatga

SEQ ID NO: 2258 - DNA, 660 bp, Artificial
  Synthetic
caaacaatggctactttctcctcagtcctctctctcagcctttgcttcctcgttctctcccacagctgttttgctcagctcttagagcaacagcaacagaacgtatggcagagacttcaacagcagcaacaacaccgcgctctcaggtcaaaaaccgagtgccaaattgagcgtttgaacgctcaagaaccaacccggagatttgagtctgaggccggtgttattgagttctgggatgctacccaagagcagtttgagtgtgccggagttcaagccgttcgccatcaaattaggcgaaatggacttttgcttccttactataccaacactcctctgctcatgtacattattcaaggacgcggtattcactcgactgtgataccgggatgtgctgagacatacgaaacagaatctggagaatccagaaccggagaaagacgccggagtttcaatgataggcaccagaaactcagacgtttcagagccggtgatgttcttgctttgccggcgggagtcactttctggatgtacaatgatgctgaggaaccaattgtcactgtctcacttcttgacacttctaaccacgctaatcaacttgatctcactttcaggagcttcttcctagctggaaacccacagcgtggagtacaacaacaatct

SEQ ID NO: 2259 - DNA, 958 bp, Artificial
  Synthetic
atggcttctaactcctctctcatttgttttagcctttgtttcttctttcttttccatggcactttggctcagatctttgagcaccagcaagtctggcagaggcttcaacagcagcagcaacatcgggcgctcaggtccagaactgagtgtcggatcgagcgcctgaatgctcaggaacctactcgtaggtttgagtctgaggctggtgtcactgagttctgggatcatactcaggaacaatttgagtgcgccggagttcaagcagttaggcatgaaatccgacgaaatgggcttttgttgccttactacagcaacactccccagctcatctacataattcaaggaagtggagtgcattcggctgtgttcccgggttgtgctgagacatttgagacagagtcagcacaatcgaggaggggagaaaggggagaaagaggagaagcaggacaaagattcaatgaccgtcaccagaaagttagacgttttagagctggtgatattcttgctttgcctgctggtgttacacactggacttacaatgatggtgaagaaccaattatcagtgtctctcttattgacacttctaaccaggccaatcaacttgatctcaccttcaggaaatttttccttgctggaaatcctcaacgtggtgtacaacaacaaatgttaggaaggcaacaggagggagctcctggcctaggaagaagaggtagtgaacaagagagaggaagcaacatcttgagcggattcgacgctcaacttttgtcagatgctttcaatgtcgatcctgaaataattaggagactacaagaacaagtcccggaaaggggagtgatcgttcgggcggagaaccttcggtttctccaacccgaagaatcagaggaagaagaagaacaatggcaacaaggtagaagaggaggaagctggcctttgaatgggttggaagaaacattttgca

SEQ ID NO: 2260 - DNA, 959 bp, Artificial
  Synthetic
  misc_feature (883)..(883): The residue at this position can be any nucleotide.
ctcaataataataatcatgggttttagctggctctctttctccttgagtttccttctggtgttgcacggtacctttgctcagcagagataccaacagcagcaaggcgagtgccaactcaatagacttagtcctcaggaacccaccgtccgcattcaagccgaagctggagtcactgagttatgggatccaaataaccagcagttccaatgtgctggtgtctccctaattcgccacgtcatccagtctaggggaatgctgttgccttcctatgttaacacacccctacttgcctatgttgaacgaggtcagggattttatggcatcatgcaatctggatgcccggaaacattccagtcatcccagcaattgcagcaaggtgaaaggggtgccggttcaagatttcaagatcgccaccagaggattggacagtttaggcagggtgacattattgccttccctgctggagctgctcactgggtttataacgaaggaaatgaggagcttgttcttgttgttcttgaagatagcagtaacaatgccaaccagcttggtcgaacttcaaggaggttcttcatagctggaaacccacaacaaggacagcaacaacagcaacaaggacaatacggtggccgcagcttgcgcagggaacaattccaatctggaaatgttttcaatggctttgacgtacaggtcttggctgaggcatttggcgtagaccaggagacagccaggagacttcagggacaggaagaccagagaggccacattgtaaacattcagaaaggactcagagttgtgaggccaccattctcacaggaacaagaggagcgcgaggagagacaagagcaaggacaatacggtcctcgcatgaacggaattgangaaaccatctgctccgctaaagtcaggcagaacattgacaacccctcacgtgctgatatctacaacccacatgccg

SEQ ID NO: 2261 - DNA, 742 bp, Artificial
  Synthetic
accactcaaatatcactaatatggaattgcgttctcttcttcctcttgccctttgcttttttctcctctttaatggttgttttgctcaaatagagcaacagcaacgattcttatggcagaaacttcagcaacagcaacaacacagtcgtggccgagctagaactgagtgtcggatccagagccttaacgctcgggaaccgacttataaatttgaatcggaggctggaaccactgagttttgggaccgtaataatgaggaattcgaatgtgctggagttgctgctgttagaaatgttattcaacctcagggcttgctcttgcctcattacaataatgctcctcaactcctctacattgtccaagggagtggacttctgggtactgtaatacctggatgtgctgaaacatatgaatcaccacgaagagagagaggcatgaggggagaagagagcagagagggagaaagccagttcagaagtggtggtgatcaacatcagaaagtcaggcaatttagacaaggtgatgtattagcattaccagcaggtcttactctttggttttataacaatggtcaagaacgtcttgttactgtcgccttgcttgataccagcaatcctgctaaccagcttgatctccaattcaggcatttcttcctagctggaaacccaaaccctagaggacaaagtggaagcaggtacgaagaagaaatccgaggaagaagagaacaagaacaaggcgaaca

SEQ ID NO: 2262 - DNA, 892 bp, Artificial
  Synthetic
ctttaatatcttctctacacaacaataataatcatgggttctagctggctctctttctccttgagtttcctactggtgttgcacggtacctttgctcagcagagataccagcagcggcaaggcgaatgccaactcaatagacttagccctcaggaacccaccacccgcattcaagccgaagctggagtcaccgagttgtgggaccaaaacaaccagcagttccaatgtgctggcgtctcgctaattcgccacgtcatccagtctagaggcatgctgttgccttcttatgtcaacactcccctacttgcctatgttgaacgaggtcggggattttatggcatcatgcaatctggatgccctgaaacattccagtcgtccttgcaaatgcagcaaggtgaaaggggtgcaggctcaagattccaagatcgccatcagaggattggacagttcagacagggtgacattattgccttccctgctggagctgctcactgggcctataacgaaggaaatgaggagcttgttcttgtttgtttagaagacagcagtaacaatgccaaccaacttggtcaattttcaaggagattcttcatagctggaaacccacaacaaggacagcaacaacagggacaatacggtggcaaaagcttgcgcagggaacgattcgaatctggaaatgttttcaatggctttgacgtagaggtcttggccgaggcatttggtgtagacagggagatagcaaggagacttcaaggacaggacgaccagcgaggccacattgtaaacattgagcaaggactcagagttgtgaggccaccattctcacaagaacaagaggatcgcgaggagagacaagagcaaggacaatacggtcctcgcatgaacggaattg

SEQ ID NO: 2263 - DNA, 588 bp, Artificial
  Synthetic
ggttcgttagcccaacttcttagccaaagtactagtcaatggcaaagttctcgccgtggaagtccaagagagtgcagatttgatcggttgcaagcatttgagccgattcgcactgtaaggtcccaagctggtacaactgagttttttgatgtctctaatgagttgtttcaatgtactggagtatttgttgtccgtcgagttatcgaacctagaggtcttctgttacctcactactccaatggagcaactttggtatatgtcatccaaggcagaggtataacaggaccaactttcccaggatgtcctgagacctatcaacaacagtttcagcaatccgagcaagaccaacaattggaaggccaaagccaaagccataaatttagagatgaacatcaaaagatccaccgttttcaacagggggatgtagttgcattgcctgctggtgttgctcattggtgctacaatgatggtgatgcaccaattgttgccatatatgtcactgatatatacaatagtgctaaccaacttgatcctagacacagggatttctttttagctggcaacaataagataggtcaacaattgtat

SEQ ID NO: 2264 - DNA, 507 bp, Artificial
  Synthetic
attcaagggaggggttctatgggtttaaccttccccggttgcccagcgacttatcagcaacaatatccaacaattttcgtctcaaggccaaagtcaaagccaaaagtttagggatgagcatcaaaagatccatcaatttagacaaggagatgttgttgcactcccagctggtgttgcacattggttctacaatgatggtgatgcatcggttgttgccatatatgtttatgacataaacaacagtgcaaatcaacttgaaccaaggcaaaaggagttcctattagctggtaacaacaatagggttcaacaagtatatggcagctcaattgagcaacactctagccaaaacatattcaacggattcggtactgagctactaagtgaggctttaggcatcaacacagtagcagcaaagaggctgcagagccaacatgatcagagaggagagcatcgtacatgtgaaaaatggccttcaattgttgaaaccgactttgacacaacaacaag

SEQ ID NO: 2265 - DNA, 1029 bp, Artificial
  Synthetic
aaaaagcattcagttcattagtcctacaacaacatggcatccataaatcgccccatagttttcttcacagtttgcttgttcctcttgtgcaatggctccctagcccagcagctattaggccagagcactagtcaatggcagagttctcgtcgtggaagtccaagagaatgcaggttcgataggttgcaagcatttgagccaattcggagtgtgaggtctcaagctggcacaactgagttcttcgatgtctctaatgagcaatttcaatgtaccggagtatctgttgtccgtcgagttattgaacctagaggccttctactaccccattacactaatggtgcatctctagtatatatcatccaagggagaggtataacagggccaactttcccaggctgtcctgagtcctaccaacaacagttccaacaatcaggccaagcccaattgaccgaaagtcaaagccaaagtcaaaagttcaaggatgaacatcaaaagattcaccgtttcagacaaggagatgttatcgcgttgcctgctggtgtagctcattggtgctacaatgatggtgaagtgccggttgttgccatatatgtcactgatctcaacaacggtgctaatcaacttgaccctaggcaaagggatttcttgttagctggaaataagagaaaccctcaagcatacaggcgtgaggttgaggagcggtcacagaacatattcactggctttagcactgaactacttagcgaggctcttggcgtaagcagccaagtggcaaggcagctccaatgtcaaaatgaccaaagaggagaaattgtccgtgtcgaacacgggctcagtttgctgcagccatatgcatcattgcaggagcaggaacaacgacaagtgcaatcaagagagcgttatcaagaaggacaatatcagcaaagtcaatatggaagtggctgctctaacggtttggatgagaccttttgcaccctgagggtaaggcaaaacatcgataatcctaaccgtgctgatacatacaatcca

SEQ ID NO: 2266 - DNA, 310 bp, Artificial
  Synthetic
gaagaatgaacaattccagtgcacaggtacatttgtcatccgacgtgtcattgagcctcaaggccttctggtacctcgatacagcaatactcctggcatggtctacatcatccaagggagaggttctatgggattaactttccccggctgcccagcaacctaccaacaacaattccaacaattcttgcctgaaggccaaagtcagagccaaaaatttagggatgagcaccaaaagatccaccaatttagacaaggagatatcgttgcactgccagctggtgttgcgcattggttctacaatgaaggcgat

SEQ ID NO: 2267 - DNA, 561 bp, Artificial
  Synthetic
aaaagaacgtcgtcctatagatctctcccaggggataccggcaaagaggacgaacctacccctgcgcagtcatgattcattttgtggtactcattagccggcaggggaaagtgcgattaaccaagtggtactctccttatgctcaaaaggaaaggacaaagatcattcgagaacttagtggagtgatattatcaagaggtccgaaactttgcaattttgtggaatggcgaggcttcaaagtagtctataagcggtatgctagcttatatttctgcatgtgcattgatggggacgacaatgaattagaatgccttgagataattcaccactacgtcgagattctcgatcgctactttggaaatgtttgtgagctagaccttattttcaattttcacaaggcttactacatactagatgaggttttacttgctggggagcttcaagaaactagcaagaagtccgtcgcccgtgtcatcgctgcacaggacacgctagttgaaaatgccaaggaggaggcgagctctctctctaacatcattgcacaagccacaaagtgagaaa

SEQ ID NO: 2268 - DNA, 630 bp, Artificial
  Synthetic
agaagtataaccttgttctctcacattcaccttagcagaagcagaagaaggaagaggaggaggtgtttgttctttggatcaccaatcatgattcactttgtgctgctcattagccggcagggaaaagtgaggctaaccaagtggtattcaccatatacacaaaaagagagaaccaaggtaatccgtgaactaagtggtatgattctctcccgaggaccgaagctttgcaattttgttgagtggagaggatataaagttgtttataaaagatatgcaagcctgtacttctgtatgtgcatagaccaagacgacaatgagttggaggtcctggaaatcatacaccattatgttgagattctggaccgttacttcggaagtgtctgtgagctggatttaatcttcaattttcacaaggcatactatatattggatgaacttgtgattgctggtgaactccaagagtcgagcaagaaaactgttgcacgtctaattgctgcacaggattctttggttgaggctgccaaagaagaggcaagttctattagcaacatcattgcacaggccacaaaatgaaagatggagtgcattactgtttttatggttctcattcattgctgtaatcagatcttg

SEQ ID NO: 2269 - DNA, 352 bp, Artificial
  Synthetic
ttctggagatctcttctgggaatcgagcttcactgttaaagattttccttcaatcggctaaaaatgatacatttcgtgttactagtcagtcgacaagggaaagtaaggctcaccaagtggtattcgccgtatacgcagaaggaaagatctaaggtcatacgtgaactcagtggagtgattctgaaccgaggtcccaagctctgcaattttattgaatggagaggatacaaggttgtctacaaaagatatgcaagcttgtacttctgcatgtgcattgatgaggcggataacgagttagaggtactggagataattcatcactacgtcgagattcttgaccgctactttggca

SEQ ID NO: 2270 - DNA, 1024 bp, Artificial
  Synthetic
agaactgatgtgagagatgtagaagttttgagtgagatttatatctctatcaatgacaattacaaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatgaagatcattttcgtctttgctctccttgctattgctgcatgcagcgcctctgcgcagtttgatgttttaggtcaaagttataggcaatatcagctgcagtcgcctgtcctgctacagcaacaggtgcttagcccatataatgagttcgtaaggcagcagtatggcatagcggcaagccccttcttgcaatcagctgcgtttcaattgagaaacaaccaagtctggcaacaactcgggctggtggtgcaacaatctcactatcaggacattaacattgttcaggccatagcacaacagctacaactccagcagtttggtgatctctactttgatcggaatctggctcaagctcaagctctgttggcttttaacgtgccatctagatatggtatctaccctaggtactatggtgcacccagtaccattaccacccttggcggtgtcttggcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatctattggaaccgcaaaaatg

SEQ ID NO: 2271 - DNA, 631 bp, Artificial
  Synthetic
caattcaaatattatagttgaagcatagtagtagaatccaacaacaatgaagatcattttcgtatttgctctccttgctattgttgcatgcaatgcctctgcgcggtttgatcctcttagtcaaagttataggcaatatcaactacagtcgcatctcctactacagcaacaagtgctcagcccatgcagtgagttcgtaaggcaacagtatagcatagtggcaacccccttctggcaaccagctacgtttcaattgataaacaaccaagtcatgcagcagcagtgttgccaacagctcaggctggtagcacaacaatctcactaccaggccattagtattgttcaagcgattgtgcaacagctacaactgcagcaatttagtggtgtctactttgatcagactcaagctcaagcccaaactctgttgaccttcaacttgccatccatatgtggtatctaccctaactactatagtgctcccaggagcattgccactgttggtggtgtctggtactgaattgtaacaatataatagttcgtatgttaaaaataaagtcatacatcatcatgtgtgactgttgaaacttagggtcatataaatctaaataaaatcatcttacctaaaaaaaaa

SEQ ID NO: 2272 - DNA, 626 bp, Artificial
  Synthetic
caaacattatagttgaagcatagtagtagaatcctacaaaaatgaagatcattttcgtatttgctctccttgctattgttgcatgcaacgcttctgcacggtttgatgctcttagtcaaagttatagacaatatcaactacaatcgcatctcctgctacagcaacaagtgctcagcccatgcagtgagttcgtaaggcaacagcatagcatagtggcaacccccttctggcaaccagctacgtttcaattgataaacaaccaagtcatgcagcaacagtgttgccaacagctcaggctggtagcgcaacaatctcactaccaggccattagtagcgttcaggcgattgtgcagcaactacagctgcagcaggtcggtgttgtctactttgatcagactcaagctcaagctcaagctttgctggccttaaacttgccatccatatgtggtatctatcctaactactacattgctccgaggagcattcccaccgttggtggtgtctggtactgaattgtaatagtataatggttcaaatgttaaaaataaagtcatgcatcatcatgcgtgacagttgaaacttgatgtcatataaatctaaataaaatcacctatttaaatagcaaa

SEQ ID NO: 2273 - DNA, 592 bp, Artificial
  Synthetic
gaactagtgtcctgcaacaatgaagatcattttcgtctttgctctccttgctattgctgcatgcagcgccacagcgcagtttgatgttttaggtcaaaatattaggcaatatcaggtgcagtcgcctctcctgctacagcaacaggtgcttagcctatataatgagttcgtaaggcagcagtatagcattgcggcaagccccttcttgcaatcagctgtgtttcaactgagaaacaaccaagtcttgcaacagctcaggctggtggcgcaacaatctcactaccaggacattaacgttgtccaggccatagcgcagcagctacacctccagcagtttggcgatctctacattgaccggaatctggctcaagcgcaagcactgttggcttttaacttgccatctacatatggtatctaccctaggtactatagtgcaccgggtagtattaccacccttggcggtgtcttgtactgaattttcacaatattgtagttcggaagtgaaaatataagctcaggtatcatcggatgtgacatgtgaaacttaaggtgatataaatagaaataaaattatctttcatatttaaaaaaa

SEQ ID NO: 2274 - DNA, 626 bp, Artificial
  Synthetic
gcattatacagcaaaaaagaaagatctagtgtcccgtagcaatgaagatcattttcgtctttgctcttcttgctattgctgcttgcagcgcctctgcgcagtttgatgttttaggtcaaagttataggcaatatcagctgcagtcgcctctcctgctacagcaacaggttcttagcccatataatgagttcgtaaggcaggagtatggcatagcggcaagccccttattgcaatcagctgcgtttcaactgagaaacaaccaagtctggcaacagctcaggctggtggcgcaacagtctcactatcaggatattaaaattgttcaggccatagcgcagcagctgcaactccagcagtttgatgatctctactttgatcggaatctggctcaagctcaagctcaagctctgttggctttgaacttgccatctagatatggtatctaccataggtactatagtgcacctagtagcattaccacccttggcagtgtattgtactgagttttaacaatatagtggttcggaagttgaaaataggctcagatatcatcatattcgacatgtggaactcaggttgatatatcctagtacatcatcgtaactaattaccatcgttggtactct

SEQ ID NO: 2275 - DNA, 650 bp, Artificial
  Synthetic
atcacaactcaaacattacagcgaaagcataacaactagaatcccaccacaatgaagatcattttcttctttgctctccttgctattgctgcatgtagcgcctctgcgcagtttgatgctgttactcaagtttacaggcaatatcagctgcagccgcatctcatgctgcagcaacagatgcttagcccatgcggtgagttcgtaaggcagcagtgcagcacagtggcaacccccttcttccaatcacccgtgtttcaactgagaaactgccaagtcatgcagcagcagtgctgccaacagctcaggatgatcgcgcaacagtctcactgccaggccattagcagtgttcaggcgattgtgcagcagctacagctacaacagtttgctggcgtctacttcgatcaggctcaagctcaagcccaagctatgttggccctaaacttgccgtcaatatgcggtatctacccaagctacaacactgctccctgtagcattcctaccgtcggtggtatctggtattgaattgtagcagtatagtagtacaggacacaaaaataaagtcatgcatcatcgtgtgtgacaagttgaaacatcggggtgatacaaatctgaataaaaatgtcatgcaagtttaaacataatgcctctgt

SEQ ID NO: 2276 - DNA, 610 bp, Artificial
  Synthetic
ctccatttcactaaatacttattgtcttctctcttctttgcgtttacttactttctgtctcctgcttctagggttactctctcaaaatccaactacaaaaattttttaattcatttttacttctattaaagatcctatatagctatgatgttgcaagaatcaaggtacatagcttgaaagactttgcactacaaaaggaaattttaaggaaattatggcttcttccagcagctactccaacccaccatgtgctgcatgcaaattcttgagaagaaaatgtttgccaggtaattgcatatttgcaccctattttcctccagaagagccaacaaaattcgccaatgtacacaaaatatttggtgcgagcaacgtaagtaaactcttaaatgaaatccaacctcaccagagagaagatgcagtaaattctcttgcttatgaagctgaagcacgtatgaaagatccagtttatggttgtgttggagcaatttcagttctacaacgacaagttattcgtcttcagaaagaacttgatgctacgaatgctgacttaatgcgatatattaatccgtctggaggaagcattaataatcagattacggtaaatcaacaa

SEQ ID NO: 2277 - DNA, 732 bp, Artificial
  Synthetic
atctaccaacacagaaagggtagccatgtcttccttaacaaccagacaacttttccacagaacaagtagtaattcccaagtgcaaatttgtccttctaggtgtattcctgttttcatcaccaacaagaccaacaacagtaatagattctttaacatcagtaagttttcaggtttcaagaatttgagtgttgtggtaaaggcagctgctggggatggaggaatttcacctaagaatcaagatgatgaagatggtgtgtctttgggaaccatgaaattgcctctggatattgatgttgcaagatttgaaactctactttttcagtgggctaacagtctttgtcaaggagctatgctgccacttccagtgcctctaaaggttgacaaaattcctcgcggagccagacttggttttattacagttgaagatgcacaaactgaagtacttgtatatatagattgtatggtttttcctgctacggataactcacctccgatatttcgagctataagaaatggaccatcgagagataaggcgcctccgggggagccaagaatcatgagaagtcttttaggtgctcttcagaaatctgttgagattgctagagtttgaaaattgaaacattttttctattccaattgttctgtatttcaacactcttttatgtataaaagcatttccacattttctgtaataacttcctgattttattatcaatattaaacagcttcgta

SEQ ID NO: 2278 - DNA, 939 bp, Artificial
  Synthetic
gcatggagcacgtggtggcacggccgagctaggtgggtttggtgctgtgcagcagtgtgcatatatgggcagtcggccgcgggtcaagaggctggcaagccaggcaatgggcgaggaggatgccaccacatacgaggacgccaccgacgaggagcaagagtttgaggaattgcaagagccagtgaatggcgacgctgtgagcagcactagtggtgctgatgacggtgaggaggaggacgaggaggaggacgaggaggacgacgaggaagacgaggacgaggacgaggaggacgaggaggacaaggatgcaaatcgtcgccggcgttaccagcctcacccatcgccgccaccggacgcgagcagtcgccccataagggtatacgcggacggcatctacgatctcttccatttcggccatgctcgatcccttgagcaggccaagaagctattccccaacacctacttgctcgtcggctgctgcagcgacgctcttacccacaagtataaaggcaagactgtgatgagcgaagcggaacgatacgagtcgttgcgtcattgcaggtgggtggacgaggtgatcgaggacgcaccgtgggttatcaaccaggagtttctggacaagcaccgcattgattatgtggcccatgacgcgctgccgtacgctgatgcgagtggagcaagcaaggacgtttatcacttcgttaaagccgcggggaagttcatggaaaccaagcggaccgatggggtctcgacttcggacctcatcatgcggatcatcaaggactacaatgaatatgtcatgcgcaatctcgcccgcggctactcgagaaaagagctgggcgtgagctacgtcaaggaaaagcagctgcaagtcaacatggggatgcggaagctgcgtcagaaagtcaaagaacagcaggaacgtgttggacagaggct

SEQ ID NO: 2279 - DNA, 278 bp, Artificial
  Synthetic
cccacgcgtccggccaaattagcgtttccaaacaacacttaccttcttgttggatgttgcaatgatgagactacccataagtacaagggaaggactgtaatgactgcagaagagcgatatgaatcacttcgacattgcaagtgggtggatgaagtcatccctgatgcaccatgggtggtcaaccaggagtttcttgacaagcaccagattgactatgttgcccacgattctcttccctatgctgattcaagcggagctggaaaggatgtctatgaatt

SEQ ID NO: 2280 - DNA, 294 bp, Artificial
  Synthetic
aaacacttatcttcttgttggatgctgcaatgatgaaatcacccacatgtacaagggaaaaacggttatgaatgataaggagcgctatgaatctctgcgccactgcaaatgggttgatgaagttattccagatgcgccttgggttgttactccggagttcattgagaaacatcagattgactatgtggcacatgatgctcttccttatgcagatgcaagtggagctggaaatgatgtttacgagtatgtcaagtccattggtaagtttttggtgaccaagcggactgatggaat

SEQ ID NO: 2281 - DNA, 640 bp, Artificial
  Synthetic
gaattccggaagaggagaagaagatgtcgaggggcgatccacctgttcgtgtttacgccgatggaatctacgatctcttccacttcggtcatgctcgctctctcgaacaagccaagaaatcgttcccaaacacgtatcttctggttggatgctgcagcgatgaagttacacatagatataaaggcaaaactgtcatgaccgaatccgaacgatatgaatctcttcgccattgcaagtgggttgacgaagtcattccggatgcaccatgggttatctcacaggagttccttgataagcataatatcgactatgttgctcacgattctctcccttatgctgatacgagtggagctggaaaagatgtatatgaatttgttaaaaaggttggaaaatttaaggagacgcaacgtactgatgggatttctacctcagatattattatgaggattcttaaagattataaccaatatgtgatgcgtaacctggatcgtgggtattcacggaaagaacttaatgtcagctatgtgaaggaaaagcgtcttcgagtcaacatgggtttgaggaaattacgtgacaaagccaaggaacaccaagaaaaagtgggagagaggatacaaacagtcgcaaaaactgctgaact

SEQ ID NO: 2282 - DNA, 767 bp, Artificial
  Synthetic
aatgaaatcttgttgaacttttcccctcttcttcttccttcagttgagagagacggtggttcttcttgggttcgggttcaggtgtgtagatagatcgtgggagagcaatgggcgaccaaaaggtgttcagtttcgagcaggtctcgaaccacgcccaatccaaggattgctggatcattgtcagtggaaaggtttacaatgtaacgcggtttctggatgagcatcctggaggagatgaagtcatattgtcatccacagggaaagatgcgacagacgatttcgaagatgtggggcacagcaagaccgcgcgggcgatgatggaggagtactacatcggagaggttgacctttccaccgtcccttccaagccatcctatgcacccgccaaacaagcccattacaaccccgacaaaagctcagagttcatcattaggattctccagtttcttgtcccacttgccattctgggtttagcgattgctgtccgtgttttcactaagaaaaccgaatgattgcatgcaccctttaaaaagtagtgggtggggataaggggaatggaagaagaagaaaaaaaggtgcgtccctaaaatgtgttatctatcgtagaagctaatgtagatgcggtgttttccctagttttatccctaggttgcttattcatcctgttaaattgtggatacctacactgttacaactatggaggcccctttggatctgttgcaagaaggaggttccttgtttacttccatgtaatgaatattggcagt

SEQ ID NO: 2283 - DNA, 506 bp, Artificial
  Synthetic
tgacatatattatataggactcatttagagggttagttgttgctggtagtagtcgatagtcgatagtcgagggccatgtcgaagaaggtgttcagtctggaagaggtctctcagcacaactcctccaaggattgctggatcatcgttcacaataaggtttatgatgtcacatcatacttggaagatcaccctgggggagacgatgttattttgcaagcaacagctaaagatgccactgacgactttgaagatgccgggcatggctcagatgcacggacattgatggagaagtattacgtcggggatgtcgatcttaatggtaatcaaggaaaacaacccaacaagttctatagcctttccaaggaatccgatctcttgataaaggttttgccagctgttgcggtaccactcattattcttggattggttatcgttgttcgaaatctaagaactctaaaaaactcccatgactagacctcttctttaaagactatcaaattattctt

SEQ ID NO: 2284 - DNA, 641 bp, Artificial
  Synthetic
cggacgcgtgggttgtttcagtggctcagaaattttcttcttttcgtattattgttttcctttatttaaggaaggagttgggctctctctctaagtctgaatccccacgagacgagaaacctagcaaaaatctcgtctttcgccgctctctccctcctctgattcctgctgttcttgatcttggatctcaattcccaaccaagaacacacagacagagaaaggaaggagaagaagatgtcgaacgacaacaagaaggtgtataccctggaggaggtcgccaagcacaactccaaggacgactgctggctcatcatcggcggaaaggtatacaatgtgtcgaaattccttgaggaccatccaggaggtgatgatgtcttgctatcttcaactggcaaggacgcgactgacgattttgaggatgtcgggcacagcacgactgctcgtgcgatgatggatgagtattacgttggcgacatcgacacatccacaatacccgcgaggacgaagtacgttcccccaaagcaaccacactacaaccaggacaagaccccggagttcatcatcaagatcctccagttcttggttcccctcgccatattgggcctggctgttgcaattaggatctacaccaagtcggagt

SEQ ID NO: 2285 - DNA, 674 bp, Artificial
  Synthetic
ccggcggggtttccggcgccgccgagagagcggagcgtgtccagatcgcgtgactcccccacactccgctccgctccccccgcggccacgcgctcctcgtcggcttccgcttcctcccaccacctcgcagcgttgcagggcgtgggcgtgggcggcggacatggccggcgagaagaaggtgttcgggttcgaggaggtggccggccacaacgtcaccaaggattgctggctcatcatcgccgggaaggtatatgatgttacttcttttatggatgagcaccctggtggcgatgaagtgttgctagcagtaactggcaaagacgcaaccaatgattttgaagacattggccacagtgaatcagcaagggagatgatggagaagtatctcattggggagattgatgcttcaaccatcccagtaaagcgtactcatgtcactccccagcaagcgcccggcaacccagacaagggcgatgacatgctcattaagatcttgcagtttcttgtccccatcttgatcttggggcttgcatttgctatccggcagtacaccaaatctgagtagatctgttattacaatgttgataatcaatatggtccatgaagctatattaggtgaaatgatttggatcaaaagaactaaataatgatatttgttgaggggaacggtatgt

SEQ ID NO: 2286 - DNA, 613 bp, Artificial
  Synthetic
agatcgcgtgactcccccacactccgctccgctccccccgcggccacgcgctcctcgtcggcttccgcttcctcccaccacctcgcagcgttgcagggcgtgggcgtgggcggcggacatggccggcgagaagaaggtgttcgggttcgaggaggtggccggccacaacgtcaccaaggattgctggctcatcatcgccgggaaggtatatgatgttacttcttttatggatgagcaccctggtggcgatgaagtgttgctagcagtaactggcaaagacgcaaccaatgattttgaagacattggccacagtgaatcagcaagggagatgatggagaagtatctcattggggagattgatgcttcaaccatcccagtaaagcgtactcatgtcactccccagcaagcgcccggcaacccagacaagggcgatgacatgctcattaagatcttgcagtttcttgtccccatcttgatcttggggcttgcatttgctatccggcagtacaccaaatctgagtagatctgttattacaatgttgataatcaatatggtccatgaagctatattaggtgaaatgatttggatcaaaagaactaaataatgatattt

SEQ ID NO: 2287 - DNA, 600 bp, Artificial
  Synthetic
ccctttcttctcttcactcttcaattcttgtgttagtagtcttgacacccaattcaagattcattacatctttcatttctccattccaattgaggagtaatttttttgctgtgtccataaatgggtggtgaaactaaggtttatacgttggctgaagttgcccctcacaacaataacaaagattgttggcttgttattagtggcaaggtgtacgatgtgacaaaattcttggacgaccacccaggtggcgatgaggttttgttggctgctacgggaaaggatgcaactgatgattttgaggatgtcggccacagcaccagtgctcgagcaatgttggatgagtattacgtaggcaatattgattcagcaaccatccctacaaaaaccaagtacactcctcctaatcagcctcattacaaccaggacaaaacatccgagtttgtaattaagctcctccagttcttagttcccctgataatattgggtgtagctgttggcatccgcttctacaccaaacaacaatcagcttgaagattgagtacgcgatgaattcataataagtgtccacatttccgaaatgtgacccttacccacccccaa

SEQ ID NO: 2288 - DNA, 487 bp, Artificial
  Synthetic
gaataatggggggtgaaactaacgtctttactttggctgaggtctcccagcacaacaacgccaaggattgttggttggttattagtggcaaggtatatgatgtgacaaaattcttggatgaccacccaggaggtgatgaggttttgttgtctgcaactggaaaggatgcaacagatgattttgaggacgttggccacagcagcagtgctcgagcgatgttggatgagtattacgtaggtgatattgattcagcgaccatccccaccaagaccaagtacactcctcccaatcagccacattacaaccaggacaaaacatcagagtttgtcgtcaagctcctccaattcttagttcccctgattattttgggtgttgcttttggcatccgcttctatatcaaacagtcatcagcttgaagatggagttcgtggtgaagtcataagaagtgtccagaagaaaggttgtgtgtgtgtgtgtgggggggggg

SEQ ID NO: 2289 - DNA, 344 bp, Artificial
  Synthetic
cccacgcgtccgagcggttggtgtaagatcccaaactcacagattcccaaataatagtaatactcttcctcttctcaactctcaccagtcaccagcagatcatcggagatgggcggagacggaaaagttttcaccttgtccgaggtttctcagcacagtagcgccaaggattgttggatcgtcatcgacggcaaggtttatgatgtgacaaagttcttggatgatcatcctggtggtgatgaggttatcttgacttctacagggaaagatgcgaccgatgatttcgaggatgtgggacatagttcgactgcgaaagccatgctagatgagtactatgtgggtga

SEQ ID NO: 2290 - DNA, 482 bp, Artificial
  Synthetic
aatcatcaaaatgtctgacaccgccgccattcctactgatactgccgagaagaagatcttcaccctcaagcaggtcgccgagcacaaggaccgaaatgatctgtggatgatcatcaacggcaaggtctacgacatctccagcttcgttgacgagcatcccggtggagaggaggttcttcttgatgccggtggaactgaggccaccaacgctttcgacgacgttggacactctgaggacgcttacggcatccttaacgacctctatgtcggtgaggttgaccccagcgaggacgttatccgaaagactcacactgtcaagacttcttacgaggacggcgagtctgttggtgatgaccacggatcttcttccatgatcttcctcattgttgctgctgctgttgccgccgctgctttcttctacctccagggtcagaaataagtatgttaaatcatttggatattggtagttaatcatttttatt

SEQ ID NO: 2291 - DNA, 431 bp, Artificial
  Synthetic
attcggcaccaggagcttcggagctatcgaaaattctgaatctgaaaggtttgagtgaagatgtcttcaaatcggaaggttctaagttttgaagaagtttcaaagcacaacaaaactaaggattgttggcttattatttccggcaaggtgtatgatgtgactccattcatggatgatcatcctggaggcgatgaagtcttgttgtcctcaacagggaaagatgctacaaatgattttgaagacgttggtcacagcgacactgcaagggacatgatggacaaatatttcattggtgagattgattcgtctagtgttccagcaactaggacatacgttgcaccacagcaaccagcctacaaccaagacaagacaccagaattcattatcaagattcttcagttccttgttccgatcttgatcttgggattggc

SEQ ID NO: 2292 - DNA, 363 bp, Artificial
  Synthetic
tttctcagcacagtagcgccaaggattgttggatcgtcatcgacggcaaggtttatgatgtgacaaagttcttggatgatcatcctggtggtgatgaggttatcttgacttctacagggaaagatgcgaccgatgatttcgaggatgtgggacatagttcgactgcgaaagccatgctagatgagtactatgtgggtgatattgacacagctactgtgccggttaaagctaagtttgtgcctcctacgtcgacgaaagccgtggctactcaggataagagctcggattttgttattaagctccttcagttccttgttccacttctaatcttaggcttggctttcggcattcggtactacacta

SEQ ID NO: 2293 - DNA, 369 bp, Artificial
  Synthetic
cccacgcgtacgggcgaatctaatttcgtttcacgatgtggctaaacataagtgcaagaacgattgttggattctcatccatggaaaggtctatgacatcagcactttcatggacgaacatcccggaggtgacaatgttctcctcgccgtcaccgggaaagacgcgtcgatcgatttcgaagatgtgaaccatagcaaagatgccaaggagctaatgaagaaatactgtatcggtgacgttgaccagtcaacggttccggtgacgcaacagtatattccgccgtgggagaaggaatctacggcggcggaaacaactaaagaagaatctggaaagaagctgcttatctacttaattcctctcttgatact

SEQ ID NO: 2294 - DNA, 606 bp, Artificial
  Synthetic
tcgtttcctcctctaaaatcataatctaatttatctttcagttttatttttcttagaaaaattgtgtaataaatgggtggtcaatctaaggtctacactttagctgaggtttctaatcacaacaatgtcaaagattgttggcttattatcagtggcaaggtgtataatgtgacgaagttcttggaagatcacccaggtggggatgaggttttattgtccgcaacaggaaaggatgctactgatgattttgaggatgttggtcacagcactagtgctcgagcaatgttgaacgagtattatgtaggtgatattgattcttccaccataccaacaaaggtcaagtacactcctccaaagcaacctcattacaaccaggacaaaacaccagagttcatcgtcaagctcctccaattcttggttcctctgattattctaggtgtggcttttggcgttcgcttctacactaaacagtcagcttgaagattgattatggtgatctcataataaggatccaaattaccgcaacgttagaagaacaaaaaaaagaaaataaaaagaaaagaaaaagagcttttactttgttaaccaggcaaattatcttgttta

SEQ ID NO: 2295 - DNA, 771 bp, Artificial
  Synthetic
gacagagaaatggatgcgttgatccggcatcccggggagctgcccgccctcttgcggatgaagatcgcagctgcccgcgctgctcatgcattgccgccggatccacacttggcctactgctaccgcatcttgctcctcgtctcgcggagcttcgccgtcgtcatccagcagctggatcaagagcttcgcgatgcggtgtgtgtattttatgtcgttttacgcgcattggacactgttgaggatgatatgagcattcccgtggaaacgaagactgcagtgctggaggagttctacaagcacttagatgatccatcatggcgatttgtttgtggagataagcactacaaggagctcatgaagaattttgatcagctttcgcttgcgttccttcggctttccaaaaactaccagtctgttatcagcgatatcacgaaaagaatgggctacggaatggcagaatttattcggaaggaggttgtgactgtatcggactatgacaagtattgctactatgtcgccggtttggttggagttggattgtcacatctcttcaactcgtccggacttgaaagactggaagagaggctgatcgaaccggatccgaagagatcattcgtactcgacagtcctgcaatctctatgggacgattcttacagaaaatcaacataatcagggattatctggaagacatcaacgagcttccagctcctcgaatgttttggccccgcgaaatctggggaaaatatgctccaaactctctgctctcggac

SEQ ID NO: 2296 - DNA, 656 bp, Artificial
  Synthetic
  misc_feature (68)..(68): The residue at this position can be any nucleotide.
cccacgcgtccgggaggaaatcatggatcctctccaaaagcgcctcatgtttgaagatgagtgcattntggttgatgaagatgataaggttgtgggtcatgattcaaagtacaattgtcatctgatggagacaatagttaaaggaaaagcactgcaccgggcattcagtgtcttccttttcaacaccaagcatgagttgttactacagaagcggtcggctaccaaggtaacttttcctttggtgtggacaaatacatgctgcagtcatcctttgtatcgagaatccgaattgatttcggacaactgcttaggggtaagaaatgccgctcaaaggaagcttttcgacgagcttgggattgtagcctccgaggttcctgttgatgacttcaccatccttggccgcattttgtacaaggctccttcagatgggaagtggggcgaacatgaactggattaccttctctttattgtcggtgatgtgacgacgcatcctaaccctgaggaggttgacgacattcggtatgttaccaaggagcaacttaaggagttgctcgaccaagccgaggcaccaggccaagacagtgtcaagttttcgccttggttcaaattagtggttgagaatttcctttttgattggtggaggaaagttgaggaga

SEQ ID NO: 2297 - DNA, 639 bp, Artificial
  Synthetic
gctttctgcaaaatgggtgatgttgaagctgatgccaatatggacgctgtccaacgccgtctcatgtttgaagacgaatgtattttggtggacgagaatgaccaggttgttggtcatgacaccaagtataattgtcatttgatggaaaagattgaatctttgaatttgctgcacagagctttcagtgtatttcttttcaactcgaagtacgaacttcttcttcagcaacgatcagcaacaaaggtaacctttcctttggtgtggacgaatacatgctgcagccatccactctaccgagtgtctgagctaattgaggagaatgctcttggtgtaagaaacgctgcgcaaaggaagctgcttgatgaattgggtattccagctgaagatgtccctgttgaccagttcacgccattgggccgtatgctttacaaggcaccatctgatggaaagtggggagagcatgaacttgattatcttctattcatcgtccgtgatgttaatgtgaacccgaacccagatgaagttgctgatatcaaatatgtgaaccaagaacaactgaaagatcttttgaggaaagcagatgcaggtgaggaaggtttgaagctatccccttggttcagacttgtcgtcgacaacttc

SEQ ID NO: 2298 - DNA, 624 bp, Artificial
  Synthetic
gcccaaatccatccagcccgtcgccgcccgccgcccgccgcgcgcgcgcgcacccgagctcccgctccctcccctccgatggcggcggcggcgcgctccctcgcgctgctctcgaccgcctccgcgtccctcggcctcggcgtcgcgcgctcctccgcccgccctcggtccccgtttgggcggggcctcgccctccgcggcctgtcgtcgtcctcgtcctccttcgccgccaccgccgcggtgatggggaaggccggcaccgcggaagccgccgacgccgggatggacgccgtccagcagcggctcatgttcgaggacgagtgtattttagtggacgaacaggacaacgtcattggccatgattccaagtataactgccatctcatggaaaagataaattctggtcatgtcctccacagagcgttcagtgtttttcttttcaactccaaatatgaattgttacttcagcaaaggtctgctacaaaagtgacatttccacttgtctggacaaacacttgctgtagccaccctctataccgcgagtccgagctcattgaagataaaagcctaggggtcagaaatgcagcacagcggaagctattcgatgaactgggaatacaagct

SEQ ID NO: 2299 - DNA, 817 bp, Artificial
  Synthetic
cccagatgtcgctgacaactacgccttcttttcaaatctggcggaggttcatcgcagcctcccctataacttgtccttcatccctctcacttgtatccgtatccaaatcccctcttcttaaaagccatagaagagctgcctctctccgctgctattgtgctacaagaatgggtgacgccattgctgatgctaacatggacgctgttcagcgccgtctcatgtttgaagacgaatgtattctggtggatgagaatgaccgtgttgttggtcatgacacaaagtataattgtcatttaatggaaaagatcgaagctgaaaatttgctgcatagagctttcagtgtatttctatttaactcaaaatatgaattgcttcttcagcaacgatcagcaacaaaggtaacctttcctttggtatggactaacacctgctgcagccatccactctaccgggactatgagctcattgaggagaatgctcttggggtaagaaatgctgcacaaaggaagcttcttgacgaattgggcattcctgctaaagatgtcccagttgaccagttcaccccattaggtcgtatactttataaagctccatctgatggaaagtggggagaacatgaacttgattatcttctattcaccgtccgtgaagtgaacatgaaaccaaacccagatgaagttgctgatgttaaatacgtgaaccgagaacaactgaaagagcttttgaggaaagcagatgctggcgagggaggtctgaagctgtccccttggttcagacttgtcgttgacaacttcttgtttaagtggtgggatcatct

SEQ ID NO: 2300 - DNA, 678 bp, Artificial
  Synthetic
  misc_feature (404)..(404): The residue at this position can be any nucleotide.
cgtttcttctctcgcttgtgattgtgagcattctatcgcctttcttactctctctcttctggatttccatccggattgtttactttcttccttccagtccgccaaaatacctagacacacgtagcccgcaatggcgtcatcattcaacgttgccgacctggccgagtatatcgatctggacaagcagagcctattgatctcggccgggtcaatcatcttcaacccgctcttctggaacattgtcgctcgtcaagaataccacaacaagatcctgacaaggctgttcgggggcagaccctacccggcctgctatgccctcgccataaccatcttctcgctgggccttctccgcgattggctgtacaagacggccctgtccgagcagccatcgcacccgctcctgnagacgctgtattcgcaggctgccggatacaccctgttcatcatcggcaacatccttgtcgtctcgtcgacgtggcgcctgggcatcacgggcaccttcctgggcgactactttggcatcctgatggacgagatggtgacgggcttccccttcaacgtgacatcggccccgatgtactggggctcgacgatgaactttctgggaaccgcgctcgtctttggcaagcccgctggtcttgcgctgaccgtcggcgtgctcgtcgtgtacatcatcgc

SEQ ID NO: 2301 - DNA, 633 bp, Artificial
  Synthetic
tacctgtgtgttcttgcgtttgaagactcgcaactcgtctggacttgctcttgaccatggcttcttacatcgacttcagtcagcccagtttgtgggtatctgctgcaagcattgtattcaaccctactttctggaacatcgctgcgcagcaagaataccataacaaggtcattaccaagctgtttgggggtaactctcgacttgggtgctatgcgcttgccgtaaccattttctcactgggtatctttcgagactacctttacaatgaagctctcgccgatcagcccacccatccgactctcctctcccctgctatcaaatactccgcgatccctctgttcctaacagggaacaccctcgtcctgacctcgatgtgggctcttggtgtcactggcacctaccttggtgactacttcggcatcctcatggacgagcctgtgacgacattcccatttaacgtctcgggttcgcccatgtatcacggctctgccatgtctttcctggccacggctatttggtacggaaaaccagctggtatacttcttactgcactggtccacactgcatactctattgcgtgcaggtgggaggatccattcactggtatgatctaccagaagagagacgaggaga

SEQ ID NO: 2302 - DNA, 489 bp, Artificial
  Synthetic
ggctggagcaatggatctagcttccggacttggaggaaacttgagccgtcgagatctgccgtctgccgtcgatcaatacgagaagtatcattcctattatggaggcgaggaagaccagaggaaattcaactacacggatatggtcaacaagtactacgatctggcgacgagtttctacgaatatggctggggtcaatcttttcacttcgccaacagtcttgtggttttgtttctatttgtcgcagataccaggacgagacactacaggagagcatcaagcgacacgaacatttcctggcgctacgtctccagttgaagccgggagcgaaggtgctggatgttggctgtggaatcggtggacccttgagggagatagcgagattcagtggtgcatctattacgggtttgaataataatggctatcaaatttcgcgaggaaccgaactcaacaaaaagtatggactgggacaaacatgcgatttcgtcaag

SEQ ID NO: 2303 - DNA, 691 bp, Artificial
  Synthetic
aagagagcattaagaggcacgagcactttcttgccttgcaactgggattgaaaccaggacaaaaggtcttggacgtaggatgtggcattggtgggccgttaagagaaattgctcgattcagctctacatcagttacaggcctcaacaataatgaatatcagatatcaaggggacaggtgttgaaccgcaaagtaggattggatcagacttgcaactttgtaaagggtgatttcatgaaaatgccattccctgacaatagctttgatgcagtgtacgcaatagaagctacctgccatgcaccagatccagttggatgctataaagagatttaccgggtgctgaagcctggtcaatgtttcgctgtgtatgagtggtgcatgaccgattcttacaaccccaataacgaagagcacaagaggatcaaggccgaaattgagctcggaaatggcctccctgaggttagattgacaacacagtgcctcgaagcagccaaacaagctggttttgaagttgtatgggacaaggatctggctgatgactcacctgttccatggtacttgcctttggatacgagtcacttctcgctcagtagttaccgcctaacagcagttggcagacttttcaccagaaatctggtttcggcacttgaatatgtgggacttgctcctaaaggtagtcaaagggttcaagc

SEQ ID NO: 2304 - DNA, 657 bp, Artificial
  Synthetic
tcactttcctcttttctcactcccacagtcccactaatggactctctcactctcatttgtaccgccgctcttctagctgccggtggactttactggttcgtttgcatccttggctccgccgaggttaaagggaaacgcgccgtccaactttccggcgggtcaatcgagaaagagaatgtccaagacaattataaacaatactggtctttcttccgccgccctaaagaaatcgaaaccgccgataaagttccggccttcgtcgatacgttctataatctcgtcactgatatttacgaatggggttggggtcagtcttttcacttttccccttctatccctgggaaatctcaccgtgaagccacacgtattcacgaagaaatggctgtagatctaataggtgttaagcccggggctcgcattctggatgcaggttgtggcgttggcgggccgatgcgggctattgcggcccattcacaggctaaagttgttggcatcacaattaatgagtatcaggtgaaacgagcccggatgcacaacaaaaaagctggcctcgattccttgtgtgaagttgtttgcggcaatttcctgcaaatgccctttccggacaacagtttcgacggagcttattcaattgaagctacatgtcacgcccctaag

SEQ ID NO: 2305 - DNA, 667 bp, Artificial
  Synthetic
ctgtatcttgtgatttaggaaaaagatgtcaaaacaaggagcattatttgatttggcatctggggttggtggcaaaattaataaggagaaagttgtgtctgctgttgacaagtatgagaaataccatggttattatggaggtgaagaagaagagagaaagaataactacactgacatggttaacaaatactatgatctttccactagcttctatgaatatggctggggagaatcattccattttgcacccaggtggaaaggagaatcactacaggagagtattaagaggaacgagcatttccttgccttgcaactaggattaaaaccaggacaaaaagttttggacgtaggatgtggaattggtggaccattaagagaaatagctcgattcagctctacatcaattacaggcctaaacaacaatgaatatcagataactaggggacaagagttgaacaacaaccttgattcaacattgaatcaaacttgcaactttgtaaaaggcgatttcatgaaaatgtcgtttcctgacaatagctttgatgcagtatacgcaatagcagcaacttgccatgcaccagatgtagttggatgttataaagaaatttatagagtgttgaaacctggtcggtgttttgctgtatacgaatggtgcatgaccgatgca

SEQ ID NO: 2306 - DNA, 651 bp, Artificial
  Synthetic
agattgtagaggatggcaatgctttccatcgcagctcttcgacggatccagtccgttgctcgagcaggaggaatccgtttgtcttcgtctgctgcagcagttgccaatgaagagtcatacctccgcctcaaagacaaatcacatgtcacgtggccaaaagtactaaatacatctttggaagagatagacccagaagtcacaaatataattgaactggagaagaatcgccaatggaagggtctggagctcattccttcagagaactttacatcactctcagtgatgcaggctgttggttctgtcatgacaaataaatacagtgaaggctatccgggagccagatattatggaggaaatgagtttatcgatatggcagagtcactatgtcaaaaacgggcacttgaggcttttcgcttggacccggcaaagtggggagtgaatgtgcagccattgtcgggttcaccagcgaacttccatgtttacactgctctcttgaaaccacatgacagaattatggctcttgatcttcctcatggtggccacctttcccatggataccagactgatactaagaagatatcggctgtttcaatatactttgagacgatgccataccgactgaacgaaaccacaggcttcatcgactatgat

SEQ ID NO: 2307 - DNA, 613 bp, Artificial
  Synthetic
gaattccagctgaccaccatggctctcaataaactaaagaatataccttctttaacaaacagttctcatagctcaattaacggcattgcatccaatgctgcaaattccaaaccaagcggagcagacacggatgatatcgatgagaatgatgaatctgggcaaagtattctattaaatattatttcccagctgaagccaggttgtgatttatctagaatcacacttccgacatttattctggaaaaaaaatcgatgttggagagaatcactaatcaattacaattcccagatgttcttttagaagcacactccaataaagacgggctgcaaaggttcgttaaagtggtagcatggtacctagcaggttggcacattgggcccagggctgtgaagaagccccgaaatcccattcttggagaacactttacagcttattgggatttgcctaacaagcaacaagccttttacattgcagaacaaacgagtcaccatcctcctgaatctgcgtatttttacatgattccagaatcgaatattagagttgatggagttgttgtgccaaaatcgaaatttttaggaaactcaagtgctgcaatgatggaggggttaactg

SEQ ID NO: 2308 - DNA, 582 bp, Artificial
  Synthetic
cgctatcccttcaattgcatcgatagatttgattctcgactcgaccatcctatcccgaacgagcatttgcaagatccttcttctctttcacctggtacatatacaattgcaactcaatgtcggaaacattgatttcagaaacccacacgcgcgagcggcgtgacctctaccatgaggccgatgttgtcgtcgtcggcgccggtgtctttggttgtgcagctgctttcgctctggcaaaccagggacgctccgtgcttcttctcgagaggtggatgcatgaacctgaccggattgtgggcgagctgctgcagccaggcggcttgacggccctcagaaagctgggcttgggtcactgcgttgaggacatcgacgcaatcccttgctacggctacaacgtcatctaccacggagagccatgcgccattccctatcccaggctcaacgaaaagggcgaagtgacacatgcgtggggaggaagagggacgggcggaacaaagcaagagggatgcggcttccaccacggcaaattcatctcgcagctccgcaaggcgtgtctgggccacaagaacatcacagtcgtcg

SEQ ID NO: 2309 - DNA, 571 bp, Artificial
  Synthetic
gccccgtcgaaagcgaagacttagggttactcgcaacgcaatgcatggatagaagggctggaatggcgcaaggagatctagtgcgccatctctatctcctgccgccgctcagcctggctatcgcgctgctggcgctggtgatctcgctcgccatcacagcgcgaaaggtgagatcttcttcctacggcaatgctgctgcagcaattgcggcggcggacaaggaggacggcaaatccgccagaacttccggggacgatgccgtggattgcatcgtggttggagcaggcatcgccggggccgcgctagcttatgctctaggcaaggattcgaggagagttctgttgatcgagagagattgctctgagccggatagaattgttggagagctgctgcaacctggtggatacctcaagcttgtggagcttggcatgaaagactgcgtggacgagatagaggcacaaagagtccatggttatgccttgtttaaggacggtcgagatgccaaagtcgggtatcctctaaaaggtcgttcggcggacgttgccgggagaagcttccaccacgggagatt

SEQ ID NO: 2310 - DNA, 614 bp, Artificial
  Synthetic
aaacagtgtccgcaaagaaaaaaaatgaccccgacaccaccagcaccactaccacaacggtgtatgatggagaatgcagatcaaaggacgcaaacgacgacgctgacatcatcatcgtcggtgctggcgttgctggtgccgctcttgctcacacccttggcaaagaggggcgtcatgtaaaagtgattgaaagagatttgacagagcctgatcgaattgttggagaactcctacaaccaggtggcttcctcaaattgcaggagttgggcttggaagattgtgtggagaacattgatgctcagcgagtgttcgggtatgctcttttcaaggatggaaagagcactcgtctttcttatcccctggagaagtttcacactgatgtatctgggaggagctttcataatgggcgtttcattcaaagaatgagagagaaagctgcatctcttcccaatgtgaaactggagcaaggcactgttacttctctgctagaagaaaacgggaccattagaggtgttcagtacaaaaacaaatctggtgaagagttgaaagcctatgcaccattgaccatagtgtgtgatggttgtttctcgaatctacggcgtaccctttgtgac

SEQ ID NO: 2311 - DNA, 632 bp, Artificial
  Synthetic
gaacaacatacccacgctctctcgcccgcacattcgttccgacgcatttacaaaccgccagtctctcgctcaacgctcacataaattaatcacacaacagcccacactcacactcacacaaaatggtcacccaacagtctgcagcagagaccagcgccacccagaccaacgagtacgacgtggtcattgtcggagctggtattgccgggcccgctctggccgtggctcttggaaatcagggcagaaaggttcttgttgtggaacgagatctctccgaaccggaccgaatcgtgggagagctgcttcagcccggaggagtcgctgctctcaagactctgggtctcggctcttgtatcgaggatatcgacgcgatcccctgccagggatacaacgtgatctactctggagaagagtgcgttctcaaataccccaaggtcccccgagacatccagcaggactacaacgagctgtacagaagcggaaagtctgccgacatctccaacgaggctccccgaggagtatccttccaccacggccgatttgtcatgaacttgcgaagggccgcacgagacacacccaatgtgactctgctggaggccacagtcaccgaggtggtcaagaacccttacacc

SEQ ID NO: 2312 - DNA, 493 bp, Artificial
  Synthetic
tcgcgatctagaactagtccgggtttacattgataagtgacggatatgcatcccgaaaatgacaaatttgtaagcatgtcactgccggcaaagaaccctgaatgctctagatgcttccgaaggattctccataagatgatatcccatgcagtttgtgccaaaatgggttaacggacgcccgattccgtgggtgtgcatttgattgagacccccatgtttgcagtgaatcggttgggtaagatgcattggagaggatgtacgtaggaggttcatttattgctgctcttattttccatgttattatttaaatacatgatcatattcacatatttacatttgagttgagtgcatctgctatgaatgtttctagaaccatccttagcagctacatcattacgacatatagtggtggtccctctgattcactttcatacacaccctgaacgacacatcttctacacttattaggaaacaaaaaaagcggacgcgtggg

SEQ ID NO: 2313 - DNA, 554 bp, Artificial
  Synthetic
gtttctcaaaacaccaaatgcacctgaatctcagctgagcctcgcccgcccgccaaagtcagttttttatgcttcacgcaatttagaacaaacaaggggaatccgaaaccaaaaccttcctgaatcgccaatcatgggctcctcaagcctgcttgaccagtacggcgacgccgtcagccagagtggccgctcgtctcgtcaccacgcgaagagcagccgccacaagaagcgccgctcgcactcgcactcgccgtcgcgatcccggtcccgggaccgatctcgagatcgtgatcgtgaacgtgaacgggacagagacagagacaggtcgcgctcccggaaccgcggcgggatctttggcggcgagagcggccaccgcaggcacagcggctccaagggctcgttctttggcctgggtggcggtaataacagccgctccagcctgtttggaagcagccgtccctcgtactacaaacgctctcctcgcgagggcttcgtccagcgctgcatcaagcagctcaagcgactcctccgcgaccttcagcactacgccaagc

SEQ ID NO: 2314 - DNA, 692 bp, Artificial
  Synthetic
gctatggagccagtatcaaacggtgccgggacaagcagcccgagtctttcttctcccagagcgctgtttcttgaatctttgtttccgccacatcctccgtgaagcccgagaaaaaaacatctctagcatcagaagatcctataaaagataaaaaagacttatacaaaaaatccttcctcgcaagggaagcgccggagcaacaacatgcccatagcactgtcccctcccttccggccaagaaatggcttgaccaagttcaccaactgccgcctcctgcgcggcgataagctggtcgaggaggatctctgggtcagctcgctgtctggcaaggttgtcaacagccaggctgcctttttcgatgacctcgttctccctgaccagaccatcgacctcgacggccgcatcatctcgccgggcatgattgatgtgcagctcaacggcgcgttcggcttcaacttctcgacgctgctcgatgacatgtcacagtacggcaaaaaggtcaaggaggtgcagaagttgctggtgcagacgggcgtcacatcgtacaatcccaccatcaccagccagaggccagaactataccagaaggctcttccgttcctaggaccgtcagggcacttgcaggaggccgaagatggggccgagtcgctcggcgctcactgcgaggggccgttcctcagcccgaccaagaa

SEQ ID NO: 2315 - DNA, 164 bp, Artificial
  Synthetic
gtgccgggacaagcaccccgagtcttgcggctcccagagcgctgtttcttgaatctttgttcccgacacatcctccgggaaccccgagaaaaaaacatctctagcatcaaaagatcctataaaatataaaaaagacttatacaaaaaatccttcctcgtaaggg

SEQ ID NO: 2316 - DNA, 484 bp, Artificial
  Synthetic
caagaaacaaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactgctgttcagaatggctctactagctgtgtcattgctgcttgtggcgtttctgtcgccattaaccaagttctgcctgccacccaggctctttgtgccaaccagtgaactcatccatcgagagggagaaaatgacatgggagaaaatcaggtactcttgtacattgacaaacaagtacatagctgaatggtgtgaatgaataaaacgcattgctgctggacaccgctctgttcatttctgcaaaaa

SEQ ID NO: 2317 - DNA, 79 bp, Artificial
  Synthetic
gcgcttgcgcacattgcattgctgttcagaatggctctactacctgtgtcattgctgcttgtggcgtatctgtcgccat

SEQ ID NO: 2318 - DNA, 707 bp, Artificial
  Synthetic
gctttcacagtccagctacattcgttgtctgaacactaaaccaaaaaactccaaaaaaaacaacttaatacacacccccccaacaacacttaataccgacaagatgaaggccgctttcgttgctgttgctctcgccgctctggcccaggctcagacccgcgctgatatcccatcctgcgctctgccctgcctcgacgacgccgtcaaggccaacaccaagtgctccaccaccgactacgcctgtatctgcaaggacttcaacgctgttcagggcgctgccaccggctgtgtcgttgagaagtgcggtaccgacgttgccatcaacaaggtcctccccgccactcaggctctctgcgccgccaactctggatccggctctggctcttcttctgctgccaacaccactcccgcccagcagaccacctctgccgcccagtcttcttctgctgcccagtcttcctctgctgctcagtcctctgtcgccagcgctccccccagctctgcccccgcccagaccacctctgctgcccagaccactcccgtcattcccgttggcactggcactggcgttccccccgctggcaacaagaccaccaccggtgctcccaccgcccctaccagcggcgcttccaccatcctgcccggccttgccttcatcgccgctctctgcgcctttgccctgtaaggggtttgacaatgaacgacga

SEQ ID NO: 2319 - DNA, 570 bp, Artificial
  Synthetic
aaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactgctgttcagaatggctctactagctgtgtcattgctgcttgtggcgtttctgtcgccattagtatgtgctcccctctcattttggtcgaggatatttacgtctcaaatgcttatgtatatttatagaccaagttctgcctgccacccaggctctttgtgccaaccagtgaactcatccatcgagagggagaaaatgacatgggagaaaatcaggtactcttgtacattgacaaacaagtacatagctgaatggtgtgaatgaataaaacgcattgctgctggacaccgctctgttcatttctgtatttcaatgagtattcatgcgatatgtagcttga

SEQ ID NO: 2320 - DNA, 550 bp, Artificial
  Synthetic
ggagctcatttctctcttttaaattcaatttctattttctctctctcaaactatggaaaaatgtctggacgtggcaagggaggtaagggattgggcaaaggaggagcaaagaggcacaggaaagtgctgagagataacatacagggaattacaaagccagctattcgtaggcttgctcgtaggggtggtgtgaagcgtatttctggtttgatttatgaggagacacgtggagtgcttaagatctttttggagaatgtcattcgtgatgctgtgacctacactgagcacgcaagaaggaagactgtaactgctatggatgttgtgtacgctctcaagaggcagggaaggaccttgtacggatttggaggttaaatattgggggttagggttcatagtattttgttgttagtgattgtggatttcatgtttgtgctttctggttgagctagtggtcagtttaaggtaggttagtttaatttctgttgttaaggtctggatattgtaattccgcgttatacaatcaagtaaaacagaccattttaccctattg

SEQ ID NO: 2321 - DNA, 555 bp, Artificial
  Synthetic
gccattacggccgggggaatccgaatcaaccacatttttcgtcatttcaaattcaaaaatccccaaaaatctagtttcacaatgtcaagaggaaagggtggaaaaggattgggcaaaggaggagctaaacgacaccgtaaggtgcttcgtgataacatccagggaatcacgaaacctgcaattcggcgtttggctcgtagaggaggagtgaaacgtatttctggtttgatttacgaggagacacgaggtgtattgaagatatttttggagaatgtgattcgtgatgctgtgacttacaccgaacatgccaggagaaagactgttactgctatggatgttgtttatgccctcaagaggcagggaaggactctctacggatttgggggttagatttgtctaattagagtttttgtggggtaatgattgtagatttgttctttactatctgatgtattagggttggttagtttttgttgagattttataatgtaattctctattacatactcaggaatagtaattgcccaaaaaaatctaacaagcttctagtagtat

SEQ ID NO: 2322 - DNA, 602 bp, Artificial
  Synthetic
ggtttaccatctgcatctctttttgatatctcaaaactccccaaacaacccacatcaatcatcatgactggacgcggcaaaggtggcaagggcctcggcaagggtggtgccaagcgtcaccgcaagattcttcgtgacaacatccagggtattaccaagcccgctatccgacgtctcgctcgtcgtggtggtgtcaagcgtatctctgccatgatctacgaggagacccgtggtgtcctcaagtccttcctcgagggtgtcatccgtgatgccgtcacatacactgagcacgccaagcgcaagaccgtcacatcactagacgttgtctatgctctgaaacgacagggccgcaccctgtacggtttcggtggttaagcgatctgccactaggtcgggtcgacataatgtgttattcgcgtgtttgttacgattgggcttttcactatgggcgcgggtcattgctttttgagattttgtactgtacaacgtactgggaaatgggtgacccccgaaagggggtaattgagacttattcagtggtgaccttgaaataaagcatcacatatactctacaagtaaaatctttctgcctgattgtgaat

SEQ ID NO: 2323 - DNA, 387 bp, Artificial
  Synthetic
gggcccacgcgtccgcccacgcgtccgaaacaatgtctggccgaggaaaaggtggtaaaggacttggaaagggtggcgctaagcgacaccgaaagattcttcgagataacattcagggtatcactaagcccgccatccgacgtcttgcgcgacgaggtggtgtgaagcgaatttccgcccagatctacgaggagacccgaaacgttctcaagtctttccttgagtctgttattcgagacgccgtcacctacactgagcacgccaagcgaaagactgtcacttctcttgatgttgtctacgctctcaagcgacagggccgaaccctttacggtttcggtggttaattatttatattatatatgatattggaatggatttattatactg

SEQ ID NO: 2324 - DNA, 588 bp, Artificial
  Synthetic
tggtgcgaaaaacgtcattttgcaaagtgacgcgtttataacggatttctatatcttccgactttttcacattttaatacattcatcatgactggccgtggaaagggtggcaagggcctgggcaagggcggtgccaagcgtcaccgaaagattcttcgtgacaacattcagggcatcaccaagcctgctatccgacgtctcgctcgtcgtggtggtgtcaagcgtatctctgccatgatctacgaggagacccgcggtgttctcaagtccttcctcgagggcgtcatccgcgatgccgtcacctacactgagcacgccaagcgcaagaccgtcacctcgctggacgttgtctacgctctcaagcgacagggccgcaccctctacggtttcggtggttagagcgttggacgcgttgttttctgctgtctgcgcggtggcgatgtggagctggggttatctgtgcaaataacatggactcttctgtactttgatcgattggcgttgggggaatgggcttacgaggaggcgtcatggtagacgaccttataaatgagaataccacatgaatacaaatacgataatcatttg

SEQ ID NO: 2325 - DNA, 517 bp, Artificial
  Synthetic
gccattacggccggggatctcaaatcaaaattcatattcttctcagtttaattacgctacctacaaaatgtcaggccgtggaaagggaggcaagggtttgggaaaaggaggagctaaacgacaccgtaaggtgctccgtgataacattcagggaatcacaaagccagctattaggagattagcgagaagaggtggagtgaagagaatcagcgggctgatttatgaagagacaagaggagtgttgaagatatttttggagaatgtgattcgtgatgctgtgacttacacagagcatgctaggagaaagactgtgactgcaatggatgttgtttattctctcaagagacaaggcaggaccctttatggatttggtggttaatttatgtatttttatttgttttaggggagatggagtttagttggtgtttaattagtgtttgttgatgaatgttatgaggttgctgtaattgagttctttgtgttaatgaaatggatctcattactatttctgataaaa

SEQ ID NO: 2326 - DNA, 554 bp, Artificial
  Synthetic
cccccccccctgaaaccaaaaaaatccccaaatctcaaatcctcctccgtctccaagctctcgtcgtcgtcgtcagacatgtcgggccgtggcaagggaggcaaggggctgggcaagggaggcgcgaagaggcacaggaaggtgctgcgcgacaacatccaggggatcacgaagcccgcgatccggaggctggcgaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgattccttccttccttccttcctggtggcgtgcgggtggtggtggtggtgtaggagctagggtttcgatgggattcggggggaatttctgctttgtgttggcttctgtgtagcgactcttctgtttaaatgaattcgatgaatctgaactgaagatttggttcccc

SEQ ID NO: 2327 - DNA, 514 bp, Artificial
  Synthetic
gccattacggccggggatctcaaatcaaattctattttcttttcagttcaattactttaccaacaaaatgtcaggccgtggaaagggaggcaagggtttgggaaagggcggagcaaaacgacaccgaaaggttctccgtgataatattcagggaatcactaagccagctattcgtcgattggctcgtaggggtggagtgaagagaatcagcgggctgatttatgaagaaacaagaggagttctgaagatttttttggagaatgtgattcgtgatgctgtgacttacactgagcacgccagaagaaagactgttactgcaatggatgttgtttattcattgaagagacaaggcaggaccctctacggatttggtggttgatttatgtattttaggttttttaaggggaaatggagctcagttggtgtttaaaagttgtattgttaatgaaggttattaggtcattgtaacgagttatttgtgttaatgtaatggatctcattagtatttcagatg

SEQ ID NO: 2328 - DNA, 501 bp, Artificial
  Synthetic
gggtgctagagcaacagcagctaggaaatctctcgtcgtcgcggcaatgtctggaagaggcaagggaggtaagggattgggcaagggcggcgccaagcgccaccgcaagcatctccgcgataacatccagggcatcaccaagccggcgatccggcgccttgcccggcgtggcggcgtcaagcgtatcagcggcttgatctacgaggagacccgaggcgtcctcaagatcttcctggagaacgtcatcagggatgcggtcacctacaccgagcacgccagaaggaagaccgtcaccgccatggacgtcgtctatgcgctcaagaggcaaggcaggacgctctacggatttggcggctagaagaagaaaattagaagctctccatctccttggaaaatttctagttttcctcgatttctaactggtagacaaggaagaaatattttcctttgcattccatccaccactttgtaatattcgaatctaatgtagaatcttaaatc

SEQ ID NO: 2329 - DNA, 551 bp, Artificial
  Synthetic
gccattacggccggggacaatattccgaatcaagaacatatcttcccatatcgagctcaaatttcaaaatccccataatcgtttcacaaaatgtcaggaagaggcaagggaggtaaaggattgggtaaaggaggagcaaagaggcacagaaaagtattaagggacaacattcagggaatcactaagcctgcaattcggcgtttggctcgtaggggtggagtaaagcgtatttctggtttaatttacgaggagactcgtggggtgttgaagatatttttggagaatgttattcgagatgctgtgacctacactgaacacgctaggagaaagacagttactgcgatggatgttgtttatgcgctcaaaaggcagggcaggactctttacggatttgggggttaaatttttcaaattagggtttttgtgggtaacttttattatagatttgtacttttgctgccgttgtgttttagggttgcttagattttggtaaggtcgatgatgtaattctcgttacatattcaaggaatagtaattgcttggtcctcaaa

SEQ ID NO: 2330 - DNA, 595 bp, Artificial
  Synthetic
ccccccccccgtcgaatacatttcatttctgatttcaattcaaaccaaaaaccctaggtcaaagttctgtgtgaaaatgtctggccgtggaaagggtggcaagggattgggcaagggaggagctaagaggcaccggaaggtgctaagggataacatccagggaattacgaagccagcaattcgtcggttggctcgtaggggaggagtgaagcgtatatctggtctgatctacgaagagacacgtggagtgatgaagatctttctagagaatgtgatccgtgatgctgttacctacaccgagcacgccaggagaaagactgttactgctatggatgttgtttacgcactcaagaggcagggcaggactctctatggatttggtggttaggttgtttagtttgtgatttaggttggtgtacttgtggtaattgtagattttctggaaatttctgttgtttcggtgttggtttctcagcagctttgttctagttgtcgttcttaaggtcttgatattgtaatttctcattgcaaattcaaggaacaaagttcattttctagaaattacaatggttaaattgattgtttgaaacgacca

SEQ ID NO: 2331 - DNA, 471 bp, Artificial
  Synthetic
aaattcattcatggttaaacggaaaaattacaaatttgaaatccctaaatgctgaaattgaaaagtttacaaaatccgaatttgcaatccgaacgatttacccgccgaatccatacaaagttcgtccttgttttttgaaagcgaaaacaacgtccttcgccgaaacagttttccggggagcgtgctccgggtaagtaacggggtcacaaatcacgttttcaaaaaaaattttgaaaaccccgggagttttttaataaataaaaccattgatacgtttaacgcctccttttttggggagacaacaaatcgcaggttgggaaatccctgggaggtggtctttgagtactttccgaggtctttgggctcctccttttcctaatccttttcctccttttcctgggccggacatttttttttggggaaattaatttcgaactaaaaaaaaaattttttgatcggacccgggggtca

SEQ ID NO: 2332 - DNA, 414 bp, Artificial
  Synthetic
gcagcatgtcaggccgaggaaagggaggaaaaggattaggaaagggaggagccaagagacatcggaaagtactcagagacaacatccaagggattaccaaacctgcgattcgtcgtctcgcgagaagaggaggcgtgaagcgtatcagtggtttgatctatgaagagactcgcggcgttctcaagatctttctcgagaacgtgattcgtgacgccgttacttacacggagcacgctcgccggaaaactgttacggcgatggacgtcgtttacgctctcaagagacaaggacgaactttgtatggattcggcggctaaatcgttcggattgcaatttcggattttgtaaactcttcaatttcagcatctagggatttcagatttgtaatttctcagttaaacgatgaatgaattg

SEQ ID NO: 2333 - DNA, 560 bp, Artificial
  Synthetic
gccattacggccggggatcgccctaatcattatctctcgcacaatttttcagcttcagggtctttaatttgcagagaaactaaaggttgattgaaaatgtctggacgtggaaagggaggaaaaggattaggaaagggaggagcaaaacgacaccgtaaagtcctccgcgataacatccaaggtatcacaaagccagcaatcaggcgtttagctcgtagaggaggagtgaagcgtatcagtggactcatctatgaagagacacgtggcgtgcttaagatctttttggagaatgtcattcgtgatgctgtaacttacactgagcacgctaggagaaagactgtgactgctatggatgttgtgtacgcgctcaagagacaaggaaggactttgtatggttttggaggttaatgtgaaacttttattttttctgcaagagtcttgctgtcaagaaaacaacaagaacggttaccatatggtatatgaggtttgttttgcttttgattagggatctgattcggtgtaattagtttggttacctattggtgataggtttctttttt

SEQ ID NO: 2334 - DNA, 289 bp, Artificial
  Synthetic
actgaatgagacaagagacaagagacagaagagatcgggaccggcattcgggggggacaccctggccgaactaaatcaatccgtgctactgtacgtcttacacgatttcggctctgctaggggccccgaatggccacggagcccatggacagagagagaaaagtggcggatcaggatgaggctgatggtgatggatgatgccatgctgcttttcgtctgaaacgacttacttttatgtagcttgtgaggccataatctcgcagataaataacacgaatatttcctcacc

SEQ ID NO: 2335 - DNA, 657 bp, Artificial
  Synthetic
aacatttggcaattcctcaagctcacccatttgttgactctggcagtgtagcacacagtctgctcaacaaaccacatcaccatgtccgccgaagagaagaccacggtggcgaccgacgtcgcaaatccccccagtcgcgagcatgaagttgtccacggcgacgagagcaatgtcgacgtgcctctagatttgcccgcaggatggaagtacaggcagattagccttttcggctacaagatgccttggtacgcgtcgccccgtgtccagctcctcatggttgcttttgtctgcttcatgtgtcctggcatgttcaacgcgcttggtggtttgggaggtggtggtcgtgccagcgcgaccttggctgacaacatgaacaccgccctctacagcgcatttgctgtcttcggattctttggtggcaccatcgttaacaaactcggtgttaaatggacactcgctttcggcggcatcggctatggtatttacgccatcagcctgctggtttccctccataagaccgaacagggtttcagcattttcgctggtaccttccttggtatctgtgccggtcttctatggactgctcagggcaccatcatgatctcctacccaaccgagaaagagaagggccgatactttgcctggttctgggctatc

SEQ ID NO: 2336 - DNA, 654 bp, Artificial
  Synthetic
aagatgctgcgctctatgggtctacgaggcaatgccttgacgcagaccacccgactggctgcatccagggccatgtcgagccaggcgctctccaacccgaccctgtccaacatcgagaaacgctgggagggaatgcctctccaggagcaggccgacctgtggatggccctgcgtgaccgcatgaagggcagctggaacgacctgaccctgcaggagaagaaggccggtaggtggtgcaccttgagtttttcttactggatcgccttcggccctcacggcccccgcaccgttgacgctcccggagccggtgcccgtgttgcctggggagttgccgttggccttgccgcctctctcgctctcttcgctgccatccgagttgccgccaagcctgcgccttacaccatgaacaaggagtaccaggaggccactaacgagcttctcaaggctcaaggtgctgatcccctcactggtatctcttctcccggctatactggcaagggtgttgttcagtctcctcccaaaaactaaaataaaacacgataatatcgcttcaagcttcgcacaattggggcgggcatgggagaagttttatcaaaacgacatttgtacatgtatagctttagtcctagagagtatgcaagacagggttctcgc

SEQ ID NO: 2337 - DNA, 998 bp, Artificial
  Synthetic
acaagatgctgcgctctatggttctacgaggcaatgccttgacgcagaccacccgactggctgcatccagggccatgtcgagccaggcgctctccaacccgaccctgtccaacatcgagaaacgctgggagggaatgcctctccaggagcaggccgacctgtggatggccctgcgtgaccgcatgaagggcagctggaacgacctgaccctgcaggagaagaaggccggtaggtggtgcaccttgagtttttgtgaaaatccctcccgggagagctggcttgagcttcctgcctcgatccggagctgcagactcttttcttctctctttattctctctcgaggacctacaacagctcgtatgacaacgatcccggcaatccgctcttaattggcatggaaactgttcaccaaatcgaggcgggccaaggtgctcggtgtcatcaattcctggaccgagtgggctgggaattttatgccaatcaagaaagagcttttgccaatacacataaaacatatgttcaacacgtcattaccactgctactagcacttattatcatcttcttcagctgctaacttcatgtcatgacaatagcttactggatcgccttcggccctcacggcccccgcaccgttgacgctcccggagccggtgcccgtgttgcctggggagttgccgttggccttgccgcctctctcgctctcttcgctgccatccgagttgccgccaagcctgcgccttacaccatgaacaaggagtaccaggaggccactaacgagcttctcaaggctcaaggtgctgatcccctcactggtatctcttctcccggctatactggcaagggtgttgttcagtctcctcccaaaaactaaaataaaacacgataatatcgcttcaagcttcgcacaattggggcgggcatgggagaagttttatcaaaacgacatttgtacatgtatagctttagtcctagagagtatgcaagacagggttctcgc

SEQ ID NO: 2338 - DNA, 406 bp, Artificial
  Synthetic
gattatattgtttggcaggtttcggaggctgattgagtcggaggggctgccttattgcggcagaggaatagtgacgtcatgactatcaaggaccctggaggttacctaaaagaaaagcatctggacgagtgttagagtgtgcgaatggatctcattgtttgaattgatgaatctcggaagatctgagctagctgcaagatgcctcaagccatgcgcaaggcacgtgtggatggaggcaagattggatggagatttactgtaaatcttccaactttaactatagaagggaaagggggaaagaggcgatcgctataccgctggttggattcagctccagggacagatttcatcaaaacaagcgatgaactgtgtggtgacatatatatacgagtacgggtttgatcat

SEQ ID NO: 2339 - DNA, 618 bp, Artificial
  Synthetic
aatctctttgtatatctgcccttttttcatcatcgtaatattgacgcactttgagtaagattttcactcacctcaaaaggagcactttcactgctggaaaccaaaatctcttgggatccccaaattaagccagacgtactccgtacctacaggacccagttacaaccgtagagaatcctctctccaatcgcctccaatcgtctccaactttggcgtcagatagtacatcgagccgccaattttttttttctcttttgagtcattctccattcgacgtttgacccgccatcggagccttgtcttgccgactttcctcttaactcccgggcttcccttccaaacttttaatcttccaccgcaacatcttttcttcctttcttcttctttttcctttcttcactgaaaaggaaattcaatcattcatcatccttctcacctctacatcatcctcatccgtcacaatggctccctctgctatcccaacccaggacgtcgacctgaccgccgccaatatccaggtcaaggaggccactcagcccgtcaagcccagcaatggcactactcctgctcccctcgatgcctccaagctcacctacacctacactaagaaccctcagc

SEQ ID NO: 2340 - DNA, 625 bp, Artificial
  Synthetic
cccacgcgtccgggatcttggtgggcaccacgacgttcttctccatcctcatcttctcgatcaacactgtctttgctcaggaaacactcgcgcagtggattggagattacctgactcaatctgctggtgttacggttgtcttcgaatcagccatagtgcccaagtggaagaatggcgttatcgcatttcgtaatgtgtttatttcaagaagacccgggcagatcgaatcatccgtcagcaagggatcgtctgacgctgctgctgttgctgccgcagggcgccaggttcagcataacgggactgttaccgaagacgatggcaactatacgcaatttgatgtaacgatcgcaaacgtcaatgtcacactttcattcctcaactggtggaatggcagggggcttctcaaagatgtggaagtaaatggtgttagaggaattgtcgatcgcacctctgtccgttggccactgcagcaaatcgaccccttgtcttaccgccacaaacaccaaccaggcgattttgagattgaatctttcaaattggaagatcttttgctcaccattcgccaacctgatggcttccgccccttctcagtgagcatatactcctgcgaactccctcgactgag

SEQ ID NO: 2341 - DNA, 304 bp, Artificial
  Synthetic
ggcgcccaggagcaatgtctcagggcccaacgaatgtgcggtgaacgagctgctactgcaccgccgattgtctgatgcaagcaagggagttgtttgtttgctccatccttgattcactttaatgcttgttattaggtactttaagagccaggttgaaagggtactttgcaagtgcttaaatctccattctgccttatactccatgcctgtaattgtatagtagcaccagggtaagccagcaataccgcaagctggcagtatcaatcgccatttttctctacaaaaaaagaaagaaaaaaaaaac

SEQ ID NO: 2342 - DNA, 244 bp, Artificial
  Synthetic
gatgaggacgatgttgaggatgtgattggagaagacatggacgaagacatttatgattaagcggattgatcaatccaggaaacaaagtttcacccaaaagttatttttcttttctcgtcacggatatggcatacggagtttcaggaggaaatggggaaaccgtttttggtttgagtaattactcataaattggccctctataatgtatcataactaaaaatgaaaatattgttcattaaaaatg

SEQ ID NO: 2343 - DNA, 624 bp, Artificial
  Synthetic
gagagagagagagagagagagagagagagagcacctgcaccatgagattccaggtccagtgtaaagctggtttgtttcgattcccaaattagaaaatctaaggtcttttatccaagagcacgaaggaagagatatagatatgggcaggctgtacttgctacgcctagatggcaaaatttatagctgtcgctactgcaggagccacttggccagctgtagtgagttaatctcaaagacttttcactgcagacttgggaaggcttaccttttcaacacagtagtcaatgtctcagcagagcctgaggaagaccgggtgatgacgacaggcttgcacaaggtttctgacattttttgcaaaggatgtcatcagattgttggctggaaatatgaagaagcatatgaagagagccagaaatacaaagaaggcaaatttgttctggagagagcaaggataatagacggtaatggcgatagcagtggattctacttggaatccaatcaagcctgcagtgatgaagaggaggcttgatagtaataatatatcccacttgcaatatgttaaatgtgctatttacatacgctaatataatatatatagtaatgtaggcgcatgtggaatggtat

SEQ ID NO: 2344 - DNA, 673 bp, Artificial
  Synthetic
gatttctccaccactcgctcggcatttgttctctcttcctcagcgatttaaaggacctgacccgtctcacgaatcaagaggcataaccgttactgccatctcagaccgctaagcagcgatatcgtcatattcgcggcgctgtgaaggacaagaacgagaacgagaactgttgaagcttggctcacccagtccccgcagcaatgggcctggcctacaacacctacctcaccagcaacaagatctacggttgcaaaacatgcaaggcgcatcttgcgaaccacgaggacatcatctctcggaacttccggggccaacatggcaaggcctacctgttccatcgtgtcgtcaatatcgacaccggtgaccctaatgagcgtaacatgaccaccggccgccacattgtccgtgacatcgcctgccatcagtgcaaagaaacggtgggttggaagtacgacaaggcttttgagacttctgaaaagtacaaggagggcaagttcatccttgaagctgagctgctatgtaacgtcgcttgattgtacgaatttcacctctttagcatgatttcatcaagatgggcccttcttttttctctcatgtttttgttcttggcttcaataggcgttcaacagatagtagtttcagacaaagcacagcatccttgggctggagtgat

SEQ ID NO: 2345 - DNA, 592 bp, Artificial
  Synthetic
cccccgatctctctctctctttcactgtttcttcctcctctgcacttggcgcagcacaaagtcgattcctttccgcctcagcggcgccgcttgtttcgatcgaagcatcgcgagaggcagcccgccgcctgggtttcgtgccgattttgatttcctttttcttggccgcctctgcctctctctctctctctctctctccctttcttggttcgattgttcctggttcttggcctgattggttgaacctgcttcttctggaatcaattaggggagaaatatttgcaggagaggggcggtggcgatggcggagttggttgggccgcgggtgtacagctgctgccattgccggaaccacgtctgcctccacgacgacatcatctccaaggcctttcaggggaggaacggccgtgcgtttcttttctctcatgctatgaacatatctatgggtccaaaggaggacaggcagcttatgacagggcttcacacagttgctgatatctactgccgtgattgccgtgaggtattgggttggaagtatgaaagagcatttgaagaatcccagaagtacaaggaaggaaaattcatatttgag

SEQ ID NO: 2346 - DNA, 603 bp, Artificial
  Synthetic
ggagtggagtaggagtagttggggatatggggttgttgttccgggagcacctgagcggacctcgcatctactgctgcagcaactgccggatgcacgccgccaaccaggaccgggtctacgtcaaaagctaccagggccgctttggttatgcctatatcttcaattccatggtgaatgtgtgcctttcttctaaagaacgtgtgcacatgactggcttgcacaccatcaccgatattcattgcagctcgtgccatcaaatccttggttggagatatgaaaaagcttatgagcagagagagaagtacatggaggggaagtatatcatggagagatctagaatggtcaaggagactcactagcttcattttatttttttcccaactttgtatactcacaacatgaaaattaaaagagaacaaaggctatttacatatatttgcagccctttttaggccattaattgcaaatttagctatttttcaaaattaggagattcttttttggccaccaaaaccactttttggaccaaaaaaatagaaagcaatagtctaaatttgattaatgtaatgtcatttatgaggattaattgcctaaaaatgtata

SEQ ID NO: 2347 - DNA, 637 bp, Artificial
  Synthetic
gagagagagagagagacacacacacacacaccattcttattacttgcacagattacctatggctttctctctctctctggaggagaaagcttttggagctggtttttgcctccgcccaatttagcacatctgtggttttggtgggtcaaggtctccttttttctttcaaagtgaggaaaaggaataaaacacacatatgggaagactgtacttagtgcagctggatggcagaatttatcaatgttgttactgccggagtcacttggccagctgcggcgagttagtctcaaagcgttttcattgccgactcgggcaggcttaccttttcaacacagtagtcaatgttttggaggggcctccagaagatcgaatgatgtcgactggcctacacaaggtggttgacatcttttgcaaaggctgccatcagattgttggttggaaatatgaagtagcatatgaagagagtcagaagtacaaagaagggaaattcatattggagagagcgaggatgatagatggggaaagtagagaatcctatttggaagtcaatcaggctggaaattatggagacgaggttcaatagttgtctactcttgtttcaagtgcaatattttaatggacatatatgtgtacatat

SEQ ID NO: 2348 - DNA, 681 bp, Artificial
  Synthetic
  misc_feature (118)..(118): The residue at this position can be any nucleotide.
cgtcgagatagatagatagatagatagatagagagacagcataaccaaaccaagccaagagagagagagagaggagcatagcaaagcaaagccaagcctccttcatgggtttccctgnatttaagatctatcatttgagagctctaaaatctgcagaataacgctacaaaaaacagattctaggaccgtgaaaggtatccatttttttcctagagtgggggagatatcataattatacatatgggaaggctgtacttagtgcagctggaaggcaaagtctatggctgccgcttctgcaagagtcacttggccagctctagcgagttagtctcaaagagttttcattgtaagaatgggaaggcataccttttcaatacagtagtcaatatttcccaggggcctcaggaagaccggatgatggcaacaggactacaccgggtttctgacatcttttgcaaaggctgccatcagcttgttggctggaaatatgaagctgcatatgaagagtgtcagaagtataaggaagggaagtttatttcagagagagcaaggacaatagatggagatggtactcaattcttcttggatgtgagtcaaggcagcagtgatggagaggaggcctgatacttcctttcttcaatatacatctttcaacacaccttggtatgtagtatatatata

SEQ ID NO: 2349 - DNA, 620 bp, Artificial
  Synthetic
gcaatctccagcgcgggtcgatgatcgccgcggcgcgattggcgggcgagattccggtcgattgaatccattgatcgatcggttgattgattgattgtcgccttggattttggctggtcccaagaaagggggctttggcgaaattcgcgtgttcttggcggatttccaccaccggcgctgcccccggtctctccaatgcaaggattttgagacaggtcgactgattcgtatcgatcaagggagatggggaggctgtgcctgattgaattggacggacgattctatagctgccattcgtgccggacacatctcgcaaacttcgatcaattgatgtcaaaggcctttcactgcaaacacggaaaggcttatcttttcaacacagttgttaatgtgtttgagggaccattggaggagcgggtgatgaccactggtatccacacggtggctgacatctactgcaaaggctgccagcagaacgttggatggaaatacgaagccgcgcagcacaagtcccagaagtacaaggaagggaaattcattctagagagaagtagagttgtaggctgtgagagaggcgatttctatctggaaacccaggcgattggaagtgacccggacga

SEQ ID NO: 2350 - DNA, 579 bp, Artificial
  Synthetic
  misc_feature (277)..(277): The residue at this position can be any nucleotide.
  misc_feature (290)..(292): The residues at these positions can be any nucleotide.
ttttgatcctatctttctttactgagttgttttagttgtcaaccttaattccgagtcttcaatttaatactgatccaaaagtcttctaaggcaaagatggggagactatttgtgttgactcttgaaggcaagatctatagctgcaaacactgtggaactcatcttgctctttctgaaagcatcgtttctaagtctttccactgccgacatgggaaggcttatctcttcagtaaggtagtgaatgtcacttctggcgagatagatgaatcagaatggnatgattgaactgnnngtatgcaccactgtggccgatattttctgcgtctgttgtgggtcaattgttggatggaaatatgagaccgcccatgagaagagccaaaagtacaaagaaggaaaatccgtgcttgagcggtttaagatttctggccctgatggaagccattactgggccagtcatgaaacgcatgttgcaggaagtgatgctgatgatgtttgatcacctcatctcaccgtcagataaataattctatcccaaatgtacattctttaactcaccaccccattgtattggattcttga

SEQ ID NO: 2351 - DNA, 640 bp, Artificial
  Synthetic
gagagagagagagagcacctgcaccatgagattccaggtccaggtaaagctggttgtttcgattcccaaattagaaaatctaaggtcttttatccaagagcacgaaggaagagatatagatatgggcaggctgtacttgctacgcctagatggcaaaatttatagctgtcgctactgcaggagccacttggccagctgtagtgagttaatctcaaagacttttcactgcagacttgggaaggcttaccttttcaacacagtagtcaatgtctcagcagagcctgaggaagaccgggtgatgacgacaggcttgcacaaggtttctgacattttttgcaaaggatgtcatcagattgttggctggaaatatgaagaagcatatgaagagagccagaaatacaaagaaggcaaatttgttctggagagagcaaggataatagacggtaatggcgatagcagtggattctacttggaatccaatcaagcctgcagtgatgaagaggaggcttgatagtaataatatatcccacttgcaatatgttaaatgtgctatttacatacgctaatataatatatatagtaatgtaggcgcatgtggaatggtattttttcttttttcattccattttgaatgcatcta

SEQ ID NO: 2352 - DNA, 671 bp, Artificial
  Synthetic
ggcttctggaaatattctagcctccgccctgcattagatacccgaagactcgggcaggctgtattctgcgcccaagatctccaagtgccggcaccaacccgcgcgctacgggcttttttgtttttgtgtgtgaataccccaatttctggaaaatctccaaaaagagcaacgaaacagccccaaaatgtcccagcgggctagttcgggagactcaccgtctgtgggagcagaggagaagggaaacgcaggcaaggccgtgcaggacactgctgtggtgcagcaatcagacgctgccttcacaaattcatacgatgaggaggatttctggacgaggaacggcttgaatgccaagtcattccagaagaaacactatggattgggactggtggaactggaccgagcgatgaagacaaggcacttacagatgattgccattggaggctccattggtgctgggtttttcgttggctctggtggtgctttggccaaaggtggtcccgcctcggttcttatttgcttcctcgtcgtcggtttcatggtcttcaacgtcgtctttgcccttggtgaacttgccatcatgtacccagtttccggtggtttctacacatacgcaactcgcttcatcgacccctcgtttggctttgcagtcggatgaaattattcttcctctg

SEQ ID NO: 2353 - DNA, 579 bp, Artificial
  Synthetic
cccacgcgtccgcccacgcgtccgggcaaagagattctacatccataattccatcacatgccgcttgcctcgtcatcattatttctcaagcagcacattccgtcaaaaccttgtgttgagccgtggcaatagccagaaagtatcttgctcaaccctcactcagcttgccttgtcgtttcctaatctaccaacatgggatgcctagaagtctgggccttccgtccatttaccgtggcgtcggggacttgactgattccgaggagttctggtgacacagcacgcaaggcagccattcctcctggttaagcatatctctttgccatcggattccgaagaggccgaaatttggaaccgcaatgacagatcccgttgataacggcatgccggggagtgtcattccagtattacgcagcgtaggggcggcggttcggtttcgagctacgggcatgctatgcatttggaagaacctttttgttttcgtttactccggttacgcggaaaaaggaaaggagacgggaagctgagttgttcatcgggatccgtttggctccgtgatgatgagttttgccttggagatgg

SEQ ID NO: 2354 - DNA, 50 bp, Artificial
  Synthetic
aaggcaaaactcatcatcacggagccaaacggatcccgatgaacaactca

SEQ ID NO: 2355 - DNA, 893 bp, Artificial
  Synthetic
gacgaagcatgtcattcaacaacagccaagggtagttgctttagggggcccagcaaatcgacagggtcgactcgccgcagatgatatagccggcagaccagtgcactatcgcggcaacatcggcacaatcatctgtcaggtcttcgatttaaccgtcggtttagctggcctgtccgtctcggcgctgcgtgacttgggacaggagccgctctgggttacagtgcatcctccacaccatgcgaggtattatcctaacgctcgtccaatcacgatcaagaccgcgttcgaaaagggcacaggccgtattctgggggtgcaggcagtgggaatggctggcgtggacaaacgcatagacgtcctggcaacagcgatgcaagctaggatgacagtcaatgacctggaacatctcgaactgagctacgcaccaccctatagctcggccaaagatcctgtgaacatggtcggatttgttggctcgaacttgctccgcggggactatcagatcgtacacgccgaagacattaacatcaagaatcttcatgcctggcaagtcgtggatgttcgcacacccgaggagtttgcgactggccacctcccgggggcaatcaacttgccaattgcaacactgcgcaatcagaaattggagcttgaccaatccatgccaattcttgtgtactgttatgtgggctatcggggatacttggcctaccgcatcctcagtcagagaggattcagcgtagtaaaccttgatggcggactgaagacagtagtcgaggggggaaccaggctttgaaaatttgttcttcagaaaatttgttcttcatgtttctaacatatttaagtgatatctaagtaatataatctcagtcttacgcaaaaaaaaaaaagagcgc

SEQ ID NO: 2356 - DNA, 349 bp, Artificial
  Synthetic
gcagttagctcaaagggggcatttcgatgggaacgaagcaatctggaacgtggtaaccaaggagtgtagaggtagtttcgatgtatactcgccacatcgtatcttgagcgagttcctcgtcagtttcgatgtgtcaacgctccgtgattggaacaaaacagccaatgcttgacctcgcgtaatctgtatcttgcacaacattgcggggatgatctttagccgatatcttggaaggcagcggcgcgaatgaccatctactacgtccaaaccgggcgataagagaggccgccacgtacgcgattcgcgcggtcctcggtcgttcggagtggtgttgtggagagtgccaggc

SEQ ID NO: 2357 - DNA, 72 bp, Artificial
  Synthetic
acaaatccattgcgctacaaagaacaagcaccatggacgccaagcctgccactttctccttggccgctgcgc

SEQ ID NO: 2358 - DNA, 409 bp, Artificial
  Synthetic
ctaaccccaatcgccaaatacacaaatccattgcgctacaaagaacaagcaccatggacgccaagcctgccactttctccttggccgctgcgccagttgcttctcccgcagcctccgcgagcgcttccaagcccaagccgtgctgcgtatgcaaagaggaaaagtcgaagcgcgatgagtgcatgctcttctcaacggccaaggatcccgcagccgactgcagatcgctcgttgaccaatacaagagctgcatgcagggcttcggattcactgtataaatcaaaatatcttcatcttggcgctatgcctttgtacattatcaccatatagactactcggaaaagtacagcgctcgattattctccattctagagtaacgatcccatcccctgataaaaaaaaaacaaaa

SEQ ID NO: 2359 - DNA, 640 bp, Artificial
  Synthetic
tccaactcaactcaaccatgctatctgtggaccacaactacaactcatcacaacaatatcagcgctttcaacaacagcaacagcaccagtataacaacaacatcaccaacaacaacaacaacctgaacaaccatcatcagacaaagctggacgacttcacctttggcaactcgaccgactttgacttctcgacctcgaccttcccctcaaccgagctctctgtgtccaatctcgagtatctcaacgccgcaatcgcctctgcgttttcgtctgactcgatgcggcccgaatcctgggacgccgccgctcgcttctcaactcccaagtttggtcgtcttccccatcaacgagaatcctctctgtcttctctgggatctacggggccggcgtcgcccttcaactcgcacatcgcgaacccccacatcgccgtcactgacgccaatggtgacggcttcatggacatgcactcgcacgacatgaccatgagctcaggcccttactaccagctggccgccaagacgatgcctccctactcaaacttccatcatctcgacaacgcctctgtcagcgagatggcatatccagtctccatcccgaccaacagccaccacaagctgcgacaggatcgcaacctcctccc

SEQ ID NO: 2360 - DNA, 625 bp, Artificial
  Synthetic
cggacgcgtgggcaaacatcgacgaattcgaatcgcccacgatgtttgccgcccgacaggttacccgcaacgccccgcgctttgctgcgcagctgcgcactcccatgcagcgccgcttcgccagcaccgccgagaacgagttcatcgctgagcgccagcacatcaaggaacacgccaagggcaccactgagctttggaagaagatttccatctacgccgttgttcctgcgctggctatcgccggtgccaatgcctactggctgtggactgagcactgggagcactggagccatcttcctcctctgcccgagcgcaccgagtacccctaccagaacatccgcaccaagaactaccagtggggtgatggtgacaagactatcttctggaacgacaacgtcaactaccacaacaaggacaagaccaaataagctggaacaatggctcccggaggaaaactgctggtatttgtagattaccctttttgggacccctctgtatatttcccttggagcttcaatcgattacactgtggctgaggagagacttccatgctgtgtgtgacatggcgactgagcttgaaccgttttttcaatgtacattattcccctgtgtccctaccttagta

SEQ ID NO: 2361 - DNA, 720 bp, Artificial
  Synthetic
gtttgctggcaggacgacatctccaccatagagtcgactcattgctggcatacggagcattccaatcttactcgtagtagtgttattgccatcgctcatcatgctgcccaaggcgatcatcgcgattgccgcattggctttcagcccagcaaatgcgctgtggcccattcctcagaagatctcgaccggagacagcgtgctctttattgaccaggctgtcagggtaacttacaatggagtgccgatcatccctatcggctataacccaccggccagctccaacttcgacagcaggcaaatcgtccaaggcgctgtctcgcgtgcctttcaatccatcttcaacaccaactatgtgccatggaagcttcacccgcgtaacagcaactttgagccgaaggtggcccctctgaaccgaatccagtccatctcaattcagcagactggaaaggacacttccaagacgttcaagccgcgcgccggagatgttgatgagtcgtactctctgaccatttccaagaatggacaggtcaacatcagtgccaagtcctccactggtgtgctgcacgccctcgagaccttctcgcagcttttctacaagcactctgctggacctttctactacacgacacaggcacccgtgtccatcacagacgcacccaaatacccccaccgtggcatcatgcttgaccttgcccgtaactatcaaaccatcgatgacat

SEQ ID NO: 2362 - DNA, 172 bp, Artificial; identical to SEQ ID NO: 976
  Synthetic

SEQ ID NO: 2363 - DNA, 529 bp, Artificial
  Synthetic
aagtagcaaattgttttcttcttgcacggactttttacggagtatttgttgtcactctggcccgagccttttgaccgtttggccgttttcattactagctccgtccagcatcaaggatccccatcgatacgacgtcgagatacctacctagtagtacctagctgcttgaagttacgagttgcgagttgtcgatattgacttcagctgccctgtcctatcatacagcccaggggaacaacgcccctgataagaaaaacaagctccagtcccgccgtctccagcttttggaccccgtttgcctccgtacagcacgcattggatcccgtggccctcaaaaactcaactcagggctaggtctggtgacgtgcataggcgggccttttcaggcgtcgaatcgcacgtagcgggtttctccaggcgcctctccaggccccctctaggccctgtccaaaggcgcagcgacagcctaggccgcaatcaattgatcctttccccgcggatttacccgtcaaccccaccatcagaccac

SEQ ID NO: 2364 - DNA, 479 bp, Artificial
  Synthetic
agaggattaaggattgggaaataataagagagttgtcgagaggtcactggtggcaaatgtttttgttataggtagcccatcaacccgtatcacacaagactgagcagtatatatagaattctcagctctctcctcggtgtccctcttgttatcccaagtatacgatactcaccaaggacgtccatcacccactccttatacaggtatagcactgcgagaacctgcccagcatgcatcgtcaatacgcccctccgcgcgaacctatccgcaatgagattgtcgtcgtctttggcgagttctgcggtaccttcatgttcctcctgatgtccttcatcggcacccaggccgccatcgaaaacaacgatccaacaaaccccaacgcgcctctatttcccttttcgctcttgtatgttgcttcttctttcggagctgcactggccgtcaacgtatgggtcttttacagagtgacgggcggcatg

SEQ ID NO: 2365 - DNA, 696 bp, Artificial
  Synthetic
attcttccccccgttaaaatcgaatccttcagcgctcgccgctacaaaaaaccgcttccactcattcccacgcgacaatctcgagcatcataacccttttgaccgcttcgccacatcacatacatcatgtctaaccaggactgggattctgccaccaagattggaagccgcgttcgcggtcccggtgcttcggaccgcgaaaccgtcatccgaggaaagagtgcgttgaacgctgcccagagatctggtgctgccattagcacggagaagaagtacgccagcgccaacacggccagcggtactgagggtcagcgtctcaccaaggtcgaccgctccgacgacatcatcaagcccaagactgtcggaaaggaagtcggaaaggccattgagcagggccgacagaagttcgagcctaccatgacccaggctgctctgggcaagcagatcggagagacagctgcaactgtcgccgcttacgaacgcggtactgctacgcccgaccagaccattctctccaagatggagcgggtgctcaacgtcaagctgaggggcgccaacattggtgctccccgcttgggccccaagaagaaataaataaggaagaaaaaaatatgacattagattttggagcataatggaagaggcaggaaacaagtaatttgcaattggacaagggcgatgaactgcgtggctctc

SEQ ID NO: 2366 - DNA, 679 bp, Artificial
  Synthetic
tcattacacacagttagcgtttgcatccccggctactgtaatacccccgcaccgagtctaccaccatccacactaaccaccaccattagatcagggtaactctagaaggttccattgctcacacgaacgtcaaaaacgcagtcgactaaaacccactctacttctcacaccacacaccttttaaaccacacattcacaactaaacatgtctgacgattgggaatccaaaactgttattggctctcgagcccgagttggcggaggaggtcctcgagccactgtcgctaagacccaggcagaaatcaacgctgccatgcgatccggtaacgttctgtctactgacaagaagtacgcttctgccaactccaaggacggaggagacggacagcgattgaccaagattgaccgatctgacgatatcattgcccctcctaaggttgaggcttctgttggtaaggccatcatcaagggccgatccgaaaagggtctgacccagaaggagcttgccgtcaagatcaacgagaagccccaggtggtcaacgactacgagtctggacgagcccagcccaaccagcaggttctcagcaagatggagcgagtccttggtatcaagcttcgaggtaaggacattggtcttcctcttggccccaagggaaagaaatagagaatgatatttatg

SEQ ID NO: 2367 - DNA, 553 bp, Artificial
  Synthetic
gagaacataaccacaactaagtcataaggaaacaatcacgattctgaatatctattcgcgttatatacaagctaaaatgaagccgttttatctgatttctattctatttaccagtttgggcactgctatcccagttatccctagggataataacggaatcctcgataatttcctagctattgtgaaagacgcgacaggaattgatcggacacccgtccacgggctcgtcggcactgtcctgaatggtggcaccaaatctatcttgattaactcgactgtcctgggtcttgcagaggcaatttttgatgaggtgaaatcccaattaggcattcaagatccgcggtcgcttgaagaaactattgcgtctttggaagaggcgggtaatgagacttttaaccaattctgccaactactcgacacgttccgcagagaggataaaggtcctgctggaggaaccattgactcgctaggcgtgggcaatatatcctcattagacttggcatcttctatcgacttgatcataaacttggtcggactacaatgtccaagtggt

SEQ ID NO: 2368 - DNA, 648 bp, Artificial
  Synthetic
gcctagaactcgcgattccttggagataacgcgaaggaatcgggtacagtaaacgaaccccgctgggacaattcattgataatctcacgcaatcgcccatctcgttcaagagattcgtcatttgcttcaatgggagcgagcatttgtagttgattggggaaatacagcagaagacagacgaattgaccaagagtggggagttcatttacaactccaaccctcgacttcaccatgatcatctccaacagcgtcattgcttcgggcattttgctcgctggcagcacgacagctcatttacggcttcccccgttctttacggccaagcagcaggctctgggcccgtctgcccgatcccaattccaaagcttcgggttcggtgagcagcagcagccattgaccagctccaacattggaacagcgacaacatcctcttcaacagatgatatccccgccttcaaggctggccagttcactcttacgccgcaagatgattctacgtgtgctacgtatggcgagtcgcaatggaccggcaccatcgacgtgacagactcgcatcgcctcttcttctggttcttcgacagccgcaacgaccccgtcaacgaccccatcatcatctggatgaacggagggcctggcggcagctcaatg

SEQ ID NO: 2369 - DNA, 489 bp, Artificial
  Synthetic
gccggacttgggtgaaaagacttcggtgccttcgacttccatccgctggtccgtcgcaagctcgacgggatccggggcggatgacggggacctgactgtgcctgcatcggtcacggcgccggagggcgtgacggaagagaccattgtccagcgattcgcctgggcttgctgcggtgacaactgcgtattggccatggggatgtcgcccggggcggcaccgcttgcgcctccggattgtagggaggcgtcgttgtatacgcggcgctctgcagcatttctccgctttgtgagatagaaccacacggctgccgcgacgaggaggccgccgcccaccactgcaccgacggcgatacccgcttccgccccgggagagagacccccggacgacgaggacccggagttgttggagtcgccgcccgcctcgagggtgctggtcgggcccccggttgcggtggagcagtaagcccgatccggcgaacgaagtacatg

SEQ ID NO: 2370 - DNA, 432 bp, Artificial
  Synthetic
aaacatacggcctcgtgtggcgccttgtctcagggacaacagacgacgagcaactcaaagaccagagctaaacatggcttggctagatggcaataagcagagcacgcttcaatcgagaacagacgcgctcgacaataaaggatgtgctacggcacagccattgggacagatgatgtcgcggttcaacggtaagtcttttgatcttgttgattgagcatcataacgtgaggccggctctagttgttcaggacgataaatgccacttgcaatgaccgaagctgtttgagtctcaatacactctgtaccagatgaaagggcttctatgtctgctaggttttcatagatttgtcatagttatgactcctgaagaagtagttgtactgctaaatgagagccactgtgtttgctttgcccctggctagctagtagaat

SEQ ID NO: 2371 - DNA, 187 bp, Artificial
  Synthetic
tttttcggcgtttggcatcaaaatcccttggtcagcgaaccccgagcccgtgcgcttgggaaaagtatgggggattgacttttcgagggagggtcatgtgatcttagtacgtaccgcagtttttagtaacagcctagaggttgcaagtttttttttagaaattcccaacgccaatgttggctgtggc

SEQ ID NO: 2372 - DNA, 440 bp, Artificial
  Synthetic
cgcatcttcggcaaggcgccgtcatcgcgcggcatcatcgtcattgacttgagcttggaaagctcagcaagatgccagcaaccatggcccctccaacgcagactttcaacctcgatgttgaggcaatctcgggcatttgcggatctatctctatagcctgttgggtggtcgtgttctctccgcaaatcatacaaaatttccaacgcagcagcgccgacgctctttcgattcaattcatcattgcttggctcctaggagatgtcttcaatatcctcggagccgttttacagggagttctccccaccatgatcatcctagccatctactacaccattgccgatctcgtactgctctgccagctgttttactatcgcggatttacgtggcgcgacgagccgactccatccccgcccaagacaaatggccactcttcgacatca

SEQ ID NO: 2373 - DNA, 594 bp, Artificial
  Synthetic
cccacgcgtccgccgtgactgaagttcaaccacatcccaaacacaatataaaaccctcacattttcaaaagaaaatcgattattatcacactagaaattaagaaaaataacaggaagcatgtctgacgaagagggcggcacaacaagatgctgcgccccgttcctcgctctcaccgagcccattgaagtcagcgaactaggatggcctcgacaaaccatccgcatttttccaatggccctggcccagtcccctcttgttcatcaacgaaagtagcgatgcgcgggatcactgcgccaacgagcgaactttcctttcgtacctccgcctgtcgatatacatggccatcgtctctgtcgccatcaccgtctcgttccacatcaagggtacgcccagcgatctcgagcgccgggtggcaaagccccttggtggcattttttgggtactgtctgttgtgactttggctttaggagcgggaaactatatcaggactgtcaatttatatggtaaaagagccgctattgtgcaatctggctggaagactcaggtggtgttgggtataatagctgcttcaatcattgggacgtgcatcatat

SEQ ID NO: 2374 - DNA, 445 bp, Artificial
  Synthetic
atacacgaggggatatccccaactccagtcttcttgctttcttgctctcgtcgggaaaacgaggagagggctagagaaaaagaaagtcaattctcgcaaaaaagctttgccacactttgatttgtctgctccggcaaacgcctcatttcgtcagcgcgccagaatatgtcaccggacgtttacgaaagaagagagacattttggaaaaaaggttggatattagccgagtgggctggcagaagatgacgccaacccgggcagcgagcggttttcgtttcgcctgagctccgccttttttttttctctttccaatggcacagcgggcgacacagcaaggcaaggcacatgtaccgtattggttctcggggctcgaatgcaacagtgcctcatggcgattgattgcagcgtgcaataaattgcctatctgcggaaaaaaaaaaacaaa

SEQ ID NO: 2375 - DNA, 387 bp, Artificial; identical to SEQ ID NO: 422
  Synthetic

SEQ ID NO: 2376 - DNA, 316 bp, Artificial
  Synthetic
gacccacgcgtcgtgccccttatgatgtttgtgtttgagacacggctgatgagggctgagaagttgttcaacattgcacaacgtctggaaagacggcagtgggccattcgagtaagaaaagaacaacagacggatccagactcttggtagtagctaggcagcagtttaacagaaggaacaaaacgggtaatgcgggtggttttggacgccatgtgttgacgtctctccagctttctccatcttctccgtactgactctgtctccatttggccgggttagtcttgtcagtttggggttggtctttgtcatggagcca

SEQ ID NO: 2377 - DNA, 605 bp, Artificial
  Synthetic
aagcttctgctacatcgccaacattctgttttgattataacgatctgaatgcctacctcctcaccgttgtgggtgtttctcggcctgagagcgatcaagccacgctttttcatgacatcatgaccaaggctcaagggggagctcgtatatcacttcgcgagatccagaccttgtgttccagagaagccatcgtcaaattggactcgggtgtgaatctagctcaagctatagaaaagcttggtagcggaatacacagaatcttggttactgaacaagctgggaatgttattgggattataagccaacttcgcatggtggagttcttctggaacgaagggatcaattttcccaccattgaccgacttaatccagtcacgctacaagagttaggaattggagtgcggccgataatctctgtccacgccgacgctcctcttactgaagctttatcgctcatgtatgatgagggcctttcaagcgtagctattgtagacaacggacaaaatgtggtgggcaacatctcaacaaaggatgtgcggcatttgacaagctcctcgagtgcatatttgcttggtaactcttgtatgcacttcatttccatcatt

SEQ ID NO: 2378 - DNA, 600 bp, Artificial
  Synthetic
cccacgcgtccgacgatcctcaactctccagcaatccattgattcccgcccgttcctcccgtccaccccttcgacgcatattccgaggtcaaaatggctggtgtcgctacctacactattgctggtcgacagatcggcggccactaccttgccatgggctggttggctaccctcttcggtggtgcctactatgctgcttccggccccaagaagcctgcgtctgctgtcgctactcccccgatcaacgcttccagctctgacgaggccgacttcatcaagaaattccttgaggagcaggacaagaagcactaaagggcgaaactcgaaaacgaccggcatggagggggatagtgtattgttgtcttgtacataatagatgcccagagagcgaatgtgtctcgagatagaaaaaaacgatgcgatttactctccccgacacggccagtgcactagtttgatcacgcctacgtttgacggcttgaatatgtctcctttgcatagtctatgttgagctacagtatatcatgttgatgggcaaggcgatgctacgactgttagtccagcggagtcaggtgacgcctccaccatattcattgtttt

SEQ ID NO: 2379 - DNA, 665 bp, Artificial
  Synthetic
cctccaaatcaagtcatccgattcatccacagcatgacacttccccaaacgagattatttccccctcaagcactactccggaatacccaaagccagaagtttatccgaacgattgcttcaatggctactgatgcacctaatttcccatttcggcgagcttctggcatggagccaccagccgagttcgcacggttaagggctgttgatccagtatccagagttaagctttttgatggaagcttggcttggctggtgactaaatacaaggacgtaattactgttgcaaccgatgaaaggctctccaaggtccggacacgccctggcttccccgagttgggtgctggtggcaaagaggccgccaaagcgaagccaacattcgttgacatggaccctccagaccatatgcatcaaaggagcatggttgagtcgatattctctgctgaccatatcaaggagctgcagccatatattcagaagacggtggatgatctccttggttctctgaaagctaagggttgcgctgatggccctgttgatttgattaaagagtttgcattgccagttccatcatacattatctataccatccttggcgtgccgttccacgatctcgaatatcttacccagcagaatgccatacgaaccaacggaagctctacggcgcg

SEQ ID NO: 2380 - DNA, 1068 bp, Artificial
  Synthetic
agcatttgtatagaaacaaacttgtatccactaaacaaaaaaattgagttctagccatggctgcatctttctcagttccatcaatgataatggaagaggaaaggagatttgaatcagaggtagcagaggtgcaagcatggtggaactcagagaggttccagctaaccaagaggccatattcagctagggatgtggtggcactaagaggtactatgagacaaagctatgcatccaatgagttagccaagaaactgtggagaacactcaaaactcaccaagtcaatggcactgcctctagaacttttggtgcacttgaccctgttcaagtcactatgatggccaaacatttggactctatctatgtttctggctggcagtgttcttccactcacaccacatccaatgaaccaggccctgatcttgctgattacccttatgacactgttccaaacaaagtggaacatctgttcatggctcaacagtatcatgataggaaacaaagggaagcaagaatgagcatgagcagagaagagagggctagaactccatttattgattatttgaagccaattattgctgatggtgatactggatttggtggtgctactgctactgtgaagctttgcaagcttttcgtcgagcgtggtgctgctggtgtccacattgaggatcagtcatctgtgaccaagaaatgtggtcatatggctggtaaagttcttgttgctattagtgaacacattaacaggttggtggctgcaagattgcagtttgatgtgatgggaacggagacggttctcgtcgctcgtactgatgcagtagcagcaaccctgatccaaaccaatgtggatacgagggatcaccagtttatcttgggggtatcgaacccgaatctgaaggggaaaagtttggctactcttatgtccgaagccatggcagcgggcaaaaccgggcctgaacttcaagcccttgaggataaatggctggcaatggctgaactcaagacattctctcaatgcgttattgatgcaatcaagaaaatgaacgttacggagtccgaaaagcagagga

SEQ ID NO: 2381 - DNA, 390 bp, Artificial
  Synthetic
ctcgagcttgcggccgcgctgcatctttctctgtcccctctatgataatggaagaagaagggagattcgaagcggaggttgcggaagtgcagacttggtggagctcagagaggttcaagctaacaaggcgcccttacactgcccgtgacgtggtggctctacgtggccatctcaagcaaggctatgcttcgaacgagatggctaagaagctgtggagaacgctcaaaagccatcaagccaacggtacggcctctcgcaccttcggagcgttggaccctgttcaggtgaccatgatggctaaacatttggacaccatctatgtctctggttggcagtgctcgtccactcacacatccactaatgagcctggtcctgatcttgctgattatc

SEQ ID NO: 2382 - DNA, 570 bp, Artificial
  Synthetic
ttgatagtggcagcgacagtacatatcaaaagatgatgcgaatagcttcacgagctccccagcgggcgtgctctctggcctcctcttctgcatccgccgttcttcgtcgatccatcccgcgctctgttgccatccgcgccattgcaacaaccgctcgcatggctgctcccactcagaccatcgctcacgcagcgccggccgacgcctatcagctgctgcccgagtcgcaaaaggccggccaggccgaggatgctctctacgaggcccaggtcaaggagattgaggagtggtgggcatcgcctcgttatgccggcattcgacgcccgtacagcgccgcagatgtcgcatccaagcgcggcacgcagttgatcaagtaccccagctccgtcatggccaccaagctgtttaacctgatccgcgagcgcgaggccaagggcgagcctattcacacaatgggcgccatcgatcccgtgcaaatgacccagcaggcccctcaccaggaagtcctctacatctccggctgggcttgctcctccgtcctgaccagcaccaacgaagtgtctcccgact

SEQ ID NO: 2383 - DNA, 665 bp, Artificial
  Synthetic
gattagtcttctggatctccttgtttcttcatcctctattcaattgacttgattcactcttgtctaacaagcagtgaccacttgcatcattcatcatggcctccaacaacatggtgacgctggctgtgaatccagacaaagaagacgacctcttcctccaagaagtccagcaggtcaaagattggtggcgcgattcacgatggaggcacaccaagcgtcccttcactgctgagcagatcgtttctaagagaggccatctgaaaattgagtatcccagcaatgcccaggccaagaagctatggaacatcctggagaaccgttttcagaacaaagatgctagctatacctatggctgcttagagcctacaatggtcactcagatggccaagtacctcgacaccgtctatgtctctggctggcagtcgtcttcaaccgcctctgcgtcagacgagcccggccctgacttggcagactacccatacaccactgtgcccaacaaagttggccacctcttcacggcccagctcttccatgatcgaaagcaacgccaggaacgcttgagcacccccaaggctcagcgtgccaatgtggccaatattgactatctacgacccatcatcgccgatgccgatactggccatggcggtttaactgccgtcatgaag

SEQ ID NO: 2384 - DNA, 761 bp, Artificial
  Synthetic
catccacgacagcttcgatagcttcgacaaagacgaaaatcatcatgaagctttcgctggggattgccgcagcatttgtgagctgcgctgcagcatcgcagcccgccgccgacgtttacgttctgccgaatcgcgaatccgcatcgccgccgtccattcccagcagcgttgcccgactcatcttgctgaagctggcggactccagttccttttccttggtccgcgatattcctgacgacgtcgatgtagaagaggtggtctcgttgatgaatcgatatggaggcgtcactactccattgttcgatgagctcgctcatgagcctaagcagctgttcattgcgcttcagggcttgacggacgagcagatgaaagagaccagagcgaaattacagcggcagccctcattcactatccccgatgtgcctcatatcgaccgtctgcaatgggcaacgggcactgaaccgcctccatccgagtttgtaaaaggaaaagggatcagctgctcttatgatgagatgaccaacccagtcgagtcccggtgctggaagggaaagagcttgctggctagttttgatatccaaaagaagcccgaatacttggacgacgtgatcgacagcttcccacggctgacctcgcttgctgagattggcgaagtgcaaacgactttcctcttcttcactggcgttggtaaattgtcgagccagaccaaagcacttcacaagcgccaggcggagcgggtgatttcccactttcataagact

SEQ ID NO: 2385 - DNA, 600 bp, Artificial
  Synthetic
cggagctgagaaatattaatgatactattaggtcgcagcgaaatcgattgatctattcgtattgggggtgcagggggaatcccaggtgacggcgtggtctgccgcaacagttggcggtgtacccatcgacaaatgtctctcagcggacaatgccatcaatcgcgccgaactttccagcgagtgtaagaatcgatcgcaaagtatagttcgagccaaaggagcaactcctttcggtattggttccatcgtgtccagcatttgctctgccattgtctttgacaagcggaccgttcatcctctaagccacttccagccgtcatttggatgctgtttcagcttacccgtggtgctcggcataaaaggaattgaacgcacagtaaaagtgccactggatagggacgaggatgttcaaatagccgactcagcaattgcactcaaaatgatgattgaccaagtgagtaagaactggtgagtatagcgaattgagaaaaataagacaaggaggggggctattagggaccataactgtctcgtaaattaagagttgtctagctaatacactacgaatgtgtatgtaatgcaaaatttggatgtgtaaat

SEQ ID NO: 2386 - DNA, 236 bp, Artificial
  Synthetic
aggcatttggctagaggacaaaacaacatgagcccaacagtttaaaatcgatcatcgtcaggttgttcaaagccaagatttagaataatcacctatgcgtgtaattagtacggttcagagaagatgcaaccaactccaagtcaggtacaaatttcaatgattcaaagactggtatatatggccttgttttgcagagcatcaaactttctgccgggtcggtacctacattaatgggc

SEQ ID NO: 2387 - DNA, 582 bp, Artificial
  Synthetic
gtgaggtcaagaacggagtacagatcggtacctgcaccaaccgttggtacgacaagcttcagatcattgtctgtaagaacggcagtgctggaatcaactttgagcatacgggcgtggacggccacacagtgctccggttcgcaagtgacgtctataccgacaccattcttcgcttcgcacgcaccattaacggacaggcgccgaccctctggacctctaccagccctgacccgtccaagcgagagattgatagtttcggagacgtcaacaccacccctcgaaagctcgggtgggatatgattcccgagctaagtatcgcggtgcggttcgccgaaaccaggctggcagatttgattgaacaaaacgaattccaatgcctcgatttctccacctatggcaagcactttattacatcgatgggattctcgcccgatgcctttgtccaaatggcattccaggcggcatattacggtctatatggaagggttgagtgcacttatgagcctgccatgaccaagaccttcttgcacggccgtacagaggccatcagacccgtaacaaaggaatctgtggattttgtcc

SEQ ID NO: 2388 - DNA, 996 bp, Artificial
  Synthetic
tcttcattaaccaactgcgtctctcctgagtgaatctcgttcgtgttcttcctatcatcgcgagattgctctttatctgctctccctctctcgcgacttctctgcgtctcccttgggctctccctctcgatcgcccaggaacacgactctcgacttcaatctcactcttgcgcttccggctccgcaaaaaaacaccgccaggcctcaccgcatcacggcccagccgcgacgaacgttcctcattcgatagactgtgagcagctgcaggcattttcgcataaatctgcacgcctgggacacccccataggccgactctcgggaccttctccctcgcaaaaccctacgcaaacgcacgcactcgcgcacaaggcagctgataatccaaatctacctacgcataataatcttcaacaacctgcatccaacgaagcgaaacccaaaaacaacatacatgagtgtaacaccaccaaacgtccctcgcatcgaagacaagcaaagcaatacgatgccctcacaacgtcccttcttcctctcctccttcttcaactctttccgccagcaagcgccctccctcacccagcaggcggccagcaaacacacctcgcaagctgctgcatctgcatctgccgtcgcctccacaacagccgcagcagcagcagcagcttcttcaaccgcctccaccgcccgcgcaatctccacaaacgctgctaccacatcatccaccaacgtcgccatccacacgcctcgcggatctcccggcggcgccatccccattcctggcgggcgcagaagaggcagcgatagcagtagtgaaggctttcgcgatgccctcggcgccgacaagtggtatatcggcggcaggacggcgactggagaggagaagttctttaagcttggcgtgatacgccgagtaaggagtaatgatggcctgagtctcgatcgcctaagcttataggtgatgaccacatcactgaacgactcgagaatgactggtt

SEQ ID NO: 2389 - DNA, 560 bp, Artificial
  Synthetic
gtttggcttgcagtaagaccggcttatgagaaagaccattgtgagagatgtaaggctgatccggagctctacgtcatctgagacatgacattggcatgatgagggtccagtaactacctgatgattggggtaatcgaaagagatgcagagagaaacacgcaactctgagaaagcgtcccgttacacacggaacacactgcctccggacagcggcttgtggctcattgcttgagtcccttaatcagcaatccccaggttctcttgacagctcagcggtgcagttttgcgggcacagctgatccacccgtcaacggggcgggacgccgggaagccgggactccggggctaaaatgacatcgccatgacatccgcaccgtccgaccagaactgctactactcaagacggtaagcaagtgctagcaaaagtgagttttacgaggtaagcaagtaggaacgtggcttataaagccacagctagcttgaggcgaaggctgctagtaggaactaaagtcagcttatactatttataagctcactgcatgggctagtaataatagctc

SEQ ID NO: 2390 - DNA, 265 bp, Artificial
  Synthetic
  misc_feature (85)..(85): The residue at this position can be any nucleotide.
gtcatggagaacgtcctcttcaaggtctcctaccctgccgagttccactcccagaccgtgaccactgcatccagtacatggcctnccgtcatgctcgtcttcggccgcctcgaggccaccgactacgtcgacggctctgaggctgctacttcggagcttgtcgagtctctgcgcaagaagatcaagtgcgttgaggacccccagtacactcaggactaccatgaccctgccctgcgaaccatctccaacgcccctgaccgttgag

SEQ ID NO: 2391 - DNA, 615 bp, Artificial
  Synthetic
gggtcgagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgt

SEQ ID NO: 2392 - DNA, 611 bp, Artificial
  Synthetic
gctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgcg

SEQ ID NO: 2393 - DNA, 608 bp, Artificial
  Synthetic
gctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgt

SEQ ID NO: 2394 - DNA, 619 bp, Artificial
  Synthetic
tattactcgagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtg

SEQ ID NO: 2395 - DNA, 620 bp, Artificial
  Synthetic
tatactcgagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgcg

SEQ ID NO: 2396 - DNA, 608 bp, Artificial; identical to SEQ ID NO: 2393
  Synthetic

SEQ ID NO: 2397 - DNA, 398 bp, Artificial
  Synthetic
agctagctgattaattaagtcgacgagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctg

SEQ ID NO: 2398 - DNA, 608 bp, Artificial; identical to SEQ ID NO: 2393
  Synthetic

SEQ ID NO: 2399 - DNA, 632 bp, Artificial
  Synthetic
tcgagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgcggccgcgtcgaggggtag

SEQ ID NO: 2400 - DNA, 232 bp, Artificial
  Synthetic
aattctggatctgcttgagccttctttcttcactgtccgctcccaattgtcgcctcggttccacggcttcggattggaacacgcgcccacagacagaacgctccgtttcccattgagcgtcaacctctactgagctttcatcaatcagtacgaggccatcttcgacaattttcagaaaaagaaaaaagcctttcgagaacatcaattcggaaagaagagccacttcttcacc

SEQ ID NO: 2401 - DNA, 660 bp, Artificial
  Synthetic
gttctgtgtcttctcacctttttgcgtcagctcgactttcgttttgcaccggtcgaccttttaccctctcttctcttctactctagagacatcgaccagttcgctcgttgtcaacccctccgcctgacggaatcccccaccgataaacagacaaacaaacaaaacaaatccaaaaaaatcagccagaaacaagacaccatgggtgccggtcggtttttctgcgtggctctgccgctactcctcacaattgcctccatcggcactctgctctacgcagttctcgctggcgttgcccacgagaacgtcaagctcatccaggtggacctcagcaacctgagcatcagcccgctgagcttaaagaccctcacctcccgagccgaattcaatatgaaggagacccagacggataacatcaccgccgaagccctcggcctccacaagtactatgacctcacgctctggggatcttgctcctccgatgacaacaagaagtggacttgcaccaagagccagttcgactgggccagcaagcagatcaatgccgacgatatcaaggagggtagcaccactatcgagttgcccaaggatatcaaggacgccctcaaggtcttccagaaactcatcaagtggtctgaggttgcctttatcatcgctcttgtc

SEQ ID NO: 2402 - DNA, 648 bp, Artificial
  Synthetic
cccgatccctagccactttactcctattcgcctccaccaccttttcatttcctatctcctcctcttttctcttctgctcagttcctctctttcacatacacactcacaaaaaaaattcgattatggccggaagcggtgtggtaacactttacggaaatggtgcactcaccgagactacaaagcaatcccctttctcagtgaaagtgggtctcgctcagatgcttcgcggcggcgttatcatggacgtcgtcaatcccgagcaggcccgtatagccgaggaggcaggcgcgtgtgccgtcatggcccttgagcgcgtccccgctgatatacgcgctcagggcggcgtagcccgcatgtcggatccccagcttatcaaagaaatcaaacaggctgttaccatccccgttatggccaaggcccgtatcggtcacttcgtcgaggcccaaatcctcgaggctatcggaatcgattacgtggatgaatcagaagtcctcactctcgccgacgatgagaaccacatcaacaagcacaatttccgcattccttttgtctgtggctgccgtaacctcggcgaagccctccgccgtatcagggagggagccgccatgatacgcaccaagggggaagccggtaccggcaacatcatcg

SEQ ID NO: 2403 - DNA, 100 bp, Artificial
  Synthetic
ctcagataaaccactcaatcgattccttgataccccttgggacaactctacttgttctctccaaacttacccctccaaataccatcatcaccatcaccat

SEQ ID NO: 2404 - DNA, 640 bp, Artificial
  Synthetic
aacttacaaattacaacctacaactgcccacaatgtcgctttctgttggtgcttctctgcggcctgcggccttccgctgcgttggtgcgtctgccgtgcgcatgcgatgtgcttttggcacaactgcgtccagaaggagtgagagctcgacgccgggcgagcttggggttggagagctgcagggcgcatcgtttcgcattgagcctctccggagggttggggaggatgcttcgactatgcgagcgagacttttataccaatctcggaagcgcggaaccctcgagtcggatcttttactgtctacgtttgcctcacagaacctgcccaccatgacggccgaagaactgcggcagtacgacctcttcctcgacgagaacgactgggacatatactactgggcgacgcagcgggagccgaattccacgacgaacccttccgtgacggcgagtccggcgagtgcttcggcgagcgaagggttcgaggcgagacagcaggatgagttgcccaagaatccgccaaagggggagtgggcgcagacggtgggcaattttaagcctgcgtataggccggtgccgcagaggtggaaggatagcgagattttggagaagttgagggcgcatgtgaggaggaagagtgtgaa

SEQ ID NO: 2405 - DNA, 418 bp, Artificial
  Synthetic
agatcactccaccacgaagcacttttcaaaccgaagacctacacgcatcttcattttcaaccgccaaaatgggtatgatcgacgccaagaacagggtgacggagcaccagcgcttttaccaggctgcgtacaaggctcacacccgcctgtggaagattaacccccgaagcaactggtacatggccccctacctcgtcgccctctggggaggtttcggagctaccctttacgctgccagccgaaaggttgccggccacaacacctggttcagcaaggattaaagtatcggtatctatgggacgagccaattgagttaccccaacttgcgtcaaatgcaagattgagggtatgtatgagtttaaagtcttatagacagtaaatataggatttgtcagtccgtctcatacgtctcgctgct

SEQ ID NO: 2406 - DNA, 589 bp, Artificial
  Synthetic
actctcaaccactgaccttttcctccggctcagcagactgacaataaccagcagcccgcaatatccgctgggggcctcgtctcgtttcttaccgcgaccaaagcccactgaaaataatcccgctctaccgctaccgggccatcagcgcaggcggatctccagtcccccagcagtgcagcccgctcggaggttttctgttggcgcaaaccgggcctggtgtcgtcatcgagccaactccagatccacttggcaacattgcgataaagcgactctcgcctctgcgtgagcgtttcttgtttgatctcccttttctggcatcatgacctgggaactcaaccgccgacggtttgtccgtgccgtcaatagcaaattcatctatggacgtttgcctctactccacaccatcatcctcctcatcgaaatggccctcgttgctcggctgacggcgcgattcaattcgtactacaatgaacgaccactattgaccatgatggtcaccaattcgatccttggtggcatcgccgataccgtcgcgcaaaccatcacctcggtgcgtgagcgagcgcttagaaagccgggcggagtcacc

SEQ ID NO: 2407 - DNA, 655 bp, Artificial
  Synthetic
gtgcagctgataaattccatcgattggtttctttgggagcattaatcgacctttctcattcttcataccatcggcgtcgttggcatttatacggcatctcgtcttgtttccttcgtactcgaggtacggtaccctgaccgcgtcgtcatacgaatttgcagcatcggcgaattgacagtataaggcagacatcatggctgggtggcagtcctggaaccccttcagtaagagggagacgcacagcaatggctccatcgtcgcatacaagattttaaccttgctctcatggcttttgtccgtcgtcgtcactgtctactatgccgttgacgagcctcacgatggcttccacatccgccggcgcatatgggatcagaactatctgtatcccagcgcctttaccatgaaccacatcctcgctgatatctactggattgttctcttcatcctccagtttggatacgtcacatcgctcttctccagcagtgccgacgtcgttgccgcagctgctggtgtcggcagccacttcatcctcaacaacttgcttcactctgcattcgtcatgctctttgtgaactcgcacttccacatcgccgaggtcatactgattctcaacttcttcaacctcagctcactgtatttccgccacaacacggtc

SEQ ID NO: 2408 - DNA, 600 bp, Artificial
  Synthetic
agctgataaattccatcgattggtttctttgggagcattaatcgacctttctcattcttcataccatcggcgtcgttggcatttatacggcatctcgtcttgtttccttcgtactcgaggtacggtaccctgaccgcgtcgtcatacgaatttgcagcatcggcgaattgacagtataaggcagacatcatggctgggtggcagtcctgtaagagacaacgatcccaacaattcccattcttcacagcttgctaaaatccgcatcacagggaaccccttcagtaagagggagacgcacagcaatggctccatcgtcgcatacaagattttaaccttgctctcatggcttttgtccgtcgtcgtcactgtctactatgccgttgacgagcctcacgatggcttccacatccgccggcgcatatgggatcagaactatctgtatcccagcgcctttaccatgaaccacatcctcgctgatatctactggtaaattcgccatgactccatcaattctcgctcaagctttctgacacttgaaaaccaggattgttctcttcatcctccagtttggatacgtcacatcgctcttctccagcagtg

SEQ ID NO: 2409 - DNA, 570 bp, Artificial
  Synthetic
aaatcagtcaagctttggaatggctacacaggagaatttgtcacaacttttcgtggccatgttggtccagtgtatcaaataagctggtcagcagataatagactcttgcttagcgggagcaaagattcgacacttaagatgtgggatatgcgaacgcggaagcttcgagaggatttacctgggcatgctgatgaggtatttgctgtcgactggagtccagatggagaaaaggtagcgtccgggggaaaggatcgtatgctgaaattatggatgaattaaaagaaaaatattttcacagtgaacaggctatgcattagcaggctttattcatgtttgctatgaggtaaatcctcctcatcagtggttatagttattccacatatgttcttccttctaatttcatattagtacattgacaaatagattgaaaaaacagttagcaaattgattaattaaatctcatcgattaatctagattctaaatatgaaaggtgcatctagaagccttgcattgtgtttctatcacttgtttttggtctgatttctacatgaaatcatgaatacttgttt

SEQ ID NO: 2410 - DNA, 636 bp, Artificial
  Synthetic
aaacaatccatggtgttgcttcgcttttcgaacctgatctcgtgcttacacaggacgactttaccatgtacctctgggatccttcacaaggcacaaagccggttgcacggcttctgggacaccaaaaggccattaaccacgtgacattttcccctgatggcagtctcatcgcgagtgccggatgggacaatcataccaaaatctggagcgcaagggatggcaaattcatcaacacactccgtggccatgtcgcgcccatataccagtgtgccttttctgccgatagtcggctccttgtgacggcatccaaagataccacattgaaagtgtggtcgatggctacgtgtaagctggccgttgatctaccgggacaccaagatgaagtttttgccgttgattggagtcctgatggacaacgagtaggcagcggaggaaaagacaaggccgtacgcctttggatgaactgatgacgatgatgggagcgaatcaaaaaaggataaatcatgtgtgttatcggcgtccagtcagggattgattacgtgtatgttctaggtctagactctgtagagctgtttgtgcagcatccgctaatgatagagagcaaatgtggcatttgcccaagggcacggctgatgc

SEQ ID NO: 2411 - DNA, 677 bp, Artificial
  Synthetic
gccatgtacctctgggatccttcacaaggcacaaagccggttgcacggcttctgggacaccaaaaggccattaaccacgtgacattttcccctgatggcagtctcatcgcgagtgccggatgggacaatcataccaaaatctggagcgcaagggatggcaaattcatcaacacactccgtggccatgtcgcgcccatataccagtgtgccttttctgccgatagtcggctccttgtgacggcatccaaagataccacattgaaagtgtggtcgatggctacgtgtaagctggccgttgatctaccgggacaccaagatgaagtttttgccgtatgtttgcccccttgcccttccaattttgttaacccccgagcctgtggctgacagcgtgctaggttgattggagtcctgatggacaacgagtaggcagcggaggaaaagacaagcccgtacgcctttggatgaactgatgacgatgatgggagcgaatcaaaaaaggataaatcatgtgtgttatcggcgtccagtcagggattgattacgtgtatgttctaggtctagactctgtagagctgtttgtgcagcatccgctaatgatagagagcaaatgtggcatttgcccaagggcacggctgatgcaatttacatgaagcacttgtgaacaaggctcaatggac

SEQ ID NO: 2412 - DNA, 563 bp, Artificial
  Synthetic
aatctgttgagacacccggtttgcctttgactgcaccagctgccacgcgcgacaaggctcaaggcacaaggcacaaagcctctcctcctcctttgtatcgcataaaccgccatggctgactccggcgataactaccgaccgcgtgagaggtctcgatcacctcggcgacgatctaggagtccaggccgacagtctcgtcggaggtcttattcgcctcgcagcagatcaaatagtcgggacgactatcgacggggccgcgatcgctccccaatgactggaacaggagctgcaccagccggtggtcccactggcaattatgcgggacagcaatcccatcgatcatacgaagaacgggccgcagcccgagagcagatgatgagcaacattcgagagacgtcccagcaggaccgccgcgtctatgtcggcaacctctcatacgacgtcaagtggcatcatctcaaggattttatgagacaggctggagaggtactcttcgccgatgtactattgcttccaaatggaatgtcgaagggatgcggaatcgtggaatatgctacaaggga

SEQ ID NO: 2413 - DNA, 826 bp, Artificial
  Synthetic
  misc_feature (633)..(633): The residue at this position can be any nucleotide.
tggagtcccggtgctcgacgtagtatttgccttttttcgagcgctccatccttcgttgtcattgccggctcttataaacaaggcttcaggctcttccataaccaaaaactaacacgcgaaagcggctgttgatctcccagccttattccgcgcattcctctgccaccaataccatggaccgccagaccatcatggagaccaaccggtctcttcgaaccattaagaatgagctcgaaagcctcctcgagaaaggcgtcatcgacgaagccgctttcgacactattcatgccgccctgcccgccgaaactcctcttcgtggagccgctcccggaagcgctgctcgttctgcaaaccaaacacctcttcagcctgtggcggctgcaactcctccggtccaggcccctgtccaggcctttcagaacctcaacgtcaacggaacctctcccgcccctccttcatacgatgatactcccgctcctggcgtcccacgcgctctccggctccggctgggaagcccgttttggcccatgcgagagccttgtaccgctacgatgccagcgatgcccgcgacctgagcctggaaaaggacgataagatcgatgtctacgaatacatgaaccaggactggtggantgggcgtaaccaccgcactggcatggagggcatcttcccccaaaactacgtttttgtcgagcaggagcaaaaggctcctatgccagctcccgtggcctaaccccagcagccggcatatggctacccgcaggggacctccggcgcagcagaacccttacaatgccagtgtgccacctatggcgatagcagaggg

SEQ ID NO: 2414 - DNA, 428 bp, Artificial
  Synthetic
cccacgcgtccgagaagaaacagatctgaagatggagtgtgtatttggtctagttgggaatggattcgctatcgtggcggcggatacatcagcagttcacagtattcttcttcacaagaacaaagaggacaagatcatgactcttgactctcacaagctcgtcgccgctagtggtgagcctggtgaccgggttcagtttacggagtatgttcagaagaatgtgtcactgtatcagtttcgtaatgggattcctttgagtactgctgctgctgctaacttcactcgtggagaacttgccactgctttgagaaagaatccatattcggtgaacatcctgatggctggctatgacaaagaagccggctcatctctactacattgactacattgcaaccctccacaaggttgataagggagcatttggatac

SEQ ID NO: 2415 - DNA, 616 bp, Artificial
  Synthetic
aactctgcttaacgctgcttgttctccaagacagacgccttcaaagctcttattcgaaaccaaacctcagatttgtgtgtgagaaatcctcagaactttttcctagaagaagatggagtgcgtgttcgggatggtgggcaatggatttgcactggtggtggcggattcatccgcggtgcatagtatactggttcacaaatccaacgaagataaaatcatgatcctcgattcgcacaagctcatgggagcgagcggtgaagccggcgacagagctcagttcacggagtatgtacagaaaaatgtggcgttgtaccagttccgtaatggtattccgttgactacggctgctgcggcgaattttacaagaggcgagcttgctacggccttacgaaagaatccttacatggtgaacattatcctggctggctatgacaaagagacaggcccttctctttattacgttgattatatcgctactcttcacaaagtggacaaggcagcatttggttatggttcctatttctctctcgccatgatggataggcactatcggaaggacatgacagttgaagaagctgttgatttagctgataagtgcatcttggagatccgatct

SEQ ID NO: 2416 - DNA, 247 bp, Artificial
  Synthetic
gatacatcatacccaacacacaacacagtcatcatggaggttcttctgggaattacaggcaaggactttactctcatcggcgcctccaaagctgccatgaggggagccaccatcctcaaggcatccgacgacaagacaagagcgttgaacaagcacactctgctggctttctctggagaagctggcgatacagtacaattcgccgaatacatccaacgaaatgcccaactctactccatgcgcaacg

SEQ ID NO: 2417 - DNA, 588 bp, Artificial
  Synthetic
tcttgttcatcttgctaccgctcacaaatcaccagccaagcggagacttaacaagggcttatgtacatgtaggattgggccgtgtccgggaattacctgttaggtactaaggcatgtaagagatgatgcaatcacaaagcaaaacccttttgatggtatcaaagtaaggcatcaacatcaattaatgtctccgaaactacatgcaatccgtagctccaagcccctctcattcttcaacttatcatcatctttactccttttatacaaaccggagcccacaagccttgccgattctaactaaactaaaccctcactccccgcttccaaactaccggcgactttacaaccaacaaatcttcaccatgagtgcctcacagcaacacgacgaggagtccaaagccctcgcctcaatcatcccaaccttcactccttccgaatcttccgaatccactgccgtcaaatcaatcatcagctccctctccctcatcgagcacgtcgaaggaggctatttcgcagtcacagacgtcagcaacatcaagatcccttccccgtacccagccacgcccctctcacagcgcaccatcgacc

SEQ ID NO: 2418 - DNA, 602 bp, Artificial
  Synthetic
tgttagggtttgttaatctggtcagcaattcagaattcctgtttcctcaaagatgaagatgatcgtgctaaggagttccgacggcgagactttcgaggtagaagagtcagttgccctagagtcgcagacaatcaagcatatgatcgaagacgactgcgccgacaccagcatccctttacctaacgtgacgagcaagatcttagctaaggtgattgagtactgcaagcgccacgtagacgccgcctctaagactgaagataaggccgtcgaggacgatctcaaggctttcgatgctgattttgtcaaagttgaccagagtaccctcttcgatctcatcctggctgccaactatttgaacataaagagattgcttgatctgacatgccagacagttgcagacatgatcaaagggaagaccccggaggagatccgtaagacatttaacattaaaaatgacttcactcctgaggaagaggaagaagtcaggagggagaacgcctgggccttcgagtgaatttgagtctgttaagcgtcaatattgtgctgatagatttgcaatatcttagtagatgttataaacaatcttgtatattagtaaatat

SEQ ID NO: 2419 - DNA, 595 bp, Artificial
  Synthetic
acctcagctgcaagcttaccgccccctgtgcaagcctttcgcatcgatctctaatatcgttccgtctcgccgacgaagcttctactcaaccaaagcatcatcgtcccatcatcacaatggcggaagcaaagcctgcgtcccagaagatctggttggtctccaacgacaacgcgaccatggaagtcgaccgtgccgtggttgagcgatccatgctcttgaagaacatgttggaggatctgggcggtgccgacgtcagccctgagaacccgattcccatccccaacgtcaacgaagcagtgctgcgaaaggtggtcgagtggtgcgagcaccaccgcaacgaccccgtcgccgctcccgatgacgagtcggatgcccgcaagaagaccactgatatcgaggagtgggaccagaagtttatgcaggtcgaccaagaaatgcttttcgagatcatcttggcctcaaacttcctcgacattaagccgctcttggatgtgggctgtaagactgtggccaacatgatcaagggcaagtcccccgaagagatccgcaagacattcaacatcacaaacgatttctcagccgaggaggaggagca

SEQ ID NO: 2420 - DNA, 700 bp, Artificial
  Synthetic
attatctctctctctctctctctctcaatatatctcaaaaaatctcaattctagggttagtgttgctacgatgtcgtcctctaagatgatcgtattgaagagctcgaacggcgagactttcgaggtggaggaagcggtggctttggaatctcagacgataaagcatatgattgaagatgattgcgccgacaccagcatcccccttcctaatgtgaccagcaagatcttggctaaggttatcgagtattgcaagcgccatgttgatgctaccaaaactgaggataaggcttctgaggatgagcttaaggcctttgattctgattttgttaaagttgaccaggccaccctctttgatctcatcttggctgccaactacttgaacatcaagagcctgcttgatctcacatgtcaaactgtggctgacatgattaaagggaagacaccagaggagatccggaagacctttaacatcaagaatgacttcactccagaggaagaagaggaggttaggagggagaatgcttgggcatttgagtgagctttaaatctcataatctggggataaatttggaatatatcttactagatcgtatgaaaaatcttttgtgttagtaaatatgtgagtacggtatttgctttggatccctgactttgttattcaatgaagtggcttgaacctccttttgctattatgaactct

SEQ ID NO: 2421 - DNA, 787 bp, Artificial
  Synthetic
gcgttttgcattggccaatatagcctggaactttattttggggcaaaagcaagaagcctggaacaagcttgttgtgtttgttagcgaccaaaaaaaaggtacctgcgactacaactgagggtcccccagtggctgaacgacgacttacacccgttggcagcagagcttttgtcttttcaccacaacaattttgacattcgtctatacaaaacttgcacggtttctttcacctggcaggtagcatctcgacattcaccatgtccaaactccagatttgggcctcgtggcccgaagcccacctcttcaacttccctcctgccaaccctccggccccaatcccaccggcacatgtccctgccactattctgaggcccttcaacatcccagatgatctctatgtgtctgctctggatgctcgagttccgttgacgattgctgctctttatgccatctcggccaagctgctcaacaagtacaacaaggcgcgcaacaagaagccctggggcatcagcaaaacacgccccttcttcgtctttgtcgtcctgcacaacatcttcctcgccgtctactctgcctggaccttctggggcatggtcggcgtcatgcagaggagtttcgtcagcccctttggccctggcggcgtcgcagctactgcggatggcttctgccgcccccacggacctcgtggcctgggcaactccatctacttcaacgagaccactttgagctgggacagtgcttcaccgagctccgttgcgcatctgcttgcttccaatggcatgcctag

SEQ ID NO: 2422 - DNA, 923 bp, Artificial
  Synthetic
gcttttctcctgggattttcgagtgcaaacatctgcccttgtttgcgtctttccgcctgcgcaaaccagaacaccgcacttcctcccgagacagaaacgagtgttggttgccccagactgtctttgattctgagacatttggcctcccttgcaggtaactgacggtgagaataaaagccgacgggccgccgcctgcagcaaacgaaaccagcgacatacaaaaagaaacacaaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccggcgcgcccacgttcacgcacggcacgccgccgaaagccaccccaccgcccacgccgctgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacagggcaaggcattgctgatggtgaatgcacaacacgcgtggcagactggccgaaaattgatgatttactgatgggcgactttggacttgaaatggggcatgccggatgggttacttgacagtatttacaccatttctattcaacaataaatggaattctctagataaaaaaaa

SEQ ID NO: 2423 - DNA, 524 bp, Artificial
  Synthetic
gatcctcaatgggcagatctgtgtgagagttggggtatataaagacatctgtctctgccccggatcctgactttttctccagcatcaccccagcaagcattcgcctctcgttcagatctcaagacaaaaagcactcaaaccaatcactcaacctcttcaagaccacctttcaaaacaaaccttcaacatgaagttcaccgccgttgcctttgccgccctcgctactctggctacagccagccctcaccctcctcctcctcacggttgcaagcctgctacctactcttgccttcccaacgacagcggttggcaagtgtgcagcactgccggtcagtgggtgtttgctggcacctgccctcccaagactgtctgcaagttcgacagccaaaatggcagcccctactgcgttccccccaacttcaccatcccataaatccattaaatggggatcaacggggctacttacaaaagcctaccggatgagcatgagatttagagtttttggttgctaagacgtttcgtgg

SEQ ID NO: 2424 - DNA, 719 bp, Artificial
  Synthetic
accacgcgtcgccatctcgaaaaccccccttctgagcattttgtgctgaggaggtgtaattactattgataattatttgattggagtcttcattttttttttttggaataacgagatacgaagtgactgcgctctcccccctttatctacctatccatctttgatatccgagtaaaatctacacacacacacacacaacacacaaaaccatgtccagcaacccgcccatccactccggcgccgacgcggcccaaaccgcctcaacctgcgcaagtctcaacatcaccaccgccgagttcgccgagctgcagcgccgcgccacggcggcaaaggccaccgcgtactgccgctacagccggttccgcgtgggcgcgacgctgctctgcgccgacgacgccggcgagacggtttatgtggccggggccaacgtggagaacgcgtcgtatcccgtcgggacgtgcgccgagagggtggcctttgggacggcggtgacgagcgggattaggaactttcgggcgattgctgtggcgacggatattagtccgccggcgagcccttgcgggatgtgcaggcagttcatccgcgagttttgctccctgcagactcccgtcatcatgtttgacaaaaactccgactacgttgtcatgacaatcgaacaactcctccccatgtcgttcggccccgaggctctcccgcctcctggcgcctcgggatattga

SEQ ID NO: 2425 - DNA, 873 bp, Artificial
  Synthetic
tctagatcgcgagcgccccaatcccaccaccgatcgatccattcctgctgctcgcggccaccggagaaggagagagagagagctcgacctcgtcggcgggtgaaggatcgcagcagcagcagcggcggtagagcaggaggagaggcgaagatgtcgtcggtgttcagcggcgatgagaccgcccccttcttcggcttcctcggcgccgcctccgccctcgtcttctcatgcatgggggcggcgtacgggacggcgaagagcggcgtcggggtggcgtcgatgggggtgatgcgcccggagctcgtgatgaagtccatcgtgcccgtggtcatggctggtgtgctgggtatctacggcctcatcatcgcagtcatcatcagcacggggatcaaccccaaggccaagccctactacctcttcgacggctacgcgcacctctcatctggcctcgcctgtggtctcgccggtctcgctgccggaatggccattggcatcgttggtgacgccggagtcagggcgaacgcccagcaaccaaagctgttcgtgggtatgatcctcatcctcatttttgccgaagcgcttgctctctatgggctcatcgtcggcatcattctgtcatcccgcgctggccaatctcgtgcggattaggcatgtttcaacacgcaaacccttagtgggttcttgtttcatattcctgaaactacaagctgagctctaggggtttattctgtcttagtttctgttcttctgttgggtcatgaacaaaaaaacatctgtatccaagggatgtttgcccttgtggtgccattctttttcgctatggtggtgctggcggcggtctgaatcttatttatgcacagtttttttgggtct

SEQ ID NO: 2426 - DNA, 805 bp, Artificial
  Synthetic
ctgaatccccaaatcgaagcactcctctcctctcctctcctcagatcggatcgcgagagccccaatcccaccaccgatcgatccattcctgctgctcgcggccaccggagaaggagagagagagagagctcgacctcgtcggcgggtgaaggatcgcagcagcagcagcggcggtagagcaggaggagaggcgaagatgtcgtcggtgttcagcggcgatgagaccgcccccttcttcggcttcctcggcgccgcctccgccctcgtcttctcatgcatgggggcggcgtacgggacggcgaagagcggcgtcggggtggcgtcgatgggggtgatgcgcccggagctcgtgatgaagtccatcgtgcccgtggtcatggctggtgtgctgggtatctacggcctcatcatcgcagtcatcatcagcacggggatcaaccccaaggccaagccctactacctcttcgacggctacgcccacctctcatctggcctcgcctgtggtctcgccggtctcgctgccggaatggccattggcatcgttggtgacgccggagtcagggcgaacgcccagcaaccaaagctgttcgtgggtatgatcctcatcctcatttttgccgaagcgcttgctctctatgggctcatcgtcggcatcatcctgtcatcccgcgctggccaatctcgtgcggatgcggccgcttatccgtatgatgttccggattatgccgagctctacaaacagctgttgaattttgatttgctgaagttggcgggtgacgtggaatctaaccctggtcctaggtct

SEQ ID NO: 2427 - DNA, 602 bp, Artificial
  Synthetic
acatattaaagccccagcaggccaagtcatcgacagcgtccctcgcgcatctgccagacttcggaagcttcgcacgagcaccagaaaccactcctccctacgcctctttaaaatctttatcgcttcgataacccatcgtcgtcacaatggccaccgaactttgccccgtctacgcgcccttctttggtgccatgggctgcacctgcgccatcgtcttcacctgcctgggtgcctcatacggtactgccaagtctggtgttggtattgccgccatgggtgtcctccgccctgaccttatcgtcaagaacattgtccccgttattatggctggtatcattggtatttacggcctcgtcgtttccgtcctgatctccgatggtctcaagcaggacctccctctctacactggcttcattcagtttggtgctggtctctctgtcggtctcgctggtctcgctgctggttttgccatcggtattgttggtgatgctggtgtccgaggaactgcccaacagccccgtctcttcgtcggaatgattctgattcttatttttgctgaagtcttgggtctttacggtctcattgttgctctgttgatgaac

SEQ ID NO: 2428 - DNA, 645 bp, Artificial
  Synthetic
  misc_feature (597)..(597): The residue at this position can be any nucleotide.
ggaacttttagatccgatcattacacttcttctctctccaaaaacaacttcgcagaaacaatggcgtcgactttcagcggcgatgaaacagctcccttcttcggcttcctcggcgctgccgctgccttagtcttctcctgtatgggggcagcttatggtactgctaagagtggggtaggagtggcatctatgggtgtgatgaggccagagctagtgatgaagtctattgtgcccgtggttatggctggagttttgggtatttatggattgattatagctgtgataatcagtactggcattaacccaaaaaccaagtcttattatctttttgatggctatgctcacctttcttctggtattgcttgtggccttgctggactttctgctggtatggccatcggaatcgttggtgatgctggtgttagagctaatgcgcaacagccaaagctctttgttgggatgattctgattcttattttcgctgaagccctggctctttatggccttattgttggcatcattctctcttctcgtgctggccagtccagagcagagtagaagatgagcatgttatgctccgtaactgtgaattatctntttgttcttccgcattggatgagatagtctggctgctgaattatgtta

SEQ ID NO: 2429 - DNA, 516 bp, Artificial
  Synthetic
  misc_feature (433)..(433): The residue at this position can be any nucleotide.
accgatcagaaaaattgtcatcaaaattccgatcggtcactggcgaaatctctgataaactgaaaaaaatgtcatcaactttcagcggcgatgaaacggcgcccttcttcggtttcctcggagcagctgcagctctcgttttctcctgtatgggagctgcttatggaacggcgaagagtggggtgggggtagcctcaatgggagtaatgaggccagagcttgtgatgaagtcaattgtgccggttgttatggccggagtgttaggtatttatggtttgattattgcggtaattatcagtacgggaattaaccctaagaccaaatcatattacctttttgatggatatgcgcatctttcttctggtttggcttgtggtctggctggcctttccgctggaatggctattggaattgttggtgatgctggtgttanagcaaatgcacaacaaccaaaactgtttgttggtatgatcctgattctcatcttggccgaggcattggctttatacggactga

SEQ ID NO: 2430 - DNA, 860 bp, Artificial
  Synthetic
gtcgtggttcgtccccccctctaaaaaacctgccctctgaaactctctccaaaaccccacgatataccccgcgtcatcgcttgtattgccgagctgtaccagtgctagccgttgcctcactacagctctacccgtcttctccaaatagaatcccccaactctttatctcaacctcaattcgattcatttctgtccaattgcctctcataacacccgcgtcgccgagatctacatccagggacacggaatttcaccactaccagcaagctcctctgctgtataactaaaaccaagcttcccccgaattacatcatcgcctcaaaccgccaccatgagcgcagacacgggcgaaaaagtcaacacccacatcatcacactcacgcgcttcctcaccgaagagcagattaagcacaaagaagccactggtgatttcacattgctctgccatgctctccaatactccttcaagtccatcgcctactacatccgtcgcgccaccctcgtcaacctgacgggtctggccggttcctccaacaccaccggcgacgagcagaagaagctcgacgtcatctccaacgacctcttcatcgaggccatgcgctcctgcggcaaagtcgccatgctcgtgtccgaggaggaagagacggagattcacttcccccaggccgccggcgcccgctacatcgtctcctgcgaccccatcgacggctcctccaacttggacgccggagtgtctgtcggcacaatcttcgccatccacaagatccccgacggcgtcaatgtcgctagcaaggaggacatcctcaaaccgggcactgagctcgttgctgctggcttcacaatgtacggcgcctccgccc

SEQ ID NO: 2431 - DNA, 737 bp, Artificial
  Synthetic
cacgcgtccgcagctacaaagacatctactcatctacacacaaacaaacattcaaaaagcatcatcacacaaagcttccaaagctccagcttctcaacaatccactattctctacacttcaaaccacaacaaccacaaccaaaaccttcaaaatgttcgtcggtgacctcgtccacttccgcgctgctctcagcaacggcatcacccacgagatgattctctgcccctcagccgccacttctcccgccacctccgccgcaaacaccccagacaaccgctccctcgcctcggagaagaagaagaagcgtttctcctctttcttctcccgccctcgcccttctgtcaaggccgccaacgtcggtgctggcatgaagctgcccatgaacattgcctaaataaaaccaatctttcacaccaacaaaacaactacaacaatgtgctcctgaactgcggatataaagaggaatggatgaaccggtctatgcccagcacgatggaataaaatacacaaaacacacaaacacaaaaaacacactcctttaagagacgacgaccaacgaaacaacaacacctaaaagtttttttgctttttccgacactacttttttctttctcttttgtcacaagtttttttgggcatggattttttttacacacaggggcaggctgggagcacaaaacagtttttatgagtattagattctatacccatttgattcgagaaaacgcaatgatac

SEQ ID NO: 2432 - DNA, 321 bp, Artificial
  Synthetic
gccaatcgggaacaaaaaagggctgcgcgttctttttgcctctcctgactccttacagatgggtggcattgctaaggtacagtgtggagtctgcagtggattcgagagctgcgatttcagttgtttggacctggacggagaattttacggagcagctcacccttgatgcagtttaggtaggcggtgtctcttgttggcgtgttttataagagcaactttgctggtggtaataatgatgtccatgctattttcgtatttctggaataggtacctggtatggcaaagagaatagaatgatggtgaatgagattacacagttcg

SEQ ID NO: 2433 - DNA, 726 bp, Artificial
  Synthetic
aggggaagtaataccatggcatcgctaaacatgcacagagcagcgtcgcgattcgtcgccgcttcaatctcgaggccactgccggcatgtcgaatcgcagtagcctctcagcggcatctcagcaccggcatgcggatcccagtcattgccgcatcacggcctcacgcaaggaagacacagcgccctattccgagcggcgtacggacaatcttcatccagactgaaaatacaccaaacccggatgccctcaaattcttaccgaaccaccgcatcatcccgccagacatgagcaccccgtttatagagtatctcaacccgcgagctacgatttctccgccgcatccctcgcccttggctgcgaagctcatgaacattgacggcattacctcagtcttctacggagccgactttatcactgtaaccaaggctggagatgccaactgggctcatgtgcgacccgagatctttgctctcataaccgaggctatcacttccggcgagactatagtcaatgtcgcggagcgcaagggggatgagtccgcggctgtggaagaagacagtctggcttacaacgaaaacgacagtgaggtggtgggcatgatcaaggagctgctggaaacgagaatccgcccagccatccaggaggacggtggcgacattgaattccgtggcttcgaggatgggcaggtgctgctaaagctgcgcggagcttgccggacatgtgac

SEQ ID NO: 2434 - DNA, 456 bp, Artificial
  Synthetic
agactttatgttgttggcggtgaatggctcaacatcgaagctctaggcgccggaggtattgctcctgttgcaagcttggccgcaaatgggaaaacttttatgccgggctgttttttttccggtttgtcaatggggccgtgcgattacctaagatgaggcagagcagcggcggcttcgagtttgaatttacaagaaacatggattgtgctcggagtacgccgtggtatgtaggatggtctgtggctgaggtcgtccagcttcaggtgtttatatatggctttaccggcagatttcacaagctcaatcgacttttggaaagtgtgtttcaggctattcttgaactttatactcgacgtataagtctggctaagagattttgctatttcctatatcattatcataacatgggcatatatgggtcaatggatggtaaatgaaatttgatttgtacgggac

SEQ ID NO: 2435 - DNA, 295 bp, Artificial
  Synthetic
cgcctcttacgtgtcaatggcctaaaggcgccagtagtatactccgtactggtagtatatcgtggaatcattaggtagctttcctcatacggcctggcgctccctgtaaacgacctgtgaccaaacttcgaacacgagtatcgtcgtagcttcatttcatcgagtttttcagaatttcgaaaacaatcaattcagtttggtgaaggatgacaatgtgtacagaatactacacgccacgtgttgattgcatctacctccgccggcgtctcttgtgcaataactcatcctccacatc

SEQ ID NO: 2436 - DNA, 686 bp, Artificial
  Synthetic
attgagcatagagaagacaactttgcaaactctatagagttttataatgcaacctggcctcgtgagctttgcataaattttcccctagaggctataattcagaagcatgcagagaatatttagttcttgttgaatataacaaggccccctacccaaaaaagcgcacaaactagataatgtctacaacaactttgactaaggtggggcagagaattgcttcaaatgctcgtcgtcaagccctcactttgacagatgccgcagcaaagagagttcaagatcttctgaataaaagacataaaccctttttgcgactcggtgtgaaggctcgtggatgcaatggactcagttacacccttaattatgcagacgagcaaggaaagtttgaggaattagtggaagataaaggagtcaaaatcttgattgatcctaaggccttgatgcatcttgtcggaacaaagatggatttcattgagggcaagctcaagtctgagtttgtctttataaatccaaactccaagggtcaatgtgggtgtggagagtcatttatgacgtgaccaaggagattcatatcgttacattcacccaaaatccaagggtgtacgaggttagggagactcattaatgttttcctcaatcaaatttatagctttgcctataacatgctgtgctattttctttaacaagca

SEQ ID NO: 2437 - DNA, 829 bp, Artificial
  Synthetic
gcacgtttgggcagcatctttatgatacaatgatgaacgtctccttctctaccggccgcgctgcgctgcgcctcagccgctcgtccttccgccacctgtgcgcatccagagtcgccggctttgcttaccactcctatccgctgccgtccaaaatccccgagcctcccacaagcgacaacctctccaagtcatcccttgcccagccagaggcccttcctcgcgtccacgagacacggccgcctcctcaacacgatgccgtacccaagccgatggccccaccgcaggttgaagctcagtcgccttctccaacaacctcctcagttcctccatctcccaaagccgccgagaccgatgcgcaaaagacacagcctgctcccgctgctcgacctcgttccaagcttcgcgcgcgcaaggccgcaatgaagctcacacccgccgccgtggagcagctgcgcgcactgctcaaccagcccgacccgaagctcatcaaggtcggtgtgcggaaccgaggctgcagtgggctcgcataccagctggaatacgtcgataagccgggcgctttcgatgaactggtggagcaagacggcgtcaaggtcttgattgacagcaaggcactcttcagcatcattggcagcgaaatggactgggcggaagataaactgagtcagaagtttgtgtttaagaaccctaatattaaggagcaatgcggctgcggagagtcatttatggtctaaggagcttgtgaagctacaaaggaacaagacaaaggccatggcacatgagaatactaccaaggccgatgtatggagagattgtacgatgacgacta

SEQ ID NO: 2438 - DNA, 559 bp, Artificial
  Synthetic
  misc_feature (518)..(518): The residue at this position can be any nucleotide.
ggaacgaggatgatgcggaggctatgttcagcgcaggttaggaagaagaatggcagcggtgtgtgccgtcaaggaaggcctgaggcaagcttcatcggccaggaagcaggcgcttgcattaagcgatacggctgcaacgaggattcggcacttgcttgatatgaggagcaagaatttcttacgcttgggagtgagagttcgaggttgcaatggcctcacctacaccatgaactacgcagacgaggctggaaaatacgatgagctcgtggaagacaaaggtgtcaaggtgttggtcgatccgcgggcattgatacacatcgtcggcaccaagatggatttcgtagaagaccgtctcaagtcggagttcgtgtttataaatcccaatgccaccgccaaatgtggctgcggcgaatccttcacgaccggctcacaaactacacggccgcaaagtcagtaggagaacttcttgatatgattggtcagacttggccaaatttcaacggtagaatgaataaatnggtcggttgttcaagcttgccaatttttgaatctgaaaaaa

SEQ ID NO: 2439 - DNA, 531 bp, Artificial
  Synthetic
ggagtttgttcgtttatttcgttctccctaagatgttgcggatcatgatgtagttgctctccaagtatacataagatagccataaacatagccacagcagcgcccaacaacaactgggaccaagggtgggtggaagtctggcttccagcacagtactttgcatgatagagtcatgacaatgtcatgaaaagagaattgtatgtacatgtcttatatttcctgatacagcttgggcacggagcgcgtgtgacgaaggtaggtgatggttgctacgtataggtaggttgggattgaagtcacatgcttcatcctcacttgtatgaaacccgtttctcagcccataccagcatatttgaaccagttgggacggcaatcttctcggtggaggaacggctcaccatccgtcagtcgaccagtaacacagcccttgcatttgggagagttggggcagttgaaaaaggggatgtgctggtagccaatatcacggaaccagtggattttgctagaatcctcaaatagacccagggcaat

SEQ ID NO: 2440 - DNA, 713 bp, Artificial
  Synthetic
actttgtgtacctcgagatcgggtataaagttacctcggggcgcctcttagtgctggcgttcgtggcttgtctgctaacaatcaggttatatccagagcttgggcaccagagctcttcttacactgccaatctctgcatcatctcgtaaacagagtatacaattctggatacaatttttcttcgctccatggggtctcaagtccaagaagagctgacagtgctcgtcactggatttcagcctttccggccagaatatccaatcaacccgtcatgggaaatcgcgagagccctcccagaatacctccctccgctaagggccaaggacccaaactctcgaaatgccgtcgacatcccgcctgtgcgcattctggtgcaccccgaccccatccgagtcaactacaaggtggtgagggagcttgtgccaacactgtgggaggagacgtacgcgggccgcaagattgacgtcgtcattcacatgggcatggcagggccgcggctcatgtatcagatcgagagccgaggacatcgtacgggttacaagtctctcgatgttgacgggaagcaccttgacgagctcgatgggaaacgggacgaagagtggatctggcatggcctcccggatgtgctgaagacggacttgaatatacaggacatctggcagagatggcagcagcacagctcgaatgacatggatcttcgaatctctgacgat

SEQ ID NO: 2441 - DNA, 642 bp, Artificial
  Synthetic
acgatgctccacgattcggaaacccaaggcacaagccattatcgcggtccggatgctagttggcctggacccctcctcgtatctccttcatccgttttgccgtcagctttgtcgctctggcttgacgcatctccatcacccaagtctgccctccaataaacgcttcttccccctcgagtccagactctctgttctgccactggctctggctctggctctaagcgatctccgccccggtccgtccaagcttgccccccgaagatgacggccgatgccatctccggctccgggcccgcatccggctctccccagcctctccggctgctcatcctcgaggccgatacgccgcagcccatcacaaacgccaaatatggtggttaccgcggagtcttcactgctctgttgacggcggcggcggaaatcatggttccgccacggcagctctccgacgtggccacaatcacggcgcacaacattgtggaagacatgcagtcatacccgccgctggacgacgtcgacgccgttctaattactggctcgcgtcacacggcatatgaggatgacccctggatcctgaagctggtggagtatgcaaggcaggccatcgacaccggtcgcatcaaggtcgtgggcgtgtgcttt

SEQ ID NO: 2442 - DNA, 590 bp, Artificial
  Synthetic
ggggggggggatgatatcccgggtgtatttgtactagctatcaaaccaaaaactctttctgtcatctaaaaaagaagagagaacagagatgctatgctcattgctatatgcgaaacaatctatatcaggggggggaaataatacgccaaaaccgtcaactcaaactcatgtgccagagtgaaacaaccaagaagaaaagagagcaaagccatctatctagctttctactctaaacaaccaaaaccaaaaacaacgttcgtaaaatctctaaactcaaatctcttgcgcatgatagtgctctacgccgctcatctgttcgactgccatattctgcacagcctcgccgggcttctccgtcttcgccctcaactccttggtaatctcctcaacctccccctcaacatcgagatagcgcctcagaaacttgccgacatcggtgttctcgacgtttccacgaatcttttccgtgccgggccctccagacgagtaaatattgacgtcgacggcggtgtgtccgtgagtgctccatccgacgtgggcgcgcagggaaatcatcgcagagaggatctcgagggaagcctcggcgttgt

SEQ ID NO: 2443 - DNA, 214 bp, Artificial
  Synthetic
ggcgtttgtggttgacagagggagaggctgtgtttggttgaaggaggagaagaagaagaagaagatgtgaagaggaaatgccgaaaagaaggatgaaagatatgttcttgtctcgagctctttccaattgctctggccttgtgcataccatacagaggcaggcagtcgcaagaacaaataacgaggcaatttgcaatgcaaaaaaaaaaaacaa

SEQ ID NO: 2444 - DNA, 688 bp, Artificial
  Synthetic
cccacgcgtccgctccctcaacaaatatcacacttccattacatctttgaagttcttttcattcattttatcaaaatgacaaattcctccaattctgtttttgcccatgttgttcgtgctcctgaagatcccatcttaggagtcacagttgcttataacaaagataccagcccactgaagttgaatttgggtgttggcgcatatcgcactgaggaaggaaagccccttgttcttaatgtggtgagacgggctgaacaaatgctcgtcaatgacacgtctcgggtgaaggagtatctctcaattactggactagcggattttaacaagctgagtgcaaagcttatatttggtgctgacagccctgccattcaagagaacagggtgactactgttcaatgcttgtcgggcacaggttctttgagggttggggctgagtttctggctaagcattatcatgaacgtactatatatataccacagccaacatggggaaaccatccgaaggttttcactttagccgggcttttagtaaaatattaccgttactacgacccagcaacacgaggcctggatttccaaggacttttggatgatcttgctgctgcacccgctggagcaatagttcttctccatgcatgtgctcataacccaactggcgttgatccaacaaatgaccagtgggagaaaa

SEQ ID NO: 2445 - DNA, 1227 bp, Artificial
  Synthetic
tcatcatcgtcctctcaatctcgttcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctgggaatcggcgcctaccgagataacaatgcgaagccatgggttcttcctgtggtaaagaaggctgatgagattctccgaaacaaccccgaactgaaccacgagtatgccccgattgcaggtatcgagagcttcaccagcaaggctgcggagctgatgctcggcgccgattcgcccgctctcgcggagcgccgcactacgtctatgcagaccatctcgggaaccggtgccgttcacttgggagctctgttcctcgccaagttttacaaaggcagccagaccgtctatgtgtcaaatcccacatgggcaaaccaccatcagatcttttccaatgtcggcatcaaggtcgcccagtatccctacttcagcaaggagacccgggggctggactttgatggcatgaccgctgccatctcagcggctcctgaaggttccatcatcctgctccacccctgtgcgcacaacccaaccggcgtcgacccaacacttgatcagtggaaggagttggccgtcattatccgagagaagaagcacttccccttctttgactgtgcctaccagggctttgcctctggcgaccttgctcgagacgccgccgctgtgcgttactttgtcgagcaaggcttcgagctcgtagttgcccagagcttcgccaagaactttggtctttatggagagcgagctggctgcttccacgttgtggctgctcctgccgctgatgccaccaccacaatcacccgcattgcatctcagcttgccattctgcaacgatcagagatttccaaccctcctttgtatggcgccagaatcgctagcaccgttctgaatgacgcccagctcttcgccgagtgggaggagaatctgaagaccatgtccggccgcatcatcgacatgcgcaaagctctccgttccaagcttgaagagttggagactccaggaacctggaaccacatcacagaccagatcggcatgttcagctttactggcctatcagaaccccaagttctcaagctccgcgaggagtat

SEQ ID NO: 2446 - DNA, 532 bp, Artificial
  Synthetic
tcccctcctcacaactccaccagactctcaaaacgatgctccgaaccatcgcccgaacccacgctgtggccgccaccaaggtcgtgcgagcctccactttttctgccacccccgccgcctcttttgtgcgattccagtccgtctgggccaaggtcccccagggtccccccgacgccattctcggaatcaccgaggcgttcaagaaggacgcctttgagcagaagatcaacctcggtgttggcgcctaccgagatgacggcggaaagcccttcgttcttccctccgtccgagaggccgagaaggaggtggtgaacaaggccctcgacaaggagtacgcccccatcaccggagtccccgccttcaccaaggctgctgccgagctcgcttacggcgccgactcccccgccgtcctcgaggaccgaattgccatcacccagaccatctccggtaccggtgctctgcgaatcggagccgagttcctcaacaagttctactcctccaagaagattctgctcccccagccttcttgggc

SEQ ID NO: 2447 - DNA, 728 bp, Artificial
  Synthetic
gctagcgggcttgtcaggaacgcggggaagcgattcatgtctactgcggcggcggcttcggcatcgtcggctccagctggagctcgatccggatggtgggaagccgtgcagccggcgccgcgggatccgatcctcggcgtcactgaggcttttctcgccgattccgatcccaaaaaggtcaatgttggcgtgggcgcgtataggaacgatgagggcaagccggtcgtgctggaatgcgtccgcaaggccgagcaaatcattgctggcaagcaaaatatggaatatcttccaatgggaggccttgtgaagtttaatgatctctccgtcaagcttgcctatggcgactccgctccagttcttgaggagaagcgagtggccgcggtccagacgctctctggaactggtgcttgcagacttttcgctgatttccagaagcgattcaagccagactcacgcatttacatcccggttcctacctgggccaaccatcataacatttggagggatgcccgagtcgaggctcacactttccgctactacaagccaagtacgcggggattggacttcgaagggtttgtggaagatctgaaaaaagcgccggagggatctttcgtcctgctgcatgcttgcgctcacaaccccaccggagttggacccaccgccgagcagtggaaggaaatttctcagcttttcaagagcaatggactcttcccgttcttcgacatggc

SEQ ID NO: 2448 - DNA, 697 bp, Artificial
  Synthetic
tgatcagctatggagagcgtggcgctcaagcgagtttctgctgtagccaaccatctcaatcccgagcagcagcagcagcagcagcagcaactctccatggctgtcgccgccagcgccggcgcctcttcggtgtttgatcatctggagcaggcgcccgaggatcccattctgggaataactgtggcatacaacaaggaccctcatcccgggaaagtgaaccttggagtcggagcttaccgcacagaggaagggaaaccccttattttgcatgtggttcatcgtgctgaggaacgtcttctagctgatcgctccagaaacaaggaatacttgtcaatcactgggctggcagactttaacaagcgaagcgcgacgctcattcttgggagcgatagccctgctatcgtggagaagagattggtaactgcgcagtgcctttctggaacgggttccttgcgtgtaggagccgagtttctttcaagacattatggtgtgaagctggttttccttcctaccccgacgtggggaaatcacttcaaggttttcatgaatgctggacttggtgttaagacgtatcgttactatgacagcaaaactcgtggtcttgactatgagggtatgctcgaggacataagtgcagctccgaccggatcggttattctcttgcatgcatgtgctcataatcccactggcgtggatc

SEQ ID NO: 2449 - DNA, 490 bp, Artificial
  Synthetic
  misc_feature (490)..(490): The residue at this position can be any nucleotide.
gtctctccactacttcccccccatcaagccctccgcccttgccgtcggcaccatcttctcccacttctcctctttgattggtttcgcccccgtcattggcgacaccatcaagcgagccaaggccgctgacacccccgaggagtttgcccgacagaaggagaacaacggcgtcctcgccctctacggatcttctctgctcggctccggtctgcagtcttacgccgtgtcggccctgattgtcctcaccggcaccaccaccactaagggtgctgcctacctcggaggtctcatcttcgccgtcaactccatccccaccctcgtcaccggaatcttccaggagaaccgacccgtcgagtacctcgttggcaagaccctctctgctctgctggagaccgttggtcttactctcactctgaactggtggggaacccgaaacgagactctttctctcgccaagtaagctgtatattaatgcattatgatgattcan

SEQ ID NO: 2450 - DNA, 676 bp, Artificial
  Synthetic
acggacatcattgtatagctgtaaaatcacaactcataaacagatctcgtcctttacatcttattctcttcaagctcatcacagcatcgtatcatcatagtcaacatgtctctccaatacttcccttccgtcaaaccctccgccatcgccctcggcaccttcttcaaccacggcgtcgacctcgtcgtcctcgcccccgtcttcggccagacctaccagcgcgcaaaggcctccaacacaaaggaggagttcatccgctcccgcgaggccagcggcgccgccgtcgcctggggcacctcgtttgtgggatctgccctgcagagctacggcgtgggcgcgctgcttaatgccacgggcaccctgagccacaagggcgctgcgtatctcggcgccttgatcttcgcggcgacgtcagctcctggattcatctctcagatctttagcgaaaagaggcctcttgacaccgtcggcgtcaatgtcgctgctaagctgctcgagactatcggcctgtccttggttctcaactggtggggaaccaggaccaatccctttgagtaaatgggatatctcttcgtaattctttcctgaggctggttctgggaggagttgacagggaatggaaaggccccatcatatatgacggcctttgttgtataacatcacacctaaattagtc

SEQ ID NO: 2451 - DNA, 857 bp, Artificial
  Synthetic
acacaagcaaatcaacaacacacacaacacaacaaacactcttacaacgcgctcacacaaccgagtctcaaaagactacatctctttctaagccaatcatcagccatcaaacaaacaaacaatcaccaaacctctcatctcatcatccaaaatggcctttcttcagcgcaacttttacactcccgagacctctttcactcccctcttccgccttcttgaggacttcgacaactactcccgccaaggcaacgacaaccagcgtaccagccgccgcactatcgctcactggcagcccaagtttgatgtccgcgagacgggcgaagcttacgaactccatggcgagctccctggaatgaagaagcaggatgtgcacatcgagtttaccgacccgcaatcgattgtcatccgcggcaaagtcgagcgcacctacacggctggcactcctccttctggtgctctcgaagactcttccaagagcggcgccatcactgagtctggcgagcacgagcgccccaagtctcctcacaaggctactgtcgaggacgaaaacgagactggaaacaccaccgcccctgccgaaggcgaggtggtcaaggccgactcctccaagaagcaacctaccgactccgccaaatattggctcaccgagcgaagcatcggagagttttctcgcactttcaactttcccgctcgtgttaaccaggatggtgtgacggctagctttacagacggcatcctcaacgtggtcgttcccaaggcggccaaacacgagcctcgccgaatcaacgtgctctaaagcactaccaaaacaaattatttctctaatactattttctattttcctttgttatccacgc

SEQ ID NO: 2452 - DNA, 1194 bp, Artificial
  Synthetic
cctttacctctaagttactagcccgatccgccagtcagagacacacgcacacatggattcgagcgccttcgttttgacctacccaattgtacggccctagcccacggtcttgcaaatggcgctcagacagcagcaaagcaggcgcaggcgcagcccccattcgagacgagaaacgggcctttgattgggggcgtccgtgtgacccgaagtgctatatctactgcagccgctgcccgcctcgtcgaagcttcttttccgcatctcccctcagaagcattttgcaccaggactatccgccgatagcatatattttttccctaaggcttacgcgcaaattccgatttcttacggacctacacgtacttcagttaaagtccaatcgcccaaaatgaacaccagcaccgtcaagagccgcttcctttctcaccccgaggaccttggtattgtcaccgtaggcttctcgggcggtcagcccaaagccggtgtggatgcaggccctactgccctcatcgagtctggtctcttgacccagattcgagatgagcttggttacaagctgcacggtgatgagacggtcaagttctacaacgacctgactcccgcgtccgaccccgactaccgcggcatgaagaaccctctccttgtctcggctgtcactcaaaagattgcatctgagacatacgagcactcttccaagggccgcctcacgttgacgcttggcggtgaccacagcattgccattggcactattgctggaactgccaaggctacgcgcgagcgcctgaaccgcgaaatcgccgtcatctgggttgatgcgcacgccgatatcaacacccccgagacgagcgacagcggcaacatccacggcatgcccgttgccttccttaccggcattgccaaggaagagaaggaggagtactttggctggatccaggatgacatgcgcctgagtgtccgcaagcttgtgtacattggtctgcgcgatgtcgatgctggcgagaagcgcatcttgagagagcatggtgtcaaggctttcagcatgttcgacattgaccgccacggaattggccgtgtcatggagatggccctcgcccacattggcgacgacactcccatccacctgtctttcgatgtggatgctctcgaccccatgtgggcgcccagcactggtactcctgtgcgaggtggccttac

SEQ ID NO: 2453 - DNA, 302 bp, Artificial
  Synthetic
gcgaatgatgctgatggattgatgatttggggttcaggctttttcccttctcgctcgtcgccacaatgtcaattgcatcagcgcccaatgcgcttcgagcctcatcagggtgcgcctcaaggctggggctgtctctccataaaggcccatcatcaagccttctcctgcgggtagcaagtgtctcgacaactgcgccgcaatgcaagcgcaagacaaaggacagcaacaagcgactaggcgtcaggatcctctacggatcgggcccgcgagagccggtgtccatgtccaacatgccgctgccg

SEQ ID NO: 2454 - DNA, 590 bp, Artificial
  Synthetic
cgacccacgcgtcgccccgagacgcaagcaaaagatgcgaggcagtgtcgtggctagcaggcccttgagccggataagctgctcggcgtgttgcgcgcggagccggcagtttagcaggtcgtttcgggtgcagtcggcacaaccagtggtcgtgcgagcgggattgagtggcggcgttggaagatatctcgatgctcgagccaagcgtggtacatatcaggtttcattggcgacgacgagatctttggcgacagtttcagatcgtccggtggttggactgggtccgttggaggagtatgaccggcgggtggacgctgggattctgcggaacgacgagcatcaacgaggcatcatcgagaacctgcaacatcttcacaatgagcttcgcaactaccatgcaccgcccgttgtccatcccagcttcgatctcctcaagcccgccaagaaatccgtcttctcatcgttattcggcaatggaggcgccgcaaaggctacaattaaggatatccccgagaacttacctcggggattgtatctatttggtgatgtgggcagtggcaagacgatgctcatggacctattctacgata

SEQ ID NO: 2455 - DNA, 355 bp, Artificial
  Synthetic
tctccttccaagatgggagagtttcacgtggggtagggggacattattctgtttttcacctctttgtcgttgtccctcatacggctttcgtaattacgccgttatgtacccatgtcctgtctgatgcgttggtcacgctggtcgacgctgcggggggaaggcaaacgaaggcaacagaacggaaaagggaaataaaaataaaagttgaacctaggggggtttgataatggccagcgtgcggcaggcttacaaaacaacgggaagattttcacgttgggcgggattacggctctgatttgttattcactctagctactagtcatggccgaaaacaataatgccaaggttttttcgg

SEQ ID NO: 2456 - DNA, 574 bp, Artificial
  Synthetic
agcaacattaattgttcttcttttgtctgggtgatagacttgtcttccaagcgacctctattagactccgtatagaactatagagccacacggaacaaacccaataggctattgccagcacacacacccgggaaaaaaaaaaggaacgacaaaaaaccttggaaataataatcagaaacccaaaagtgagacacacggaagacaaggcagacatcaattcacacccgtcccgtgtctctcaagtataaaacaaaactccagcaactaaaccacacatccaccgcaacaccaaaaaacaactatcaccatcaccatggccgccctcagcccggagcagatcgccatcatcaagtccactgtgcccatcatccgcgagcacggcaccaccgtcaccaccaccttctacgccaacatgctcgccgcccatccggagctcaagaactacttctccttgcgcaaccagcagaccggcgcccagcaggccgccctcgccaactccgtcctcgccgccgccacccacatcgacaacctgggcgtcatcgcgggagccgtcgagaagatcgcccacaagcac

SEQ ID NO: 2457 - DNA, 573 bp, Artificial
  Synthetic
tgaaactgaagagacaccatattaactccaagattcagctccctcagctcagcaatagcctcagcctcagcctcagcctcagcctcaaaataaaatggccgtcactggccttgttgcagtcgagacgctgccccgattcctcctcccacggctcagctggactgcgccgctcgccgcatctcgatctgctgcagcccaaccctttgcccctctacaagcacgaacgaaccaaagagcagtgcccgccttcaacaccaatttctcggccagaagatacaacaatggccagataccggcgctgaggcgagggtttcacgcgacgagtcgacgatcccgagagcatcatttcgatacgctcaagtttgtcaagcagctcaaggatgagggctttaccgaggagcaatcagtcgccatgatgaaggttctcaacgacgtcatccaggagaggtttgtgtttgcaatcctcaagggctcctaacgagcatgccattgctagtgctaataccaacacttcaattgcagcatccaaaacctgaccctaaccatggtcctccgcgacgatgctgccagaac

SEQ ID NO: 2458 - DNA, 493 bp, Artificial
  Synthetic
  misc_feature (206)..(206): The residue at this position can be any nucleotide.
agcccgtcttcaactcacttttgccaatctgcatgctctcaaccgacagttcaatcaccgcggcgcaatggctgaaaacatcctcgttctgggtgctggcgagcttggcctcgccgttctggaggcgctctccagacactccaagcgcaaccacagcaagattaccgtcatgatgcggcaggccacgctggactctgccgtattcnataagaagaagctgattcagcaaatcagggcgctgggcgtcgactttgaggcggctgatgtggtgcaggcttcggtgtcggagctcgccgccatcttcaccagatacgacactgtggtgtcctgcaacggcatgggcctgccgtcaggaacgcagaccaagctctcccaggcggcgctcgaggcaaaggtgcggtggtttccctggcagtttggcatggactacgatgccatcggcctgggcagctcgcaggacctatttgacgagcagctgggcgtgcgagcgatg

SEQ ID NO: 2459 - DNA, 482 bp, Artificial
  Synthetic
gattagatcagattgcaggcaccctcaattggcatcacatcatgctggcgacaagagcactccgagcggcccacgggcccaagcccaacatcaccggcttcaacatgcgagccctcaaagaggccactggccagccccgatacgacccttgggagagagccgaggcatggcgatacaagggcaccttttccagatggaaccgattccggagcggcttccctggcttgggaatcgcgtctgttgcatttgccggatactgcgcctacgagtacctcttcctcaaggatgaacaccacggcgagggacatggcgaggggcaccactagagcgttttttttttgcgagcgagagcagtcaggagtgtgcgagaggagaagagagaggaaatgtatatacatctctccaaagacaagaaaactcaggcctggtcttgcggcgggcaaaaaatgaatccaacacaaatcaatataaactctatttag

SEQ ID NO: 2460 - DNA, 642 bp, Artificial
  Synthetic
gatccaaatcccacaagtcgaaacgaacccaattggcacgcacaccagaggccatatacaaatacaaatatccccccccttgaaccgactctcgcccacccgcccatcatgcatctcatgtacaccctcgacgccagcggcaaccgcctctacaccctcaagaaggtcgcccacggccaggtcaccaagtctgcgcacccggcgcgcttctctcccgacgacaagtggtctcgccagcgcgttacgctgaagcgccgctttaacctgctcttgacgcagcagaaggaggaggctatgtaaattcgcatcatggagataccctcgaaccaaagaaatcccaagcggcgttaattgggagcgacttcgggcatgctttttgaggtgataattgattcgtcattgtcctctgttggcgatacgggataaagagaacggcaagctcttcttctagagagtcacaaagttggccattcgtcccaattcgggtaaccgactggctttgtttccttcgcttaggatcgatggaggaatacacttgagcgagcaacattgttcgtttggggacagcaatgagagactacaggagggggggtgagtgtctggcgagagcttgactaagtggatgggtggatggatgacaag

SEQ ID NO: 2461 - DNA, 666 bp, Artificial
  Synthetic
agctcacactctccaggctcacacaaaactcactacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacctggtccgttggcagcgccatctccaacccaacaacccttgctcaaggcggttcctatggcgagaccttctcacgagaccccgtaaccggcggtcgtgccatcaaggtcaccgtccagcccgatggcctctacactggcaagccccagaccaacttcgccatcaaccttgagggcaacaccatctggtacgatctttcagatgtctttggcgatgccttcaacggccacaaggtcgttgtttccagcgccaacactgcttgcccccagattgtttggggcagcggaatccctcctgccggaagccaggtcaagaactgcggtgcggataaggatgtgactttgactctgtgtgcttagagttaagggaggacggaatcatgtcaagggaaaggtttaaatcaagtttatgatagaatttcaagtcctagctatgtttaagacttatgacagtatgaattgatgagtttactcc

SEQ ID NO: 2462 - DNA, 572 bp, Artificial
  Synthetic
gacaagttcaattcgcagcaacagaagcggcgcagacagcatgagctcatcactgaggagctgcgttgcggcccggccgctggctcgcatctcgcagacggtcgcttcacggaacggcgtccagagcgtccggtgtctgtcccagacaagcccacgatgggaggattcaaaagatgcaaagccagaaccacccaaggcggtgcctccaaagcctcgaaccgagtcgctcctcgacagcatctacagcattacccaggcgccaaacagccggtccgcgcagtccaaccccatgggcagcctctcccagagcatggtcttccaggccctcagcaaatccaacatcgacaccagcgtcctgtcaggcggtccctcgcaggcagcgcagaagaaggaggatgaattggagccattccatttccacgtctactcgcacaagcacaacactcacattacatgcacaaagcccaatcgggaacccatcatctccatgtcatgcggcaacattggcttcaggaaatcacggcggggcaccttcgattcggcctactctttgacaaagtacgttttggagc

SEQ ID NO: 2463 - DNA, 233 bp, Artificial
  Synthetic
gccggctagcagtatagagcggatgggcatcgtagatgggcagtgacgatagtgtacacccggaaaaagtgactgcgtatcgctttgcccctccgtgtcttccgacgggattgtctcgataaaaatgacatcagcacgggaagaagaagagcatctccactaacggcacacacaaacacgcatagaacaagacgctctccgtactcctcggagccggtgctctccctgcaggg

SEQ ID NO: 2464 - DNA, 548 bp, Artificial
  Synthetic
gagccccaactcttttttgttttctgtatttctctctctcactttcactctctcttctctcttgtttcttctccttctttctcttggttacccagctaagtgaagctcaacaaccgcaaacatggctgccccctcgagcaagaccaccaagaacctcaatggcaaatggaccatgaacaagacgctctccgactcctcggagccggtgctctccctgcagggcgttggctacctgatccgcaagggcatcagcctggccaccatcaccctcgaggtcgagcagtacgagggcccgcccaagccgcccaacaccgccgccgacgtcgtcacgcacatcgacatcaagcagtccgcgtcgggcctgtcgagcacgcaggagaaccgctgcttcgacaacttcccgcgcgaccacaccgactggctgtttggcaccgtgacgggccgcagccgctgggtgagcctggacgaggtcaccgacgagttcctcaagaagggctgggaggtcgagggtgagggtcagagcttcatcaccaacattgctgagaaca

SEQ ID NO: 2465 - DNA, 637 bp, Artificial
  Synthetic
tgaaactgcgtctttcagttgactctggtgattctctgaggcgccgaggctctgtgtgagcatcccgatccaacatcatggcgatacgcgaggaaatcgtggcgtctgcagcgcaatttctacaagatcccagcgttgccacctcgtccgtcgagaacaaaatctcgtttcttcgaaccaagaatctgacacaggaagagattgatgccgccattgccagagctgggggcggtagcggcgcggtagctcctagggctccctatgctggcgcgcctcagggtcctcctcagggtcctcctcaacagtattaccaatcctacccccagtatgcgtggcagccgcctgcgtcaacacaacgggattggagagattggttcatcatggcaaccgtggttggaggggtcagctatggcctgtactcattgggcaagcgttatgtatacccccttgtagcgccacctacccctgaaaagctggagcaggacaagaagtcgatcgaggagcagtttgacaaggcctttgctctggttgagcagctgtccaaggacacagaggcactaaaggatgccgagaagcagcggacagaacgactggacattacactggcagacctggacacgatcatgacggagctgaa

SEQ ID NO: 2466 - DNA, 301 bp, Artificial
  Synthetic
aaacgaagtactgtaatcgtacgtactcaattgacgggctttcgacccctgttttgcatctgcggtcgaataaacaccgactgcatctccatcagattgcgcttggcggccgggtctactgttgcagttgatgccgcccaactctggcaaaacctggcgctgcggctgcggctggagaccgggggagcgattctggctgcccaaacgagaaccgggggggatgtcaatgcacagttgcatcgaaatttggcgattaatttttttacgagggaggattaggattaggactttgcacggtagg

SEQ ID NO: 2467 - DNA, 395 bp, Artificial
  Synthetic
tctaggtaaccaccagcacacgcaaacgatacgaaaaaccgagaacaagtataccttcagctccgcggacaacaatcatcaccgcggacaacaatcgtcactgcacgtctgcctagttgagagttccaagtgtaaaaacatcagcagttgccttgctgcgtggttcccaagtccagatagtcaacagatcaaacacaagacaaacctgcctgttcgattactttgcctccttgtagtacaattcgcaatagttcaccaaatcaccagtcatcatgcctgtcactgagtttgccattatcaagctgaggcccaatttcgaccccctcgagtttctcgagacactcatggagtgtcaagagattcaggacaattggattcgccgcaatcagccatgc

SEQ ID NO: 2468 - DNA, 846 bp, Artificial
  Synthetic
gggcaatcttaacggaatgaagctttcctggtcgccatgagagacatatgcggagaaaccgaaatgtgcaattgtccagcaattgcttttattctagggtctacgagagcctgggtcaacgccaccgtcaggatttgtggcggcgcctcagcagttacgaaccagtcttctgctcatgctcccgcctggggtcgcccttcacaactgcagtagcattggcgtccggatagagcatcaaatctttcgcgagacaagatcgacggatacacaaacatgagctacgaagatactttaattcgatcgagaataacgggtttatcctatataaccaggagaaattccacgagtgacacatcaacaggaggcaccagtcatgactacgtccccataattgttatgactgttattgtcgtggcgatcgttctggtactccttatccttgctcaatacacaaaggtgcttgatcggaaaaagccagccaacggatttgatgatccagaaagcgcacagaatgccggcaaaatcgagaaactgaaccaaaaagctccgactcaatcctacaagagctggaaggagaagagcgaggaagcgactggttccgttaaacaaagtactactcatgtcgtatgtgcaatatgtttggagaccctacaagaagacgatacaattcgcctgctatcatgcgcgcacattttccactctctttgtttggcaaaatggtttttgaagaggcataatacttgtccgctttgtaaggcgtgcttcatgtcttcgtcggagaaatcctcgatacctgtacaggttccagaaagaacacatgcccgatgagaaatctcaaacaataat

SEQ ID NO: 2469 - DNA, 787 bp, Artificial
  Synthetic
ggtacgttattgtttttttgttggccttttcactttggtttgtttttaatttcttcgtttttgttttctgttgcagaggagaagcgtgaagataggagagaatagagatagagaggcaattgcacggaatgtttagccaacaagttgctcgtggcgggcgccgcatcggccagatggctcgaggcggccaatatccgtcactcgctgcgctcagaggagctgctcaacgacgatgttatgctgaggctgcacaggcagcccccaagggacgtatcggtcgaggcctcgggctgctcctgtatggcgttgcatttagcggcctcggagcagcagcaacattctattcgatggtacaaaagggtttcgcctcgttcaccgacgccgagtcagccaaactgtttgtcccagatagcgacgagctgcaacaaatcgaagagacaatcaacaaacacccgctcgtccaagagcttcgatcacgaccagagttcaaggagtcacgaccacacctaaagatgtcaagcgaagtccgcagccgcaccctcaccggcggcgctctacaaggcgacggcatgatcatggtcccccccgtcgccttcatcgaggacggcggcaagtccatcgtcagcgtcacgtacattggcgacaaactatgcggccacccaggcctcgtgcacgggggcctgctggcgacgatgctggacgaggggctggcgaggggctgcttcgacgcgctgccgcacaagattgccgtgacggcgagcctggagatcaactaccgcaagccgac

SEQ ID NO: 2470 - DNA, 248 bp, Artificial
  Synthetic
agctggtcccctggagaaagatgaggaaaagacccggaaggagaaaagggaatcgtgtgatttaatttgctatgccggatcgtagccgtggatgtgagatgaggcgggaagggagaagccggagaaggcgggccttgacacggagctgaagaattttctttttctttgtgtcgcgtgttgtgtgctttgatcgtgattcttttgccgtagccctttttttacatacatttgtgtgcataactattacc

SEQ ID NO: 2471 - DNA, 632 bp, Artificial
  Synthetic
atcatctaattcaagtatgtcatatcccgcggtgtgtgatgcgatgtgatgtgattgactgatgctgatctttgtcgattgttttacttgtagcaaactcaagtataacttatacctactatttatacctactcaacagtatactcgaccttgtccaacaaaatcaaaacaaaacaacaaccgaggcaaatcaaataacaaactacctcaaaaatggactcttcaccaccaacaaccccaaccaaaactcaacaatcacaaaacctccagcaatcttctcctcacccccaagactcctcccccgcctgccaatccgccatcaaacactcctcatcgtggaagcccagctcgctcgaccgccgcctcagctggagctcccaggaccagaagcacgcgctgcagatgagcggcattgacggcgtgcagtcgggacaccagggctttacggagcgatgaatgcctttccatccagtcggggtctttctttctttttttattctatggagagaaggtgtagattgggaatgaaagagggggaaagaagatgaattcataaaactctatatgagcgtggttttcttcttcttctttctttctcttttcaatgatttgatgaaacaaaagggctattg

SEQ ID NO: 2472 - DNA, 663 bp, Artificial
  Synthetic
cggacgcgtgggtaacgatcactccgtcgtcgtcacaaatctcaacttcagctatggaggcactaaccgcaaaattttatcaaatgttaacttcacaataacaaaagggtctcgatgtttgctgttggggatcaatggaacgggaaaaacaactttattgaggattttagctggaaagcattatctccccggtgacgaagtgattgtgctcggaaaaaatgtttaccatcatacaccaatgggattaacttttttaggtggagactgggccacgaatccaaatgtccgaaaagacattacggttcaacaactcatgaattccgctaatggaagcctgcatcccgaaagaagagaccatcttatccagattcttgatatagatccaacctggagaatgcaccaagtctctgatggtgaaagaagacgagtccaaatcatgcttggtttgatcgagccatttgaagtgatgctcatggacgaagtgactgtcgatcttgacatattagttcgacaagatttgctgaatttcttgaaacaagaaactgaaacaagaaatgcaactattatttatgccactcatatcttggatggacttaatgagtggcctactcatatctcacatttgtccaacggaacttttacgaaaatcgtccctattgaaca

SEQ ID NO: 2473 - DNA, 258 bp, Artificial
  Synthetic
gagaaaaagaaaatagagaagggggagaaaagaagagagcctcttagaggatgatgctgaatgacgctgtggatggtgaaatgtgagatgagcaaggtttgtgttacatgtatattaagaggattttttctttttgtggacggttttttatatgtgatattatggagaaactagcaaggatggagaaaagggggagaaaaggaacgataagtttatctctgtttgggcatgtatgggtgttaatatgattgacttgtc

SEQ ID NO: 2474 - DNA, 687 bp, Artificial
  Synthetic
tcgacccacgcgtcgcttgcattaagtagacatcattgtgtctactcccagtcatcgtcgacaacttctttgatacaagattgcaagactctatccaagtatggctaccccaggtaccgaccccatcgagggacaatacaacaaagaatccgcggccgacgtgcccaccaacgggcactatgtttccaatggcatgggctctggacagcaattccagccccagcagtatcagcagtatccgggctatggacaatttgttccgtttagcaacacccaagatcctcgggctgggcctcaccaggccatgatctcccaggtctaccaacctacccttggtaagattggtaacccaggtcctcttggtctgatcggtttcgctttgacgaccttcgtgctcggactttaccagtgcggtgctggtctccctaattccaacccattgggcaacgtcggccctgatcaagctgtcttcggtgtggctgtcttcttcggaggcatggctcagtttgttgctggtgtcatggaatttgtccttggcaataccttcggttgtactctccactgttcatacggggctttctggcttgcctttgccatgttctcagtccctacactgggcatccaggccgcttataacggagatcaacgtgcctttagctttgctgttggcattttcctcatcatatg

SEQ ID NO: 2475 - DNA, 126 bp, Artificial
  Synthetic
tctcgaccacgcgtcgagtagctgctgttgtgaagcactgctttcatcaaaacaagtactctccaatcacatctggggttgggtccgaacaaggtcaccacccaacaacatttcgcatattccatc

SEQ ID NO: 2476 - DNA, 423 bp, Artificial
  Synthetic
  misc_feature (296)..(296): The residue at this position can be any nucleotide.
  misc_feature (355)..(355): The residue at this position can be any nucleotide.
gccttgatggtatgattcttcttgttttatcaatctgaagcaacattgatcagcataatctaatcacgatgcccaagttcttttgcgactactgcgatgtctacctcacgcacgactccatgtcggtgcgcaaggcccacaacagcggccgaaaccacctgcgcaacgtcgtagactattaccagcaaatcggccacgaaaaggcccagtccgttattgactcgattacttcttcgtacgctgccgagggccaggcccatgcgaacccgatgcttcttcagaaccagcccggccanggatttccggcctttggcttccccggcggcatccctccgccattccccggtatgcctgnagctcctcccggccaatttccccaaggccttccaccacctcccggcggtcgcggtatgccctccatgc

SEQ ID NO: 2477 - DNA, 495 bp, Artificial
  Synthetic
acaaaatgcttatgagcgggccgcgggtaccatgtcagtgtacgggtactcgtacaagttctctggacgagcagatgcaaccatccggcagtcaaacttgatgctacttgacctgtaacatttgcattgatgagcggcagcagggcctggcaacctgggtagtactcccaagtattgcccgtacacgtcctaacatgcggcaggcgatcaagccgttctcagggcgctaacaagggggggacgaggcgcactggaagcgctgagaacacatgcatcgtgaggtgatggagtcggtgggctcgggtagatgtacctaaagggcacataaccttgcctggctctttggtcctggaaggggtgatgtgatttactttcaatggaagaagccggatgttgcgactgctggacccatgtacttgtacttgtacgagtatgccaatgagaagagatcaagatgaacaaaaagaacgatgccaagaaacaaggtcctgaaaa

SEQ ID NO: 2478 - DNA, 486 bp, Artificial
  Synthetic
gacatgggcatcgagaaggagcgagagagccttgtctacctatccaagctctccgagcaggcagaacgctatgacgaaatggtggagtcgatgaagaaagtagctaagttggatgtagagcttacgattgaggagaggaatttgctctcagtggggtataagaatgtgatcggagcgcgaagggcctcgtggcgaattctctcctccattgagcagaaagaagagagcaagggcaatgagaccaatgtaaaacgcatcaaggagtaccgcaacaaagtggaggaagagctttccaagatttgcagtgacatcctaactatcatcgatgagcatcttatcccctcatctggcacagcagaatctaccgttttctattacaaaatgaaaggggattattatcgctaccttgctgagttcaagacaggacatgagagaaaggaagctgcagatcaatctctgaaagcttatcagactgcaagtgacacg

SEQ ID NO: 2479 - DNA, 546 bp, Artificial
  Synthetic
  misc_feature (457)..(457): The residue at this position can be any nucleotide.
gctgtgtttatcttcttcgccttcgtgttcgtcggtggtgttggtagtgggaagatgggtgtggagaaggagcgtgagagtgatgtgtacatggctaagctcgctgagcaggcggaacgttatgatgagatggtggaattcatgaaaaaggtggcaaacttggatgtggagctatctgtagaggagaggaatctgatgtcagttgggtacaagaatgtgattggggcacggagggcctcttggcgcatcctctcctccatcgagcagaaggaggagggaaaaggcaatgaagtgaatgccaagcgcatcaaagaatacaagcacaaggtcgaggaagagctttcaaacatctgcaacgatgtcctctccgttattgaggatcatctcatccctgcgtctagcacgggggaatcttctgtcttctattacaaaatgaaaggggattacttccgatatntggcagagtttaaatctggaaatgagaagaaggaagccggagagcagtctttgaaagcataccaggctgctatggacatagcgacatct

SEQ ID NO: 2480 - DNA, 499 bp, Artificial
  Synthetic
gtatgctcacagctcacctcactcctctttatttttagggttcattggaaggaagagagagagagagagagagagagagagagtcttgctgcaccaacccaacccaaggagctcttctttgtgttctactcccatgggtattgagaaggagagagagagccatgtctacatggccaagcttgctgagcaggcagagagatatgatgaaatggtggattccatgaaaaagattgccaagttggacgtcgagctgaccattgaggagagaaatctgctttccgtgggctataaaaatgtgattggggctcggagggcctcgtggcgaatcctctcctcaattgagcagaaagaggagagcaagggcaatgaaacaaatgccaagcgcattgagagttaccgacataaggttgaggaagaactctctggaatctgcaaggacatcctgactaccatcgatgagtatctcatcccctcgtctggcacggcggaatccaccgtt

SEQ ID NO: 2481 - DNA, 667 bp, Artificial
  Synthetic
gaaccgcgtctcatcgcacctgccataaaactccaaaaaatctcaaaaaccaaccgtcaaaatgggtcacgaagatgctgtttatctggccaagctcgccgagcaggccgagcgatatgaggagatggtcgagaacatgaagatcgtcgcctccgaggaccgcgacctgaccgtcgaggagcgcaacctcctctccgtcgcctacaagaacgtcattggtgcccgccgtgcctcttggagaatagtcacttccatcgagcagaaggaggagtctaagggcaactcttcccaggttacccttatcaaggagtaccgccagaagattgaggccgagcttgccaagatctgcgatgacattctcgatgttcttgacaagcacctgattccttctgccaagtctggagagtccaaggtcttctaccacaagatgaagggtgactaccaccgttaccttgccgagttcgccattggcgaccgccgcaaggactccgccgacaagtctctcgaggcttacaaggctgctaccgaggttgcccagaccgagctgcctcctacccaccctatccgcctgggtcttgcgctcaacttctccgtcttctactacgagatcctcaacgcccctgaccaggcttgccacctcgctaagcaggcatttgacgatgctatt

SEQ ID NO: 2482 - DNA, 518 bp, Artificial
  Synthetic
agccgaatttgaactccacctgagcacaggagaagccgcagccactgagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactggtccagagtccaaggtcttctacctcaagatgaaaggcgactactacaggtacctcgcagagttta

SEQ ID NO: 2483 - DNA, 579 bp, Artificial
  Synthetic
gtacgagaccactcgaacccgacccgcctcgccgccgccgccaccgaagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccata

SEQ ID NO: 2484 - DNA, 663 bp, Artificial
  Synthetic
caaaatttccgacgccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtacctttgccgaatttaagaccgggggctgagaggaaggatgctgctgagaataccatggtggcatacaaggctgctcaggacattgctttggctgagctgcctcctactcatccaattaggcttgggcttagctcttaacttctcagtgttctactatgagatcctcaa

SEQ ID NO: 2485 - DNA, 599 bp, Artificial
  Synthetic
gaattcaagatcatgtttctattattaaagaatataggggaaagattgaatctgaacttcataagatttgtcaagggattttagggcttttggattcccatcttattccttcatcaactgctgctgaatctaaggtgttttaccttaagatgaagggtgattaccacaggtatttggctaagttagctgaacaagctgaacgatatgaagagatggttgaatttatggagaacgttgcaaaaactgttgattctgatgaattatcagttgaggaacgaaacctgttgtctgttgcttataagaatgtgattggagctaggagagcttcatggaggattatttcaagtattgaacaaaaggaagaaagccgtgggaatgaagatcatgtttctattattaaagaatataggggaaagattgaatctgaacttcataagatttgtcaagggattttagggcttttggattcccatcttattccttcatcaactgctgctgaatctaaggtgttttaccttaagatgaagggtgattaccacaggtatttggctgagtttaaatctggtagtgacaggaaagaagctgctgagagtacattg

SEQ ID NO: 2486 - DNA, 378 bp, Artificial
  Synthetic
gttataaatccttatctttttcaacacacagattaaaatcttcagaaagagagagagagatcccaaaatgggtgaacgtgagaacttcgtatacatagctaagcttgccgagcaagctgaacgctatgatgagatggctgatgcgatgaagaatcttgcaaatatggatgttgaattgacagcggaagagaggaatttgttttctgttggttataagaatgtggttggagctaggagagcatcgtggaggatcttgtcttccatcgagcagaaggaagagtctagaggaaatgagcagaacgtgaagcggattaaggagtaccagcaaaaagtggagtcagagctcaccgacatttgcaataatatcatgaccgcgat

SEQ ID NO: 2487 - DNA, 660 bp, Artificial
  Synthetic
agccaagtgaaagcaaaaagggagaggaaaagcgcaaaatctcccttcgattatcagtacaaaacctctgatttgagagatcggaaatggcttcctccaaagaacgcgagaacttcgtctacgtcgctaagcttgctgagcaagctgaacgctacgatgaaatggttgatgcgatgaagagtatagcaaatatggatgttgaattgactgttgaggaaaggaatctgctttctgttggttataagaatgtggtaggttctaggagagcatcttggaggatcttatcctctattgagcagaaggaagaatctagaggaaatgagcaaaatgtcaagcgaattaaggagtaccgacaaaaggtggagacagagctcaccagcatttgcaacgatatcatggtggtcattgatcagcatctaattccttcatgcactgcaggcgaatcaactgtgttttaccacaagatgaagggagactattatcgttatcttgcagaatttaaatctggcaatgacaagaaagaggttgcagagctttcactgaaagcatatcagtcagctacaactgctgcagaggcggaattaccacccactcatcctattaggttgggattggctttgaatttctctgtgttctactacgagatcatgaattcgcctg

SEQ ID NO: 2488 - DNA, 536 bp, Artificial
  Synthetic
aaaattaaaaataaaaaatacccggcgaatctccgacgatggctttgccggaaaatttaaccagagagcagtgcctatacttagcaaagctcgccgagcaagccgagcgttacgaggagatggtaaaattcatggaccgactcgtagctgtctcggcttcctctgaactaaccgtagaagagcgaaacctcctctcggtagcttataagaacgtcatcggttcacttcgagccgcgtggaggatagtatcgtcaattgagcaaaaggaagaaggtaggaagaacgaggaacacgtggttctagtgaaggattatagatctaaggttgaatctgagcttagtgatgtatgtgctggaatttcgaagatttcggatcagtatttgattccttcggcttcggctggtgaatcgaaggtgtatcacttgaagatgaagggagattattatcgttatttggctgaatttaaagttagtaatgaacgtaaggaggctgctgaggccactatgcttgcctacaaagctgctcaggacattgcg

SEQ ID NO: 2489 - DNA, 991 bp, Artificial
  Synthetic
atactccccagatctcaaaaattcaaacattacaaccaaaaagaaaagagatccctaattatggcgcgtgaggagaacgtgtacatggcgaagcttgccgagcaagctgagagatacgaggaaatggtgtcgttcatggagaaagtttctacttccctagggacgtcagaggaactcacggtagaggagagaaatctcctctcggtggcgtacaaaaatgttatcggggctcgtagagcctcgtggcgtataatctcctccatcgaacagaaggaggagtcgaggggaaacgaggaccatgtgaaatgcattcaggagtacagatctaagattgaatctgaactctccaatatctgtgatggcattctcaagctccttgattcttgtcttattccttctgcttcagctggtgattctaaggtgttttaccttaaaatgaagggtgattatcatcgttatttggctgagtttaagactggtgctgaacgtaaggaagccgctgagagtactctctccgcctacaaagccgctcaggatattgcaaatgctgaacttgccccaactcacccaatccgacttggactggctctcaacttctctgtgttttattatgagattttgaactctcctgatcgtgcctgcaatcttgctaaacaggcctttgacgaagcaattgctgaattggacacactgggagaggagtcttacaaggatagcactttgatcatgcaactgcttcgtgacaatcttactctctggacctctgatatgcaggatgatggcgctgatgaaatcaaggaaaccaaagctgacaatgaacaacagtgaggaaactgcccctcatattgtcttttgacttcttcctgttggtttttattgggagaagctgtttccttttatttcctttttaatgtggtttcccttcagcgttctcttatccgtcgcaataacaactttgacaattgatgttcaatgattttatctttatttt

SEQ ID NO: 2490 - DNA, 623 bp, Artificial
  Synthetic
cagctctctctctctcccttcaaacatcgatggcgtcgtcgcgcgatgagttcgtgtacatggcgaagcttgcggagcaagctgagcggtacgaggagatggtagagtttatggagaaggtcgtaaccgcctcggacggcggcgaggaactcaccatcgaagaacgtaatcttctatccgtagcatacaaaaacgtgatcggagcacgacgagcctcgtggcgaatcatttcctcaatcgagcaaaaagaagagagccgaggcaatgaggagcacgtgacctctattaaaacttacagatctaagatcgagtcggagttgacctcgatctgtgacggtatcctcaagctgctcgattcgaatctcattggcgctgcgtcaatcggagattctaaggtgttttatttgaaaatgaaaggagattatcaccggtatttggctgagtttaagaccggagctgagagaaaggaagctgctgagaatactctttcgtcttataagtccgctcaggatattgcaaatgcggaactggcacctacacatcctattcgattggggctagttctcaatttctctgtattttactatgagatattgaattcacctgatcgtgcttgtaatctg

SEQ ID NO: 2491 - DNA, 330 bp, Artificial
  Synthetic
cccacgcgtccgagaagaagaagaagaagaagaaaaaactatggagaatgagagggaaaagcaggtttacttggctaagctctccgagcaaaccgaaagatacgatgaaatggtggaggcgatgaagaaagttgctcagcttgatgtggagctaactgtggaagagaggaatcttgtatctgtagggtacaagaatgtgattggtgcaaggagagcatcatggagaatactatcttccattgagcagaaggaagagtccaagggaaatgatgaaaatgtcaagaggcttaagaattatcgtaagagagttgaagatgagcttgctaaagt

SEQ ID NO: 2492 - DNA, 486 bp, Artificial
  Synthetic
gaacaatgggtgccgagaaggagagggagggtcatgtctacctggccaagcttgcagagcaggctgagcgttacgatgagatggtcgagttcatgaagaaggtagccaagcttgacattgagctgactgtggaggagcgcaatcttctctcagtggcctataagaatgtgattggagcacgtagggcctcttggcgtattctctcctccattgagcagaaggaggagagcaaagggaatgaggttaacgtgaagcgtataaaggattacaggcaaaaggtcgatgaggaactctcgaagatctgccatgacattttgactatcatagatgagcatctcatcccctcttctgggactggcgaatcgtctgtcttctactacaaaatgaagggagattactaccgctacctcgcagagttcaaagctggtccgcagaaaaaggaagacgcagatgagtccttcaaagcctaccaagctgcgtcgagca

SEQ ID NO: 2493 - DNA, 1103 bp, Artificial
  Synthetic
caaaagtccaaaatttcccccacaaaagctctcctctctgaattattaaatccccattcagaaaatcgaaaaactccctcattcagatctcccaaaaaaatacagagaaacaaatctaaacatggcggtggcaccgacggcgcgtgaggagaacgtgtacatggcaaagcttgcagagcaagctgagaggtacgaagaaatggttgaattcatggaaaaggtctccaactccctcggctcagaagaactcaccgtggaagaacgaaacctcctttccgtggcgtacaagaacgtgatcggagcgcgtagggcatcgtggcgtattatctcatcgattgagcaaaaggaagagtccagagggaacgaggaacacgtgaactctatccgcgagtacagatctaagattgagaatgagctctctaagatctgtgatggcattctgaaattgctcgatgcaaagcttatcccatctgcagcatctggtgattctaaggtgttttacctgaaaatgaaaggagattaccaccgctatttggctgagttcaagaccggtgctgaacgtaaggaggctgctgagagtacactcactgcctacaaagctgctcaggacattgcaactactgaacttgccccaacacatcccatccgacttggactggctcttaacttctctgtgttttactatgagatcttgaactctcctgaccgtgcttgcaatcttgctaaacaggcctttgatgaagcaattgctgagctggatacattgggcgaggagtcttacaaggatagcactttgatcatgcaacttcttcgtgacaatctcactctctggacttctgatatgcaggatgatggggctgatgaaatcaaggaagatcccaaacctgatgaagccaaaaattgaaggaaatgaaactctctaatttgcttttcacttcttcctggttgtttttattggaagaagctgattatcgtaatttccttactattatggttctccactagggggttgtcatcttattggaaatgaacaacttttaatattgatgtttcagagttccatctttgatttaatgtggttttctggtgattagttttcttct

SEQ ID NO: 2494 - DNA, 479 bp, Artificial
  Synthetic
aaaaaatcagagaagtgaagagaagagatcaagggatcgatccttgagaaggcaatgggaatcgagaaggaacgtgagaccctcgtctacctctctaagctcgctgagcaagctgagcgctatgacgaaatggtggagtcaatgaagaaagtggctaagttggacattgagttgagtgtggaggaaagaaatctgctctccgttggatacaagaatgtgatcggagcacgcagggcctcctggcgcatcctctcttccattgagcagaaggaagagagcaagggcaatgagacaaatgtgaagcgcattaaggactatcgcttcaaggtggaggaagagctctccaagatatgcagcgacatcctaaccatcatcgatgagcacctcatcccctcatccaacaccgctgaatccactgttttctattacaaaatgaaaggggattattatcgataccttgcggagttcaagtctgggca

SEQ ID NO: 2495 - DNA, 498 bp, Artificial
  Synthetic
tacaaatcctcgactgtgaaaggagctttcgccatctctctccatgggaatcgagatggaccgcgatgggaatgtctacatggccaagctcgctgagcaagccgaacgctatgatgagatggtggagttcatgaagaatgtggcgaatatggatacggaactgactgtggaggagcgcaacctattctccataggatataaaaatgtgatcggagctcgtcgggcttcctggcgcattctctcctccattgagcagagagaggagagcaagggcaacgaggtgaatgcgaatcgcatcaaggagtaccgtaacagagtcgacgaagagctctccaagatctgcaaagatgtcctgagcatcatcgatgatcatctcatcccctcttccacaaccaaagaatctgaggtcttctattacaaaatgaagggtgattattaccgctatttggctgagtttaaggctggtagcgagaggaaggatgcggcagatcactccct

SEQ ID NO: 2496 - DNA, 371 bp, Artificial
  Synthetic
aattcggcaccagaatccatcctctttcgcttaaactttctctctctacaacaacaatgtcggctctgctcacagaaaatctcagccacgaacaatacctctacttagccaagctcgccgaacaagccgaacgctatgaagaaatggtccagtacatggacaaactagtcctcagttccactccggccgccgaactcaccgtcgaggaacgaaacctcctttccgtcgcttacaaaaacgtgatcggctctcttcgtgccgcgtggcgtatcgtatcctccattgagcagaaagaggaatcgcgcaagaacgaagaacacgtgtcgctcgttaaggagtacagaggtaaagtcgagaatgagttaacggag

SEQ ID NO: 2497 - DNA, 554 bp, Artificial
  Synthetic
cccacgcgtccgctccacctgagcacaggagaagccgcagccactgagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcggttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgaaaggaaggatgctgctgagaacaccatggtggcatacaaagccgctc

SEQ ID NO: 2498 - DNA, 423 bp, Artificial
  Synthetic
ggtgaaagaagcttgcaggccatggggacggagaaagagcgcgagaaaaatgtgtacatggccaagcttgctgagcaggcagagcgttatcaagagatggttgaatacatggaaacagtggccaagcttgatcttgagctaactgtggaggagcgcaaccttctgtctgttggctacaaaaatgttattggagcccacagagcctcttggcgtatcctttcttccattgaacagaaagaagagaacaagggcaatgagactaatgtgaagcgtaccagggattataggcataaagttgagacagaacttaccaagattagcagtgaaatttcgactatccttgatgagcatctcatcccctcatcgggaactggcgaatcatctgtcttctactataaaatgaagggcgactactaccgttac

SEQ ID NO: 2499 - DNA, 599 bp, Artificial
  Synthetic
gaagaagaggagggagaaggcatgggtgtggagaaggatcgcgatggccatatctacatggccaagctcgctgagcaggccgaacgatacgatgagatggtcgattttatgaaaaaggtggcaaacatggatgtggagctcactgtggaggagcggaatcttttatcagtaggctacaaaaatgtgattggggcccgcagggcttcgtggcgtattctctcctcaattgagcaaaaggaggaagccaaaggcaatgagcagaatgtggggcgtatcaaagactacaaggaaaaggttgaggaagagctctcaaagatctgcattgacatcttgtcgactatcgatgatcatcttatccctgcatccagcactgacgagtcttctgtgttttattacaaaatgaaaggggattacttccgctatttagcagagttcaaagcctcaagcgagaaaaaagatgctgcagagcagtctctgaaagcataccaggttgcagcagataaagcagccaagagtcttccaacaactaatccgatcaggcttgggcttgctttgaacttttcagttttctactatgaaatcatgaactcccctgaaaa

SEQ ID NO: 2500 - DNA, 758 bp, Artificial
  Synthetic
tcgacccacgcgtccgggcggcagcgcacggcgaggaacaggtgagtgcccgtggatgtgatctagatctaccctccaagccccaaaatctcagtagaaatcctccaaatcgcgccgccggaagagagatccaatccaccactgtccccatttctcggcttgttccagggatgtcgaatcttcgcgaggagaatgtctacatggccaagctcgcggagcaggccgagcgctacgacgagatggtggaattcatggagaaggtggtcaaggccgtggacgtggaggagctgacggtcgaggagcggaatctcctgtcggtggcctacaagaacgtgatcggcgcccgccgggcatcgtggaggataatctcctccatcgagcaaaaggaggaatccaagggcaacgacgaccacgtctcgatgatcaaggagtaccgtgccaaggtggagtcggagctgagcaccatttgcgacagcatcctcaagctgctggacagccatctcatcccctcatcgtccagtggcgagtccaaggtcttctacttgaagatgaagggtgactaccaccgatacttggccgagtttaagaccggggccgagaggaaagaggccgcggagaacactctcctcgcctacaagtcggcccaggacatcgctctcacacagctgccgccgacgcaccccatccggctgggtctcgctctcaatttttcggtcttctactacgagattttgaattcgcccgatcgagcttgtacg

SEQ ID NO: 2501 - DNA, 286 bp, Artificial
  Synthetic
agatatacatactcggatcagtcgtcaaaagctttggaatttgatacttttgatttttcgagaatcttgaaaatcagtcatgggttctggaaaagagcgtgacactttcgtctacctcgctaagctctctgagcaagctgagcgttatgaagaaatggtggaatcaatgaaaagtgttgcgaaattgaatgttgatctgacggtggaagagaggaacttactctctgtgggttacaagaacgtgattggttcaaggagagcttcgtggaggatcttctcgtcgatt

SEQ ID NO: 2502 - DNA, 614 bp, Artificial
  Synthetic
tggttgttattgttgttgctgtgtttatcttcttcgccttcgtgttcgtcggtggtgttggtagtgggaagatgggtgtggagaaggagcgtgagagtgatgtgtacatggctaagctcgctgagcaggcggaacgttatgatgagatggtggaattcatgaaaaaggtggcaaacttggatgtggagctatctgtagaggagaggaatctgatgtcagttgggtacaagaatgtgattggggcacggagggcctcttggcgcatcctctcctccatcgagcagaaggagcgagggaaaaggcaatgaagtgaatgccaagcgcatcaaagaatacaagcacaaggtcgaggaagagctttcaaacatctgcaacgatgtcctctccgttattgaggatcatctcatccctgcgtctagcacgggggaatcttctgtcttctattacaaaatgaaaggggattacttccgatattcggcagagtttaaatctggaaatgagaagaaggaagccggagagcagtctttgaaagcataccaggctgctatggacatagcgacatctagccttccgacgactcatccgatcaggcttggtcttgctctcaacttctc

SEQ ID NO: 2503 - DNA, 457 bp, Artificial
  Synthetic
gagaatgcattctatttcgcctaaactttcctctctctacaacaacaacaatggcggctctgctcacagacaatctcaaccgcgaacaatacctctacttagccaaactcgccgaacaagccgaacgctatgaagaaatggtccagtacatggacaaactagtactcagttccactcccgccgccgaactcaccgtcgaggaacgaaacctcctttccgtcgcttacaaaaacgtgatcggctctcttcgtgccgcgtggcgtatcgtatcctccattgagcagaaagaggaatcgcgtaagaacgaagaacacgtttcgctcgttaaggagtacagaggtaaagttgacaatgagttaacggaggtttgtgctggtatcctcaagttgcttgagtcaaatctcgagccggctgcttctacaggtgaatcgagggtgttctaccctcaaaatgaaag

SEQ ID NO: 2504 - DNA, 451 bp, Artificial
  Synthetic
aaatcctgaattgcaccaactagtacaacgacaacaatgtcttctgagagagaaaccaagaccttccttgcccggctctgtgagcaggctgaccgatacgacgagatggtcaactacatgaaggacgtcgctaagtccggtgaggagcttactgtcgacgagcgaaatctggtttccgtcgcttacaagaacgttatcggcgctcgacgagccagctggagagtcattttccccatagagcagaaggaggaggccaagggtggcacccaccatctcgagcttctcaagacctacagagcccagattgagggagagctcgaagacatctggagcgatgttcttgatattctcaacaaacaactcctccccaaaggcgagaacgccgagtctaaggtcttctactacaagatgaagggtgactaccatcgataccttggcgagttcacctccg

SEQ ID NO: 2505 - DNA, 685 bp, Artificial
  Synthetic
agctggattacgaacgaggattgggagcattcaaaattcacattgtcaaccacgcatcgcagcacctatacgtgcattttcgactatggcctccaacaaggatgcgccagctgcgattaaacgcaaggacctctacgaggccctgaggctctcgcgactcccagatgagcagagcggctcacaggatcccatcaagagattcgtcagtcgtacaccagcctggaggcctgggaatgagctgccatggggatcaatcgactctgaagggtataagaagggcaacacggttgactttaacccggctgcgtttggaggccacgtcttcgcccaggcacccttggcggctgcgagagcggtggaggaagaagagaatggcaatggcaatggcaatgacaaactaggcattcattccatccaaggcgtctttacaaaagcgggcgcgattgatcggccattcatctatgatgtgacaaatgtccactcaagccgttcattcaccaccaagctggtccaggcacggcagcccacagaggcttcagatgctccgaatggcccattccccgagtctgatgcgaatcggccgctgggccccgtcagtttcacctgtctcacaacgttcaagcgtcccattcccatgccatcgcccgcagagctgcagatcaaagggtcggcacaggaacgctat

SEQ ID NO: 2506 - DNA, 575 bp, Artificial
  Synthetic
gtatgtagatgaatttgaattatatacagttaataatataccgccccaagccggatacccacccagctcctcttaagccatacctgttttaaccactgtacactaatgataatacgtgaaaaatagaaaaaaccctgcccaataaaagaaaaaagtcatcctagacttaaaacagcgtgcaagcagtggcgttgagctgagtgcagtaagtcatctggatggggaacgcgctgaccccacgggcaagcaagcgttctcggaactcgttcagacgaggaacaacgtccagctggctgcgctgttggccagaggcatcggtattgccggaccaccaaacctcaccggcggcgctgccacgaggccagatgatgttgtccaggttgctggcgtcaatcatctcgctccatatggcaagctctcctcccaggacgttcttggcagccgaagcggacacgttggctgcagggtcgtgagagtagatgagcctccagttcttggtgggctggcaccagtcgttgaatgggtagtaggtgttgtaggagtctcctggagggaagttgacccattgaccgcgg

SEQ ID NO: 2507 - DNA, 197 bp, Artificial
  Synthetic
gaggaataagacaagaaggaatacaagactccaagatgcatcatcagcttctcactctcaccgctgctgctggcctcctcgcgacggcctcagctacctactcgaagcttcccagtgtcaatgtgccttcatgtcctcgtgttggcacgattagctacagcaagtcagtgcccgacctgacgcccttcccgctcaca

SEQ ID NO: 2508 - DNA, 319 bp, Artificial
  Synthetic
gaacttcttttcatccaggcagccaaaaagggcagtgcaaggcaggcatcgtcagttgcagcgcgggtgattggctcatccgccgggctctttttttgcccttcgacttgctttgatgcccggagggatgtgaatccaaagagaggcgacctgcccaaagagggaaacagggcaacgtgagcgggtagattcgcagctaggaacaggacaagcatcacacatgtatgtaagatggtcactccggcccttgctcggaatcaaccgcggggacccgtgtgagcaaagatagataccgtatgaatatatcgtatcctaggat

SEQ ID NO: 2509 - DNA, 439 bp, Artificial
  Synthetic
atcaactcattgaatacaatttacaacagcaacctaagcgcacctagatatcatggcggacaacactaaccccggaaactttgccaaccggtatgatatcaacagcggttttaaaagtaaatcattgaccaattgttgttagccccaaggaggaagtgcagtcgattgcatccaagggtggacaggcgagtcaccagggcggcttcgcttccatggatcctgacaagcagcgcgagattgcgtccaagggcggccaggcctctggaggatcttttgagcccggaagcaagaaagctcaagaggcgggccgcaagggtggtttgcagtaaagcatgaccgtaactctagtgtcgattcactggtagacggtgtgattatctcttattgtagataaacatacactagcaattttgctctaatacaaactaattggtcctac

SEQ ID NO: 2510 - DNA, 991 bp, Artificial
  Synthetic
cttgtcattattactcgatcccacgcgtccgtcgacccacgcgtcgcagatacacagcaaacacccaagcaacaacaaaagcaaagcactccagcaacaaacatctacccacctcacaacaacatcaaccaacctgacaacttcttcacaactccacaaacaacaacactcaaccatcacaatggctttcttccctcgcactttctaccaccccaccgaggcctctttcacgcctctcttccgtctccttgacgactttgacagctacagccgacagaatggcaaaagccgctctgttcgccgccagcaagttccccagtggcagcccaagtttgacgtgcgcgagaccaccgaggcctacgagctccacggcgaacttcctggcataagcaaggagaacatccagatcgaattctctgacgcccagaccttggttgttcgcggcaagactgagcgcacatacactgcgggcacatcaccctctgcttccgtcgaaaacactccttctacagagactgtcgctgaaaaggccgagtctgaacgcaggaactcgcaccaggcgactgttgaggacgaagacgaggccagcgagcgcgagtcgggctatgaagtcgtgaccaccgaggaagagaagaagcctgaggccaagactccccaacagcccgccgacaaggccaagtactggctcaccgagcgcagcattggccagttctcgcgcagcttccacttccctggtctggttgagcacgacgctgtcagtgccagcttccaggacggcattctgagcatcaccgttcccaaggcgaagcacgaagcccaccgaatcttcatccagtaaaccatttcacaaatcggaaaagacactatctcacaacaatgtaatactactacaatctaccttgggattagctttgctgtctgcctttctcgattgcatcaatgggagttggggggatttgggatcaacggataattttcaacgtgtgcactt

SEQ ID NO: 2511 - DNA, 722 bp, Artificial
  Synthetic
gcaaccaacagccaaggcgttgaaaagagcatcacatgaaaatttgcagagaactgcttcgcgacacattacgttgccaaaaacgtacttcgacgctcacatcttcaagacgtctcactgcaacgcccagccgcaaaatggcattctcccagcgtcacttttacacccccgagacatccttcactcccctcttccgccttcttgatgactttgacaattattctcgtccaggcaacgcggagcaacagggtcgtcgctctggcctagcgcactggcaaccgaaatttgacatgcgcgagactgactccgcgtatgagctccatggcgagctacccggcatgagcaaggagaatgtgaacgttgaattcaccgatcctcaaaatatgctcgtaagcggtaaaattgagaggacatacacttctggtaccccacctgctggagccctggagggaattgcatcgagaggcaagatcgccgagggcggcgaaggacaggccaagacatcttcccgcgaagcaaccgccaaagatgcgactgaagatacagccaagtactggctcactgagcgcagtgttggcgagttctcgcgcaacttcagtttccctacgcgtatcaaccaagaaaacgtgacagcgagttttaaggatggcatcctcaacattactgttcccaaggctgccaaacatgagtcacgccgcattaccgtcaactaattgacgttt

SEQ ID NO: 2512 - DNA, 660 bp, Artificial
  Synthetic
acaacaaacaacgaaacaaccgcccaatcgccaatcgccgcctcgacatggtgctcggcgactacgaggaagcacaataggcgggacgcgaagcaaacaagcgctgggcgtctgagaagtagcccgagagtcacagctacagctacagctacagtgaacacgcgatagagtgattcaggacatccagagacgagacgaggcgcctgaacgagatacgaagcaaacagacacgggaaagcagatgcaatgtcggcaaacgtaacaaagccggcgcccaatcggccgcagcggcgcgtaacggccggccagatcctgtcgatgccgccgaaatggctcggcatgtacgacgaattcatcaccaagaacgccggccaggtgtcgcagattgagagcgcgctgaggagcttgacgtatatcattccaggccgctttcgcgatgctgaaatcgcctccgagtcgattcactcgggcgtccagctgctgtcgctctaccacgacggcatcctctcgcaggcagtgtccaagctgcccacgccgcctgtccggtcggctcatgcgcgctacacgcgatactggacgcagaagagcaaaacgtaccgcaggatagccatggtgctgcagatggtcgtctacacggagctgctgtgcgaaatgagcgcc

SEQ ID NO: 2513 - DNA, 654 bp, Artificial
  Synthetic
gcgtcaacttcacggcatcacgaggttcctggacaagccgtcaccatgtccactgacgatctgagcacccatctggccgactccggcatcaccatgcggtccgacagcgagcagtactctccgggcgatgaggtctcatcaccctcgtcatcaaactcaccggttattctctacaagccccccacagcatggagtctgatacggagcgccgccatcaatctggttctgccattcatcaacggaatgatgctgggatttggagagttgtttgctcatgaggcagcattccggttaggatggggcggtacaaaggttttccctctttctcgaagacgagcccaccccattggcccaggcatcgaagtccgtgaacgaccagagcgacccgggccttcactaagtgattacgcaagcttagagtagaagggaagaatggaatgaggacgataggggcattgtatatgaatcaatcatgtctaaataaacagatgcaggcgcttttccaaaagactgtggcccatctgctgcactttcagagctccccaaccatataggcagctagtagcggcggataagtggccgcgaattgtacaccagcagattgcacgaagctgtagccactgcattaaaataaatcaattcaacttttctcat

SEQ ID NO: 2514 - DNA, 689 bp, Artificial
  Synthetic
atcggagttgttcccgttgtataacagggcttgactatacttcttcatcttcagctacacatactctcaggctctttcaaagtattcgccggagtcgtctttccccgacatggtcataacaagcttacagaatgagccacggactcgataacctcaccggcctcgccgagggtatcggtctgcgctttctaaatgaagagtggaacgatagcatctcaaacgaccacccgttcaccatccaatggaacgagtcgctggatggggctcaggcaccagagcttgggctgttcaagattacatatcccaaagatggcgttatcgcatacgagctggtatcaaatctgacaggccgcatgaataatgaaaatgcaacatgcttgtggacaccaagccacttggacgacgaattatatactctatggctctcatcctctcgagacgctcgcgcaaattggacgacgtctcctccttggagactaaaagaaactccccgacattcacatcattgggccgcccccattgttatccccattattgtgttgctcgcagtgtataccttgggactcaccacctgtatcgtatatcgacgccgcagaaaagcgagacgtgtgagagagaaaagcaagggaaaggatcctgaaaaggacaaatcaagtcagacgcatctccttggagacgcggagagacat

SEQ ID NO: 2515 - DNA, 1282 bp, Artificial
  Synthetic
atcaacactcgacttgaacacatacaacagccaatcacctctttacatcctcactcaaacaatcaacaaacaaaccaacacaaaaactcaaccatctaatctacatttttaaataaaaaccctcacacgaccatcctcaaacagctccaatacacacttccgaggagaaccagtcatctgctaccgatcggcccataactcgctgcctcttgctgctttgggatccaccacagcttttctgacaccacccctctcccatctgagttcctctggggtatcaaatctcgcccgactacctagaaccaggcctttttttctccttaaacagccccgacagccatcacagttaccgctcgagccggccttaatcagcctacttcaactggagagatagccttttcgcggccttttcgcaaccccgctttccgcacagtagaaaccagaagcttcgaagctctcgagatatatattcgctactgagccacatccctccactctagcttcccatagctatcaccaccgcactcccctacacaaccaacccccaacagtcatcatgaaggtcgtcaccaaagaagaagaagccgcccactacggcgctgtcgtcaagggcggactcattggtggtactcttggtcttgccattggtgtctctggtgttgtctacgcctcaaggcgctaccccagcttccgtggcttgacactccccttccgaactttcctcgtcacatccaccgccacctttggagccattgtccaggctgatcgagctggcatcaagttccagcagggcaaggaccccatgaagacctaccgcgatgcctctcagcgtgctcaggaggttatccgtgagaacgagactgcatacgagcgattcatgaactatggacgcgagcaccgctacagcattgtctgcgcctcatggcttgctagtttggccgttgcctttgccattgtcagccgcgcgcctatgagcacaccccagaagatcgtgcaggctcgtgtctacgctcagggcctgactcttgctgtgctcatcgtctcagctgcctttgagatgaacgacgccaagaacgcaaagggccgctgggagaccgtcatggtcctcgaccccaacgaccccgagcacaagcacctcattgagaagagaatccaccacgaggagtacgagggacaagatctgtggatggatatggttgaggctgaggagaagagaatggctgcccgcaaagctgagcaggagcgcgagcagcagcaggcccagtaagcaagctgctgaatg

SEQ ID NO: 2516 - DNA, 313 bp, Artificial
  Synthetic
gagggaaagaaaaatagataaaagggccagggtccgaccgtgttgatttggagttttgtgtcagcacaggattttgatgagactgttattgaaaagactctttgccttggttggcagattggttgtattaggcatactgtttcgatacgcttcaacgtactttttgagtcgcaaagctaccatgactgtggctcctgtgattgcgctctcacatggtggaggtcccctccctatccttggtgatccctctcacaaggacattgtttactctctcaagaacagagtgcccaagattctcaagctcgggactcct

SEQ ID NO: 2517 - DNA, 631 bp, Artificial
  Synthetic
aatgggtaaaccattcccgcaagttcagcctggagggagcctgattctggcttaccgcgtcaaggacaagaatgtcctggtggtaggcggtggtgaggtcgcggctggccgcatcctcaactgcctcaatgccgatgcccaagtcaccgtcgtctgccctgcgtcaggcctcaacgaagaggtcgcattccgaattgccgagaagcaggtgacacacatcgaccgcctgttcgagccgtccgatttagacaaagcagacatggtgctggtcgccattgacgatccggcagcctcgacagcgatatggaaactgtgcaaggaaaagagaatcccggccaacattgcggacgtgccccctgagtgcgacttttactttggcagcgtccatcgtgacgggcctctacaggtcatggtcagcaccaacggcaagggaccgcggctggcggcatcactacggcggcatattgccagccaactaccgcagaatgttgggaatgctattgagacaattggagagttgcggacacggctgcgcaaggttgcccccaatcatgaagacagtcagaagcgaatgcgatggatgtcaaaagtcagtgatacctacaagtgggaagagatgagcgaaatcacg

SEQ ID NO: 2518 - DNA, 200 bp, Artificial
  Synthetic
cggacgcgtgggcctcgctgcaactccacgcctcgccaatctcgaacgcctgtcaaaatgctctcccgcgccgccactcgcaccacctccgtggtcgcccgccgaggcttccacaccacccgccctcgcatgtcctctccttaccactaccccgagggtccttactccaacttgcccttcaaccctcgcagcaagtggtt

SEQ ID NO: 2519 - DNA, 572 bp, Artificial
  Synthetic
gaagcaaccaagaatctgcacctcactcgataataaaaagaaatcggtactcaaggtttataactcattcaaaatgcgttatactgctgtcctcgctgtcctcggcttctccggagtcatggccaacaaaaacttcggacccttcggatttttcggaccctggttcgatggcgacttaactatcgatgacctcgctgactttcagtttcctgagaacccttgtgagttcattggtggtacttgcgagatcgccacttcccttacattctgcgctggtcggggcgacttcagcgttgatttgccttgtggcgttggcctcggctgctgctggcaccaggacaccagcaatgtttggtttgagcaatggaaggagtggctcgagctacacagccgcatcaactaaagccgctttaatgtcttgacgctttgatggcttgacgcttctatggcttgacgcttctatggcttgatgctttaatggcttgacggagtcttcaattggcacggtagtgggtgatggagaaattagccgtactgaactcaatgagagattgttaaccccgattaagtag

SEQ ID NO: 2520 - DNA, 625 bp, Artificial
  Synthetic
ccatggctgaaccaacccccggcctcactcccgagcagctctcggccttccaaaaagacggctatctcatcatccgcaacgccctcaagccagaaaccgtctcatcgctccttagcgaaacaaagggcctgctcgagggcttctccctcaaggaccacccgctgactcgcttctccacgggcgagaagtcggaccacgtgggcgacgactacttcctcacgtcgggcgacaagatccgcttcttcttcgaggaggacgcctttgacgacgcgggcaacctgaccaagcccaaggagcgcgccgtcaacaaaatcggacacggcctgcacgtgcactcgccgccgtttgcgcggctcattgacgaggcgtcgacgcgggccgcgggcgaagtgagtcctgcggctgtggctcgtgatctcgggttcaaggatgcgcggtgtctgcagagcatggtgatttgcaagcagcccgagatcgggggcgcggtgccgccgcaccaggactcgacgtttttgtacacgagcgcgccgtcggccgtgggcttctggtatgcgctggaggacgcgacgctggagaatgggtgcttgagtttcttgccggggtcgcatcgctgggcgcccgtgga

SEQ ID NO: 2521 - DNA, 1050 bp, Artificial
  Synthetic
gcgctcgcctgttcatctctctacgaaaccgccccccaacacacgatcctacaagaggaaaagcggattgattaagacccgccaaagaagaggcgtcacgcaacatggcggaggagatcctggacaaagttcgggatgtggtggagggccaaattgactttgagggccagagacgagcagaaggccttgccactctgttacttgccctgacaggactcatcgcattcaacgtcggatacgtactacaagacatcgtcaaatgcctatatgttggactaggaggaacggtcttgacatttctcattatcattccgccgtggcccttctataacaagaacccggtcaagtggctgcctatcggatctgcatttaacacgggcgggacatgacgactggataacgccgctctgagtaggccccggcgttttgtcacgttgtcaaaatcagcatgtagcttaaatcttttcgaaatcatgtgccacatttcctctcctccaggtcgtgatatcgttccttgcttttgcttcccgttccgcctactccgtttatcgaccgtacttttgaaactcccagtctctgttgtctagagggcagactgatcgggcctttagccatcgtgaaatgcaatggaagtggaaagcatggttgcaaattccccatgcgacagtgcactcctcgctggtagcggatgcctggttcgcctgacattctatgcaaagatccatgatatggtttcggcagatggcgcagttgtcgactacgatatcccaagcccacagcgcgacggcgttccacttcttgacttcaaacttcttcttgtccgagcctttgctgacgacaccgtcggcctttttggcggccaccggggcatcgctcatttcgacgtcagccatgttcggatagctcgtgacttgtcagggaagctctatcagtgacgatggttccgtgatctcgcagtatcgcgatagggatataaacgtgtgaggatgtgtaaacgaggggagcagtcgagctcttgggactcgatggatggatgacctgtgcggctct

SEQ ID NO: 2522 - DNA, 624 bp, Artificial
  Synthetic
aagatcaggacaagacaattcgagagtgccaaaaacagcaaaagggcagagagacgtcatcatggctcaggccaagttcgccgtttatcccagcctcgtcgaccgcaccgtcgtcatcacaggtggtgcgcagggtatcgccgccgacatggtcgagcagttttccctgcagggttctcaagtcatatttttcgacgtcgaggacgagcttgccgctgatttagtccgaaaagtgtctgatcagggcgtcaaacacaagcccatatactaccactgcgatgtcatcaagatcgacgaggagctcaaacccacagcggccaagatcctgaaagaccatcccaagatcgacggactcataaacagtgccgcgagggcaatggtgaagccctcgcaggatatcacgactgagtggtgggatgagagcgtcgccgtgaacctgcggcatcagttcttcctgacccaggccttgctgccggggcttctccttgctgctggaaacgcttcggtgattaacatggggagcatcaactggctcgtctctgcgacgggtcaggcgccttacacgacgagcaaggccgccgttgtgggactgacgaggacgctggcacatgagtttggaccgca

SEQ ID NO: 2523 - DNA, 745 bp, Artificial
  Synthetic
ccacgtcactctcaacataatgtgtaaggcctcccaggttcgtctctctaatgtttcattgcctaactctcatacacagcggcatacggcggataccaaaagactagctacggcgcccagggcggcgatgactctggtggcttctttgccggagggggttcacagcaaggcagccaaggtggtggtggtggcaagtcataccaagacgaatcattacggcccttgaccatcaagcaaatcctcgaagctgaggaaccgtactctggtgcagacttcaaagtggacggcgctcccatcactcaaatcacattcgtcggccaggttcgcagcataaatccacaacagacgaatctgacgatcaaggtcgacgacggcacagggcaaattgacgtcaagaagtggatcgacgcggacaaacaaggcgatgcagagcccggctttgagattgattcacacatccgcgtctggggtcgtctcaagtcattttccaacaagcgacacgttggagcccacgtcattcgaccagtaacggattttaacgaggtcaactaccacctactcgaggcgacatacgtacatttgttctacactcgtggcgccagcggtaactccggtgcaggaccaaacaacagtgatagcatgtttgttgatggcggcgatggctataacgctggcgccggtggagcccagcttcccaccaagctctctggatgcagtgccgccgcaaagagagtgtacaactact

SEQ ID NO: 2524 - DNA, 563 bp, Artificial
  Synthetic
tgagtgcagtgtaagacaacatggaagacatgtatgtcagcaatacggatgtttccatacagtcaaagcgttgcatcaaccccggcatgtcaggaagatgctctggatactaagcgggaaaatcttccggatgctgacctggctgcttccaattgccctgttgtcgattcttaatttgcgcaggcgatcaggccacatgccacatgcaagtccgagtgcaggtccaagccgagccgcagaggagacaatgggtccaaatgcaaatgcatacaggtagtactgcctacgtgcgctgctacagtaccgctggctgttcatttcgtcttcagggacaaagggggatggatgtacaccgatagatcggcctagtcgaatgttacttggtccattcgttccttctaagccatattaggcatccaagatgctcggtactcgcatggccatgtacggtctcacggctcaccgctaggccttttttgaatgtcgttacttcgttacgattattgggacagatggcgtagagctaccagtgctagtggtgtaatcgacaaagttcgctcctg

SEQ ID NO: 2525 - DNA, 201 bp, Artificial
  Synthetic
tgggcctcctgcgcgatcagaggtctctatgaggagatgagctattgattgcactcagcgctagatgtttgatgaaccctcaggacacagcattggaagtattattgatcagagaaaggctctgggctattcactccagagttgcgagaactatgattcacgttgacatacgtgtcgggcctgcaagaccgctggaaaaaa

SEQ ID NO: 2526 - DNA, 486 bp, Artificial
  Synthetic
accccatcatctgcttcacatattcattatgggggcatctgtcgagcaccaaaatggctcccccgattcacttcatcaccggcaatgcgaataatctgagaaaagtcaaagcgatcctcgaaccgcaaattgagattgacagccagtcgctggatctcgaggaaatccaaggaacgattgaagaggttgccgagtcaaaatgtcgtcgatctgccgacttggtaaacggcccggtgctggttgaacacacggcgctctgttttaatgctctcggaggcctacctgggccttacatcaaatggttcctggataagactgggcaccaaggtctcaacaaacttcttgcggcatacgaagatcaatctgcagaagcagttggtacatttgcatactcaccacgacctggccgcgacccaatcatcttccaaggacggacgccgggtcccattgtacctgcgcgaggcccttcgaactttggctgggacc

SEQ ID NO: 2527 - DNA, 397 bp, Artificial
  Synthetic
attgcgcgccaaaagactgtacacagacgtcttttgatatattttcaaaatgggtggcggtggaaaaatcccttaccccaagcacgtctggtcgccttctggtggttggtacgcccagcctgccaactggcgcgccaacacgctcatcgccggagccgccatgttcggcgtcatcgctattacgtggaagttcagcgccgacagggaacgatgggcgcataagccggagccgtgggagtggcatcctagccgatactggtcaaagcagttgatcgagtgggacaaggaggacaagctgaaggcagcaagcaacagcaaggagtagagttttctttttgggagaaggataatagacgaaattgtacaaattctatacgaacaaaaggcaaacatttct

SEQ ID NO: 2528 - DNA, 649 bp, Artificial
  Synthetic
gcccacgcgtccgcccatatccgcacagacaaatctcacacaatgtctaccgccgagctcgcatcttcctacgcggccctgatccttgccgacgatggcattgagatcaccgccgacaagctccagaccctgatcgccgccgccaaggtcgaggttgagcccatctggacatcaatcttcgccaaggctcttgagggcaaggacattaaggacctcctggtcaacgtcggctccggtggtggtgccgccgctgcccctggcgctgccgccgctgctggcggtgccgtcgctgacgctcctgctgaggaggcaaaggaggaggagaaggaggagtccgacgaggacatgggtttcggtctcttcgactaaacggccagctccacctgttgcggcgactgttttttctcttgcttctttgtacttcaactgcatggcacttcggggtctttatacacatcgatggatgcatacaggatggagtgggcgcctatatcctgcgtcctgggcagagtagcttcgttcataaggataatatgatgaatgctctcacacgacggagttcacgcggggaggggacaaatagtcaattaaatgacttgggaagaacaaaaagaaattttttgacaaatgttgaacttttgaaaaaaaa

SEQ ID NO: 2529 - DNA, 344 bp, Artificial
  Synthetic
ggggggagaagaaaagccagaagatgcgatggggccgtgagtttgagtgtgagtattgcggcgttgtccaggtacaacgggggggacgaaatgcgaaaagcgcacaagacaaggtaaaggaaacggctaaaagaacagacagggcgtgaggataggaaaaggaaacaaaaacgaagagattcccagtattaaatgaaacgaatatgcgccgtagagtagagaggcaccagagcagacttcgagagtcgctggcgagcttacaatgcggtaccgaacttcatcgcgacgttcgatggggaaagaagagcagaatcgatgacggccatgggggtcgtggcatagct

SEQ ID NO: 2530 - DNA, 365 bp, Artificial
  Synthetic
cacgcggtggtgattggaggtgcggatttcacgctttctgatgatactggcagcaattacatttgcgcggctggcgttctttgcaaggatgcccggaatgcggttgtctttactgtgagctacaagagcgggaagggatatgcgtttaacgtcaagggcacgcaaaagtatctgtctattggcgggcgtggatcgtccagttatgtttccttgacgggggggctgggatactggcaggcttatagcgtgagttattgaatgtctgggaatatatagcatggctagtattttgagatggattcattgagtatgaaaggggttggggttagacaaagaaattaaaatagcattattcatttcagccg

SEQ ID NO: 2531 - DNA, 711 bp, Artificial
  Synthetic
aatgaacccaaagaccattgaagtggcctcaatattgatctatcaactttcacctactctcgaacgtttattctcgaggtaatagcttttgaagttttcatcatgtccaaaaaggtggtcatagtcggcggtgttggcggaggcatgtccgctgccacccgcttgcgtcgtctggacgaatcagcaacgatcaccgtgtttgagaaaggagcttacgctggctacgcgaattgcggtataccttatgctctgggtaaggtgatcaaagatgacgaagctctgattttacacacaccaaagtatttcaaggaatatttcaacatcgatgtttacctcaacaccgaagttattgagattgaccgcacgaacgagcaagtgtgcacacgaaccgttggagagactgagattcggcgagtcggctatgacaagctcatcctttcccaaggcgcagaagctgtgcagccgcagattgttggagtagatcagagccatgtgatcactctacggaccatctcggatctacaagctattcgatctatcatggtcgaacgatgcgtgagagatgtttgtatcattggaggcggattcattagccttgaagcggccgaaaacttgcgaaagatgaagtttggagtctcaattgtcgagcaatggacccatgtcttgccgtcaatagacgccgatatcgcacagtttcttcacaccgaactg

SEQ ID NO: 2532 - DNA, 604 bp, Artificial
  Synthetic
tgtacaactccaatcactcatacctcccttctctcagcatactcaacctcataacaaccacaatggctgcacaagaaggacgagctccatatccgccattcacacttgagacagctcaagtcaaagtcaaggccgctcaagatgcttggaacaccagaaacccagatggtgtcaaaatggcatacaccccagactcaatctggcgcaatcgcggcacatttctacaaggccgcgacgagatcaaggcgttcttaaccgacaaatggagcaaagaagacggctaccgacttcgcaaggagctttttgcttttacagacaacaagattgccgtgcagttctggtacgagtggcatgatgaggcaggccagtggtggcgcacgtacgggcttgaggactggacttttgccgagaatgggctgatgaggaaacgtcagatgagtggaaatgacgtgaagattagcgatgcggagagatggttcaaggatggcgttgatgtgaacaccgtcgacatttccgagaagcactggtgagggaggctatttactaaactttaatgaagtcttttgaatatatagataagcaaagtttggtttacgaaaaaaaa

SEQ ID NO: 2533 - DNA, 214 bp, Artificial
  Synthetic
gtggatagcggatggatacttgcagtaatatggggtaagtgagtgagtgagtgagtgatatggatacagcgggatgatgatgatggtggtggtggtggtgttgtcactgatgttgtcgagtgagttgtttgttttgtttacctttggaattgattgaaatgaaatgaaatgaaacagcccaatgcacagcctaagtccaaagaaaacaaaccag

SEQ ID NO: 2534 - DNA, 770 bp, Artificial
  Synthetic
tcttcttcccgtcgtccatcttcgtatatcttacgaagtcgacagtggcgcgtctctgttccgtttgagacatctgtcgcctgagtggtatagaccaaccatccgtctccctcctctccatataaacctccgggcatatcgccgccatgagtgacgacgatgggctttacgctcatactagccccgcaggctacggacacgatgtcgagaaaagcagcgccagaatcggaaactacgagaatgttcgcatccgtggtctcgagacctcgcctgagacgtctctgcaccgcggtctcaaggcgcgccacatttccatgattgccattggtggtgcgctcggcactggtctcatcattggtaccggaaaagccctcgctcaggctggtcccggctcgctgctcatctcgtattgtttcgttgggattctcgtctacggtgtcatggcttctttgggagaaatggctgcttggttgcctatgagtgctggatttacgggctatgcgacgcgatactgccacccttctctgggatttgctcttggttggacatattggttcaagtacatcattaccaccccgaatcagttgacagctgccgctttggtcatccagtattggtgtcctcgagacaaggtcaatccaggtgtcttcattgccattttcctagtcaccattcttgttgtgaactacctaggaattgaactgtttggcgaacttgagttctggctgtcctctttcaaagtcatcatcatcgttggtatcatcatcttc

SEQ ID NO: 2535 - DNA, 453 bp, Artificial
  Synthetic
ttcacctcaggttgttaaagcttgatctgagtattcagaaacgctagccaagatgcagaatgaagagggacaaaacgttgatctttacatccccaggaaatgctctgctaccaacagggtgatcacttcaaaggatcatgcctctgttcaacttaatgttggccatttggatgataagggcttgtatatacctggcagtttcaccacttttgctctctgtggtttcatccgtgctcagggtgatgctgacagcgcactggatcgcctctggcagaagaagaaagtcgaagcgagacaacagtagaaaaatagatttgctatttgagattatcttgtgatggaggatttatgataactatttcaatttcatctgagtttgacactgtttttcctctacatatgggatagcttttcatctttggatatttcacttgcctttcatggttttgagca

SEQ ID NO: 2536 - DNA, 503 bp, Artificial
  Synthetic
acacttttcccgccaaatcaccacctctacgtcaccactaccccctcccacacaaccgaaatggagaacgaccgtggcgacatcgtggacctctacgtcccgcgcaagtgcagcgctaccaaccgcatcatcaaggccaaggaccacggctctgtccagatctccattgccaaggtcgacgagaacggccgcgctgtccccggcgagaaccacgtctacgccctctgcggcttcatccgcgccatgggcgagtccgatgactccctgaaccgattggcccagcgtgacggcctcgtcaagagcgtctggagcgctcagcgataaattttgcaaaacaaaaatttggaagagggacaagctcgggtatgaaggcaggcgtggaaactagagttggctgcatgtagcaattccaattcaaggcgttttggctccgtttcgagacaattatttgcgacgtggaactatgcgattcggacgtgacgttgattgaacattttttatca

SEQ ID NO: 2537 - DNA, 655 bp, Artificial
  Synthetic
tcaccactaccccctcccacacaaccgaaatggagaacgaccgtggcgacatcgtggacctctacgtcccgcgcaagtgcagcgctaccaaccgcatcatcaaggccaaggaccacggctctgtccagatctccattgccaaggtcgacgagaacggccgcgctgtccccggcgagaaccacgtctacgccctctgcggcttcatccgcgccatgggcgagtccgatgactccctgaaccgattggcccagcgtgacggcctcgtcaagagcgtctggagcgctcagcgataaattttgcaaaacaaaaatttggaagaggtacacaaaaacaacaacaatgccgaaacaaaggagaaagccttggatatggaagaatcaggttaactaacctgatttgcagggacaagctcgggtatgaaggcaggcgtggaaactagagttggctgcatgtagcaattccaattcaaggcgttttggctccgtttcgagacaattatttgcgacgtggaactatgcgattcggacgtgacgttgattgaacattttttatcatcctattaaacacctaccggctagcaaagtctcctcggacgagcacctccctgctctctgtgatcggggattctggggctacctcgatagtcctcgagccg

SEQ ID NO: 2538 - DNA, 665 bp, Artificial
  Synthetic
caacttacaaagccaagaaaccattgaagcacataacaaaccgttcgaaaaccgcaacaatgtctatcgtccagccacaagaataccagaccgttgacgacgtgccgtatcagcgaggccgtcctctcccaacagtcacccccgtcttccagaacaagctgcccaactcgcctggcaagacgtccatcggcctcctcgtcgacttcccgcccaactcgtcgacgcccccccacacgcacggcggcgcggccatctccgtcttcgtcatcaagggcaccgtgctcaacaagatgaacgatggcccgactcgtgtgatcccggcgggcggcacgtggttcgaggcccccggctgccaccaccggaccagcgacaacttcagcaccacggagccggcgcagattctggcgacgatggtggttgacacaaagactgttgaagagggagggatggcggctcttgttgtgctcgacccggagtatgctgatatcagacttggttaaattgatatggatgctgcagtgaagagaaccggaagctcggaaagggtgtgggtgttgtcaatatcagaagtggccagcggaggctcggattgctgttagtaaacggggcatctcagcaggaaggcaaaatgaatatgtaaagcaatcaatggcaacgaatcgttt

SEQ ID NO: 2539 - DNA, 721 bp, Artificial
  Synthetic
ggccagaaccgcgcgagtatacatctatctgcaacatctcttacctccatcttcgcaatggcttctgataagatggaccgcggcctcgacgaaatcattgcagacaagcgcagcaatggatctcgaacccgacgcggtggcgaccgccgtcgtgaccgtcaagactatccccgtgatggggtgaaaaagtctctccgcaacgaacctcgaaacttggatagcgaatgggtacatgatcgatacgaagagaacacgtatcgcaatagaggccctgcaccgcgtcgcaggcgcgagtctcccagcgggggagatgcccgcggcgcacgactccgagtcgaaaatatccactacgatctcaccgaggaggatctcgatgaacttttccgaagaattggccccatcacaaaattgcaactgcgttatgatcggtctggacggtccgaaggtgtagctttcgtaacgtatgagagcaaagacgatgccgcagaggctgtgagacaattcgatggtgccaatgcgaacggccagccaattcgtttgtccgtcatgtcaagtgggccttctcgaaacccgtttgatactgctgtgatgccaggcaagcctttgtccgaacgcatttctgctcctggtggcagatctcgatcactctcccctcgccgatacgatgaagaagatgccgctcgcagaggcattgatcgatatgttccaggcggaagtcgct

SEQ ID NO: 2540 - DNA, 603 bp, Artificial
  Synthetic
gcccgtcacctggagaaaagcagcgactcttcgtcttcgtctccaaccaccacaatgtctggctacaccgtccgcaaggttgctgcccagaacactctggagcaccgcgtctacatcgagaaggatggcgtccccgtgtcgcccttccacgacattcctctctttgccaaccaggagcagaccatcctgaacatggttgtcgagattcctcgatggaccaatggcaagctcgagatctccaaggaggagctccttaaccccatcaagcaggacgtcaagaagggcaagcttcgcttcgtccgcaactgcttcccccacaagggctacctctggaactacggtgccttcccccagacctgggaagaccccaacaccgtccaccccgagaccaaggccaagggtgacaacgaccctctcgatgtctgcgagatcggtgagcttgttggctaccccggccagatcaagcaggtcaaggtcctcggtgtcatggcccttctcgacgaagaggagactgactggaaggtcattgtcattgacgtcaacgaaccccttgatcctaagttgaacgacgttgaggacgtcgagcgccacctgactggcctg

SEQ ID NO: 2541 - DNA, 615 bp, Artificial
  Synthetic
agcaacatgtctacctacactacccggtccattggtgcccccaacactctcgactacaaggtctacattgagaaggacggcaagcccgtttccgccttccacgacattcctctgtacgccaatgctgagaagaccattctcaacatgattgtcgaggttcctcgatggaccaacgccaagatggagatctccaaggaccttgctctgaaccccatcatccaggacaccaagaagggcaagctccgattcgtccgaaactgcttcccccaccacggatacatccacaactacggtgctttcccccagacctgggaggaccccaaccacgtccaccccgagaccaaggccaagggtgacaacgacccgctcgacgtctgcgagatcggtgagactgttggctacactggccaggtcaagcaggtcaaggtcctcggtgtcatggctctcctcgacgagggtgagactgactggaagatcatcgccatcgatgtcaaggaccctcttgcctccaaggtcaatgacattgaggatgttgagcgacacctgcccggtcttctgcgagccaccaacgaatggttccgaatctacaagatccctgacggaaagcccgagaac

SEQ ID NO: 2542 - DNA, 590 bp, Artificial
  Synthetic
aaatcatttattgatttaatctcctttttcctttatcataatgcaaagaatccattaagagaagcacttcaaacgagcgagagatcccccgccggggcagaccttgtcacaagcttcacccacgcttgatgcgtctcctggatcaccttgagcgcgtactccttgccagcagccttgttccccagcccaaacttattctgcggcttcccatccggcaccttgtagtcgcggaaccagtcccggatctccatcagcgtcccgggaaagtacttctccacatcactctcatcgttgaaaagcccagccctgggatcatccacggagatggccaccaccttccagtccagctccccctcatcgatcatcgccagcaccgccaccggcttcactcgaagaacttccccacgccccgcctttcgctcgccgatctcgacaacgtcgaccggatcattgtcaccaagcgctccctccacatccgggttggcgtggtttggatcttcccaagtttgcggaagaagcccgtagttccagcgtatgtcgtatggatagaaccgtagcttgcctttcttcacgtcctgcttgatcggcgt

SEQ ID NO: 2543 - DNA, 559 bp, Artificial
  Synthetic
aggcggctcggcggcgaagatgtctctggtgagcaatgaggagtttcagcacattcttcgtgtgctcaacaccaacgtggacgggcggcagaagatcatgtttgcgctcacctccatcaagggtatcggccgccgcttcgccaacattgtctgcaagaaggccgatgtggacatgaacaagagggctggtgagctgaccgctaccgagctcgagaacctgatgctgatcgttgccaacccgcggcagttcaagatccccgagtggttcctcaacaggaagaaggactacaaggacgggaggtactcccaggttgtggccaacgctctcgacatgaagctcagggacgacctggagaggctcaagaagatcagaaaccaccgtggtcttcgtcactactggggtctccgcgtccgcgggcagcacaccaagaccactggacgccgtggaagaactgtgggagtgtccaagaagcgatagatagccgcagcttttgtttggtctcttaatttccaatatgttttaagtgcaaattttaaaattcattaagaaaattaattt

SEQ ID NO: 2544 - DNA, 260 bp, Artificial
  Synthetic
gatctttctcggcatccaaaaatgtctctagttgcgaacgaggagtttcagcatattctgcgtgtgctcaatactaatgtcgatgggaagcaaaaaattatgtttgctttgacctcaatcaagggtattggaaggcgattggctaacattgtgtgcaagaaggctgatgttgacatgaacaagagggctggagaactaagtgctgctgagattgataacctcatgacaatcgttgctaaccctcgccagttcaagatccc

SEQ ID NO: 2545 - DNA, 334 bp, Artificial
  Synthetic
cccacgcgtccgcttttgtgttcttcactctccagcgatcgtttattgcttgaagacggcttcttcttctcacaaatctcatctctgctaatcaaaatgtctctggttgcaaatgaggagtttcaacacattcttcgtgtgttgaatactaatgttgatggtaagcagaagattatgtttgcccttacctctatcaaaggtattggtaggcgattggctaacattgtctgcaagaaggctgatgtcgacatgaacaaaagggctggtgagttatctgctgctgagattgataacctcatgacaatcgttgcaaacccacgtcagttcaagatcc

SEQ ID NO: 2546 - DNA, 577 bp, Artificial
  Synthetic
gggagggagagggagagggagagggagagagagaagtcgaaaaccggctaatctgcgtcctctaatcatgtcgctgatcgccaacgaggatttccaggacatgcttcgtgttctcaacacgaacgtagatgggaggcagaagatcatgttcgccctcacggcgatcaagggtatcggccgacgtttcgccaatctcgtctgcaagaaggcagacgtcgacgtcaacaaaagagctggagaactctctgctgcagagttggaaagccttatggtgattgttgcaaatcctagacagttcaagatccccgactggttcctgaacagaaagaaggactacaaagatggacgcttctctcaagtagtgtccaatgctttggatatgaagctcagggatgaccttgagaggctcaaaaagatcaggaatcaccgaggtcttcgccactactggggccttcgtgttcgagggcagcacacaaagaccactggccgccgaggaaggactgttggtgtctctaaaaagcgtgaggggggtaattctagttccttgtcgtggctggcatttagaaatgtctcaatt

SEQ ID NO: 2547 - DNA, 682 bp, Artificial
  Synthetic
cccaaaaccctaaccctcgcagccgcatcgcgccaccgcctcctcctccccctccccctccggcgagagagcccgcgccgttgccgccgccgccgccgccgccatgtcgctgatcgcgggggaggacttccagcacatcctgcgtctgctgaacacgaacgtggatgggaagcagaagatcatgttcgcgctcacctccatcaagggtgtcggccgccgcttctccaacatcgcctgcaagaaggccgacatcgacatgaacaagagggccggtgagcttacgccggaggagctggagcggctgatgaccgtggtggcgaacccgcggcagttcaaggtgcccgactggttcctcaacaggaagaaggactacaaggacgggaggttctcccaggttgtctccaacgcgctcgacatgaagctcagggatgatcttgagaggctcaagaagatcaggaaccaccgtggtctgaggcactactggggcctccgtgtgcgtgggcagcacaccaagacaaccggaaggaggggtaagactgtcggtgtgtccaagaagcgataagcctaagaaccacccgagacttgatgaagcgtttcgttgggtgatgttttgccctaggataatattttgcagctatggaaccttgtcgtaatgtatcttgaagagtgtctttgggaacta

SEQ ID NO: 2548 - DNA, 249 bp, Artificial
  Synthetic
gtcttcaacccgaacaatcgaatctaacgagcagcacggcaacgtcccatacagttgcccagcatgtcgctcgtcacgggagagaagacgaactttcagttcattctccgtcttctgaacaccaacgtcgatggaaagcagaaggttatgtacgccttgaccaagatcaagggtgtcggtcgccgatactccaacttggtctgcaagaaggccgatgtcgacctgaacaagcgcgccggtgagcttacc

SEQ ID NO: 2549 - DNA, 165 bp, Artificial
  Synthetic
gcggacgcgtgggtcgaatcaaggtcatgtacgccatgtgcaagatcaagggtgttggtcgacgatacgccaacctggtctgcaagaaggccgatgtcgatctctccaagcgagccggtgagctcaccgtcgaggagctcgagcgaatcgttactatcatccaga

SEQ ID NO: 2550 - DNA, 575 bp, Artificial
  Synthetic
gtcgcaatcgatcaaacaaacaccaggacaaaccggcaaagaaataccctgcagtcctcgagactcgcgatagagcagaagtacatcagtcttatttactagcgagcaagacagtcaaaatgtcgtgggcgggattcaagaagaatgtgaaccgcgcgacgacgcaggtgatgatgaagacggggcatgtggaaaagacaaacgatcgcgattacgaggtcgaagagagacggttcaagacgatggaaacagctgcactgcggctgcagaaagaatcaaagggctaccttgactctttgagagccatgacagcttcacagatgcgaatcgccgagacgatagatgcgttttacggcgactccggtgcgaaggatggcgtgagcaggagctacaagcaggccgtcgaagatctcgacgccgaaaccatcaaggccctcgacgggccttaccgaatgacggtgctcgaccccattggccggttctgcgcctacttccccgacgtcaacgaatgcatcaagaagcgctcgcacaagcttctcgactacgatgctctcccgagctaaagtgaagaagct

SEQ ID NO: 2551 - DNA, 1098 bp, Artificial
  Synthetic
ggcgcaatgcttcaacagcgtctctcgccacagtctggatctgcccgtgccgccactctgaactacaatcacgcaaccaaaccttagtttaaatgcgccgctctgcgcccccacaagagcttgtgcgcatgtgctgtggcactcagttcaaagtggtactgccgagtcaagtgagacgtgcaccctggtcgaggccgtgaccatggcttctcaccctcagaccaacgagcttgacgcatctgcctctgcagtggcattgccgaagaagacgctatcgagggctgacctgcatcgtcgtcagtcggcagacgagcggattaacaacattctcgagacggctctgcaacgagcagaaacgatggatcccgcctctctaagccttctccagaaaggctcttcccacaattcctctcccaactatggagcctccggaacggtgacaagagggatattgcaagactatcaggcggtaccgaccagcgatgaaagcgatgccacccgtccgagaaaggtttcatacagcgatgcggcgaagaaggccgggaaccatgcgaagagccagagctctctgcggcaacgaaacggagtctccggctcggaggatacaagatcgccaacaaaagcaaagtcatcatggacgaaggaaacatttcgaaaatttcagtcccttcagttggaaaacaagggaagcgtggctagagatcacctggctctcggtatgtcgcatgcgtatacagcagctgagctgcatgtctcaagagaaccaattggctgaccatttcatttccccccccttccagaacgcacatttctagcatggcttcgaacctctctcgcttttgcatcgattggcgtcgccgtgacgcagctattccgcctcaacactgataacgcttccgcctccgatttcgaccacacaaggctacaaaagatgggccgcccgttgggtgcgacattcctcgccattagtattgtgaccttgctcctcggttgcagacgatatttccatgcccaggaatggatccttcagggcaagttcccggcaagccgagggaccatcattatcatgtcactggtggcattggccctcatgatttt

SEQ ID NO: 2552 - DNA, 519 bp, Artificial
  Synthetic
cccacgcgtccgcccacgcgtccgacaggaagcagcgagatggaaggcaagagccggcgaccggagataaccgtcgtgccggcggcaggcggcggcgccgccgccgccgttgatgcggtgaaggcggcgaacaaggagcccatcagcccgggctcgccgtccctggcgagcggcgccggcaaggagagcctgagccgccatgaggccgccgtcgtgtccctgcccgcgtggaagctcgacgcgctctgccaggagtccggctcgtcgccggcggtgatgagggcgcgcttcccctacttctgaatttctgaatttctgatgaagccatgagctttttgccatcttcgtacgtgtgtgtgtgtgtgtgtgtgtgattgtaactgtgttgttcatggctgagtaaagaattatacttcctacaagcggctgtgatgtatatgtgagctgctttagctgacgcgttcatctttggacgctgtaaaaactaaaaactgccagtttttcatgtagcatcattgg

SEQ ID NO: 2553 - DNA, 771 bp, Artificial
  Synthetic
agcccttattacagtctaacagccttattaattctagcttgttatacggccacagtgttactatgagcaaacgcatattgctcgtcttatgcatcgtttgtttacagcgacgactcgtgattactcatgagtaaaccatttacagggttgatttgaactaattaattaacccccccccccccccccccccgaagtctaatcagtcgcattgcatagaagaagaatagaagcatttgaagcctcctcctccaggttgcagcaaaagcacaggaagcagcgagatggaaggcaagagccggcgaccggagataaccgtcgtgccggcggcaggcggcggcgccgccgccgccgttgatgcggtgaaggcggcgaacaaggagcccatcagcccgggctcgccgtccctggcgagcggcgccggcaaggagagcctgagccgccatgaggccgccgtcgtgtccctgcccgcgtggaagctcgacgcgctctgccaggagtccggctcgtcgccggcggtgatgagggcgcgcttcccctacttctgaatttctgaatttctgatgaagccatgagctttttgccatcttcgtacgtgtgtgtgtgtgtgtgtgtgtgattgtaactgtgttgttcatggctgagtaaagaattatacttcctacaagcggctgtgatgtatatgtgagctgctttagctgacgcgttcatctttggacgctgtaaaaactaaaaactgccagtttttcatgtagcatcattggaaaaaaaaaa

SEQ ID NO: 2554 - DNA, 397 bp, Artificial
  Synthetic
gcccacgctgtcgcccacgcgtccgatttcactcttctgcagacgaggacggacccgattgaccatgttgcgacaatccttcagagcctttgcccgcacggctgttgcgagaccggccgcggcgagaagctacgctaccttcaactgggaggatcccctcaatgcgaacaacctctttaccgaggaagagcaggccattgcagaaaccgcagagcgatactgccaggaacgactacagcctagggtcttgcaggcctaccgagacgaacactatgaccccaagatcctcgaagagatgggcgagctgggcctgcttggctccagcatcaagggctacggatgcgctggcgtttcttcggtggccggcggcctgattacacgagcggtcgagcgagtc

SEQ ID NO: 2555 - DNA, 476 bp, Artificial
  Synthetic
tcatgcgcctcaaagaatggaagaaaacacaggcgaatgacgtgaaacgaaagataaaaagacaggcgccttcatgcgagggtttcgccagtcgcctctagcgtgtttcgaagcgcagggttgaaacgcggctgcatgatgcccggccgcccatctgaggcatggcggctaccggaacaggacgacatccgaagacttgaggaggctccgtgtttgttcgtttcgtttcgtctttcgagtgaagggttggttcttgttttcggctgttgtgtgttttggttgacttgtgtttacgggttgggggtgagttgaattgagtgcgagacttgatgcttctgtcaacaagccagccacttacactgcggcttcaccctttcgtctcttttaccatgttacgcaacatggcgaatttccttctataggatccatattgcccaaattcagatccagcccgcaagggagaattttatccgcct

SEQ ID NO: 2556 - DNA, 313 bp, Artificial
  Synthetic
ccaaattttctgcttgttcctggcgcctctgacacacacacacgcactgacaaagctgactggctgtgggcaactccctaggccgcctcgctctcggtcgtatggcaccgagaaaagggaccacactgatagcggcggggcctcgataaacgccgcagcaagggtctaccgtcaagagccggaagttgttggctcgcagctagttgcccggttggtggatccgataatgcgaagagagtctttgggacctgcgatcagattgggcaatactagggggtggcaagagatttgtttgttggtgggatgttgttgg

SEQ ID NO: 2557 - DNA, 317 bp, Artificial
  Synthetic
gggaaaatagactgcgagagagagagcgacgaaaagaaggaaatgctccgatcacgattaggggcggaattggaaatccggagctccgacagagtgcgaaatgcgaatgcgatagttcaaatgtatgattgatttactgtatgaggcgacgatgatgcgatgaagaagaacggaaaatatcccgagctgatgcatacattgcgggctttccggatatctcgtcagccctccttccattatgtcagaagctattatgcagttggttttgatggatgggcgaatttgatgacaaggtgcagtttactggacgggaccgg

SEQ ID NO: 2558 - DNA, 657 bp, Artificial
  Synthetic
gctgcattttggggtcgcaaatctacagcaaaaatggcctcgacaacgaccaagcagaccccggcgtcctttgtcgggaccagcaaggtcgtcgagactgactatccgctcatcgacaacgaccctcactttaagcgggttatcggatatgcgagaacgtcagactacgtagctggtgcaacctctgcggcctttgcaccgactgctctctatgccctcgagaggctcgccccgtcgcatgttggccggggaggctttgccaaagccatgcggttagccggattcattggcttggccggcggtttcctctacttttaccagcgatcagcccttcgattctacggcgccactgagaactcaagggaagtcgagatggatatgcgagagatggtttccaaggtcaaggcgggacagcctctgtatggcgagagcaagctgagccctcacctgcagggagttgcggcccgacagagcagatactctgcgctctttttcagcacagtaccgtggttcaactttgtcaaccacaaccagcacggcgtggacacggccaagtactatcagcaggccgagagggaactggaagcagagcgggcggcgggcaagagctagacgggaccaaatgtgtatatttagcgggactaccgcttcttgcgg

SEQ ID NO: 2559 - DNA, 522 bp, Artificial
  Synthetic
atccccggattcaacactcaatgccgcctccatgaacgactcgagcttcgtccaagcccaacagcgcgtcgctgagcgacgagcggcccgcgaggtcgaacaacgggcccgaatcgcggctcagcgcgaatcgtctcgcgtgaacaaccagctgcagcgtctggcataccccctcaatcgcctcgccggtgtctgggatgcagccgcctctatagaaaacacccggcctgcgtttcgcgttgcgcaggttgatgccgagctgctggatgaagagctgctggagctcctcaaggggcaggttggcgacgccctcagatactatgccggcgggcatctcaaagacgactggtcttccgagattcagctggcgctcagggccatcctgttcaaactgagcgtctgggataacgatgcaacgtacggagcgggtctacaaaacctcaaatacaccgacgccagaaaagggggccccgtgctgtcacccccgacgagggtacaaaagtcactatacgggctggtaac

SEQ ID NO: 2560 - DNA, 637 bp, Artificial
  Synthetic
aaacgaaaccgcaatccatctcccggcggaaattgccctccaaccgcaaccatgtcgaccctccccaggactctgggcaacctgcgcaagattggcatcaaggaatacttccgccagatgctggttcgtctctcgcccttctaacctcccacgacctctggctaacgcacagctcttcgcggtcctcctcgaatagtacatcggtgacaccaagtacggtactctcatcggccaggatcgcttcggcaacaaatactacgagaacctcgaggaactgcccctccgaacccgctgggtcgactacgccaagcacgactacgatgcctcccacatcgagcccggctggcacgcctggatcagctactccgtcgacaagcccccgacccaggacagcctcatcgccacgggcaccagacactttgagcccgcccttcccaagcccaactttaccggaacgcgaggcgcttacaagccgtataacacagtgaaatcgaagcttaatgcttgggagccggtggccaaggatcgggtatgagtggtttttacgttttcttttttaaaccgtgggaaaatatggtgtacatattgaaatcgcgcaacaaacgcaaacaaatcaaacaatagacacagacatgtg

SEQ ID NO: 2561 - DNA, 674 bp, Artificial
  Synthetic
tacagttcaaaatggccagttcaattcttcgagggagggcgctgggagccgtgcgccaggcccgttgcttcagctctactccaaggcaatatgccgctgatgtcaagagcgtcggtgttctcggcgccggccagatgggtctgggtatcgctcttgttgctgcgcaaaaggcgcaagttccggttactctcgtcgatgcttctgagcaggcattgagtaaaggcattgcttttgccgagaagctgctggccaaggacgtgtccaagtctagaattactcaggaacaggctgatcaagcccgctccctgctgaagactagtaccaagattgaggacttctcttctgtcgacttcattatcgaagctgtgcctgagatccctcagctcaagtttgacatcttcagcaagctggccaaggtagctcccgctcacgcaatcttggcgaccaatacctcttcaatctccatcacgcgcattgctgccgccactaccaacgatcctaatgacacctcggcttcatcgagagttgtttctactcacttcatgaacccggtccctgttcagaagggtgtagagatcattagcggcttgcaaaccagcaaggagacgcttgatacggcagttgagttctgcaagcggatgggcaaagtcacttccgtttcggctgactctcct

SEQ ID NO: 2562 - DNA, 604 bp, Artificial
  Synthetic
agtatctcaaagatgggcaccaagatggatttccaacactttgcgccgcaaatcgacaagatccccaaagttacaccgaggcaaatcgcttctactgctctttggaatactgtccgcgacaacttctccatctcgacgtggatggccattggagccaccctccagggtctcttagttttgttcgctcgacctacattcgcgattgcaccggcaacgctcatcttgctttaccgattctcccacacgatgctcatgcactacggctttattcgcaacacgcagatggaagatgtcatcatgggaaagtataccgtgcaaattcccgacaaggacggtaaaccgccaagtgagccgtcggggacaggcatggctgtcatcatgctgggcttcagaaacaattccgccctcggtatgtttggagcaggcgggctggagacctccctcaagtttcaagcgatgttgaaggatctcgagaatgatccggactccggctttcttggcatgtgtgggtataaagctgccaatgagcgaccgacggccaacggtttcatgtcggtgctttatttccgtagtgttgaggatatcaatcgattcgctcacgccc

SEQ ID NO: 2563 - DNA, 1022 bp, Artificial
  Synthetic
tcgacaccccttcacgcactcgccattgccgcgctcctcgtcacgctctgctcgattagccgtctctcgcccattgattgaacctgctctcggcctctgcagccaccctcacgcaacctacgcctgacatcctctgcgtcgctcggctgtctcccggttttatccatcagctgaaccttcaccttcgccttcgctctcaagagggaatccgagggcccggccgttctctgccatctattgttattgccattaacgctgctgctgctgccactgtctcctctactcctgtttcgccctcatatgtctcagccgcctcgccggatgcctctactatcacaccctaaacaccgtattagcatacttgatcttaccaaactgccgttgcagtaacgccggcttcatcttcttgacaatgccgtcgaaaactaacaatggtgtgggagttcaggtcgaggacacaaagatatgcgttgtcatggttggtctcccggcccgcgggaagagctacattgcccagttagcccagagatacctgcaatggctgtcgattccggcagcgactttcaatgtcggcaactatcggcgcaatgacgctccacagccgactgccgacttctttgattttaacaatcccgaaggagagcggaagcgccgtgcggctgccgaggccgccgttgctgacatgcttgcctggttccgcaccggcggcgtcgtcggcatccttgacgcgaccaattctacaaaggagcgccgtaaatgggtcatggacacgtgcaccgctcacggcattgaagtgctctttgtcgagagcaaatgcgatgatgaagaggtcatcatggccaatatccgtgacgtcaagctaacgagccccgactatcgaggccaagatcccgaggccgcggcgcaagactttcgcaatcgcatcagccactacgagaaagtttacaagaccatcaacgccgacgaggatgaggacaactacacctacctaaagctgatgaacgtcggcaagcaagtcatca

SEQ ID NO: 2564 - DNA, 661 bp, Artificial
  Synthetic
aaagtttggctacgctgtgttttattggcctccagggctatgaaatcttgctgatcccactgttaaaatggagtatgctacttttctcaaagagacttccgaacccaatccgatcttatgtcaatataccttggtatcccaaaagttgaaaagatgtcgtcgccccctctagccgccaccaagaccccagactccccacaagatagcagcatagaagaagcagaatgcacctctgtcagacagtctgcctccactgcttctattcataagtggagtgatgagaatattgaagatagaggaatgtatcgattactgtcttcaccaaatagagactgccatgacgagatcagaatttcgacacgtcctgcaactccatctaaggcactaatgtgccttatactttcaatacataaaaataggattttggatccaggagactgctatgacgacattaaatcgataggtgctttaactccatctatggcaccttatattttcctaacaaaagaaaacctcgtgtcttcaatccttcgagatcgttttttgcgtcgaggcgagcctgataatttaacctgtacccaaatactgaaatgctagaggagcctgctaacagctcacataagcaagaaggtggcctcgacatctggaaatgctgaagagc

SEQ ID NO: 2565 - DNA, 965 bp, Artificial
  Synthetic
gttcacgattcctcctttcttcccctccatactatttatcctgcctcttcctcgtcttccatctgttgccggtgtgactcttgcaattcattccctgcccggcttcctcgcttgattgaatagccgttgctacttccaactgcaaatcattatagctatacctccctagcttcatataagctcggctcttctaggaacgcgcaagcaaacatcctcggcagtgacccacgagccttgtctggagattttaaataggaaagctcatcaacggcacctgagcagcgtccaattgctctgttcagctcaattaagctttcaagatgcctagagacggcagtaaacaaccgccctcagcggcgacaaacctcatcgctggtggtggcgccggtatgatggaagccctcgcctgccaccctctagacacaatcaaagtgcgaatgcagctctctcgccgtgcacgaatgcccggcgccccccgccgcggcttcatcaagactggtgtagaggttgtgaaaaaggaaactcctctcgctctatacaagggcctcggcgccgtcttgacgggcattgtccctaaaatggctatccgattcacatcatttgagtggtataagcagctcctagccgataaaaccaccggcaccgtctcaggccgaggaacatttctggctggtctcgctgccggtgtgacagaagccgtggccgtcgtgacacccatggaggtcatcaaaatccgtctgcaggcgcaacatcactcaatggccgatccgctggatattcccaaatacagaaacgccgcgcatgctctgtataccgtcgtcaaggaggaaggcttcggagcgctataccgtggagtcagcttaacagccttaagacaaggctccaaccaggctgtcaacttcacggcatactcttactttaagcagtggctcaaggactaccagcctcagtataccgacggtaac

SEQ ID NO: 2566 - DNA, 526 bp, Artificial
  Synthetic
aaccctccagggcagctagcgaagagagcaggcccagttccgggtgacaggtcgggcaacgccgcgacggctgcgattccgagcgaacggcgctggcgttccagacggcacagcagcaagcacagcaacagcacagcacagctacgaacatcgaggatcccgctccaggaaccggtgctatccagaacaaggccccggcgctaggacccgcggttggcagtggtggatcgcaaggctccagtcatgccatgcaagcgagggaaaaacgcttgcatgctcatgctttgctctggctctagatgagtctgaatctcatccatcctcgacctgctgctgtgtctccccgtcccgcacgaggcttcggtcggcgagagccgggatcgaggcgttgggggatggcgtctgtgagccagacatgacctgtcacagcgctgcgtcgatgatgaaaatggcctgatttcttgctcgcggagctatgccgggaccctgcaaccgcgaaatgggctgccaccggccacagagaaaa

SEQ ID NO: 2567 - DNA, 706 bp, Artificial
  Synthetic
cgaatatcatgctatcagccgcttccttcgttcctggaaatggtccatgctgacctacctacccctcgccttggcccttcaactacgcaaccccaggcgcatcaacctcgtcaaggccatcaccggctctacccgatcatccacttttcttgctacctttataaccctcttttactacggggtgtgtctggcccgcactcgcctcggcccccgcgtcctcggcaaagaaataccgaaccgccagcgaatcgacgagggcatctgtgtcggtaccggatgctgcctttgcggatggagcgtcttcatcgagacggcaggtagaaggaaagacatggccttgtttgtggcgccgcgggcactggcaacgttggtccctcggcggtatcccctggagaagcagtggcgagagaagttgatattcgcagcgagcacggcagtcgtgtttacttgcgcccttgagaatccaaagagagttagaggcgtactaggggggattttgggcatggtgttgaagaaataaaccgggcatatgggcaaatatgatctcttttagggagttctgagacgtgacatgactaatttcttcttcttctttggatgtctttggaataagctacggtttttagatgatatacacaaacaaccctgatgctataattggtaataaatacataatattaattgtttatccaaacaaaaaaaaaaa

SEQ ID NO: 2568 - DNA, 710 bp, Artificial
  Synthetic
gcttcagcccggctctccaagaacaccatccgcctcaatcggcacatgcaaaagcagcgacactcgtcgatcgcggctgacagactgcagagctacagacgacagatagacacagctccctaccctcaagctcacgctcaaacttgctttcgcactcgcacccgcacccgcacccgcacgcgggctcgcgccagccctccgcgagacaatacgagaccacaaaacaccacggcatcttccccacattctccagccagagacctctccacgaatcgggcttgggctcatcctattttgccttccctcctcccaactccttccgaaatctcggcatcgtgaactccgggctccaatggctaccagaacgggttcgaccggcgtggccacctatgccgactgcgtcgattcgctgcgcaactctctcaaattcctcgaggcctccgtggagaccattgaccgtggcgtatctgacttccctcgcctcgtgaacgtcctcaagacagtccgacactacgaactcattccccagcccacactcgctgctgctgaggcttccctgcgcgacgaaattgggccctacatcgcttttctcctcagccgcgctgatgctcaagttgaacgccaggaacgccgcattgagacgctcaaagcccgggctgagttacaacagggacggttaactaggcctgatgaaccggcacgcagcgtat

SEQ ID NO: 2569 - DNA, 627 bp, Artificial
  Synthetic
ggacctataagacaagctgtggcttttttaatccttaatccttactttcaattccattccagtgttgctaccttttcttgggaataactcagctacaaagacaattttgaacctacaacatcatcatcaaattatcattattcaaaatgaagttcacaaccatcgtcaccgctgctgtctcttcagccattgccgtctccggcactcccatccacaagcgcgagatcggcggcgtatgtcttctccctctcctctcccttgcatcttctccattcctatcactcgtctgattcaatatcatctctaactattggtcaatccctcacaggtcctcttgtgcaccggcgtcaatgcaaccggcacctgcagctacaacgtctacgaactcaagacgtgccaccagcttcccgcgcctttccaccaaaacaccagcacgtttgcccccgacggcgaagactttgagtgcttccctcgtattggcgactgcggttctatttgcaccagcccgacgggatgtacctttggcagcgtcgactttaactacaagaacaagttcaatctgggggctattaagtggaacaccttgatttccagctttgactgttcgctgaagacgacgacgacttc

SEQ ID NO: 2570 - DNA, 668 bp, Artificial
  Synthetic
cacactccaatttccaatttccaatttcccaatctgcaattttctctttccctttcaacaaagaaaaatctcagagagaaaaatggcggatcagctcaccgacgatcagatctctgagttcaaagaagcctttagtctctttgacaaggacggagatggttgcatcacaactaaggagcttggaactgtaatgcggtcattggggcagaacccaaccgaggctgagcttcaagacatgatcaatgaagttgatgctgatgggaatgggaccattgatttcccagagttccttaacctgatggctcgcaagatgaaggacactgattccgaggaggagctaaaggaagctttcagagtgttcgacaaggatcagaacggattcatctcggcagctgagcttcgtcatgtcatgacaaacctaggcgagaagcttacagatgaagaggttgatgaaatgatccgtgaagctgatgtggacggcgatgggcaaatcaactacgaggagtttgtcaaggtcatgatggccaagtgagaactgacgaatccaacttttaatctttattagaagtaaaaaatacgaagagaaggaaacagggcagataagtttgttgagattctgtttcaaattaggacatatttacctgtctcagtgcttgcctattttccta

SEQ ID NO: 2571 - DNA, 628 bp, Artificial
  Synthetic
gttccacgtgcttttctgctctcttttggtttcacgactgcccaactcaacctgcccagcgctctctctctctctctctctctcttcctggtttgggtttctatggccgcagtgatggtcgagcagcccctgacagaggagcaaatagccgaatttaaggaggcctttagtctttttgatagagatggagatgggtgcatcacaacaaaggagttgggcacggtgatgaggtcgttagggcagaaccccactgaggccgagatccaagacatgatcaatgaagtggatgcagacggcaatgggatcatcgacttcatggagtttgtgggcctcatgtctaggaagatgaaggatactgactcagaagaggagctcaaagaggccttcaaggtctttgacaaggatcaaaatggcttcatctcagcccttgagctccgccacgtcatgaccaacctcggtgagaagctcagtaacgaagaggttgacgagatgatccgagaagccgatgtggacggggatggccagattaactatgaagaatttgtcttaattatgatgagtagtaagtaagtaggacccccatatagaagcctcttaaacccttctctaagtcttgtgtgtactcatg

SEQ ID NO: 2572 - DNA, 526 bp, Artificial
  Synthetic
cacagcccgcgcacctccacaccattagccatcaacgaccagcatctcggctttgctcgccttctcgaagcttctgctgccatggcggaccagctctccgaagagcagattgtagagttcagggaggccttcagcctcttcgacaaggacggcgacggttctatcaccaccaaggagctaggaaccgtgatgcgaagtctggggcagaacccaacagaggcggagctgcaggacatgatcagcgaggtggacgcggacagcaacggcaacatcgaattcaaggagttcctgggcctgatggcgcgcaagctgagggacaaggactccgaggaggagctgaaggaggcgttccgcgtcttcgacaaggaccagaacgggttcatctccgccgccgagctccgccacgtgatggccaacatcggggagcggctcaccgacgaggaggtcggcgagatgatcagcgaggccgacgtcgacggcgacgggcagatcaactacgaggagttcgtcaagtgcatgatggcca

SEQ ID NO: 2573 - DNA, 623 bp, Artificial
  Synthetic
cctcgccactcgttccccttccttcctctcctcctctcgcggaaccttctcgaagcttccacacccccaacctcgcctccaccaccaaccccccatggcggaccagctcaccgacgagcagatcgccgagttcaaggaggcgttcagcctcttcgacaaggacggcgacggttgcatcactactaaggagcttggaaccgtgatgcggtcccttggtcagaacccaactgaggcggagctgcaggacatgatcaacgaggttgatgctgatggcaatgggaccattgacttcccagagttcctgaacctgatggcgaagaagatgaaggataccgactctgaggaggagctcaaggaggccttccgtgtgtttgacaaggaccagaacggtttcatctcggctgctgagctccgccacgtcatgaccaaccttggtgagaagctgaccgacgaggaagtcgacgagatgatccgtgaggctgacgtcgatggcgatggccagatcaactacgaggagttcgttaaggtcatgatggccaagtgaggagggttcccattaaataagttctgtctgaagtgaactaaaactgtcagggcctacaacaaagctgtactttgtgatg

SEQ ID NO: 2574 - DNA, 595 bp, Artificial
  Synthetic
ttcaaacttcaaagaccaatctttttgtttctccctttacgttctctgaattccagaagcttcttctccctctctcaatggcggatcagctgaccgatgatcagatctctgagtttaaggaggctttcagcctattcgacaaggacggcgatggttgcattacaactaaggagcttgggactgtgatgaggtcattgggacagaacccaactgaagctgagctccaggacatgataaatgaagtggatgctgatggtaatggaaccattgacttcccagagtttttgaacctcatggccaggaagatgaaggatacagactcggaggaggagctgaaggaggcattcagagtttttgacaaggaccagaatggtttcatttctgctgctgagctccgtcatgtgatgaccaaccttggtgagaagcttactgatgaagaagttgatgaaatgattagggaggccgatgtcgatggtgatggacaaattaactatgatgagtttgttaaggtcatgatggccaagtgatttccctcttctgcagtttaccttttttacactgaagaaagaccaaacattcatcagactgggtcagc

SEQ ID NO: 2575 - DNA, 542 bp, Artificial
  Synthetic
gcagatcagctcacagatgatcagatctctgaattcaaagaagctttcagccttttcgataaggatggagatggttgcatcaccactaaggagcttgggacagtgatgcggtcattgggacaaaatccaactgaggctgagcttcaagacatgatcaatgaagtagatgctgatggaaatggaaccatcgactttcccgagttccttaacttgatggctcgcaagatgaaagacactgattctgaggaggagctcaaggaagctttcagagtgttcgacaaggatcagaatggatttatttctgcagccgagctgcgacatgtcatgacaaacctaggcgagaagcttactgatgaagaagttgatgagatgattcgtgaagctgacgtggatggtgatggccatatcaactatgaggagttcgtcaaagtcatgatggccaagtgagaactgatcaacttgacttaattcttagtagtaaaaaattacaaaaaaagaagctggcaacggagcagataaattggatgagatctctatatttg

SEQ ID NO: 2576 - DNA, 674 bp, Artificial
  Synthetic
cgattattttgtctgaaattccagaacaatcttctctcttaagttttctctgttgttgaattgaagaagaaaatggcagatcagttaaccgatgaccaggtctctgagttcaaggaggccttcagcctattcgataaggacggagatggttgcatcacgactaaggagcttgggactgtgatgaggtcgctcggacagaaccccaccgaagcagagctccaagacatgataaacgaggtggatgcagatggtaacggaaccattgacttccctgagtttctaaacctcatggcccggaaaatgaaggatactgactccgaggaggaactgaaggaggcgttcagagtgttcgacaaggatcaaaatggcttcatctccgctgctgagcttcgtcatgtgatgactaaccttggggagaagcttactgatgaagaagttgatgagatgattagggaagcagatgtcgatggtgatggtcaaattaactatgaggagtttgttaaggtcatgatggctaagtaatttcaccatctcttattgaagttgaagtttagacttgttaaaaatgtgaaaattccaaaaatatttcattggataggatttgcctagtgtaatgtgttccgttgtaccatcttggatgtattggacctggaatgaatgtaatgctttattgt

SEQ ID NO: 2577 - DNA, 560 bp, Artificial
  Synthetic
gttttggagagacggggagctgagatggccgaccagctgacggaggatcagatcgcagagttcaaagaagccttcagtctttttgataaggatggagatggttgcatcacaacgaaggaactggggactgtgatgaggtctctgggccagaatccaacggaaggagagctacaggacatgatcaatgaagtggatgcagacggaagtggaaccattgacttccccgagttcctcaacctcatggcccgcaagatgaaggacaccgactctgaggaggagttgaaagaggccttccgtgtgtttgacaaggaccagaatggatatatctctgccgaagagcttcgtcatgtcatgactaacttgggagagaagctgaccgacgaagaagttgatgagatgatacgggaggcggacgtggacggcgatggccaaatcaattacgaggaatttgtgaagataatgctgtccaagtgaggagaccgaacgggaatacttgggttgtgtgtgaggggactttctcttactcgtagcaattctttttgtgtgaaattgagcaacta

SEQ ID NO: 2578 - DNA, 725 bp, Artificial
  Synthetic
ttctctctctctctctctctctctctcactctgtccagctcctcctcctcctcagcaatggcagaccagctgacagaggagcaaatcgcagagttcaaggaagccttcagcctctttgataaggatggagatggttgcatcacaacgaaagagctgggtaccgtcatgcgttccttagggcaaaatccaactgaagcagagcttcgagacatgatcaatgaggttgatgctgatggaaacggaacaattgattttccggaattcctgaatttgatggcccgtaaaatgaaggacacggactctgaagaggagctgaaggaggcattcaaggtctttgataaggatcaaaatggctatatttctgccgccgagttgcgtcacgtgatgactaatttgggagagaagttgacggatgaggaggtcgatgagatgattcgtgaagcggacattgatggggacggccaggttaactatgaggagtttgtcagaatgatgcttgcaaaataaaatcccccattccttgcactcaatctaacacaaataggttgctaatttgctttttgggataggttgtattaagcttgcactccctaaggaatgaattgtttttttttctttcccttttttgttcatatagccatggctgaaatgcttgggcacaattatcagttatgcttcattgagacaccatacgggctttatgagcttgtgtaactttgatgaag

SEQ ID NO: 2579 - DNA, 595 bp, Artificial
  Synthetic
aatagatcctcctcaggcgatactgcttctgctcatcttctctccttcaatatctcgtccttggcagtagcgcgaatcgaacagcggtggaatggcggagcagctgagccctgagcaaatcgctgagttcaaagaggcctttagcctcttcgacagagatggagatggctgtattacaactcgggagctgggggtagtgatgcggtcgttgggtcagaacccaacggaatcagagcttgtagacatgattaacgaagttgatgctgatggcaatgggaccatcgattttgcggagtttctcaacttgatggcccgcaagatgaaggatactgactctgaggaggaattgagggaggctttcaaagttttcgataaggaccagaatggctttatctccgcttccgagctgcgccatgtgatgataaaccttggcgaaaagctgactgacgaagaagtgaaagagatgattcgggaggctgatacggacggggatggccaagtcaactacgaggagtttgtgaagatgatgctctctaagtgagtcgggaaagtcaaagtcaaaagcgaaaagtgaaaagtaaaaagtaaaaaaatt

SEQ ID NO: 2580 - DNA, 470 bp, Artificial
  Synthetic
aaaaatattacaaatgtcgcaaaactccaaatctttcaaggacgccttttccctgttcgacaagaagggcaccggcaagattcctgctgaagctctcggtgatcttctcagagctgtgggccagaaccccaccctcgctgagattgatgatctgaagcagaccattcccgctgagttcgactacgagaccttctccaagatcgtcaaccgaccaagcggtttcaagtctctcggtgagcccgaggattacatccggggattccaggtgttcgacaaggactccactgggttcgtgggtgtcggcgagatgcgatacatccttacctcgctgggcgagaagatgtctgattccgaggttgatgagctccttaagggagtcaacgttactcgagacggcaacgtcaactacgttgacttcgtcaagtccattctggcccagtagatacctaatatattttttatgtttgagc

SEQ ID NO: 2581 - DNA, 723 bp, Artificial
  Synthetic
acccctctctctctgtctgtgcctctctctctctctctctctttatatatatatattctctttcctccggtcaaacgttgggagtagcatggccgaacagctgactgaggatcagatcgcagagttcaaggaagccttcagtctcttcgacagagatggcgatggttccatcaccaccaaagagctaggtacagttatgcgttctttagggcagaatccaacggaagctgagcttcgagacatgatcaatgaggttgacgctgacggaaatggaacaattgattttccagagttccttaatttgatggctcgcaaaatgaaggatactgattctgaggaggagctgaaggaagcatttaaagtctttgataaggatcagaatggctacatttctgctgcagagttgcgtcacgtaatgacaaatcttggagagaagctgactgatgaggaggttgatgaaatgattcgtgaagctgacatagacggggacggccaggttaattatgaggaatttgtgagaatgatgctttcaaagtaattccaaacttgttcttgttgccgttcgtattcaaatagcagatctactgctaacaaagatttgctttggcacataattgagccgctttttcatgtggaaggaggcaaaaaaaaggccacaaagttcaccagaacaattagctgctgtgtattttgaggtagtaggttatataacgtttgtagtgg

SEQ ID NO: 2582 - DNA, 521 bp, Artificial
  Synthetic
aggaacacagcagcaagcttggtgcttcgtcgtccggtacccctgttcttcgcagggcctgaaaaggaaggaagagttttaagcaagagacatcgatggccgcctctgctgccgagcagctcacacaggagcaattggcagagtttaaggaggccttcagcctgtttgacaaagatggcgatggctgcattaccaccaaggaactggggacggtgatgagatccctgggacagaaccccaccgaggcggagctgcaggacatgatcaacgaggtggacgcggacgggaacgggaccatcgactttgccgagttcctgagccttatggccaggaagatgaaggacaccgactcggaggaggagctcaaggaggcgttccgggtgttcgacaaggaccagaacggcttcatctcggcggtggagctgcggcatgtaatgaccaacctcggggagaagctcaccgacgaggaggtggacgagatgatccgggaggcggacgtcgacggcgacgggcagatcaac

SEQ ID NO: 2583 - DNA, 643 bp, Artificial
  Synthetic
cctcaggcgatactgcttctgctcatcttctctccttcaatatctcgtccttggcagtagcgcgaatcgaacagcggtggaatggcggagcagctgagccctgagcaaatcgctgagttcaaagaggcctttagcctcttcgacagagatggagatggctgtattacaactcgggagctgggggtagtgatgcggtcgttgggtcagaacccaacggaatcagagcttgtagacatgattaacgaagttgatgctgatggcaatgggaccatcgattttgcggagtttctcaacttgatggcccgcaagatgaaggatactgactctgaggaggaattgagggaggctttcaaagttttcgataaggaccagaatggctttatctccgcttccgagctgcgccatgtgatgataaaccttggcgaaaagctgactgacgaagaagtgaaagagatgattcgggaggctgatacggacggggatggccaagtcaactacgaggagtttgtgaagatgatgctctctaagtgagtcgggaaagtaaaagtcaaaagcgaaaagtgaaaagtaaaaagtaaaaaaattggtatgaattgggtttggttatgcatgtctctactggattctcacggtgtataaattt

SEQ ID NO: 2584 - DNA, 593 bp, Artificial
  Synthetic
ccttatttcaaatttccagtaaaataatcgaaagagattatggcggatcagctgactgacgatcagatctctgagtttaaagaagcctttagcctcttcgacaaggacggcgatggttgcatcactacgaaggagcttggaaccgtgatgcggtcactggggcagaacccaaccgaggctgagcttcaagacatgatcaacgaagttgatgctgatgggaatgggaccattgactttcctgagttccttaacctgatggctcgcaagatgaaggacactgattccgaggaggagctcaaggaagcttttagagtgtttgacaaggatcagaatggatttatctctgcagctgagcttcgccatgtcatgacaaacctaggtgagaagcttacagacgaagaggttgatgagatgattcgtgaagctgacgtggatggcaatgggcagatcaactatgaggaattcgtcaaggtcatgatggccaagtgagaatccaacttaatctttaaaattaaagtacaacaaaaaggaacggcggataagtctgatgaggtttctatttctggttaggatgtcttctttggcttattagc

SEQ ID NO: 2585 - DNA, 632 bp, Artificial
  Synthetic
atagggttctttgaaatcgtgaaaagagagagagagagagaaatggcagagcagctaacggaggagcagatcgctgagttcaaggaggcctttagccttttcgacaaggacggcgatggctgtattactaccaaggaattgggaacagtgatgagatcacttggtcagaatcccactgaagctgaactacaggatatgatcagcgaggttgatgctgatcagaatggaaccattgattttccagagttcttgaatctgatggcacgtaagatgaaggacactgattctgaggaagaactcaaagaagctttcaaggttttcgataaagatcagaatggctttatttctgcagctgagcttcgtcatgtaatgacaaaccttggagagaagctgactgatgaagaggttgatgagatgatccgagaagcagatattgatggcgatgggcaagttaattacgaggagtttgtccgcatgatgcttgccaagtgactttagattctcgtgtattttgcgacggccacttagttacctataacttctagctgtcagtttatattctgtgttgctgttaagacaaacaaatgtgccctatgcttttactagtatctagactcctttcagtttatatg

SEQ ID NO: 2586 - DNA, 624 bp, Artificial
  Synthetic
gccacgcgtccgccacgcgtccgcttctctctctctctctctctctctctcactctgtccagctcctcctcctcctcagcaatggcagaccagctgacagaggagcaaatcgcagagttcaaggaagccttcagcctctttgataaggatggagatggttgcatcacaacgaaagagctgggtaccgtcatgcgttccttagggcaaaatccaactgaagcagagcttcgagacatgatcaatgaggttgatgctgatggaaacggaacaattgattttccggaattcctgaatttgatggcccgtaaaatgaaggacacggactctgaagaggagctgaaggaggcattcaaggtctttgataaggatcaaaatggctatatttctgccgccgagttgcgtcacgtgatgactaatttgggagagaagttgacggatgaggaggtcgatgagatgattcgtgaagcggacattgatggggacggccaggttaactatgaggagtttgtcagaatgatgcttgcaaaataaaatcccccattccttgcactcaatctaacacaaataggttgctaatttgctttttgggataggttgtattaagcttgcactccctaaggaatg

SEQ ID NO: 2587 - DNA, 654 bp, Artificial
  Synthetic
atcgatccatcgatccaccgggcatttcgtcaaagaggagatggctgatcagctgaccgaggaccagatcgccgagttcaaggaggcgtttagcctgttcgacaaggatggagacggctgtatcacaactaaggagttgggaacggtgatgcgatcgcttggacaaaacccgaccgaggcggagctccaggacatgatcaacgaggtggacgccgacggcaatgggaccatcgacttccccgagttcctcaacttgatggcgcgcaagatgaaggacactgactcggaggaggagctcaaggaggcgttccgcgtcttcgacaaggaccagaacggcttcatctcggctgccgagctccgccatgtaatgaccaacctcggcgagaagctcacggacgacgaggtggacgagatgatccgcgaggctgatgtggacggggacgggcagatcaactatgaggagttcgtcaagatgatgctagctaagtagtagaacatctgtttcctttttctctactttgttcctcgcctttcctctctctgtcttttctctttcctttttgttttggtaaagtcctgcttccatgttaggatgatgattccaccacgtctaaaaccttttaaattatttgttcctgtccttgcaaaaaaaaa

SEQ ID NO: 2588 - DNA, 597 bp, Artificial
  Synthetic
gatcatgactatgtggggttggattcacgcgatagcagactatttgctgtcctgggtgaaactcgagcaaaatgcggaaattgggtggcgttcgttcaatcgaaagaccggaaagttagagcgcgaacaacagacactgtggaagaagctcaagcttctcgtcttatttaacccactcatggaatggattgataggagtcaactcatgcgtttatacatgcatgaagagtcaattgcagaagggcgaagagaaagaacaacgagttccaggaggcgcatcaaggctttcgttgacgcctatggaataaacatgcatgatttcgagccctctgatatcagtcgctatcctacctttgaagatttcttcactcgttcactcaaaacagagtcgcgtcccatttgtaatgttgacgacccttcccatgccgtcgtggtggctgactcgagagtcgtcgtcttcaattccattggggaagcaaaagcgttgtggatcaaaggcaagaactttagcctcaatgatctagtcatgagcaatgaagtaggtgataagtttagagacgctgccattgcgagctttcggctttcaccgcaggacta

SEQ ID NO: 2589 - DNA, 532 bp, Artificial
  Synthetic
gcgcgattgtgaattcgcgagcgaatgaaactcgtcgcatgctttggatcctgcttccgacaagctcccacgacttggcttggataaacctctaacctccattttggaatcgagtgtcctccatggctcgagaataagtcacatattcaatcaacagtatacatagttgtaatcgatacaccaatttctactggaaacgaggtttccatgggcttcatcgaacttctcttggagaaattctccatcacgaggttcttcctcatcatggctggcgtctggacagctgtattcatcgtcggccgcatacgagaacaccagaaaatcaagagcctcggcagctacggcccttctctaaagcctcttcttccatttggactggattttatctaccacggagctcgtgccacattccgccaacagacctttgcgctatggagggacgtcctcttctcccaattctggaccgtcgagatgcgcgtcctcaacgaacgagtctgcttcaccgctgaccccgagaacatcaacgccgtgc

SEQ ID NO: 2590 - DNA, 616 bp, Artificial
  Synthetic
tgttattaggcctaaacctaccctctgttcttttcaggtaacttagcggtttcttttccctgtgtttggtgttcgtagtcaaatctggctatggctggtaatggcgtagtggccatctatggcaatagtagctccatcgcagaccccaagaagtcctcctatggtgtcaaggtcggccttgcccaaatgctccgcggtggtgtcatcatggacgtcattaacgttgaacaggcccgtatcgccgaagaagctggtgccgtcgctgtcatggcccttgagcgcgtccctgctgatatccgtgctgaaggcggcgtcgcccgtatgagtgaccctggcttgatcaaggagatcaaggctgccgtcactatccctgtcatggccaaggcccgcatcggccactttgttgaggcccagatcctcgaggccatcggtgttgactacattgatgagagcgaggtcctcacgccggccgacgatgctcatcacgtcaacaagcacaacttccgtgtcccgtttgtctgtggctgccgggacctcggcgaagcactccgccgcattgcggagggcgctgccatgatccgcaccaagggggaagccggcactggcgacatcgttg

SEQ ID NO: 2591 - DNA, 713 bp, Artificial
  Synthetic
gcgaagctttgtcgtttttgataaattgtcacccaatttggttcaggcattttcatcaacaccttgcaaatggaagaagacagtgccgttacagtgtacagtggcagcgcaattaccgacaccaagaagaatccgttctcaatcaaagtcgggctggcccaaatgctccgtggaggagccattgctgaggtcaccaccgtcgaccaagcgaagatcgccgaatccgccggcgcctgctgcctcgtagtatcggaacctaaaggacccggaatctcgcgcatggccgacccatctgtaatcaaagcgatcaaacaggccgtctcaattcccgtaatggcaaaagcccgagtcgggcattttctggaagcccagatccttgaagctattggagcagactatgtagacgagagcgaggttttagccttagccgacgaagatcatttcatcaacaaacacaatttccgtgccccattcgtctgtgggtgtcgagatctcggagaagcattaagaagagtccgtgaaggtgctgcgatgattaggacccaaggagatctattaggtacaggtaatattgtggacacagttcgcaatgtgaggaaagtgatgggagatattagagttctatcaaacatggacgaagatgaggttttcactttttcaaaaaagatctccgcgccttatgatatcgttgcgcaaacgaagcagatgggtag

SEQ ID NO: 2592 - DNA, 678 bp, Artificial
  Synthetic
agcaaccatttcgtcatcggaccatagcactccccaaatacctcactcttctcgctgatctggtcctgctcttatccctcattcccatcatcaacttttccacatctcgaacaaatatgtcgggagacggctatcgttcagtcgcctatttcgtcaactgggccatctatgctagaaagcatcgcccccaagatctccccgttgataaactcactcatatcctctatgcctttgccaatgtccgccaagatagcggggaagtacacatgacggatggctgggcggacacagacatccattgggagggcgactcatggaacgacacgggaaacaacatgtatggatgcctcaagcagctgaatcttctcaagaagcgcaaccgcaatctcaaggttttgctgtccattggaggttggacgtacagcggcaacttcaagggccccgccagcactcagcagggccgtgagacattcgccaaatctagtctcgagctgctcaaaaacttgggtttcgacggacttgatatcgattgggagtatccccagaatgcagacgaggctaggaatttcgtcgagcttctcgccaccgtccgcagagagctggatgcctattctgctacccttccaaactacagccactttgaactgactgttgcttgtcccgccggagctacgcact

SEQ ID NO: 2593 - DNA, 997 bp, Artificial
  Synthetic
ttgaacaatctaccaacatcacaagcaattcaccatgttgagcttcctcggaaaatcggtagccttgctggctgcgctgcaggctactctcagctctgcaagccccctagccacagaagagcgctctgttgagaagagagccaacggatacgcaaactccgtctatttcaccaactggggcatttacgaccgcaacttccagcctgccgatttggtggcatcagatgtcactcatgtcatctactcattcatgaacctccaggcagacggcacagttgtctctggcgatacctacgctgatttcgagaagcactatgccgatgattcttggaatgatgtcggcaccaatgcctacggctgtgtcaagcagctgttcaaggtcaaaaaggccaaccgaggcctcaaggttctgctctccatcggtggctggacctggtccaccaacttcccctctgcagcaagcacggatgccaaccgaaagaactttgcgaagactgccattaccttcatgaaggattggggtttcgatggcattgacgtcgattgggagtaccctgcagacgccacccaggcctccaacatggttcttctgctcaaggaagtccgatctcagctggatgcttatgctgcccagtatgcccctggctaccacttcctcctcaccattgccgcaccagctggcaaggataactactccaagctgcgcctggccgatcttggccaagttctcgactacatcaacctcatggcctacgactatgctggatccttcagccccctcaccggtcacgacgccaacctgtttgccaacccgtccaaccccaacgccacacccttcaacaccgattctgccgttcaggattatatcaacggaggtgttcccgccaacaagattgttctcggaatgcccatctacggacgatcattccagaacaccgctggtattggccagacttacaacggagttggaggtggcggtggtggctcaactggaagc

SEQ ID NO: 2594 - DNA, 292 bp, Artificial
  Synthetic
ggttctcaaagtcttccggtgccgccggccgtttggctgcggaccgaaaggtggacaggaatcaactcgtgatgagatccgggaaatggcggcctccgccgggatttggattccattctttcgttttttgttggtttctaacgttgatgaccattcagtggcggcggctatgaaggatatgatgagaggtggtgcttatgccggtgtgtatcaagtaacgagtccgcctggtccaggcatcatcatacgatccatcaatcataatcaaggggaacacagaggcaaatcttct

SEQ ID NO: 2595 - DNA, 628 bp, Artificial
  Synthetic
ttctccaacatggccatctccaacgacgctaagaccgccaccctcaagggcgacgaccagtgggttgatctcaagctcaagtcctccaaggacttgtcccacaacaccaaggccctcatcttcgagctccctacccccgactccaccctcggtcttaccaccgcttccgctctcctcaccaagtacgtgacccctaagggctccaacgttgtccgaccttacacccctgtttccgaccctgactccaagggcgagtttgagctcgtcgtcaagtcctaccccgagggtaagatgtccaagcacatccacgagctcaaggagggtgacactctgtccttcaagggtcccatcatcaagtatcagtggcagcccaacctccacaaggagatcaccctgattggtgccggaaccggcatcacccctctgtaccagctcatctctgccatcaacaagaaccccgaggataagaccaaggtgaacctcttttacggtaacgccactgagggtgacattctcctcaaggacgagattgacgccatcgccaaggccaagccccagcagttcaacgtccactacttcctcgacaagccttccgacaactggaagggtgagaacggatttatctccg

SEQ ID NO: 2596 - DNA, 448 bp, Artificial
  Synthetic
cccacgcgtccgccaatctcgaccattaccatcatacagccaacctctacataagcacaaataccattcaaaatgtcttacggcggtgacaacaacgacaactacggctctcgccgtaatgacgacaactttggctccggaggagattctttcggctctggtggaaaccagcaatatggctccggaggagactcatttggctctgggggagattcatacggctctggtggaaatcaattcggctccggcaaccgccgtaacgatgacagctcatttggtaccagtggccagggcgagttcggctctggaggtaactatggcagctctggcggtgactcctatgggtctggaggaaacacctatggctccggcggcaatgacaactttggctctgggggcaatgatacgtacggctcgtcccgtaaccaagagtcttcttttggatcca

SEQ ID NO: 2597 - DNA, 447 bp, Artificial
  Synthetic
  misc_feature (435)..(435): The residue at this position can be any nucleotide.
ggagaagaggtgatacgagatgtcgtacgatgacgtggagatagaggacatggagtggaacgcggagctcgaagcgtacacctatccatgcccttgcggagacctcttccaaatctctctgcctgaccttcgcttgggagaggagatagccagatgccctagctgctccctctacatcaccgttgtctacaacctcgaagacttccaagaccctcggcccccgcctcgcccccaacagccgatcgccgtcgcctgatctttccagttgcttcgttcagtaaactcgacatctacattctatcctaaattgatagtcaccaaatgtctggtgcacttgagactgtttatctgacaagatttcatgtatcttggagttttgcttaaatcagcatgtagaatgataactgttggcttcttgatgtttcaaaggttacnacacaaaaaaaa

SEQ ID NO: 2598 - DNA, 249 bp, Artificial
  Synthetic
acacaattcctcgctgcgtgtgactcgtgtctccagcaaataccgcaaagatgtctgacgacgggctctcaatatacgatgagatcgaaatcgaagatatgaccttcgacgaggttcttcaaacatacttctacccgtgtccctgcggcgatcgtttccagatcgctatcgatgacctgcgcgacgagcaggatattgctgtgtgccccagctgtagcttgatgattagagttattttcgaccttgacg

SEQ ID NO: 2599 - DNA, 466 bp, Artificial
  Synthetic
tcctcaacaccgcacaagccctctgggcccgcctcgtagcaacccacgatccccataccatagacttcgtcggcaccctcatcatccaattcatcttctggtggatcccctgcatcctctttgtctctctcgactctatcgcgccctccttctccgcgaaacacaagatccagcccgcccccaaacaaccctccgccaacgacatcctccactccgtcctcgtctgcatccgcaaccaagtcatcgtcttcgccctccacgccgtcctcctctatgcctcctctgccaagggccagtcccccagcatcagagtcgacgcgagcttccccacggtccaggagttcactaccacctcgccgtcagcgtgctcgcccgcgaagtcctcttctacacctcccaccgcatcttccactggcggcccttgtacaggcgcttccacaagacgcaccacaagttcaccgccccc

SEQ ID NO: 2600 - DNA, 627 bp, Artificial
  Synthetic
atcgctgacgcaagatggcttctcaggcggcagcaaaggctgctggaggcgttgtttccattgcaaagaaacaaaccctccagtccaccggcttgtgggagaccttccgcaaggccttcgccctcgaccccaatcgctccaacggcgtccccctgaacccttacttccgaaacccgacgcccggagccttggaccccctcagcttcgacgaccccgtcactcttcccgctggcgacattgccgacaacgcctactggaagcgtgatgtccgtcgcgcgtacccgcagctcagcgtcgttacgcagggcgacgccgtgtcgttgttgacggttggaagcgccgcacagcccaaggtcgagctgattggcgaggccggcgagaaggctctcgttgcggcgcagaaggagggcgagacgacgggcctggccaagttcctggagaaggcgcccaaggatgtggcaaaggacgtgttcgtcaatggattgcctccgctgccgagcggacaggccctggaggctggaggatgggatgtgcacaagtacgagctcaatgaggatcagacatatggtgaaggctatcctaccaggacgttcaaataagacgggcaatagggtcgacttgtgtaaa

SEQ ID NO: 2601 - DNA, 724 bp, Artificial
  Synthetic
cctacatactcatccttcacgcttcaatcacccttgaataatgaacgaggaaaagctcggccacagtaatcatgaggacattgtgcctccagaatcctctactggagatgaattacagacaccatctacggattccaagggcaaacagaaggcaggcctggagttagcagcatctcaacttggggcctctacaaagctggtcgtcaatgccatcacaacgtttcgggaaatgccagctttggcatcagaatcaaagtcctctcatggttcaagtagcatgggctcgttttcatctatcgctggcgagtactcgtcatacaaaccactccagaatccgttgcttgacgagactactcatgagggccaggatgatttgtttgagacgtttatcaagagttcaacggatgcgttggtaaatgatggctatcaagtagacgtttcaggatcctcatttgcagatcaagaagcatcggatggcttggccgtttttgaatttctctcacagccaggaaatgaatcgatcgagacggccatttctagggaaaatgattttcagatctcaggcgaggatgaatcatggagtgaagctgtggctggaacactcatcgatgagaacgaccaacttgattttactcctgattttatcactaatcccgaactgtcttctcaagcagcgccgtaccttggaacaacgaacattgaagaaacaagttatacttggttt

SEQ ID NO: 2602 - DNA, 613 bp, Artificial
  Synthetic
gtcggattcaggcctcagcgctcggatcggcctcttttcctctcttccctctctgctttccatctgcccagcagaccgagtttggcagcgcaatgttgcctctatcggtgcggcgcgcggtggccgctgctcctcagggggcaagtgggctgacttctctcgccgcgtcggctccaaagatcacagcctcgagcttcatcctgaatcgtcctcagcggcgctactcctcgtcgaaaccctcaagatccgatgagcccaacgatattgctgccggccagtcggtgccggcatctacctcgcgcggagagagcaaaggcagcaggaaacgaaagagcaaggattcagccgaccgaaatgcggctttcaagaaactgcccagtgtccctagcactcaccacatgtctcaagaggccctgagcttatcgagcttcttctcactccaccgtcccatttccatcacccagaccatgcccaggactgttaccgacgagcactttgcatccatatttgcgcctcgatcaaaatcgaacaggatacgagacactgtctctacaatttctgacaccattgagcagctggaaggccccatggctcaggtgacaataggatctca

SEQ ID NO: 2603 - DNA, 639 bp, Artificial
  Synthetic
gcaaaagactacaaagcttttggtccagcaaccataaatccaactcattgtccctccaccacgaaatctagcaacctctcctcctcgccacacagcccgcaatgctcacaccagcttcttcaagaatactcgccagcggcgcccgccgtgccctttcgtcgcgcagcttccacgcttcggctcggcatctgaacgactctccccccctgcccgcgcggaagcccatgggcgccttcagaggaggtcttttcggcttcttgtttggcagcgtcctggccggcggtgccgtctacagctacgtcctgcaggagtacaaggcatccaacgagttgcttaccgaggatatctacactcttcaagcctccgtcacccgactgacaaaccacgtcaagatccttgaggagaagatccagcagaagagaaagtaaagcccgaaaagataaaaaacacaaatagcgcaatgtcattagggatggtatgataccagcgcttcaacgctggtggaaaatactgggcaaacgaacagcattatggcaatacttgtgtccttgtttgtaacaacctaacaaagcctcaattgtaaattgtaccttaagtatctagcctctgaaatatctagcacaggaaacagcacaaaag

SEQ ID NO: 2604 - DNA, 1069 bp, Artificial
  Synthetic
gctcgactctcactttcttcttttcatccctcactcttctctcatcttctctccaatccccaatcctcaataacctacgccgtgtcagtcaagcagctgtacatcatcgcatatcgaccgacgacgaccttgtcctgcgtcttccatctccaattctcacccaccacttacaccatcacacatcacaatgcctgctcctcaggttaacggcgaggtcaccagccatgtcaattccgccttcctccagcacctcttctcctatcctctagttagcgacggcattcacactgtgaccaccaacgaatacgcacagcggcctatcaagctgggcgaatctgcctataaaacttttgccgcccctgttcttccctacttttccaagccctatggtattgtctctccctacgtccagagggccgactcctttggcgacaagaccctggaccgcattgacgagcgttttcccattgtcaagaagcccactggtgatctctacaacgagacccgtggtctgattctgttcccctaccagaagggactcgagggcaaggagcacgttttcaagatctatgcttccgagcttaagaagcttgagcaggagggcgtcgtggcccagggcaaggctgccgtttccaccgccttcgtcattagcaacgaaacgctggcctggctgagcagctgggtcgctgtcaagaaggccgacgcctctgaggctaccaaggagaagatcaaccagtagacgatttccggagtggattacaagcgaaacagcgcatcatttcctttcttgaccggccctctctctcttctttgtctttctcttcttacccttttgttggcattgagtcgactttctctgtcactggatctcatttgctttgttgatgccagttcgcttttgtgatgaacagcacctagagaaaagggggaagaagggcaggctgcttcgtccgctgcgactaggcgtctacgtctggcatcatgatcgccactactagctagtggccaagctctgacgcatctcgtttcgatttcatctctctttgattccttgtttcggcggactatg

SEQ ID NO: 2605 - DNA, 634 bp, Artificial
  Synthetic
aataacctacgccgtgtcagtcaagcaggtgtacatcatcgcatatcgaccgacgacgaccttgtcctgcgtcttccatctccaattctcacccaccacttacaccatcacacatcacaatgcctgctcctcaggttaacggcgaggtcaccagccatgtcaattccgccttcctccaggtatgcatggataaaagaagagattcgccttgtcatcacacaatggcaaatgcgaatcgaaccgaatcgtgatggcttttggtccggttattgatcatattggcagcacctcttctcctatcctctagttagcgacggcattcacactgtgaccaccaacgaatacgcacagcggcctatcaagctgggcgaatctgcctataaaacttttgccgcccctgttcttccctacttttccaagccctatggtattgtctctccctacgtccagagggccgactcctttggcgacaagaccctggaccgcattgacgagcgttttcccattgtcaagaagcccactggtgatctctacaacgagacccgtggtctgattctgttcccctaccagaagggactcgagggcaaggagcacgttttcaagatctatgcttccgagcttaagaagcttgagc

SEQ ID NO: 2606 - DNA, 529 bp, Artificial
  Synthetic
  misc_feature (293)..(293): The residue at this position can be any nucleotide.
cacacacacactcacatcaaaatgtctaacctcccttctgagcccgaattcgagcaggcctacaaggagctggccagcaccctcgaggacagcagcctcttcaaagagcaccccgaataccgcaccgctctgcaggttgccgccattcccgagcgagttattcagttccgcgttacctgggaggacgacaagggccagctccgcgtcaaccggggataccgtgtgcagttcaactctgccctcggcccatacaaaggcggtcttcgatttcaccctaccgtcaacttgtccanttcctcaaaggtttcttggatttgagcagattttcaaagaatgctctgaccggtttgtcaatgggtggaggaaaaggtggtgccgatttcgaccccaagggcaagtctgacaatgagatccgccgtttctgccaggcctttatgcgcgagctgtctcgtcacattggcgctgacaccgacgttcccgctggcgacattggtgtttctggccgcgagattggatacatgtttggagc

SEQ ID NO: 2607 - DNA, 541 bp, Artificial
  Synthetic
agcaatcatgttctgtctccgaagctgggtcccgctcctcttcatcccgacaaacgcctcgcccgccttcatcctcctcttcttcatctgcacctacttcctcaaccgcccctgcgtctactgctccgtcctcctcctcatcctcttcctcacctcgtgcaactggtccgaccgctgcttcttcgacctcagcagcaactggttcctccctcgacctccttcgtccctccagctccccgtcgacgatcaagactcgcacgccctcgccctcgccttcaacgacaccctcgtcgacatggtcaattctacagccaaagccgctgcccgcgccgctgcggaggaggtcgctgtgctgcgcaacgagtggactggcttgggcgtccagtggctgcgtaatttgctgggcaatcgggagtggaggatcgactgcatggacatttacatcaggttgtaaaacgaaggggaattacatacatggagcttctatgaggggaagaaaacaaatattggaatgaaaaacttcatctacctttgtgcattg

SEQ ID NO: 2608 - DNA, 688 bp, Artificial
  Synthetic
tcaaccaccactcagcaagcaatcatcaaaacagccactctcacttttctctcaaagtaaaacacttcaaaccgccaacatgcaggttacttctatgctcgctctcctctttaccgttgccactggcgctcttgcagctcccggccacggagctcctcctcctccccatgttcctccccctccccctcctcctcccaccaaccaaaacaccaacaccaacaacaattggcaatccaacagctgtggcaacggcgcttctccttactgctgcagtgctacagctgatggcctgggagagaactactggaagtgctctgatctcaatgatgtgtgcaacgacgtcattgtttgctgcaacaacaatagcaacaacaacaaccagcagggaaagcaaaacaacatcgacaccggcaaccagtcttgcagtgccttcggacaacagaaggtcatctacctctaagcttgcctgcagaagctcaaagtcggcaatggctctcttatttgcttgtatcttagtcttataaggcagttcatgtccaagtttgtcggctaagggctgcggtgacgggtttgagaaaatgggcagtggcatgtggaacggtgaaaaaatgcttcttttctatttggtttgtagcagggtggctcttctgaggcagtctttacaacccgctcactttccttaagccta

SEQ ID NO: 2609 - DNA, 571 bp, Artificial
  Synthetic
gtggttttagttttggaggagttttactttttattctctttcatattccaattctgtacttgtctcggaagccatatttacaactctcaacaccacaatggcgggcttcaagaaactactccagactctaactgggaaaaagagcgacgatgccactcaacccgaagagcagcaacgccaaactcctcagcccaaaccttggtccggcatcgacaacacccaaccagcaggctcgaaccccatccgcggcttctccaccgaatatctcggcgagcaaaagtccagcaacacggccgtccgccgggacctcggcttcgcgggccacatcggcggccagtggttcggcgtgtacggtgacacgctgtggtgcagtcccggggtgacggacccggatttggagccggatccggaagggttccacggcatggtgcggaactcggtggcggtgttgacggatgatccgctggtagttcggtttgtgcatttgaatggggatgagccggtggcgcatccgttgcagtttacgccgtttgaggagcggtggggggagacgaatttgtttgggtttggg

SEQ ID NO: 2610 - DNA, 272 bp, Artificial
  Synthetic
tccacaatggaggctccagttgagaagaagattgaaaagacagcaaagccttatggcatgcgcaaaaatggaatgctatggcatgctccgaagaaggcgtttcgcccgaccaaaggcctctcatcgtatgagcagaggactttttagcgagctgcaatggctcagatgaaggcaaaggaaaaggagatgaaggaggagaaggaggaagagcgccagcgtcggattcaagccatcagggataagcgagcaaagaaggaagagagagaaagata

SEQ ID NO: 2611 - DNA, 334 bp, Artificial
  Synthetic
agggatcaccgaaactgaggatgtacgagtacagatatttgcatcatggatctgatattgggagaggagaggagatgcacgggccttgcttttttggggatgcagggaggggaaaagccgtctgacaagtcattttcgcgtattgagatggacagagttctagatccattactagttgcaagcacggtctgacggcatgtcgtatggtgttactgcgtcttgtgtgaggccaagacaggacataagatttggtattttctgtgttgttgaatggattgatggaggttttacaatacgggtaccgtacaggcttccatggattttatcggtgacg

SEQ ID NO: 2612 - DNA, 537 bp, Artificial
  Synthetic
agcggccaaaccgacgccatgaggtccaatggcgcttctgcactgctgaacgccttccaggggctgaagatttccgcatgcaccccgttgcgacaactgagggccccgattcagcaccagtccaaggttctcggcgccgctctgctccagaatggcagagccttttccacaagcccggccatgatgggcacatggctcgagcctagcttgaaccgaaagaagaaaatggcaaagggacggccgcgagtagcgacgggagggtctacgaagggcacaacggtcatctggggcgactacggattgcgcatggttgatcaccaccgaagaatcagcgccaagtcactaaagatggctgaggatacgattaaagtgcgacttcgaggagagaaataccgactttacaagaggaagtgctgcaacgttggtgtctacgtcagcggtaacgagatgcgaatgggtaaaggaaaaggttctttcgaccactgggccacaagaatggcagtcagccaagtcctgttcgagatcaagggccgaatc

SEQ ID NO: 2613 - DNA, 651 bp, Artificial
  Synthetic
tagaatcccagctcttgtttcagcacacgtgagcgaggcggcgcgacagaagattgacattgtcgccaagtttgtcgaggaagaatgcatccccgccgatcccgtacttgaagcccaggttggcgaaggcgataaccgctgggagaaccacccgtccatcatcgaggagctcaaggacaaggcacgcaagctgggcttgtggaacatgttcctgcccaagggcttctacgccgagtctcccggctggaccaacctcgagtatgccctcatggcagagtggctgggccgctcgcgcagcgcctcggaggcgtgcaactgcgctgctcccgatacaggcaacatggaggtggtggccaagtacggcaatgccgcgcagaaggaggagtggttgaagcccctgatggagggcaagattcgctcggctttcctgatgactgagcccgaagtcgcgtcatcggatgccaccaacattcagctccagatcactcgcgacggcgaccactacgtcctcaatggctccaagtggtggtccagcggtgccggcgacccgcgatgcaaactctacatcgtcatgggcaagactgatcccaacaacaaggatccttacaagcagcagtcagtcatcctggtcccctgctggtctgccttggc

SEQ ID NO: 2614 - DNA, 698 bp, Artificial
  Synthetic
gcctcgacgatggagacgcaatggagcctcctccaaccaaactgacaccaggcaagggtgttcagtcgaaatccaacaagggccctccatcaccgacattggccaatgttgcgcgccactttgctgtggacagcggctcaacattgcttgccacggcggtaatcacagtcttgatattcggtggatgctgctctaacgtgtatgctttagaggccatcatcaacttcgagccgacaaacggaaccctcgtaactttcgttcaattcctattcgtctctataacgggctacgtagcgcaattcgatagatcacgcccgccgttcttcctgactcccaacgtcgtcccgcttagccgctggcttgtcaatatcctgttgttctttaccatcaacgtcttgaacaaccatgccttcagctatgacatatccgtaccggttcacatcattctacgatccggaggtagcataaccaccatggctgccggatacctttacggcaagacgtattcgcgcccccaaatatttgcagtgtttctgctgagtattggcgtcagcctcgctgcttggtcggattcaaaagacaagaaaccgagtgacggtatttctgaccctgtattcaaccctgggctcttgatcatctttgtcgcccaagtactttcggcgatcatggggctgtataccgaagcaacatatcgaaag

SEQ ID NO: 2615 - DNA, 934 bp, Artificial
  Synthetic
gggtatcccgtcagcagccgctccctcctcattcccgtctcaccacccaccattgagattctatcgcccaccaagcctacaacacacagcacaagtattatcgcccatcatgcctcagcctattcccgcagccagccgtctcaccgacctcttcagcttgaagggcaaggtcgttgtcgtcaccggagcttccgggccccgaggcatgggaattgaagctgcgcgtggttgcgccgagatgggcgccgacctcgccatcacatattcgtctcgcaaggagggtgcagagaaaaacgctgcagaactggagaaagagtacggcgtcaaggtcaaggtgtacaagatcaatgtgagcgagtacaaagacgtcgaaaagttcgtcgatcaagtggtttccgattttggcaagattgatgccttcattgccaacgccggtgcgacagcaaacagcggagttgttgatggcagttctgacgactgggatcatgttatccagatcgatctgagcggcaccgcgtattgcgcaaaggccgtcggcgctcacttcaagaagcagggtcgcggatcctttgtcataacagcttcaatgtctggccatgtcgcaaactaccctcaggaacagacctcatacaacgttgccaaggctggctgcatacatctggcgcgctctctggccaacgaatggcgcgacttcgcccgagtcaacagtatctcgcccggctatattgacaccggcctgtccgactttatcgattccaagacacaagaactatggaggagcatgatcccaatgggacgcaatggcgacgctaaggaactaaagggcgcgtatgtctatctcgtcagcgatgccagttcatatacgaccggagccgatattgtgattgacggaggatacactacccgatagaaaaccaattcttctttcctctgt

SEQ ID NO: 2616 - DNA, 573 bp, Artificial
  Synthetic
gcttctcacgggtagttgtatgaagaggagatatcttgcaggtttttttatctacctgttttcaccccttggacgtattatttcttattagttttgtttgtttgccaagaaattctattcgccatggctgtaagacgaatggtgtttgccgcggctcttgctggtctggcgatggccaagcccatcaagcccatcaagccaacaggcacattctgtggcatcatctgcataagcgcgattagcgattgcggcgtaccatatggaggttgctacgatccttgtgttgacccagcccctacacctcttccttgtgacgtggaaggtccagttccggagagtccagtcgttgtgagcccagtcccagcaacgccaaccagcgaaaatccgttctcagtcacgcctggttcgacctcagtcactcccaccgtggagagtccgagttcagtcactccagcctcacagaccccagtcgttgtggtgagcccagtcccagcgacgacaaccggtgagaacccgagttcagtcactccagcctcggacactccagaagatgaggaaactcgagaagattct

SEQ ID NO: 2617 - DNA, 257 bp, Artificial
  Synthetic
gcatgatattgaatggttggaaagtcagatggaggcgttcaaagcaatcacagcgaccctgccgcagctttcctttcatgagacgaagcggtcggaacatggctttgtcgtcgaacagcggcattccatgtctggctcggatggtgtgcggatcggcctgtccgctactcattcgggtttgatccaatttgagggccgcgatgcaaactaccagacgtttgtagaaaagttccgcgaaatgatacataaagccaagg

SEQ ID NO: 2618 - DNA, 382 bp, Artificial
  Synthetic
tggcgtggcgcctcagccagaagcgttggggatgacacccgacctcgcatttgtgtactagtatgtacacaacacagccgtgtgtcagagtatcatatcagagctaaggttaggtagacagacagacggcttcgtttggcaactcgctggatgccagatggcagagcttagatggtcagcttggatggttgagcacagatgtgaataggcacctgcgaggaccagcagtgagcaatattggagcagtaagagtaaggtagctgtcgggatagagacttgaggacgggctgctccgtccggtccccatctcgtggaacccgtaatccagtcaatggataccataatcaatccataactcctccataaaaaaaagaaaaaaaag

SEQ ID NO: 2619 - DNA, 738 bp, Artificial
  Synthetic
aatttaaaagtgtcgcattaaaccgcccctacttgcttttgctctctttgttgttcactcgcagctacaactctcgcccacaatgtctctcaagaatgacgctttcccttcctccgaggccttcgaggccatcaacgccgctctcagcagcagcgaagccgaccgcaaggacgccatcaagaatggcaaggccgtcttcgccttcaccctcaagaacaaggccggcgagacggccagctggcacattgacctcaaggagaagggcacagtgggcactggcgtcggcgagaaccccaccgtcactctgtctctctccgacgaagactttggcaagctcgtcaccggcaaggcccaggcccagcgcctcttcatgtccggcaagctcaaggtcaagggcgacgtcatgaaggctaccaagatggagcccatcctgaagaaggcccagaccaaggccaagctgtaaaaagcgggcattggcaagttgggctgttgattatgggaaaacaggtggaaacaaaccattaaacggcatttttttgtttttatatgtatcataccatcgctgtttactaccactgatgtttactgttttttctttgttccccggccgcaaaagagttcggctagggacggttggttatagtgccttatgaatactggcatagacgagaataccatattccggctggacatgtttccagtctggagttcctttttttaaaaaaaaaaacaaccaac

SEQ ID NO: 2620 - DNA, 620 bp, Artificial
  Synthetic
gcaaatggaacgccgaggggttcgctgaggaggaagacgacgatgtgcagctggattattcccggcctagtctcacaagtgactcggaggctgaggcagttgggcggtccagcgctctggatgctgttgagtcgtctacctggggatccacaagcaagggcaagttcattctcaaggacttgggagacgaggtgcacgacatcttggcctcggcagaggctcagaaagccgagaaggctgcacgagcagacaccaagactggccttttgggcaccggagtcaatgccatcagtgggctgttccggaatgtggtgggcggcaagacgttgaccaaggaggatctcgacaaggccatgaagggcatggaagatcatttgctgcgcaaaaacgtggcgcgcgaagctgccgttcgtctttgcgaaggtgtcgaaaaggagctggtcggtgtcaagactggaaactttgaaagtatcaacgccaagatccaggcggcaatggagtcgtctctcaccaaaatgcttactcccacctcatccctcgatctccttcgcgaaatcgactccatcacagccccccccagtcacgtctctgcgcaaagctcggccctacgtcatctccat

SEQ ID NO: 2621 - DNA, 533 bp, Artificial
  Synthetic
aaccacggccacgacgaccgcgtctgtccgggattgatcctgtcaactgctttaccagatatctagccgtgccacgatagagcgcgcatgtcggcgagaggggggcagaagaggagaagagtcaagagaagggggggcacagctgatagacagagcgccgtcgagcctgtagcatcgccaaactcaatgtaggtacgtctgatgagtgtcgctgcatgcagatgacagtcgtggatgcatgtcattggcacttgatcagctccatatttgacagtgcccctccaacggcggcaagcgagagtgaggggtttgctgttgttatttgttgttgctgttgctttgctgttgcattttcctgaggcatatgggccaagatgagagatggatggatgacatggatgagattggtttttgtgtataacaaagcttgataatggcattgaacaaagcttgtgccggctagtcgataaggacgatgtcgataacgcgtatcgcagctatcagcccatctaatcgcagcacagcctaacccc

SEQ ID NO: 2622 - DNA, 554 bp, Artificial
  Synthetic
gatacccagtatacagcagaccgtcccgaatatcccaagtatatcaagtgcaagactgggtttataacaatcgtttttgataaactgcaatttttctcatttcatacgcgtattggaagacactttattcgtatatttacgatctgttcctttgcctgtcgagtacaccactacaccactcaacgacacctacatatttcctttcaccatggcaccaaccgctatcgttgatctcggcgagaccttttccgtcggccagaagctggaaaatgtctccgacgccatcgacgacgtaaactgcatcaagtacgattccgagtccaagttcgacgccaacaaagacaaggcaaacttccgccagtacgaggatgcctgcgacagggtcaagaacttttacaaggagcagcacgaaaagcagactgtcgcctacaaccttgctgctcgcaacaggttcaagagcgcttcacgggtgcgcccggagatgaccgtctgggaggccatagagaagctcaacactctcgttgatgaatctgacccagacacgtcgctgtctc

SEQ ID NO: 2623 - DNA, 656 bp, Artificial
  Synthetic
gcccacgcgtccgcaatgcattctggtttgttgggggctaagcctttcaacgttatgcgtgttactcccggatattatcttgcaacatgggcttgtcatctcccgccagccattcgctgtgattcgtcccgggatgctccgcggacattgcttcctggcgtatttcagcatccggcattggtgaagttcccactatggagatagaatcatggattttgcccccgccccttttttttttcttcttttccacccttctttatgcttatctctcagcccctagcaaacggtggacggatattctcatctagattgctgacaacatgccgttagcccccatcaaccacgaacccgtcccgacccggggtccaatattcgttcagctcggctgttcacccgtatactcgtgcttgacttttatttttgtttttagttgggagattattttgtattttgcagaagcaatatttgccacctgggcaatattctctcgagtcagccattgtaggcagctgaaaaggctgatctgtcttggccttgctcgtttccccgcgctggaatccatcatgtgagaagcaatggatggagacgagccatgcatcaagattcttgtctggagatctcctgtgcagatcacggattctcccaaagccaactta

SEQ ID NO: 2624 - DNA, 563 bp, Artificial
  Synthetic
tgaaagcttccatatcgcattctcatggcgactgttgggaatgcggcccggcagatacgagatcgggcactgcgcgaaagatcgatccgcgtgctcgtatcgccaacgccaatctccttcgccgagcgtcgctcagttctgcaggtgctggagcaatatggccctgtcgagttcttcaagatgactcccggctactacgccaactttgtttctataacgagagagccctcgaccgccgaaagattgatagctagcagccctctaacatacaagatcacggagcctgtccgcagcgcggtggaagacatttacgttgcagatctaaacgaaccagagagctttagcaccatgcagccgacaataactgggcaacagacgagcggcgcgaactcttggtccgacggcacggaacagggacaggaacaggaacaaggacgagaggcggaactaaagcaaggggagagagagttcaaactggaaatcttccctgcgcccgagtacaatcatagatttgccatggccggttcaccgctgcacggcatctggaacgatggctacgaaca

SEQ ID NO: 2625 - DNA, 781 bp, Artificial
  Synthetic
gcaaattggacatacacgataatgcaatcctcatccatggccagcgtagctttcttgactactgcaaaagtaaaggacgatgagacaaaggaggttgtgaatggcttgcaacaacttagtgcccatctccaactccccaataccccatgtctagccggagcctgctttttgtccgcggccaagaaggaaacgggtatcaaactcatcggtcgcttggaaatatttcctagtgaaagcgaacttgctactgttcaaaactctcctgaatataagcgtttcagcgactcggtcaccggccaaaaacttcacgaaggcaaggagactgccactttatggcagcccaccggcggttttctgacaaggaagaaccaagcctcgacaacaaaggccggtgtacttgttttagccaagttcatttgcaatgataaagagaacgcagttcaaaatctcgtgaaagagttgcaaacatattgtgagtggatcgagggcaacgagctcacgacatacacatattgcgtaatgacaagtcaaactgcaaataaggaagttctgctctttgagcgttataaggatcttccttccgtcaagacccatggccaaacaaatgagttcaagtctatgttcaaacgaatttcgccttggattgaaacaaagcgtaccgaaataactccatggagcgaattagacggttctttcttctcttccctagacttagaagccacagcgaagctctaaagatagctctatattccttataattttgtattttttcttctattct

SEQ ID NO: 2626 - DNA, 191 bp, Artificial
  Synthetic
agatgttgattccaacgccagagactagcggtgggactgctattaaaatagaataaagatcttacttggcagccgttttccggttcaccaagctgcggagattagatagagggctacatgcgacccttgtacgatcagcgcatatcatgagaacaattctggactcagaattttgacgagaccagttcctt

SEQ ID NO: 2627 - DNA, 551 bp, Artificial; identical to SEQ ID NO: 420
  Synthetic

SEQ ID NO: 2628 - DNA, 692 bp, Artificial
  Synthetic
  misc_feature (529)..(529): The residue at this position can be any nucleotide.
tcctttagggtttctgagtaagagaggagaaagataataattcccccgaggggtagagagagagaggagagagagagagagagcaagcaatggcgacggccaaaacagtaaaagacgttccctctcatgacttcgttcgatcctacgccgctcatctcaagcggtccggaaagatcgaggttcccgaatgggtggacttagtgaaaacctccactgccaaggagcttgccccttatgaccctgactggtactacattagagctgcctcaatggctcgcaaaatttacctgaggggaggtattggcgttggagccttccggaagatttatggaggccggaagagtaacgggtcccgcccttcacacttctgcaaaagcagcgggtccattgcaagagatgtgttgaagcagctcgagaaaattgacatcattgagaaggacacaaggggggggcgaaagattacatccaatggtcaaagggatttggatcaggttgcaggtcaagttataattccttctgctgctgccgnctagagttaatagttgatcaggtcaacttttcagtgggccaagttgactagcctcatatttgggtattagcaaatggcgtttcgattttagtttgactgggttgttcactgaaggataattgttcaatgagattttgaaatcatatttttccccttccaaaaa

SEQ ID NO: 2629 - DNA, 708 bp, Artificial
  Synthetic
agagaggaaggtcgaggatagaggaggagcaggagattggagattagggtagctgaggaagagccatagccatagccagagccatagccatagccatggaggtcgcggcagagagtgcagtggtggccccggcaacggccaagaccgtgaaggatgtggcttcccatgactttgttcgttcttacgctagtcacctcaaacgaaccggcaagattgaagttcctgcgtgggtggatcttgtcaagacctcaacagccaaggagcttgccccgtatgatccagactggtactacattagagcagcttctatggctcgcaagatttacctaagaggcggtgtcggtgtcggagctttcaagaaaatctatggaggatcgaagagaaatggatcaagaccatcccacttttgcaagagcagtggatcaattgcccgagatgttcttaagcaactcgagaagattgacattgtggagaaggaccatagaggtggaaggcgtatcacctcgaatggacagcgtgatctagatcaggttgctggaactgtctcagtgaaagttgtttaatttaatatgcataattcaacttttcgtagtttaggattttagtaggcatatagtttaatttaaacatagaccggattatagcatctttgcttagtggtttattgtgttgacttgagtgattagtactgaaattataaagagggag

SEQ ID NO: 2630 - DNA, 990 bp, Artificial
  Synthetic
acaccgttaaaatggccggcggaatcaccgttcgcgatgtcgatgtaggtcctccttgaaacacattgaaatcataaaatctaggatttcccccttctttcacgatcacctctcgacgatctcgcaacttggccccgaagaaacaaaaaattatcctcgaaacctccgacgcggcgatgttgtggtctggcttcgatgagccgcagcggctggagttgatctgaatacaatgcattgagaaaaaaaccagctgcttgagcctcggaccagctacatacatggttgtgtataagcgtggcatatatgtggaaaaaaattctttgagggatctaggagcaggcgcgagggagtcgcaagacttctgacgacggaatatttgctaatgggtccttttctgtaatcaggcgcaaaagttcatcactgcctatgctgctttcttgaagcgccagggcaagctgcccatccctggttgggttgacaccgtcaagactggtcccgccaaggagctgcctccccaggacattgactggttctacgtccgtgccgcctccgtcgcccgccacgtctacctccgcaagaccgtcggtgttggccgtctccgcaaggttcacggcactgccaagaaccgtggcaaccgccccagccaccacgtcgatgcctccggctccgtcgaccgcaaggtcctccaggccctcgagaagattggcgtcgttgagcaggacgaggacaagggtggccgccgcatcacccagtccggccagcgtgatttggaccgaattgcccagaccaccgctgaggccgaggaggaggatgaggagtaaatcaaaataaagaaaaaagtctttttgttttcttcttacaactgtcatggatggcggcatttggaatgggcgtacggtcttagtgtttgagatgtatgaacaagattccctctggttttgggctttcggttaccaaactggacgtgccacagccgtcttttgatgaaca

SEQ ID NO: 2631 - DNA, 589 bp, Artificial
  Synthetic
cgagcccctcaagcagccgcaccctcactctcctctcctgccccccacggcggcggcgggatggcggattcgacggcgaggacggtgaaggacgtgaaccctcatgagttcgtcaaggcctactccgcccacctcaagcgctccggcaagttgtttgtagccagccaggagctcctgttgttaggcaaccttcgaatatctttttaccagatggagctccctgagtgggttgacatcgtgaagactgcgaggttcaaggagctccctccttatgatccggactggtactacacgagggctgcctcgattgcaaggaagatctacctgaggcagggtattggtgtaggtggcttccagaagatctatggtggccgccagaggaacggctcacgccccccgcacttctgcaagagcagcggcgctatctcacgcaacatccttcagcagctgcagaagatgggcatcattgatgtcgacccgaagggtggaagactcatcacctcccagggaaggcgtgatctggaccaagtgggcggaagagttgatgttaccatcgcctgaacagatccattgatcctcaacccttaat

SEQ ID NO: 2632 - DNA, 589 bp, Artificial
  Synthetic
ctcgagcttgcggccgccttgagaatgaaatggtaacaattcttaaaagtaaagataaacactaaaagcacaatggcctcaaaagtagaagaagaacaaaaaagaacattaagatcttcaaggttcaactgcaatacggccagcaacctggtccaaatccctttggccactggaagtgatccttcttcctcctttggtgtcgagctcaacaatgttcattgtctccagctgttggaggatgtgacgggcaataccaccactgcttttgcaaaagtgaggtgggcgactaccgttcctcttgcttccaccatagattctacggaaagcaccaacaccaagtcctcccctcaggtaaaccttccttgccatagatgcagctctgatgtagtaccaatcaggatcatatggtgcaagctccttcaactttccggtcttcacaatgtctgtccatgtgggaagctcgatcttgccagatcgcttgagatgagaagcataagccttgacgaagtcatgaggcgagacgtctttcacagttttaccagttgccatggctcaagttatcaaaagactaagcggccgcaagctcgag

SEQ ID NO: 2633 - DNA, 526 bp, Artificial
  Synthetic
attggatcagcattatggcggcgccggcgacgtccaagacggtgaaggatgtctcgtcgcacgaattcgtgcgtgcctacgcggcgcatctcaagagatctggcaaggtcgagctgccgccatggacagacattgtcaagacctctgtggccaaggagctagcgccgtatgatccggactggttctatgttcgagctgcgtccatggcgaggaagatctaccttcgcggcggcattggcgtgggggcattcaagaagatctatggcggcagcaagaggaacggtgctcggccgtcacacttctgcaagagtagcggtgccatcgccaggcacgtcctcaagcagctggagaagattgacatcgtcgagaaggaaccaaagggtggacgaagaatcacttcccagggacgacgggatttggatcaagttgctggaagagttgctgttgctgttgcgtgaggtgtgccactatgacatgacgtggcacagcggtgtcttttggttatagaaaatatcttccagctaat

SEQ ID NO: 2634 - DNA, 622 bp, Artificial
  Synthetic
cggacgcgtgggcagctgcgttgggcaaaatcccagactaagatcagtgattagtcttttgataacttgagccatggcaactggtaaaactgtgaaagacgtctcgcctcatgacttcgtcaaggcttatgcttctcatctcaagcgatctggcaagatcgagcttcccacatggacagacattgtgaagaccggaaagttgaaggagcttgcaccatatgatcctgattggtactacatcagagctgcatctatggcaaggaaggtttacctgaggggaggacttggtgttggtgctttccgtagaatctatggtggaagcaagaggaacggtagtcgcccacctcacttttgcaaaagcagtggtggtattgcccgtcacatcctccaacagctggagacaatgaacattgttgagctcgacaccaaaggaggaagaaggatcacttccagtggccaaagggatttggaccaggttgctggccgtattgcagttgaaccttgaagatcttaatgttcttttttgttcttcttctacttttgaggccattgtgcttttagtgtttatctttacttttaagaattgttaccatttcattctcaaggcggccgcaagctcgag

SEQ ID NO: 2635 - DNA, 704 bp, Artificial
  Synthetic
cgttatttattatgcatcttgactacccctcgaccacgcgtccgcccacgcgtccggggagcaacgtgaagagagatctgcatcagcgccgcaacagcagcagaagtgaagatggaggcagcgagaactgtgaaagatgtttcccctcacgaatttgtgaaggcttatgcaactcaccttaagcgctccggcaagatggagcttcctgagtggactgatctcgtcaagactggtaaactcaaagagcttgctccatatgaccctgattggtactacattagagctgcttctatggcaaggaagatttatttgaggggcggtatcggtgttggtggattccgaagaatctatggtggtaaccagaggaatggcagccgccctcgtcatttctgtaagagcagtggttcagttgcacgcaacatacttcagcaattgcagaacatgaacatcgttgactttgatcctaagggtggaaggagaattacatccaatggccagcgtgatcttgaccaagttgctggaagaattgctgcagctctttaagagatgaattcaggcaattttatgaatacatgagttagctcaaacttattgtttcagtttggacctatataaattcagggtacttttcaatcaattttgtggatgttttgttttgccttcctgaacttttcgcgtctctcccaatatgtcagttttgccct

SEQ ID NO: 2636 - DNA, 682 bp, Artificial
  Synthetic
cacaagcttcagtcgatgtcgcaccttcgcaataagccctcacctcacataaacacgggagaactacattcaagatggatttctctaaattcagcaagggtttctctgatttcagtgcgcagattactccgtttgcgtcacggaccttccagtttaccaaggagcagttgggccaagcagatgatcgaactgagcttcctgccgattacatcgacctcgagaaaaaggtcgatgcgctgaaacaagcccaccagaagatgcttgcggtgacttcgcaatataccaacgaagcctatgactatcctcccaacatcaaggagacatttcaagatcttggccgaaccgtgagtgagaaggtcagccttctatcttcggctacatctacttcagaggcccaagcagctcttgtggctccagcatctgcgaagccgcaaccaaagactttcaaccatgccatctctcgtgcgagcttatccagcagccagctcctgcaccagcaccacactggtgctggcgaagatcctctggcaacagctctcgagaaatatgcactcgcgatggaacgagtgggcgacgcgcgccttgctcaagattcacaaatccaaagccgattcctagcaggatggaacacaaccctcaataccaatcttacctttgcggcgcgtgctagaaagaatgttga

SEQ ID NO: 2637 - DNA, 493 bp, Artificial
  Synthetic
cccacgcgtccgggaaagagaaggactttatcacacaagccgtttcggtttctacttctccttattgttattattacatctcggtgcaccgctgcatatgggcatggaatggaggctttttctttttcttcttttcttcttgttggtcagtcttttacgaaatacgcaacaagaccttgggtggagttctatggatacgaatatgaggcgtttgttgtggatacgtgaatgtggaacgagaaacgtacgcaagacgagtatgagtctcttgcatgaaatagcatgatgggtggtttggagaaggactaagcaagtggttgctgtcctgagcctttggccgtctgcgacttggggttgttggaacaggccttgcatgtctttatgactgacagaggtgagcttggagttagcgcttttgaaggcagctcttttcaacaagttgcaaatttccattttatcattctataagctgttccatctccttatttccact

SEQ ID NO: 2638 - DNA, 211 bp, Artificial
  Synthetic
acccacgcgtccggtggagatcattttactgtactataacggtggtggctggatcgtcatgaggcaaatcgggcaatgcgatgcgatacgatggatcacggctaacatgacaatattgattagtagcatgatgatgaaccaacagcacagatctggatggctttagctttgaccacatgccaagcaggctgcccaggttcacagaccagcc

SEQ ID NO: 2639 - DNA, 570 bp, Artificial
  Synthetic
aaaggagagagagagagagagagagagaggttgcaggttccggtagcaaggaaggcgcaaccatggtggcagcaaagaagacgaaaaaggctcaagagagcatcaacaacaggttagccctggtcatgaagagtggcaaattcactcttggatacaagactgccttgaaatctctccgtggtggcaaagcaaaacttgtcatcatctcgaacaactgccccccactaaggaagtctgaaattgagtactacgctatgctctccaagacaggggtgcatcagtacagtggaaacaatgtggacttgggcacagcctgcgggaagtactatcgcgtcagctgtcttagtatcacagaccctggtgattctgacatcatcaggactgtggagtagggatgagagttcaaaccaagtttagtgtggaagtaggacgtcttttaattcctctgagcatgcaagggggccgagttttgcctcttcactggaatttattgattagcctgtcaacctctgcttaaagagaacttggctatttcgtagatggctaagtcttgattgatgatgaaatatg

SEQ ID NO: 2640 - DNA, 603 bp, Artificial
  Synthetic
  misc_feature (327)..(327): The residue at this position can be any nucleotide.
ccccgggacctcgcagtcgccaccccgagcagaagccgccgccgccgcccgaaaccctcgccgccgtcgcttctcctcggggcgcagccatggtggccgcaaagaagacgaagaagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccacttccacggaaataatgtcnatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggaaaaaaaaaaa

SEQ ID NO: 2641 - DNA, 648 bp, Artificial
  Synthetic
ccgacctcgcagtcgccaccccgagcagaagccgccgccgccgcccgaaaccctcgccgccgtcgcttctcctcggggcgcagccatggtggccgcaaagaagacgaagaagtccacggacaacatcaacaacaagctgcagctcgtgatgaagagcggcaagtacacgctcggctacaagaccgtcctcaggaccctcaggaactccaaggcgaagctagtgatcatttctaacaactgcccacctcttcggaagtcagaaattgagtactacgctatgttggccaaggtcaccgtccaccatttccacggaaataatgtcgatctggggacagcctgtggtaaatacttccgtgtttgctgcctcagcattattgatcctggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggcccgaatcatgttttcaattaaaacgcttggctgtttgttcactgaacttcgcatcatta

SEQ ID NO: 2642 - DNA, 616 bp, Artificial
  Synthetic
gcaaccgcatcaatctaatcgcaagatcgcagctcgcgcccaaaatcagtcaaaatggcccctcagaagaagagcaagaaggatgccaacagcatcaactccaagttggcgcttgttatgaagtccggaaaggtcactctcggctacaagtctactctcaagtctctgcgatccggcaaggccaagctgatcatcattgctggcaacactcctcccctgagaaagagtgaactcgagtactacagcatgctgtccaaggctcccatccaccacttcgctggtaacaacattgagctcggcactgcctgcggaaagctcttccgctgctccacccttgccatcctggatgctggtgactctgatatcctcagcgaccagcaggcttaaatagccgaaatctagtgcattcaaaacggcgttgggggtaaaacggttcaagggcaatatggataccatacactttcacattatgtgcgagacgaaaacttttgatgcgagacatcatctactaggaaggcaaatcctttggggatggaaaaaagccccagaaatttccaagtgatagttatctcaatggaataatacagccatgaagactgttccccctgtcaaaaaa

SEQ ID NO: 2643 - DNA, 505 bp, Artificial
  Synthetic
cctcggtctctacgcaatcgcgactgcatcagaagcattcaattgctcgtcaacgtcaacatgtctctcgcacagtctatctacaggcaagtcgcaacgacagcgaatcaacgaacgtaactacggcatcctaacatatacctctacagcaccgtcttccgcaagaacttcaccatgcttgcggccgttttcggtgccggcttcgcttgggagatgtatgaggagcctaccacattcgatcgagcgtcagggcagtaaaaggctaattaagggtgcaacagcggtttcaatgccaccatgaacaaaatctgggacagcaacaaccgaggccgccaatggaaggacatccgacacaagtacattgagggcggcgaggacgaggagtaagatcaacatgcaaattccggttgctacggctagaatgggtgtggcatgggactgcctggggaaaatgtacaaaaccaacgagaaatagaatgattcacaacttttttctttcccttcg

SEQ ID NO: 2644 - DNA, 374 bp, Artificial
  Synthetic
aggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctgtattttccatcctttacatccttctgtctgttcaaaaaccagtctgggatcttgtactggcgtggattctgcataatggtgatcacacgttccacctcatcctcagtgagttctcccgccctcttggtgaggtcaatgtctgctttcctcaacaccaca

SEQ ID NO: 2645 - DNA, 665 bp, Artificial
  Synthetic
gcatctctttcaaactaaagcagccgcagccgcagccgcactgtgccgaaagcagtgaaaccctaaccatgtcgctggttgcaaacgaagagtttcagcacattcttcgtgtgcaaaacacgaacgttgatggaaagcagaagatcatgttcgctatgacctctatcaaaggtatcggtcgccgttttgctaacattgcttgcaagaaagccgatatcgacatgaacaagagggccggagaactctctgctgcagagcttgatagcttgatggtggttgtggctaatcctcgccaattcaaaatcccagattggtttttgaacaggcagaaggattacaaggatggcaagttttctcaagttacatcaaatgcacttgacatgaaactcagggatgatctggaacggctgaagaagatcagaaatcaccgtggtttgcgtcactactggggccttcgtgtacggggtcagcacacaaagaccactggccgcagggggaagactgttggtgtctccaagaagagataaatcatatgttttatgctctgctctttagtatgcgtagtccgaacgcttacaagaagtttattagggttttgtaatgtttgcactgaaattttcttgtcttgccatttggagggttatagtttatataaatcctctgat

SEQ ID NO: 2646 - DNA, 691 bp, Artificial
  Synthetic
ctcacatctcttgaatacagaagaagccgccgccgcacagagcaagatttgaaacctagcaatgtcgctcgttgcaaatgaagaatttcagcacattcttcgtgtgcaaaacaccaacgtcgatgggaagcaaaagatcatgttcgctttgacctcaatcaaaggtatcggtcgtcgttttgccaacattgcctgcaagaaagctgatatcgacatgaacaagagggcgggagaacttactgctgcagagcttgacagtgtgatggtggttgttgcaaatccccgtcaattcaaaatacctgattggtttttgaataggcagaaggattacaaggatgggaagttttcacaagttacctctaatgctcttgacatgaagcttagggatgatctcgagcgcctgaagaagatcaggaatcatcgtggtttacgtcactactggggtctccgagtgcgtggtcagcacacaaagaccacagggcgcagggggaagactgttggtgtctccaaaaagagataaatcatctacttgttcagtttgttatgtgctttctctttatgtgctccgggcgatacatgtttaagatattttaggggattttgtgttggtatgcttaaattttcctttccgttggtggattacagtataatttttttccatagtgacaaggatttctctgctttatgatct

SEQ ID NO: 2647 - DNA, 640 bp, Artificial
  Synthetic
atccgagcttttaggtttagggttctaaagccggctcaagcacccaaaggtacgcatcgtctctagctcggcagcaatggcggacaccctcgtctctaaagggcgcatggatggccacggcgactgggtgacggccatcgccacccctgtcgacaacagcgacctcatcctgtcggcgtcgcgcgacaagtcggtcctggtctgggacctgagcaaggacccgatcgagaaccactacggcttccccaagcgccgcctcaccggccacgcccacttcgtccaggacgtggtcatctcctccgacagccagttcgcgctgtcgggctcgtgggacagcaccctgcgcctctgggacctgagcaccggcaccaccacccgccggtttgtcggccacaccaaggacgtgctctcggtcgccttctcggccgacaaccgccagattgtctccggctcccgcgacaagtcgatcaagctctggaacacgctgggagagtgcaagtataccatccaggaccaggactcgcataccgggtgggtgagctgcgtccggttctcgccggtgacgacgaacccgatcatcgtctccggcggctgggacaagatggtgaaggtctggaacctgaccaactgtaagctgagg

SEQ ID NO: 2648 - DNA, 340 bp, Artificial
  Synthetic
aacatgagccagaacgttcttcttgtactccgacgaacccttgagggccacaacggctgggttacctccctcgctacttcttccaacaaccccgacattctgctgtccggatcccgagacaagtccctgattgtctggtctctgacccgagacgacaccaactacggtgtcccccgaaagtctcttaagggccactcccacattgtccaggactgtgccatctctcatgacggagcttacgccatctccggctcttgggataacactctccgagtctgggacctgaacaccggcgtgtccaaggaccgagtcgtcagccacaatggtgacgtccttcccg

SEQ ID NO: 2649 - DNA, 1149 bp, Artificial
  Synthetic
aaccgagagcagccctctcccattacctgcccgataaaatggcacaagaatcactagtcctccgcggaacaatgaaagcccacaccgattgggttacagccatcgccaccccaattgacaactccgacatgatcgttacttcctccagggacaagtccctaatcgtctggtctctcacaaaggacggcccacaatacggtgtcccccgccgccgtctcactgggcacggccacttcgtccaagatgtcgtcctttcctccgacggtatgtttgctctctctggctcctgggacggtgagcttcgcctttgggatcttcaagctggaaccaccgctcgccgtttcgtcggtcacactaaggatgttctgtgcgttgcattctccgtcgacaaccgtcagatcgtttccgcttcccgtgacaaatccatcaagctctggaacactctcggtgaatgcaaatataccattcaggatggtgactcgcattctgattgggtttcatgtgttcgtttcagcccgaatacacttcagcccactatcgtttctggatcctgggaccgtactgtgaaaatctggaacctgactaactgtaagctgaggtccactctggctggacacgccggctacgtgaacaccgtggcagtctctcctgatggttcattgtgtgctagtggaggcaaagatggtacaattttgctttgggatttggctgaggggaagaagctctactcgcttgatgctggctctatcattcacgcgctctgctttagtcctaacaggtattggctgtgcgcagctactgaaactagcattaagatttgggatttggagagcaagagcattgtggtggatcttaaagttgatctcaagcaagagagtgagatggctactgaaggaactattggctctgcctgcaaaaacaagatcatgtactgcacctgtttgagctggagtgctgatggaagcacgcttttcagtggatatacagatggtttgattagggtttggggtattgggcgttattaggagttggccatagtcatttaaagacatttagatttctcttgaaatgtttgaagaatgatatctggattctctctgtttctcatggttttgagagttttgttgttccaattttgggatgttattt

SEQ ID NO: 2650 - DNA, 325 bp, Artificial
  Synthetic
cccacgcgtccgcgaaaaccctagtttcagaggcatctccagacaccgaaaatggcggaaggactcgttttgaagggcaccatgcgtgcacacactgacatggtgacggcaatcgccaccccaatcgataacgcagacatcatcgtctcagcttcccgcgacaaatccatcattttgtggaaactcaccaaggacgacaaagcctacggtgtagctcagaggcgtctcactggtcactctcacttcgttgaggatgttgttctctcctccgatggacaattcgcgctttccggcagctgggacggcgagctccgtctttgggatc

SEQ ID NO: 2651 - DNA, 554 bp, Artificial
  Synthetic
ggcgtgcttaagaagagagagagagagagagagacagagagagagagaggagagagagagagagaagctgcaatggccgagaccttagtcctgcgtgggaccatgaaggggcacactgactgggtcacgtcgatcagtacgcccatcgacaactccgacatgatcatctcgtcatcccgcgacaagtcgctcctcgtatggtccctcacccgcgaggagggcacctttggtgtccccaagcgccgactcaccggccatgcccacttcgtccaggacgtcgtcctctcctccgacggccagttcgcgctctcggggtcgtgggactccaccctccgcctctgggacctcaacactggtgccaacacccgacgctttgtcagccacaccaaggacgttctctctgtcgccttctccgctgacaaccgacagatcgtctccgcctcgcgtgaccgcaccatcaagctctggaatacccttggcgagtgcaagtacaccatccaggaccaggatgcgcacaccgggtgggtgtcgtgcgtgcggttctctcctgtgac

SEQ ID NO: 2652 - DNA, 570 bp, Artificial
  Synthetic
  misc_feature (225)..(225): The residue at this position can be any nucleotide.
gctcaggcagaggcgtgcttaagaagagagagagagagagagagacagagagagagagaggagagagagagagagaagctgcaatggccgagaccttagtcctgcgtgggaccatgaaggggcacactgactgggtcacgtcgatcagtacgcccatcgacaactccgacatgatcatctcgtcatcccgcgacaagtcgctcctcgttttggtccctcacccgncgaggagggcacctttggtgtccccaagctgccgcctcaacggccatgcccacttcgtccaggactgtcgtcctctcctccgacggccagttctgcgctctcggggtcgtgggactccaccctccgcctctgggacctcaacactggtgccaccaaccgacgctttgtcagccacaccaaggacgttctctctgtcgccttctccgctgacaaccgacagatcgtctccgcctcgcgttgaccgcaccatcaagctctggaatacccttggcgagtgcaagtacaccatccaggaccaggatgcgcacaccgggtgggtgtcgtgcgtgcggttctctcctgtga

SEQ ID NO: 2653 - DNA, 503 bp, Artificial
  Synthetic
cggcttcccaatctctccccagcgccgccgccgccgccatcctccccgagccctagctctcccctatccctcgccgcacgcaccaccaccaaccatggccggcgcgcaggagtctctggtgttggccggcgtgatgcacggccacaacgacgtggtgacggccatcgcgacccccatcgacaactcgccgttcatcgtctcctcctcccgcgacaagtcgctgctggtgtgggacctcaccaaccccgtccagaacgtcggcgagggcgccggcgcctccgagtacggcgtgcccttccgccgcctcaccggccactcccacttcgtccaggacgtcgtcctcagctccgacgggcagttcgcgctctctggctcctgggacggggagctccgcctctgggacctctccaccggggtcaccacccgccggttcgtcgggcacgacaaagacgtcctctccgtcgccttctccgtcgacaaccggcagatcgtctccggctccc

SEQ ID NO: 2654 - DNA, 671 bp, Artificial
  Synthetic
gacggagaagaagggtctaagaccttgaatcagagcagctatggcggagactctagtcctccgcggcaccatgaagggccacacggattgggtcacctccatcagcacccccatcgacaactccgacatgatcatctcctcgtcccgcgataagtcgctcatggtctggaatctcacccgtgaggaaggcgtctacggtgtccccaagcggcgcttgactggccatgcccacttcgtccaggatgtggtcctatcgtccgacgggcagttcgccctctccggctcgtgggactcgactctccgcctctgggacctggctaccggcgccaccacccgccgctttgtcagccataccaaagacgtgctctccgtcgctttctctgccgacaatcgtcaaatcgtctccgcctcccgtgaccgcaccatcaagctctggaacacccttggtgagtgcaagtacaccatccaggaccaggatgcgcacaacggatgggtctcgtgcgtccggttctcccccgccaccgccaaccccaccgtcgtctcgggatcgtgggaccggaccgtcaaagtgtggaacctcaccaactgcaagctcaggaccacgctctccggccactcgggctatgtcaacactgtcactgtgtcccccgatggctcactctgcgccagcg

SEQ ID NO: 2655 - DNA, 511 bp, Artificial
  Synthetic
gcaactgatcctcaaaggtaccctcgagggccacaatggctgggttaccagcttggccacctcaatggagaaccccaacatgctcctgtctggtagccgagacaagaccctgatcatctggaacctcacacgcgacgagactcaatacggataccccaagcgatccctccacggccactcccacattgtgtcggactgtgtcatctcctctgacggtgcctacgccctctctgcctcttgggacaagaccctccgtctgtgggagctcgccactggcaccaccacccgaagattcgtcggccacaccaacgatgttctctccgtctccttctccgccgacaaccgacagattgtctccggctctcgtgaccgcaccatcaagctgtggaacaccctcggtgactgcaagtacaccatcaccgacaagggccacactgagtgggtttcctgcgtccgattcagccccaacccccagaaccctgtgattgtttccagcggttgggacaagttg

SEQ ID NO: 2656 - DNA, 564 bp, Artificial
  Synthetic
ccggcttcccaatctctccccagcgccgccggcgccgccatcctccccgagccctagctctcccctacccctcgccgcacgcaccaccaccaaccatggccggcgcgcaggagtctctggtgttggccggcgtgatgcacggccacaacgacgtggtgacggccatcgcgacccccatcgacaactcgccgttcatcgtctcctcctcccgcgacaagtcgctgctggtgtgggacctcaccaaccccgtccagaacgtcggcgagggcgccggcgcctccgagtacggcgtgcccttccgccgcctcaccggccactcccacttcgtccaggacgtcgtcctcagctccgacggccagttcgcgctctccggctcctgggacggcgagctccgcctctgggacctctccaccggggtcaccacccgccgcttcgtcggccacgacaaggacgtcctctccgtcgccttctccgtcgacaaccgccagatcgtctccgcctcccgcgaccgcaccatcaagctgtggaacaccctcggcgagtgcaagtacaccatcggcggcg

SEQ ID NO: 2657 - DNA, 581 bp, Artificial
  Synthetic
gtttcgaacggtgtccatggcgggcggatgggcgggacgagagggggaagctcggcgccaccatgcctttacaaaaagtatcattgatgaatagagtcgtaaatccgattcacggctgcggaggcagtgagcggaagatcgaccaacagattagcgatgagcgagagggtcaaggaaactgacagggtgattcagatgccccccggaagtggagaggaaacaagaagccaggggtgtttgtcgtacacatgttgccagcctgcatctggcatctgctgccagctattgacagctactttcattggccagatgctgcaaattggagctgcactgcacgggcacaagttcggatgggggatgacggaagcaaaacggctgcgtattacctgcgttggtagaatactaaggtattgatgtaatatttgggtaggtacggatacggtactttcatacaaagaatcacttagtcatggcacgcctatcgatacctcacctcaggccagcatcttcacttcgactcgcttatgcattagatcatatatcgaatccatataatatcaactcatcatactcaaaaaaaa

SEQ ID NO: 2658 - DNA, 137 bp, Artificial
  Synthetic
acggggtccatggcgggcggatggccgttacgacagggggaatctcggcgccaccatgcctttacaaaaggtatcattgatgaatagagtcttgaatccgattcacgggtgcggaggcactgagcggaagatcgacc

SEQ ID NO: 2659 - DNA, 569 bp, Artificial
  Synthetic
agagagcgttttttttttacttgactttgggtttggatgctggaatagaaagacgatacacaagacaaggaatcagacaggacttgcacaagacatagatcacaagaaacgcgacctcacctcatcctcgacgatgcctttcaacacagagctcacccgccgcctgggcattcgcgtccccgtcatccagggcggcctcatgcacgtcggcaccgcagacctcgcgtccgcagtctccaacggcggcggcctgggcatcatcaccgccctcatctcccccacgcccgaagccctgcgcgccgagatccagcgctgccgcaccctcaccgacaagccctttggcgtcaacctgaccctcctcccgtccctcctcccgcccgactacccggcctacgcccaggccatcatcgacgagggcgtcaagattgtcgagacggccggaaactcgcccggcccggtgattcgccagctcaaggccgcgggcatcacggtgctgcacaagtgtacgacgattcgtcatgcccagagcgcgatcaagttgggcgtcgactttttgagcattgatgggt

SEQ ID NO: 2660 - DNA, 505 bp, Artificial
  Synthetic
gtcttctccaactaaacaatagctcttttctacttctaattttttttttatctcaactcaccatctgagctatcaagctagaaagtaaccacagcaaataatcatcatggagctcgtcaactacaaccacaagacctgccccaagtgctctgccaccatcacctccgagtccaagacttgctcgagctgcggcgctacttgccccgtctaagctacctcagctcgacccgccatcaacctcaaccatcgcaacaacatgacgagaatatcctgaggtgtggcgggactgcaaggacgcgcggatgagtgaatgaatagatgaatgaaggaatgatatacctcagcaggacatggtgcattaagacaaggcgttgatggaagaagagaagcgatcatgtatgtctaatattctaagctatatgccagtccttgttacagacaggcggctagaatagttcctcgcaatggaaggaatctagaatggcaatgggcaatgggcaatggc

SEQ ID NO: 2661 - DNA, 574 bp, Artificial
  Synthetic
ggtatccgtcgggacgcgaagaagttctgaagccatgtcgaagcgaggacgaggagggtcctccgggaacaagttccggatgtctctggctcttccagtggccgctgttatgaactgcgcggacaacaccggagccaagaatctctacatcatctcggtcaagggcgttaagggaagactcaaccgtctccctgcggcttgcgttggtgatatggtcatggccaccgtcaagaagggaaagcctgacctcaggaagaaggttatgccggctgtcgtcgttaggcagcgcaaaccctggaggcgaaaggacggcgtcttcatgtacttcgaagacaatgccggagtcattgtgaatcccaagggggaaatgaaaggctcggccattacaggacccattgggaaagagtgcgctgatttgtggcccaggattgctagcgcagccaatgcaatagtctaaccctgcacttgcgcatcagtttttgtcattagggtcaatgcggatctttagtaatacaaagtgggctactggttttgtgggctatataaatgctatatctttgaaagatttgagtac

SEQ ID NO: 2662 - DNA, 618 bp, Artificial
  Synthetic
acacaatgtctggagcttctggtaccaaatacaagatgtcggtgagtattgcaacacaaacagcgacaggcgacacacacgaaacagcgggtttgatcggggcgactttggagataatgacggacgaacgaacgacacggacgacgcaggtttttcatggattgggtggcgacacagagagcccatagagcagttgaatctgtgtattcagaagacggtgtacgtcagcagctcagcagacggtgtccaggcgtttgtattgcagacgattctgacaagtctttttgggtgttcctctgtgtccatttgcagccttgtacgactgactgtgaaaacctttccatgtgtgcatttgtacagtccgactcgccactaagtcgccattgatctctcccaatcgctgccgaaagaaaccgtttgtccatcgaggctctttttatctcgtttctttccatactaacccatagatggccctgcccgtcggagccatcatgaactgcgcttgacaactctggtgctcgaaacctgtacgtcattgccgtcaagggctgcggtgctcgacttaaccgactgcccgccgctggtgccggtgacatggtcatggccaccgtcaagaag

SEQ ID NO: 2663 - DNA, 660 bp, Artificial
  Synthetic
ccgagagggagagtgaagagcaacgccgtcgcggcaatgtcgaagcgaggacgtggaggttccgctgggaacaagttcaggatgtcgttgggtttaccggtggcggcaactattaactgtgccgataacactggtgcaaagaacctttacatcatttcggtgaagggtatcaagggaaggcttaataggttgccttcagcttgtgttggtgacatggttatggccactgtgaagaagggtaagcctgatctcaggaagaaggttatgcctgctgtcgttgttcgtcagcgcaagccgtggcgccgaaaggatggtgttttcatgtactttgaagataatgctggcgtaattgtgaatcccaagggtgaaatgaagggatctgccattactggtcccattgggaaagagtgtgctgatctttggccaaggattgcaagtgctgccaatgctatcgtttagtttgagaattgtgttttccaatagtttatttgagtttttgaatatcagggagttcttttcttggtaagaattagtgcaactggctatgagaattttgctgcactccaaatgtttttgtctatgtaggacattactgtttccttttcttgttgatgtgtttgttacgagtaaaagaaaatatgttgaactaatttattctct

SEQ ID NO: 2664 - DNA, 656 bp, Artificial
  Synthetic
ttcacgacggcaatccgcgactttggcacgtttctcacgactctaacgcccccaacccttcagacacaatggccaagcaatctcgtggtgcccctggtggcaagctcaagatgaccctcggtctccccgtcggtgccgtcatgaactgcgccgacaactctggtgcccgtaacctgtacatcatctccgtcaagggtatcggtgctcgcctgaaccgcctgcccgccggcggtgtcggtgacatggtcatggccaccgtcaagaagggaaagcctgagctgcgaaagaaggtccaccccgccgtcattgtccgacagtccaagccctggaagcgattcgacggtgttttcctgtacttcgaggacaacgctggtgttatcgtcaaccccaagggtgagatgaagggctctgccatcactggccccgtcggcaaggaggctgctgagctgtggccccgtattgccagcaactccggtgtcgtcatgtaaagaggttgttaaacgaagggagggattttttttttatttaccaaagagaagagaggaatgaaaaaaagacaaatgaccaagtccctcgatgcgatcttatagaagcgtggaaactctttttcccgcctcctgtcccttttttctgatttttttgttctttggggcatg

SEQ ID NO: 2665 - DNA, 605 bp, Artificial
  Synthetic
tttaatctaagcaaaatctcttagaaactggaaatatgtctgaagctcacaaaagattgtcgtctctacttaaaacactcaaaacaccaactatttcgcgtttcgttgaagacagatacataaccagcaaaagtgataaatgatcttcagacaatggcgttagcagcactagcaatccttggccagagatccgcacactctttcccaataggtccagtaattgcagaacctttcatttctcccttagggttcacaatcactccagcattatcttcaaagtacatgaaaacaccgtcctttcggcgccatggcttacgttgcctaacaatcacagcaggaagaacctttttcctgaggtctggtttacctttcttgacagtggccataaccatgtcaccaacacaagcagaaggtaaccgattgagacgacctttgattcctttaacagagatgatgtaaaggttcttagcaccagtgttgtctgcacagttcactgtggctgcaacgggcagaccaagtgacatcctgaatttgttaccagacgttcctccacgtcctcgcttcgacattttcgacggctcaagctctagggcttctgatgtttg

SEQ ID NO: 2666 - DNA, 241 bp, Artificial
  Synthetic
aattcggcaccagctgcaaccatgtcgaagcgaggaagaggaggaacctctggtaacaagttcaggatgtcactgggtcttccagtggcagccactgtgaactgtgctgacaacaccggagctaagaacctttacatcatttcggttaaaggaatcaagggtcgtcttaaccgtttgccatcagcgtgtgttggtgatatggttatggctactgttaagaaaggtaagcctgatctccgta

SEQ ID NO: 2667 - DNA, 601 bp, Artificial
  Synthetic
ccccccccccccgagtttttggtggatagagggagggccgtgaagatcgacaccgtccgcaatgtcgaagcgaggacgaggaggttccgctgggaacaagttcagaatgtcgctgggtctgccggtggcggcgacggtgaactgcgccgataacacaggtgctaagaacctgtacatcatttcagtgaaagggatcaaaggaaggcttaacaggttgccttcagcttgtgttggtgacatggttatggctactgttaagaaaggtaagccagatcttaggaagaaggttatgccagctgtcattgttcgtcagcgcaagccctggcgccgaaaggacggtgtttttatgtacttcgaagataatgctggtgtgattgtgaaccccaagggtgaaatgaaagggtctgccatcactggccctattggaaaagaatgtgctgatctttggcctaggattgcaggtgctgccaatgctattgtgtaggagtagggttgctaagtagtttacagttctcgttttgttgggttttcatcaagtttctgaatatctgagggctttgtcttaataagaattattgctcggaattttgcagtactaact

SEQ ID NO: 2668 - DNA, 565 bp, Artificial
  Synthetic
aggcggcgaaggatgctgcggctaagcccaagtccaagtactacccagccgacgatgctcctgtgccgcgggcgatccggcgcaagatccgcccgacgaagctaagggcgagcatcacacctggaacggttctcatccttctcgccgggaagtacaagggcaagcgcgtagtcttcctcaaccagctcccgtcgggattattgctcgtcactggtcctcgctcgttcaatggcgtccggctcaagagggtgaaccaggcttacgtgatcgcaacatcgaccaagatcgacgtctcttccgtggacgtggccaagtacgacgacagcttcttcaagaagttgaagaaagacgaggaggtgaccccggagatgaagaaggcaaagaaggaagctcaagaggccgtggacaaggtcgtgatcgaggtgataaagaagggagagccggagctagctcagtacatctccgccaggttcagcttgaagcgtggaatgaagcctcacgagctagtgttttaaacgaggcctttttttcctaatcaaaaatcaatcgtgaagaatattccacc

SEQ ID NO: 2669 - DNA, 638 bp, Artificial
  Synthetic
catttggagaggaggcaggaagaaggaaggacgagagagagagagagagagaaagagggagagggagagatggcaaagcctgagggaggagcgaaggggccaagggcatcccggaacaagtcactggttcgaggcgtggggcaatgcagcaggtcgcagattgtaccacaagaggggtctatgggcgataaaggcgaagaacgggggctgtctaccgggtccaaaccaagcccaaagcgatggacacctcggactccaaggcccgcggcaaaaaccccaaattctaacccggcgacgacgttgccaaatccctggttaacaagcggtatatcaagcccaacaaactcagagcttagcattaccctggaactgtgttgatcctccttgctggacactttaagggaaagcgagttgtattcttgaagcagcttgagtctggactacttcttgtgacaggtccgttcaagattaacggtgtccccctcaggcgtgtgaatcaagcatatgtgattgcaacctccacaaagcttgatatcagctgcgtcaatgctagcaagatcactgatgcgtacttcaagagagaggtagagaagaagaagaagggcgaagcagagttcttcgaggctgagaaggagaag

SEQ ID NO: 2670 - DNA, 638 bp, Artificial
  Synthetic
agcaattcgaaatggcggacaccaaccccacgacccagaagttctccaagggcgagaggtcgatcccgcaccactcgcagaaggccagcaagtactaccctgctgaggacgtcgccgtccccaagaaggcccgtaagagtgttcgccctgcgaagccccgtgcctccctccagcccggttccgtcgtcatcctcctcgctggtcgtttccgtggcaagcgtgtcgttctcctcaagcaccttccccagggtgttctcctcgtcaccggtcccttcaaggttaacggcgttcctctgcgacgagtcaacgcccgctatgtcatcgctacctcgaccactgtcgacatcaagggtatcgatgagggtgtcctgaagaaggcctccgaggagggttacttcaccaaggacaaggccgcacacaagcccggagaggatgctttcttcaagcagggcgagaagcccgagaagaaggagacctctaaggaccgcgtcgaggaccagaaggccgtcgacaaggcccttcttgccaacatcaagaaggaggctcacctcgttgactaccttgcctctagcttcagcctccgcacctccgacaggccacaccagatgcagttctaagcgtagggtcaagacgggatt

SEQ ID NO: 2671 - DNA, 745 bp, Artificial
  Synthetic
tctttttgagccaagagggagagagggagggggagggagaaggaaagaaaagcttgacgacggagctatggcgaagcctgtggggggaggagcgaagaaggcgagggcatcccggaatagggaggtggtgcggggagtcgggcggtgtagccggtcccagatgtaccacaagaggggcttgtgggccatcaaggccaagaacggtgggtttctccctgcccatggtaagacccaggtcgcccctcaagcccccttagccaaggcccccaagttctaccctgccgacgatgtcagaaaacccctctgcaataagcgcattgctaagcctactaagctcagatccagcattacacccggaactgttctaattctccttgctggacatttcaagggaaagagagttgtcttcctgaagcaacttgagtctggattgcttcttgtcactggccctttcaagattaatggggttcctattaggcgtgtgaatcaggcatatgtgattgcaacctcgactaagctcgacacaagttccgtcgacaccagcaagttcaccgatgcatatttcaagagggaggttgagaaaaagaagaagggcgaggctgagttctttgaggctgagaaggagaagaagaccctccctcctgcaaggaaggaggatcagaaagagctcgacgctaagctggttccagtcatagagaagattccagacatgaaggcatatttgatggctagattcagtctcaaa

SEQ ID NO: 2672 - DNA, 568 bp, Artificial
  Synthetic
cccacgcgtccgaagttctaccccgccgacgaggtcaagccccgcgcccccagcacccgcaaggccaaccctaccaagctcaggtcgaccatcacgccggggacggtgctgatcctgctcgccgggaggtacatggggaagcgcgtcgtgttcctcaagcagctcaagtccggcctgctcctcatcaccggaccttttaagatcaatggagtgcccatccgccgtgtgaaccaggcctacgtcattgccacatccacgaaggttgacatctctggtgttaaggtggataagtttgatgacaagtactttgcccgggacaagaaggcaaaggccaagaagaccgagggtgaactttttgagacagagaaggaggcaaccaagaatctgcccgacttcaagaaggatgaccagaaggctgtggatgctgagttgatcaaggctatcgaggttgtcccagacctgaaatcctatcttggtgcccggttctctctcaggtacggcgacaagccccatgagatgacattctaagttagtcggtacaagtttcaagttctgaggaagtcttttt

SEQ ID NO: 2673 - DNA, 624 bp, Artificial
  Synthetic
acaacaccctaaacatcaaaaatgtccaagcagatcggaggagccaagaacggcggtagccgaaccgtccccactgagaaggcccccaagtggtacgtcgctgagcccactcacgtcaagatccccaccgtccagaacaagtccaagctgcgaccttctcttgttcccggtgccgtactcattctccttgccggccgattccgaggcaagcgagttgttctcctcaagtctcttgaggatggcactctccttgtgaccggtcccttcaaggtcaacggtgtccctctccgacgagtcaacgcccgatacgtcattgccacctccactaaggtcgatgtctccggtgtcaaggctgacaagttcacccctgcctacttcgctcgatcttccgccgacaagaaggccgagaagcagttcttcgccgagggcaagcagaaggagctcaaggccgagcgagtcgccgaccagaaggacgtcgatgctgctctcattgccgagatcaagaagactcctcttctcaagcagtacctggcttcccagttctctctcaagtctggtgacaagccccacctgctcaagttttaaattataaaaacacaaaatggaacatgggggtggaaaatg

SEQ ID NO: 2674 - DNA, 690 bp, Artificial
  Synthetic
tcctctccacacccacatatcagacacccgagagagtcaatatgtcggccaagcccacgaccaagcagttcgggaagtcgacccgggaggttcccgcctccgcggaccaggcgaagaagtggtaccctgccgacgacgagagcgccccgaagaaggttcgcaagtccgtccgaacttgggccccccgaaagaccctccagcctggtaccgtcctgatcctcctcgctggccgcttccgcggcaagcgtgtcgtcctcctcaagactcttgaccagggtgttctcctcgtcactggtcccttcaagatcaacggcgttcccctgcgaagagtcaacgcccgatacgtcatcgccacctcctacaaggtcgacatctccggccttgacgccgccaagattgaggagatctctcagcccaagtacttcaccgccgagaaggccaaggagaaggcttccgctgaggctttcttcaagcagggagagaagccccagaagaaggagatcaacagcagccgtgctgctgaccagaaggccgtcgacaaggctctgcttgctagcatcaagaaggtggatctgttggccagctacctcgccagcaccttcagcctgcggaagggtgacaagcctcacgagatggcgtggtaaatttgattcaaacacaaaatctctctggcaggtcgaaagcacgggg

SEQ ID NO: 2675 - DNA, 784 bp, Artificial
  Synthetic
ccgctcaaaaactagggtttactctctcgccagagcagcttctcttctccaatggcgcccaagaaaactctccgtaacccagaactaattcctggcctgggaaaattctcacgttctaaaatgtaccacaagaaaggtctctgggcaatcaaaaagaaaaacggcggcacatttccatcccacagcaaaaaacctgccgccgccgctccggtaataaaacccccaaagttttatcccgccgatgacgtagcaaaaccgcttgtgaacaaacacaagccaaaacctacaaaactcagagcaagcattacacctggaaccgttttgattatcctagctggtaagtttaaggggaaaagagttgtgttcttgaaacagcttgcgtctgggcttctgcttgttactggaccgtttaagcttaatggagttcctttaagacgtgtgaatcaagcttatgttattggtacctcgactaaggttgatgtttcgggtgtgaatgtggagaagtttgatgataagtattttgctaagcaggttgagaagaagcagaagaagggagaagaggagttttttgaagacaagaaagaggagaagaatgtgcttccacaagtaaagaaagatgaccagaaaaccgtagatgcagctttgctcaaggccattgatggagttcctgaattgaaggcttatttgtccgcgaggttctcactcaaggcagacatgaaaccacatgaacttgtcttttagaggaacaacatctacaacacttttttttggataaattgatttt

SEQ ID NO: 2676 - DNA, 796 bp, Artificial
  Synthetic
cccccccccccgaaaccttcactgctccatatatggatgcacattactaggtttagggttttattgaatcagcattctgcaaaagcaaaggagaacttctactttcagcaatggcggcaaagaagagtccccgtaatccagagctgattcgtggagtgggaaaactttcccgttccaagatgtatcacaaaaagggtctttgggcaatcaagaagaaaaacggcggctctttccccgtccacaaaaaagccgccgccgtcgcaccaccggccgtcaaaccacccaaaatttaccctgccgatgacgtggcaaaaccccttgtcaacaaacacaaaccaaaaccaacaaaactcagagcaagtattacacctggtactgttttaattatccttgccggtaagtttaagggtaagagagttgtgtttttgaaacagcttaaatctgggcttttacttgttagtggaccatttaagcttaatggtgttcctttgaggcgtgtgaatcaagcttatgttattggtacttcaactaaagtggatgtttctggtgtgagtgttgagaagtttgacgataagtattttgcaaagcaagctgagaagaaacagaagaagggtgagggagagttctttgaagacaagaaagaggagaagaatgtggttcctcagggaaagaaggatgaccagaaagctgtggatgaagcattgatcaaggcggttgaatgtttcctgaattgaaggcttatttgtctgctaggttctccctcaagtcgggcatgaaaccccatgagcttgtcttt

SEQ ID NO: 2677 - DNA, 471 bp, Artificial
  Synthetic
gcccacgcgtccgcgatgataaagttgtggggtaatttagatagagatgattcggctgcaacgctgaaaagtgttgatcaaactggtaggattcagttcattattgttccttcgcccttcgtggatcgacgcttcgcttaacagtggcagtgctcgcggatgatgatccgtctgacgcgatctggaggcggacccagaatgtggatgagggaatctccacaaggcgtaactccttggtttactcttgttcgcacacagatgtatcttgagagttgttaaggctataacgagtgcggttgagatacgtctacgactaagcatcttgagcagagtgttagttgcgaaacgttcaattgactaagtaagagtagagagtatcaagcctgcaaatccatccccccgaatctccgattttatgagccaccatagctcttttcgccaaatgcaaatgccgtagatagtgcccatccg

SEQ ID NO: 2678 - DNA, 411 bp, Artificial
  Synthetic
gtctttcaggtgcccagagaagacagctcgcaaagtgcggaagtcttgattgaccaggatggagatttggatggttttgatatgaaaggcttaaaagaccaagttcttgtattcaagtacagagggaaattccacgccgttgatcataaatgccctcattcgtcttaccccctctcacaagccactccatttgacattgaggattttggcgttgtcttgagtgcaggactgacctgtccaaaacatggttggtcgtttgatctgtttactggctcaggagaccgtggaaactatcagcttggactttgggaaactcagttgcgtgaagtaaagaattcggatacatcagcagacgaggcttcaggttccgcggaacaggaagtatgggttcggagaaaacagcgacagcgc

SEQ ID NO: 2679 - DNA, 475 bp, Artificial
  Synthetic
gcatagcgagtggcttcgttggtggtttgagggctggagccccggtgcccagacaatgagatttgtggagttttacccgtgttggttttctttagtgacgtattgatgaacaggtacaacgacttcaggcgatcggcggcgacgcttatttcttgcacgcccccttggatgggtcccgcgagaaccttggtaggtttaaaggaggtagctgtgctccgtaacggggttgttatttataggctagtattaaggagctgaatgacgcgctcgtgtcgaacccaggaaatggaatattcatttttgtgtggtgatggcgacagagagtagggtttggttaccccgaagaaagcaagatcgagattgaagtgtgtatcggcgatttatcagatctaggccgacttgagcatgtgagatgacacgagctaacaccagcatgatacagctggcagtcaataagagacaaagcttgttgtac

SEQ ID NO: 2680 - DNA, 424 bp, Artificial
  Synthetic
gcgccgacccgagctgtggccggtgtggcaagcggcctgtcccggctggtgcctcgttctcgtccacggctgccaattgcctctgtttctattacagcaaagacgacggcatcatcgcgatggcactcgggcttctcgtcggtcaaccccaacgaggtctcacacttcaatgccctcgccgctgagtggtgggagccgcacggatcgtcgcgcctactacacctcatgaacccgctgcgccacgacttcatccgctcctgtcgcgagtcctccgacgacctcaattccatcacatacctcgacattggctgcggcggcggcatcttcgctgagagcgccgcccgcctagccaccaccaagcacgtcaccggcatcgatcccacaccgtccgtcctcaacgtcgcaaaagcacatgcccgcaaag

SEQ ID NO: 2681 - DNA, 626 bp, Artificial
  Synthetic
ctttggactgccccttcctcccgatgcaatttggctgaaaatattgatagttgcctacttttttggctctttcctcaaccacaatctcttgctcgccattcatgagctcagtcacaacctcgatttctccactccagtctataaccgatggcttggcatttttgccaaccttcccattggcgttcccatgtctgttaccctccaaaagtatcaccttgagcatcatctctaccaagatgtagatggatttgacatggacattccacgccttgctgaagcacatgccgtcaaaaacgtcatcacaaaatctgtatgggttgtcctccagctcttcttttatgctctcagacctttctttatcaaacctaaaccacccggtatgtgggagttcatcaatctgattatccagctatgctttcatggagccatggtttacttttggggtaggaaatcctttgcatatctgatcctgtctacttttggtgggggagggatgcacccgatggctggtcgcttcatttccgagcattatgtcttcaagtctgaccaggaggcatactcctattacggtccccttaatcttatgatgtggagtgtcggataccacatcgagcaccatgatttcc

SEQ ID NO: 2682 - DNA, 544 bp, Artificial
  Synthetic
aaaaggtgagaggtgaaaaaagagggagcagaaaatggggtttgaaggggaaaagagagaagaggaagaaggagtagtaatggctaatgatttcttttggtcatatactgatgaacctcatgcttctcgtagaaggcaaatcctttctcagtaccctcaaattaaacagctttttggccctgacccttttgcctttctcaagatatctggagttgttttacttcagctttggactgctaccttccttcatgatgcaagctggctgaagatgttgatagtagcgtactttttcggctcttttctaaaccacaacctcttcttggctattcatgaattaagtcataaccttgctttctctactccagtctacaaccgttggcttggaatatttgccaaccttcctgtgggtgtgccaatgtctgtcaccttccaaaagtatcaccttgagcaccatcgcttccaaggagttgatggaatcgacatggacatcccgagccttgctgaagcccatgtcgtaaaaaatgtacttgcaaaatctatatgg

SEQ ID NO: 2683 - DNA, 539 bp, Artificial
  Synthetic
atttgatctttattctctttaatgttctcagaaaccaatacgacaaagtcaactacatgatgagctcccacaagaagaagaacgacaacaacaacagcagcaacatcccggaggcaccactgccgccaacattcaaggagcagctcgaccaggaggcgatcgacagccgggttcaccagcatgagagcgaagaacactcgacagtgaaggatattgtcgataagatatcgcatgccattcctgctgtcgcccctctcatcggcggatcaaatccagacaacaaggtggaggagcataaagaggtgcctccggggcctcctaatcgaccagagcatgatacccagattgaagagtttgtgagggagcagcatcgaagcaacggcatcgagaatctgagcgagggaaagtcgtgatggattcatccacgctctcggttcagcagagtttcttcatgtaccaatagccatcaagcttttactttttcttgctttaatacagtgaaacctgcggctactatgcaggctctttacagataatcc

SEQ ID NO: 2684 - DNA, 501 bp, Artificial
  Synthetic
ggatttgcgaaagggcgagattttgggtgtgaggcggcagacggtgattggggcgatttgggcagctctgccaagggttgggttcatgaagatacagtacgtgttagtgatgtgaagctgctccatgatgggactcggaatggcggacggatgcggtcatgggcttttggagattggcttttcttggtgggccgagacggcatctaactggagatttgatgaaggggaattcgagctatcaatacggatatgcaggactggatgattctgatttgatggcccgaggtgaaacttgtctggaaacttgattcgggggcagcgagaaagattgcccaacgaccgggtgtcttttctttcttcctctctttgtctaagatgtacgagtacgtcggcggcagggcgagcacagttagccagaagcaaggggatggactttttgacacagacatacggagtacagaagaagaagatgcagggagcgtcatcctcccgcaagatgtc

SEQ ID NO: 2685 - DNA, 817 bp, Artificial
  Synthetic
gaatgaaaggggaaaaaaggccagcatggcacgctcgcacccaagaacaaaaaaaggccggagcactaataggcacggcatgggggcctcacgccatcgattgtgtaataggcgtacgacggttacgacaggaacgtgccacaaaaggaggggtgggaaaacggatgacgggaacaaggaggaaaactggctctttaagttccaactttgttgccaatagccagtcgctgctgtctgtgtttctagtttctacggagcatgaacctgtgagaacaagccacatcggggagacgggaagatggtgacacggatgcgtttgtggaggtgggtaagctttgcgcaacatgtgccagccttatcttgatattggacgcggcgacggcgagatggttggaagggtgtgtctatgtgtaccgacaaacgcatggctgatgagacggtgaataaaactgcaccaagaaagagatgcatgagagatgaatgaccagtacctaaggtctatgacatgtcgctttgcactcggtcggactcattcacatgtagtaaatactacataacacccacttgctccagtaatcatcacttataataatacggcgagaagacaagttgacacagggcgaaacagggcggaacaaggggcgaagcgaggtggaaaatggtaaacgcagagactctttctatgtactagccatcgatcaaaaggaaggacagctcagtcttcgctgcatgctaaagcagcggccgatgggatggggctccaaggcaaggtgtaataccgagtacatgcatatcaaaaaagaaaagacgaaacgtt

SEQ ID NO: 2686 - DNA, 353 bp, Artificial
  Synthetic
tttttctcgcaactcgctgcttggctccagtatctggcattagcacctgttgtgtgcgttggcctgccgtaggttgatgcatctgcagctgcagcgtttccgcatcacatcaccttcatcttacatgacaaaccccctctttttactcccttcgatacggttattggttcgaaggctttacaattcagacgtgcaggcactaagacatccatctcgactgttagaggttgtcttgctgcagacgttatcgtaccagcacggcttatatagcaccagacagacccctccgctgcagctggtttacttctttttattaatctcaactatcaccacggctacctattcttcacttc

SEQ ID NO: 2687 - DNA, 418 bp, Artificial
  Synthetic
  misc_feature (183)..(183): The residue at this position can be any nucleotide.
atcttgggatgttctgcagacgattgtcaaagccggattaaccccgcaggcattgatggctgtctctcatctccactttgcatcctgttgttggggtaaaagaataagctcaccgtcattgctcagcttctcgaaatcgtgaagaatgaatcgccgaaaattgattacatgtactcaccaggnacatgtaggcagcttcatatttcactcctccgacgtctcggctagacttagccatgtcgatcaagcatgagcaaatcccacattgttagctgtcaatcattgtccagtgtcatctccccacgtggcaaagacggcgtcaatcaatttggacaatccctgtgatatcttagacgcatccttggcatcttctaaatgcttagagttttgagctgaaaatcggtcattaaagtaacgc

SEQ ID NO: 2688 - DNA, 329 bp, Artificial
  Synthetic
tgaagatttgctttgttttctaagttcagggggtgcaattgagtcttctaaagcgtgctggtgcaacattcaagctgacgttggataaaccttcaaccgtaactcttgtacctctcaagacatcagaatcagatgatggatggattgatgaactgacctgcatctgcccactcaacaatttaatccagtcgagcttctacaacgccaatctcaaagctcacaactctgtattcactcatcttgaccaattctctttcagtttgacctcaatcactctttccctcatgaagaccgacgacgcagtgtcacaaaccaaaaaaataaaaaaa

SEQ ID NO: 2689 - DNA, 488 bp, Artificial
  Synthetic
ggtggcattgagacatccaacgaggagcataggcatggctagacctagaatagctctgctggcccgacttgcccacaatgcccaacctggccttctctgcttttctctccttcttcatcttcatcaattgggagagccatgtcaaccatagcccaacccaagaccatcacttgccgagctgctgttgcttatgaagctaatgcaccattgaaaattgagaaggttgaggttgcacctcccaaagcccatgaggtgcggatcaagattacccacacagccttatgccacacagacttgtacactttgagtggaaaggatgcagaagggcgttttccttgcattcttggccatgaagctgccggaatagttgaaagtgttggagaaggtgttacggaattgcagccgggtgataaggttattccatgctacatagcagaatgcagagaatgcaggttctgcaaatctgggaaaactaatttatgtgggaa

SEQ ID NO: 2690 - DNA, 592 bp, Artificial
  Synthetic
acacatcatgtctaccgaaggaaagaccatcacttgcaaggccgccgttgcctgggaggccggcaagcccctgacccttgaagacgtcgaggttgctcctccccaggcccacgaggttcgagtcaaggtcacctacactggtgtctgccacaccgacgcctacactctcagtggctctgatcccgagggaatcttcccctctgttctgggccacgagggtgccggtatcgtcgagtctatcggcgagggcgtcaccagcgtcaagcccggagactccgtcattctgctctacactgccgagtgcaaggagtgcaagttctgcaagtccggcaagaccaacctgtgccagaaggtgcgagccacccagggtaagggtgttctgccagacggaaccacccggttcaagtgcaagggcaaggatctctattcgtatatgggctgctcttccttctcccagtacactgtggttgctgacgtctccctcgtcgccgtcgacccctctgctccccaggaccgaacctgtctgctcggctgcggtgtcaccaccggctacggagctgccaccgtcaccgccaatgtccagaagggcgac

SEQ ID NO: 2691 - DNA, 685 bp, Artificial
  Synthetic
gtctgactaacacaatggcttcgactgttggcaagaccatcacctgcaaggctgccgttgcctgggaggccggcaaggagctgagcattgaggatgtcgaagttgctcctcccaaggctcacgaggttcgcgtgcagatctactacaccggtgtctgccacactgatgcctacaccctctctggcaaggacccggagggtgctttccccgtcatcttgggacacgagggagctggtattgtcgagtctgttggcgagggcgtcaccaacgtgaagcccggcgaccacgtcgttgctctctacactcccgagtgtaaagagtgcaagttctgcaagtctggcaagacaaacctctgcggcaagatccgagccactcagggccagggtgtcatgcctgatggcaccagccgattcaagtgcaagggcaaggaccttctccacttcatgggaacatcgactttctctcagtacactgtcctcgccgacatctccgttgtagctgtccagcccgatgcccccatggaccgcacttgtctccttggatgtggtatcaccaccggctacggcgctgcccgcatcaccgccaaagttgaggagggttccaatattgccgtttttggagctggatgcgttggcttgtcagtcgttcagggagctgtcgtcaacaaggccggtaagattatcgt

SEQ ID NO: 2692 - DNA, 732 bp, Artificial
  Synthetic
caacgaactgcgagtgattcaagaaaaaagaaaacctgagctttcgatctcttcggagtggtttcttgttctttgaaaaagagggggattaatggcgacagccgggaaggtgatcaagtgcaaagcggcggtggcatgggaggccgggaagccgctgtcgatcgaggaggtggaggttgcgccgccgcaggccatggaggtccgcgtcaagatcctctacaccgccctctgccacaccgacgtctacttctgggaggccaaggggcaaacacctgttttccctaggatcttgggccatgaagctggaggcattgtggagagtgtgggagagggtgtgaccgaactcgcgccgggcgaccatgtcctcccggtgttcaccggcgagtgcaaggagtgtgatcactgcaaatcggaggagagcaacatgtgtgacctcctcaggatcaacgtcgaccgcggcgtcatgatcggcgacggcaagtcccgattcaccatcaaggggaagcccatcttccactttgttggcacatccaccttcagcgagtacaccgtcatccatgtcggctgcctcgcgaagatcaacccggaggcgcctctcgacaaggtctgcattctcagctgcggtttctctaccggttttggtgcaacagtgaatgtcgcgaaaccgaaaaagggccagaccgtggctattttcggtcttggagctgttggtcttgctgctatggaaggtgc

SEQ ID NO: 2693 - DNA, 634 bp, Artificial
  Synthetic
cacactgctgcagtgctgcttaagctcgccatccagccgcaatggaagatcagagcctgaagcccatccgttgcaaaggtacacaattcacttacagagatcagatctgcatagctccttggtactactactactactactcaattcctcacgcatgatatatgattgatacatatcgacgacgacgatgcagcggcggtctgtagagcggccagtgagccactgatcgtcgaggagatcgtcgtcgatcctccgaaagcctacgagatccgcatcaagatcatctgcacctccctgtgccacaccgatgtcaccctctggcacaaggtagaccctgcctttccaagaatcttgggccacgaggcctacggggtggtggagagcgtgggggagaacgtggaggggctcgcggcgggggacacggtggtgccgacgttcatggggcagtgcgactcgtgcgccagctgcgcggcggagtggacgaaccagtgcaccgccgtgccgttcaccatgggccccgggatgcggcgcgacggcacaaccaggttctgggacggcgaagggaagccgctcagcgacacggtggccgtcaccagcttcagccagtacaccgtcgtcgacgtcaaccaggtcg

SEQ ID NO: 2694 - DNA, 610 bp, Artificial
  Synthetic
gaagaaaccttcctataagaaagcccgaaaactagaccacaacagcgacatggctaccaatggcatttctcatgtaaatggttcgcttggaaaagttatcacttgcagagctgctgtagcctacggtccagggcaacctttggtcgtagaacaagtgcaggtggatccacctcagaaaatggaggtccgaattaagatcctctttacttccatatgtcacacagatctcagtgcttggaaaggcgagaacgaagctcaacgagcttaccctcgaattctaggacatgaagcctcaggagtggtggagagcgtgggagaaggggtgaaagatatgaaagcaggagatcgcgtagtaccaatattcaatggagaatgtggagactgcatttactgcaactctacaaagaaaaacaacttgtgcggcaaattcagggtggatgcgttcaaaagcgtgatggtcaacgacggcaaatgcaggttcaggagtaaagatggcaaccccatctatcatttcctcaacacttccacatttagcgactacactgttgtcgactctgcttgcttagtcaagattgaccccaatgccccacttgacaagatgaccttgctt

SEQ ID NO: 2695 - DNA, 544 bp, Artificial
  Synthetic
cctgatagtcagttcattaaaattactactctagaaaaaaagaataagttactgtagcagacggataaaaagataccagataccaacaacaatgtcaaccaatactgctggtcaggtcattcgttgcaaagctgcgattgcgtgggaagccgggaagccattggtgatagaagaagtggaggtggcaccaccacaaaaaagtgaagttcgcctcaagattcttttcacctccttgtgccatactgatgtttacttctgggaagctaaggggcaaacaccactatttcctcgtattttcggacatgaagctggaggaattgtggagagtgtaggcgaaggtgttacagatctccaaccaggagaccatgttcttcctgtgttcactggtgaatgccagcagtgtcgacactgtaaatcagaggaaagcaacatgtgtgacctccttagaataaacacagacaggggagttatgatccatgatggtcagacaagattctccaaagatggcaagccaatatatcactttgttggaacttccaccttt

SEQ ID NO: 2696 - DNA, 237 bp, Artificial
  Synthetic
cccacgcgtccggtcttcctgcgttactggcgactcagggacaggttatcacttgctaagatgcgggggcttactagccaaacaagcctctgttcatcgaaaatgtgcaagtggctccacctcaagctggtgaggctcggatcaagatcctctacactgctctttgtcacaccgacgcttacacttggagcgggaaggatcctgaagggatctttccttgtattctaggtcatgagg

SEQ ID NO: 2697 - DNA, 565 bp, Artificial
  Synthetic
gggcttcgcgaagagcaatctcttctagttctagaaacaagatcatcaaatgcaagctgctgttgcatgggaacctggagcacctctccagatcgaagacatcgaggtctccccgcctagatccaacgaagtccgggtcaaaatcactcacacttcgctgtgtcaatcggacatcactttctggcaggataagcgaatgaattttttgttcccccgaattttcggtcacgaagcagccggggtcgtggaaagcgtgggagacggcgttgaaggcattcacgaaggagaccacgtcgtgccactcttcaccggcgagtgtggcagttgcaagtattgcatttcccacaggaccaacctgtgtggacctttacgagtgaatcccgagtacacgggcgtatatggtggagaagggacgcgattcaaaaaaggcgacgttgatatctcgcacttcatgggcacttcgaccttcagccagtacactgttgtcaacaaaggtcgtgttgcaaagatcccgaaggaagctccactggaccaagtttgcttgctaagctgcggtatcacgact

SEQ ID NO: 2698 - DNA, 606 bp, Artificial
  Synthetic
ggcgtcaacagctggcaaaacgatacaatgcaaagctgctgttcttcatagtcttggatctgattacatctttgcgacgatcaatgtggagccgccacagtctggggaagttcgcattaaaatcctctatgcttcgatatgtcacacggacatgtcctttcccgagtatctccccaactttccacaaatcgttggacacgaaggatctggagtggtggaaagcgtaggagagggggtgaccgaatttgttcctggtgattccgtcatctgcgtctatcaaggagaatgtggcaagtgcaagctgtgcaacctctccaaaacaaacttttgcgagttcagcatcgcgagcttgctgaagcctgtcatggcctccgacggaaagacgcgcttctctctgctcgatgggactccggtgtcccactttggaaactcctccacattctccgagtacaccgtcgtggccgccacttccgtcgtaaaaatggatactattcctctcgaccttgctccgctactcagctgcggagttcccactggcttgggatcgtcactaaacatagcaaacgtcgaagccggttccacagtggctgtcatcggactcggaac

SEQ ID NO: 2699 - DNA, 650 bp, Artificial
  Synthetic
ggcagcagcaggtttctctctcccggagctggggatccagattcatggcgtctggcgaccgcgggcaaggtcattacgtgcaaggccgctgtggcctatgaggccgggaaggcgctcgctatcgaggatgtggaagtagctcctccacaggcaaatgaagtacgcatcaagatcacacacactgctctctgtcacaccgatcactacacactcagtggacaggatccagagggactttttccatgcattctcggtcatgaagctgccgggattgtggagagcgttggagatggagtgaccgacgtgaaacccggagatcacgtcattccctgctaccaggccgaatgcaaagaatgcaagttctgcaagtccgggaagacgaacctgtgcatcaaagttcgtccggcgaccgggaaaggcgtcatgctctcggatggaaagccgaggttcagcgtcaacgggaagccgatctaccatttcatgggaacttcgactttcagccagtacacggtcgtgcatgacgtctccgttgccaagatcagtccagaagccccgctagacaaggtctgcttgctaggatgtggtattcctacaggtcttggtgccgtttttaacactgctaaagtcgagccaggatcgacagtcgggat

SEQ ID NO: 2700 - DNA, 274 bp, Artificial
  Synthetic
gctgctgtggcatggggagctggagagcctctagtaatggaagatgtaaaagtggatcctcctcaaagattggaagtgagaattcgaatcctcttcacttccatctgtcacactgatctcagcgcatggaaaggcgagaacgaggctcagcgagcataccctctaatccttggccatgaggcagcaaggatagtggagagcgtatgggaaggtgtggaagagatgatggcaggagatcatgtgctccctattttcacaggagagtgtggagact

SEQ ID NO: 2701 - DNA, 366 bp, Artificial
  Synthetic
cccacgcgtccgcacacaccaaacaaaacaaaacaaaaaacagagagatggaaaacggaaactcctccagcgacaacaaatcttcacataaaccgatccgatgcaaagcggcggttagtaggaaggctggagagccgttggtgatggaagaaatcatggtggcgccgccgcagcctttcgaggttcggattcgaatcatctgcaccgcgttatgtcacagtgacgtcactttctggaaactccaagttcctccagcctgctttccgaggatactaggccacgaggcaataggcgtagtggaaagtgttggtgaaaatgtgaaggaagtggtagaaggagacaccgtactaccaacgttcatgcctg

SEQ ID NO: 2702 - DNA, 801 bp, Artificial
  Synthetic
aagggaagaagaaagtggggaaagaaaataataatttaagtgggctgggctttgacatggaaaagaacggcttagtaataattgaagttagaatcgcatctatttgaagtgccactcatccctcagaaaaacactgttagtattttcactcacaaattcattctgtggtccgaattggagttcatagatcatggctacacaaggtcaagtcatcacctgcaaagctgcggtggcctgggaacccaacaagcctctggtgatcgaggatgtacaggtagctccaccacaggccggtgaagtccgtgttaaagttctctatactgctctctgccacactgatgcttatacctggagtggcaaggatcctgaaggtctcttcccatgtgtgcttggtcatgaggctgcagggattgtagaaagtgtcggtgaaggagtgactgaggttcagccaggagaccatgtcataccttgttaccaggctgaatgcagagaatgcaagttctgcaaatcaggaaagaccaacctttgtggtaaagtaagggcggctactggggtaggagttatgatgaatgaccgccagagtagattttctatcaatggaaagccaatctatcatttcatgggaacttcaaccttcagtcagtacactgttgtccatgatgttagtgttgcaaagattgacccagtagctcctctggagaaagtctgccttcttggatgtggtgttccaaccggccttggagctgtttggaacactgcaaaagttgaaccaggttccattgttgctgtctttggcctggg

SEQ ID NO: 2703 - DNA, 570 bp, Artificial
  Synthetic
ggaactactccagctatggcttccactcagggccaagtcatcacttgtaaagcggcggtcgcatgggaggcgaagaaacctctcgtggtagaggaggttcaggtggcccctcctgcccaaggagaagtcaggatcaagattttgtacactgcattatgtcataccgatgcctatacgctcgacggactggattccgaaggccttttcccctgcattctcggccatgaggccgcagggattgttgagagcgtgggggagggagtgacagaactgcaaccaggtgatcacgtgatcccttgctatcaagcagagtgtagggagtgcaagttttgcttgtcggggaagacaaacctttgcggcaaggtgagggttgcaacaggggttggggtaatgctgagcgaccgccagagccggttctcttgcaaggggaagcccttatatcacttcatggggacgtcgacttttagccaatacacagtagtccacgatgtcagtgtcgccaagatcaagcccgaagctcccctagagaaggtttgactcctcggatgcggcattcccacaggtttgggg

SEQ ID NO: 2704 - DNA, 89 bp, Artificial
  Synthetic
gaacaaagacacgctgccagcattgggcaaaacagcttcaacgagggcaattgctgggaggaaaacggcgtcaattggcagcaggagag

SEQ ID NO: 2705 - DNA, 873 bp, Artificial
  Synthetic
gcgagacaacaacaatcatggccgctatccgctcctcgatgcgagtcctcagctcctctactagggcagctttccgtcccagtgccgtcttctcgcggtccatggcatcggtcagcgagactactgagcagcagcccaagatcaagtcgttccagatctaccgatggaatcccgataccccgaccgagaagcccaagcttcagacctactccattgacctcaacaagacgggccccatgatcctggatgccctgatcaagatcaagaacgagcaggacccgtccttgaccttccgaaggagttgccgagagggcatctgcggcagctgtgccatgaacatcaacggccagaacaccctggcttgcttgtgccgaatccccgccgagtcctcgtccgatgtcaagatctaccccctgccgcacacctacgtcgtcaaggacctggtacctgacttgacgcacttttacaagcaatacaagtccattgagccctacctgcagcgcgacacccctgctgaagatggcaaggagtaccgccagagcaaggcggaccgaaagaagctggacggtctctacgagtgcattctgtgcgcctgctgctcaacctcgtgcccctcttactggtggaattccgaagagtacctcggtcccgccatcctgctgcagtcctaccgatggctgattgactcccgagacgagcgcacggaggcccgcaagtccaagctcgagaactccatgagcctgtaccgttgccacaccatcctcaactgcacacgcgcctgccccaagggcctgaaccccggcaaggccattgccgagatcaagaagcagatgtctcttggggcataaggggcagggttggaattgttacaat

SEQ ID NO: 2706 - DNA, 718 bp, Artificial
  Synthetic
atcgagatgttccgggcagctggagcgatcgcgacgcgcgccaggtccggcgccgcggcagccgctagcactgtaagtatcagggcaagcgccacggccgtggattccgccaaggaatcctccaagccagctccaaacgtcaaggaattctcgatctaccgctgggatcccgactcgagcggccaccccaagcagcagatctacaagctcgacctaaacgaatgcggtccgatggtgctggatgcgctcatcaagatcaagaacgaggtcgaccagggtgtaacttttcgacgatcttgccgcgaggggatctgtggttcttgcgccatgaacatcaacgggaggaatggcctggcttgcctgaccaagatcgacaaggaggcatcggtcacgtccattcttccacttccacacatgtacgtgatcaaggacctggtggtggatctgaccaacttctatcagcaatacaagagcgtggagccgtggctcaagagcaagactgtgctggaagccgggcagaaggaacacttgcagagcaagaaggatcggctgaagctggatgggatgtatgagtgtatactctgtgcttgctgcagctcgtcgtgcccgagctactggtggaatccggagaagttcctggggcctgcggcactgcttcatgctcacaggtggattgctgatagccgggacgagtacacgcaggagaggctggatgcca

SEQ ID NO: 2707 - DNA, 399 bp, Artificial
  Synthetic
tttgatcggaagattggttggaacgaaaccgtcgaaattagccacggcggcgaggttaattccggcgagatggacctctacaggagcggaggcggaaacaaaagcttcctctggcggcggaagaggatcgaacttgaagacttttcagatctatcgatggaatccagataatccagggaagccagagcttcaaaattaccagatcgatctcaaagattgtggtccaatggtattagatgctttgattaagatcaaaaacgaaatggatccatctcttactttccgtagatcatgccgtgaagggatctgtggttcatgtgctatgaacattgatggatgtaacggacttgcttgtttgacaaagattcaagatgaagcatcggagacgacgattacacc

SEQ ID NO: 2708 - DNA, 525 bp, Artificial
  Synthetic
taagatcgattcgtgtgctgaatcgacgattacgccgttgccacatatgtttgtgattaaggatctggttgtggatatgactaatttttataatcagtacaagtctatcgaaccttggttgaagaggaagacggagccgccgacctctgggaaggagataccgcagagtaagagtgatcgggcaaagttggatgggatgtatgagtgtattctttgtgcttgctgtagcacatcatgccctagttactggtggaatcctgagtcttatcttggtccggctgcactgcttcacgctaaccgatggattatggatagccgtgatgaatatactcaggagcgcctggacgcagttaatgatgaattcaagctttatcgctgccatactattctgaactgttctcgtgcttgcccaaagggattgaatcctgggaagcatattcagaatatcaagcgtctggagcttgcatcttgagccagcagtgatgtcgttccaatctcttttgctaagatttgatttttaaggag

SEQ ID NO: 2709 - DNA, 665 bp, Artificial
  Synthetic
gggcagatcaatccggtcaatctcttcgacaaatgctgtagcaatacctgagcaacaaacatccttggcctctaccgagaagtcgcccaatctgaagaaattctcaatctacaggtgggaccctgacagtaactcaaagccggcaatgcacacctacaccatcgacacgaatgagtgtggcccgatggtacttgatgcgctaatcaagatcaagaacgagatggactcaaactctcactttccgtcgatcatgccgggaggggatatgcgggtcctgtgccatgaatatcaatggatgcaatgggttggcatgcctcacaaagattgacccgagccccgggaaggaggccactgttgctcctctcccccacatgtatgtcgtcaaggaccttgttgttgacatgaccaacttctacaatcagtataagagtatagagccctggctgaagagaaagagccccccagaagcagcggggaaagagcatttccagagcaagaaagaccgtgaaaagcttgatgggatgtatgaatgcattctttgtgcttgctgtagtacctcttgcccaagttactggtggaacccggagaaatatttgggtcccgcaaccttgcttcatgcacacaggtggatagctgatagtcgcgacgagtacacgaatgaacgc

SEQ ID NO: 2710 - DNA, 408 bp, Artificial
  Synthetic
gcaatgcttgagccaaaatattgcctaggggaggaaaccacaagagatagacctcggcaatttgttagcgatccatggattgattccatgactagctaaacgaggctagatgacatgaggcagcgtgagagagatggatgggacgagatctggtgggtttggtttgggaggcggtttggaggtttggggatcatacagtagtactagtactacaagtgctgatgatgcatagataatgtacttgaggggcgatgagatgcgatgcgatgcgacgcggtgcacgcgtatgtcatccatcagcggtgatgccctctcagacgagtacggagtcggtaccagacagcaatcaaaattggcgggtgttggctctgctctggtttaaccactgccccggcatgtacaactcct

SEQ ID NO: 2711 - DNA, 583 bp, Artificial
  Synthetic
gtggagtgtgcgtcgcaggttcgaacatccaaccttccacggacctgccgccatggtgctctctaatgatattgatcttctacaccctccagctgagctggaaaagaaaaagcataagctaaaacgtctcgtgcagtccccaaactcatttttcatggatgtgaaatgtcaggggtgctttaacataacgactgtatttagccactcacagacagtggtggtttgtggtaactgctctactgttttatgtcaacctactggtggtaaggctcgcctgacagaaggatgctctttcaggagaaagagcgagtagactgggcattgcttgcctcctaccattgcaagatttaattgcacgggtatttaatgtttttgttgaggagcatagaggataacgaagtatgttgagtcggtcattttgagtgttgtttcctgtcatcattactagacactgttgaatcatcggcatagaatcttggcactatgattttggaaaaatgcatagaattttagaaacatgatattggagacatttgattgttagcacttttgaagaatattaaatcatatgatagacatttta

SEQ ID NO: 2712 - DNA, 457 bp, Artificial
  Synthetic
ggcctccagccatggtgctctcaaatgacattgaccttctgcaccctccagccgagctggagaaaaagaagcacaagctaaaacgtcttgtgcagtctccaaactcttacttcatggatgtgaaatgccagggatgcttcaacataacgactgtgtatagccactcacagactgtggtggtctgtgggagctgctcctctgtcttgtgtcagcctaccggcggaaaggctcgcctgatggaaggatgctctttccgaagaaagggtgattaatttgatagaccatctttacccctcacccccgtaagcatattgctagagattggtggtggtattacatctgctgattgttcccgaggtttgtgggtctgtagcggtaggattaggtagatgaattagcatggaatcctgacaaacagttttggcaacattcaaattaattgaaaaacattacttca

SEQ ID NO: 2713 - DNA, 616 bp, Artificial
  Synthetic
cagcagcctcggaggttaaatagctttgccgcttttccaggtcgcgaaaatgactctctcaaatgatgtcgacttgttgaaccctcctgccgatctggagaagaggaaacacaaactcaagcgtcttgttcaatctcctaactctttctttatggatgttaagtgccagggttgctttaacataacaactgtgttcagtcactcgcaaactgtggtggtgtgcgggaactgccagactgtgttgtgccagccgactggtggccgtgctagactcaccgagggttgttctttcaggagaaagggagactaaagatgagagagagactacttgcttttcttttagagtggaagtgaaaaggttttatatgggaaacaaaaattcagttttgatgcaatcctgtttgtttttatttaatctctagtcttgagtaagaaagaaccaagggttttgaatctgttgaggatgctttgtttttttactaaattggattttgagtaaaaatatctgttgaattttcgcttatagtttgcttctcccctgaaattccctcttcaatttgtttgcctttttgcgtgctgttagggaaggtcaaaatttgaaatttggtttgatctt

SEQ ID NO: 2714 - DNA, 807 bp, Artificial
  Synthetic
ctccagcttgcgagcctctcaaatcgttgccagatttcgtcaagaccctcgacctcgcaagacactttacggcaaatttttttcgagacaatcagacaagatggtgctcgctgttgaccttctcaacccttcagcggcctctgaggccaagaagcacaagctcaagacccttgttcctcagccccgatccttcttcatggacgtcaagtgccccggctgcttcaccatcaccaccgtcttctctcacgcccagaccgttgtcatctgccagggatgcaccaccgtgctgtgccagcctaccggcggtaaggccagattaaccgagggctgctctttccgaagaaagtaaactgcccgcggggcggctttctttccttgggtactgatgactcttatggttatatggtggtgatcatctcggatctgcaaacaaaacatcatcgacgtgggggatagacattataccttgcgaaaataatcaatctcttttgcagatagaagatggaacacccaacacaggggcgtttgggggtctccggatatcttgcatggcacatcattcttctcgtttttccgtttacgcgccttgtaccacagagtcgtttcttgaggcaggaacaaaaaaaataaagcactgcatgggtgttcagctggagaaagcattcacttgagtgtctagatggatctttgatggactgactaggcgcgatgacgtggagccgctgatttgaggatcgcttcatacccggagtgcagtgggtagtggaggatagcagtgtgcttttgcgaaattcaaaggtttccact

SEQ ID NO: 2715 - DNA, 543 bp, Artificial
  Synthetic
agccctagcccccctcccccccgcgccgccaccacctcgctctccgccgccgccgccgccgtctccaacttcaagatggtgctctcgaacgacatcgacctgcttaacccgccggcggagctggagaagctcaagcacaagaagaagcgcctcgtccagtcccccaactccttcttcatggatgtcaagtgccagggctgcttcaacataacgactgtattcagccactcccagaccgtggttgtgtgcccgggctgccagaccgtgctctgccagcctactggtgggaaggccaggctcacggagggctgctccttccgccggaagagcgactaggttaggctgtgtggcttgttgttactgggacagaaatgccctgctgaacaatactatcccgttacccttcctgatgtgtactccataaattttgttaattatgcctacctgtttactgccctgcatgatgtagcaatgcgttatgtatcttgcattttgtgctggagaaagctacttcgtataatgcgtgcccctccaccttgttct

SEQ ID NO: 2716 - DNA, 375 bp, Artificial
  Synthetic
gaaacgaacgaattaaagcaaaatggttcttactcaagatcttctcaacccttctcctcagtctgaggcccgaaagcacaagctcaagactcttgtcccccagcctcgatccttcttcatggacgtcaagtgccccggttgcatcaacatcactactgtcttttctcacgctcagaccgttgtgacctgcggctcttgctccactgtcctttgccagcccaccggcggtaaggcccgactcactgagggctgctctttccgacgaaagtaaatgcagatcctttaggagcatctaaaatattaaaagagggggtggactgaaatacatacgaaaatttgaaatctcgatttgattaaaagaaagaataaaacaat

SEQ ID NO: 2717 - DNA, 568 bp, Artificial
  Synthetic
  misc_feature (551)..(551): The residue at this position can be any nucleotide.
cccacgcgtccgcatcttcgctgcttgtggcgcaacacacagcctcccctcactctcatttcaattcatcttgcgaaaatggttctttcaaatgattacgatttgttgaacccgccagcagatgttgaaaagaggaagcataagctcaaacgtcttgttcagtctcctaactctttcttcatggatgttaagtgccaaggctgctttaacataacaactgtgttcagccattctcagacagtggttgtttgcggaaactgccagacagttttgtgccaacctactggtggtcgtgctagacttaccgagggatgttctttcaggagaaagggagattagagagatagcattcaatttacattgaaatgaatcttcatatgggaattttgatgcagtactctattttaattttcactatctagtcttaattaagaacaagtgtttttgagtctactatgacttgattatgttatggttctaatttgagttatcccttttgaaattggattgttactacaatgttatctctgtggaggttccctgaaagtagntttctattctttttatt

SEQ ID NO: 2718 - DNA, 484 bp, Artificial
  Synthetic
tttcttttcctctttctcaatactctcatcgatctcatctcactgcgcctgcaaccatggttctatcaaatgacattgatctactgcaccccccagcttctctggagaaaaagaagcataaattgaaacgtctggtgcaatctccgaattcattcttcatggatgtcaaatgccagggctgcttcaacattaccactgtgttcagtcattcacaaactgtggttgtatgtggaaattgttcgactgtcctatgccaacctacaggaggaaaagctagactaactgaaggctcttctttcagaagaaagggcgattaagctaaatttccaacggttcatatgatctctcttttagctctgctcgaaaagaaacattgatatgttttcaatttcaaggcttttgtgatttcggtaaaatttgtcaatcagttttgggtatatgtatgaggcagcttaatgaaaatgcttaattagtgttcaagggc

SEQ ID NO: 2719 - DNA, 384 bp, Artificial
  Synthetic
gtagaatttaattattacgtgaagttttcctgtttaatactaatatttaataaaatatcatgcctctcgctaaggatttattgcacccgcttgcggcggaagaaaaacggaaacataagctaaaacgtctcgttcaacatcctaattcatactttatggatgtgaaatgtcccggctgctataagatcactactgtctttagtcacgctcaatcggaagttgtctgtcctggatgtttcacaattttatgtatgcccacaggcggtaaagccagattaacagaaggatgttcttttcgaagaaaacaacactaattttatgttcccttctgtaaaaaatttttttaatgttaaattaaataataaaatttaatttcgttttaag

SEQ ID NO: 2720 - DNA, 549 bp, Artificial
  Synthetic
gggctgcgtctcgagcggatcgaggaggcgaaaatggtgctcgcgaacgatatcgatctgttgcatccgccggcggagttggagaagaggaagcacaaattgaagcgtctcgtgcccacccccaattctttcttcatggacgtcaaatgccaaggatgtttcaacatcacgaccgtgttcagccactcgcagacggtggttctgtgcagcaattgccaaaacgttctgtgccaaccgacggggggaaaggcccgcctcacagaaggctgctccttccggaagaagagcgactgaataacacgagttttcctttgaaggtacacaagcaacaaaaaaacactaagaaaaaaagaaaagaacgcggggaggggttttgtagccttttgtagctggtgatggtttctataatcttcttctctactagtaagatggtgggaggctctcgagtgctctctaggggatccaacacggatttcccagtcacaccgaagcatctcatctatgtaatcctctcttttctcaatcgtaatcaaatgctctaaaatttgt

SEQ ID NO: 2721 - DNA, 639 bp, Artificial
  Synthetic
cagatggtggcgctcaaccatcccactcttgttcgcaagcttattctagctggaactgggcctagtgccggtgaaggtattgaaggtggtgatccggtcatttttgggcgtcttgcttcagcttcaaacgatgcagaagaaaagagcggctttttggagggcttttactccctgactgccaagaagcaatctcaaggcgggaactggtggaagcgtatgacaacggctcgccagaataggtctgattaccttggacctgaaggcaccaaggctcagatcgacgcagttcttcgctggtcgaaccctgaatatgtctctgagggctcatacaaccgtctgagcgagatcaagatccccgtcctcgtggccaacggcgacaatgacatcattatccccacagtcaacagctgggtcatgttcaagagactgaccaacgctgatgcccatctccacttatacccggatgtgggacatgggttcttgaacgagtatgcaggccagttctctggccttgtcaaccagttcctagacgcttaagtgggaatcaggcgttctttaaaggcgcgagtctatctatttatgggttgtgtggtttctattgggtctgggttatatataggcttcgtaactaaatttact

SEQ ID NO: 2722 - DNA, 613 bp, Artificial
  Synthetic
ttcagagaatcatttctatagtattcgtctcttgctttggttcccaaaagagccatcgaatccaccctggttgatgattgtatatcctcgatatccaagagtgaatatttttggtcctctcgaaccatccggaaggatggcggtagaagcctcgtgcatctgctgtatagagagttgttttttctcttgatgatctcgaccccgtcaatggtctgccttcgggcgcattggcggggtggatgtcgatggacgtctgacaggctttttttttcattacatttctgaggcttgccttggatgtgaagaagagtggaattcacattccaattttttctttcttttctcctacgccgctgtgttggaaaatgttgcctcgtccacaaagagtttcgatacaggccttggcgatgcttcttcatccaatggcgtgtccctggccagcattccctcgcttttttgatccatagaacctatagaactaggtgaatcgcaagaagatcaagccgatgatccaatgaatgcgacggtgaggaaatcgcccggctctctggctaatttgtgatgctctaaatattcatcgtaatacgcgatgcgaggccatctctggtatgta

SEQ ID NO: 2723 - DNA, 1095 bp, Artificial
  Synthetic
  misc_feature (190)..(190): The residue at this position can be any nucleotide.
tttcctccacagtctagacgaatccttccgcttttcgcattggatacctattaaaagtctccgtttccccccatcaattgagagcctctctcttcatctcgccaaaacgatatttattccgccgtctgtgtattcttgcccgcatctctcacaacaccggcgtatcctgtcgtgtcgtgtaccacctggnttttatcatatcgtattgccttcatactacttacttaattcccgccaactttcatcgttcgccatgccgattcgaaatccgtttactcgccgccccggcactctcatcacagtcgaggacaatgtctacaccgaccaagagcgcatttctcccggctttgagcgagtcgacactgttggatccaaggcgtcgtcggctctcagcatccgcagcgccagaagtcaggataccggcgagtataagatgagtgtcgtcaatgatagcggcgtatatctccctccctcaccgtcggaggagaagggccactggccgcgcagatacctttcgtcgcgagaatcgtcagacagctctggcgagattgagcaattttctatttctcgagagtcgtttgactcgtaccgacgctcatttgatatctcggcacgatcccccatttctgcgtacgacgttcccgctcgcatgagtctcgactcagctcgattcgctcgaatgcctaggtcggcaatcaaccgtaacatagagcaactgcccaccgctgaggagaactttgaggacgtcggactcgaggaccagaagcagccgccccgcaaacgaggtttcttttccaaactgacagagacccaagagaaggactccactgctcagacaggagtctcgagattcctcatgcccggtcggaagagggctcaaagcggccaaggggccgagttagcggcaatggaccagccgacggtgacttcatcaaactgagaaatgcctgccacgggaagcaacgacgacaacgactctgcaacttgaaataatttatcgtacataccttttcaaaagtgtatcaggcgcccatgtttttttttctggactatggatatgttttatttctgcaacgacggcgtttgggacggcgt

SEQ ID NO: 2724 - DNA, 721 bp, Artificial
  Synthetic
gcatcatcaaagcgaacaagctcagttgatgcctcgagacagcggcagaaaccgacaaccacgaaccccaaactcgaattcgagcgcaaaccagagcacaggaagagggcaaatgtcgaacccaaacaactggcaggaggaggcgatgcggcgtctgcgccagatgcagacgcggggcgggtatcccggacgaggaggaccgcagatgcccagaggagcaaacggcgccttgattggaggaatcttgctggcgggcggcgcttggttgctgtcgaactcgctgttcaacgtggacggtggtcaccgagcgatcaagtaccagcgattaagaggcgtgagcaaggagatttacagcgaaggaacacacatcaacattccttggttcgagacacccatcatctacgatgtacgagcgaagccgcgcaatgttgcttcgctgactggcaccaaagacttgcagatggtcaacatcacctgccgtgttctgtcaagaccgaatgtcgaagctctgcctcagatttaccgaacacttggaaccgactacgatgagcgagtgctgccatcaattgtgaacgaggtcctgaagagcgtagtcgctcaattcaatgccagtcagctcattacacagcgagagatggttgcccgattagtacgggagaatctgtctcgtcgagctgcgcgattcaatatcctgatcgatgatgtgtctctgacgcatctt

SEQ ID NO: 2725 - DNA, 604 bp, Artificial
  Synthetic
acaaccccaactggaaaaaattcagcaaccagctcaaccagctgcagcgacaggcccagaagggtgccggaggtgccggaggccccaagtttgtcggcgtcggaggcctggtcgttctggcaattgctgccgccaccatcaactcgtctcttttcaacgtggatggtggttctcgagccatcatgtacaaccgaatcggcggtatctctccccgaatttaccccgagggaacccacattgccattccctggttccagagccccatcatctacgacgtgcgagccaagcctcgaaatgtggcttctctgaccggtaccaaggatttgcagatggtcaacatcacctgccgagtgctgtctcgacccagcatctcggctctgcctactatctaccagacccttggcaaggactacgacgagcgagttctgccctctctggtcaacgaggtgctcaagtctgtggtggcccaattcaacgcctcccagctgatcacccagcgagagcgagtctcccggttggtcaaggagcaactcatcaagcgagcctccaagttcaacatcctgctggatgacgtgtcactcacatacatgaccttctcgcccga

SEQ ID NO: 2726 - DNA, 610 bp, Artificial
  Synthetic
ggcagcttctctcacaatcaccactctcttacacatacatctatcaactccttgttgtaaaaccaccaccacattcaaaatgaagttcttcgccgtcgccgctctcttcgtcgccagcgccatggccggcccaatgggcagcgaaggatgcccaggtggtcttactggcaccgttccgctctgctgtgccaccaacgtcctcggcctcgcgaccctcgattgcagcacccccactgttcctgtacccaatgtcggcatcttccaggcccactgtgcttccaagggcaaacagcctgtctgctgcactgttcccgttgccggccagggccttctttgcaacaagcccactggagctcagtagagtgcctgttgtacttggatggtgaaccccgtccacggcatcacggggttcacaacaccgacatcgaggggctcgcaaataggaggagttgaatggcaatggatgggtatggatgaaaatggatggacataggtggaactggatggatacagttgggcaatggatcatggtggaggacttaatggtatatttgcgagcgggataagggttgtatgtagagtcactcattaaatcacagctatcactggc

SEQ ID NO: 2727 - DNA, 615 bp, Artificial
  Synthetic
gaattgcttttccctgtccgattccgtttccggctttgaagaaggaagcaataatctatttagggttcttccgtccaactcaaaaccctaaccctaaccctaaccctagttttgaagctcagtgcaggtcagccatggcgacctttgcggaggctccggtcgggaacgccaagtccggcgagaagatcttcaagacgaagtgcgcccactgccacgccgttgagaaatccgctggtcaaaaacatggtcccaatttgaatgggctgtttagtcagtcgtggactccagctgggtactcctactctgtatcaaacaaaaacaaagctgttgtgtggggagaggatacactctatgagtaccttctcgatccacagaagtatattcctgtcacaaagatggttttcccaggcttgaaaaaacctcaagagcgcacagatctcattgcatacttgaaagaatctacgaattaatgaggcgatttttgattgccttcagaataattaattaattgagcttattttagggttaggcaagctgcatttttggacccaacaaataatttgcttaatcgggttttccttaattcctatttaattcacttgggttactcttaat

SEQ ID NO: 2728 - DNA, 398 bp, Artificial
  Synthetic
ttctacaacacaaaaactacaatgggttacaaggaaggttccgctaagaagggtgctactctcttcaagactcgatgcgctcagtgccacaccaccgaggccggaggaccccacaaggtcggccccaacctccatggtgtcatcaaccgacactccggagaggccgagggctactcttactccgatgccaacaagcgaaagggtattgagtggaccaccgagcatctgtttgagtacctcgagaaccccaagaagtacattcccggtaccaagatggctttcggaggtctcaagaagcccaaggaccgaaacgatctgatcacctggatggtcgagaactgctaagcgtctacaactggacccttagcctgtatatatcaattgattatttaaagatt

SEQ ID NO: 2729 - DNA, 697 bp, Artificial
  Synthetic
gtccggccgctttcttctccttttcttccttttttatttccttgtacgccacagaaaacctataagctttctccttcttcttgctttccactttcagaaaaatcagaaaaagccccaaattcaaacccaaattcaaaaaatggcatctttcgcagaggcaccaccggggaacgaagcaacaggggcaaagatcttcaagaccaagtgtgctcaatgccatactgttgaacaaggtgctggtcataaacaaggacctaatttgaatggactttttggaaggcagtctggaaccactgctggttactcctactctgctgccaataagaatatggctgtgatgtgggaagaaaagactttgtatgattatttgctcaaccccaagaagtacatacctggaacaaagatggttttccctggtttgaagaagccacaggagcgtgcagacctcattgcctacctgaaatctgctactgcgtaaggaattaccgacagatattttctattttgtagtctgataggcatgttttgctgtgcgcaggaagataaaccattgatttttttaaagtaataagttgacctcttttggtcttgactcatttgtttccagagcactggtatacgaaattttttgttaccttctgaagaagaggtgaaaaacacttggcaaacaatgccaattttaacatctctcttatga

SEQ ID NO: 2730 - DNA, 590 bp, Artificial
  Synthetic
cccacgcgtccgctgaaaatttttgtattccaaagtagttaaccggtccaggtttctctttggactttttcgactcttacatctttcatttcttcctaagaactctttaataccccatacttcaaaatggctggcggtgatgttaagaagggtgccaacctcttcaagacccgttgcgctcagtgccacaccgtcgaggccaacggcggcaacaagatcggccctgctctgcacggcctcttcggccgcaagaccggctccgtcgacggctacgcctacaccgacgccaacaagcaggccggcatcacctgggacgacaagaccctcttcgcctaccttgagaaccccaagaagtacattcccggcaccaagatggcctttggtggcctgaagaaggacaaggatcgcaacgacctcattgcctacctcaaggagtctaccgcttaagcgatgaatgaagaaaaagaattgtaatgacagagatatcaatagacggggtgcggcgattgtactactatagataaagttagaatagtcgaagcaccatcactgtgcttgtaccattaatatccaactccgctttttcagcg

SEQ ID NO: 2731 - DNA, 614 bp, Artificial
  Synthetic
gaattcacaaaccctagaaaagttgagaaggttgttccttcttattcttcctctcaaaatctctataagttttctgtaaaaagaagtttgaaatggcaactttcgaagaagctccacctggtgatgctaaggctggggaaaagatcttcaagactaagtgcgctcagtgccatactgttgagaaaggatctggtcacaaacaagggcctaacctgaatggtctgttcggaaggcagtctggaacaactgctggttactcttactcagctgctaacaagaacaaggctgtgaactgggaagagaatacactttacgattacttgcttaaccccaaaaagtacattcctggaacaaagatggttttcccagggctgaagaagcctaaggagcgagccgacctcattgcttacctgaaggaatcaactgcctaatccttttactgccccttggaattcattttggagacgcttttgaggtgtgacatgatcggatagcaacaaattttttcttaaataaacccttattttaggtttttattgctgtttcttttcaatcagaatagggagtagggatattgctctcttttgaaaagcaaaaacaccattttggggaac

SEQ ID NO: 2732 - DNA, 586 bp, Artificial
  Synthetic
gccttacattccacctttcgactttacacgtcaatcccccccctccatcatccaaaatgggtttcgaagccggtgacgctaagaagggtgccaaccttttcaagacccgatgcgctcagtgccataccctgaaggagggtgagggcaacaagattggccctatgctccacggcctcttcggccgtaagaccggtcaggtcgacggttactcctacaccgatgccaacaagcagaagggcatcacctgggacgagaacaccctgttcgagtacctcgagaaccccaagaagtacattcctggtaccaagatggccttcggtggtctcaagaagcccaaggaccgcaacgacttgatccagtttctcaaggaggagaccaaataagcggttcattgtcattttaacgctttgcaactccgaacccgccatgacccttctataatcccgtttccaaaatttcctccgtttgtacaacaacgatagacgcatgaccgaggcgagagaggcgcctacgggcggcaccgtcttgtgtagactttgtttggtgtatcatgatatggcgctttttcgagttttggtgtcagcat

SEQ ID NO: 2733 - DNA, 277 bp, Artificial
  Synthetic
caaggccggtgagaagatcttcaggaccaagtgtgctcagtgtcacaccgtcgaagcaggcgccggtcacaaacaaggacccaatctaaacggtctatttggaagacaatctggtacaactgctggttactcttactctgctgctaacaagaacaaagctgtggaatgggaagagaaggccttgtacgattacttgctcaaccccaagaagtacataccaggtaccaagatggtgttccctgggctaaagaagccgcaagaccgtgctgatctcatc

SEQ ID NO: 2734 - DNA, 432 bp, Artificial
  Synthetic
gagtggtcgtgagctttgcggcgtcgatctgcgatttccagggtaaagtggaatggcgacttttggcgatgccccggctgggaacgtgaagagcggcgagaaaatcttcaagacgaagtgcgcgcagtgccatgtcgtggaggcaggagctgggcacaggcaaggccccaatctccatggtttgcttggaagggtgtctggaacctgcgaggggtatagctactcgactgcgaacaagaacaaggctgttcattggagcgaggagacgctctacgagtacctcctgaatcccaagaagtacatccctggaaccaagatggtcttccccggcctgaagaagccgcaggaccgagcggatctcatcgccttcctgaagcagaactcttgacacgcgaaacgtttctactgcggcgcggggattcatgggggagg

SEQ ID NO: 2735 - DNA, 595 bp, Artificial
  Synthetic
gcaacaagcaacaacaaaacacatcaacttacaacccaacacaatctcttcaattacatcccacttatatactacctttaaagaaaacatccaatcaaaatgaccaaagtcctcatccttggcgctactggttatgtcggcaagagactagctgagactctagttcgaagcggccagcaccaggtatacggcattgctcgaactgaggccaaggccaaaacattggctctcgcagaggtcacgcccatcatctgcgctgatccagtaaatgaacctaaatcctatatgaaggctgtccgcgactaccacatcgatgttattgtcgacattgctggcgccaatcaagagtcggccaagttcctcagccatgccaaggagatcagccaagagcgactgaacagctatgccgcttctggcattaagggccctaagcttggattcatctattgttcgggcacttgggttcatggatctagtgataaagcagtcaacgatctcaacatcgctgggcccagcggtgtcacccctccaagagctcttgtagcgtggagagttggcctcgagaattccatcttggcatcttccgatgtcttgg

SEQ ID NO: 2736 - DNA, 623 bp, Artificial
  Synthetic
  misc_feature (430)..(430): The residue at this position can be any nucleotide.
gcatctgcaacatgcaacatgtgcctgctgcgctcgatagagccgacgaaccggaatatttgccattcaggcaaacaaagatagcttccccacgcgttaagagattgcagccgcgctaccaggccctcccaaagcttgcaagcactccgtagagacccgtaaacggagatggcacctcccgctccgtgagcgatttcggggagggggaggggaccaaagatcatgggggaggctttttattctatcgactctcgggaagcatctgctctcatcatcccattatcggcagcaaagcagccaagagcccccaccagacggccagaaactcggggtcagccctggcaacctggctcgatttctgtccttgtgtgggcgtgggcgcgtgggcgaagatgttttgagtgatggatgagaattaggaagagaccanggagagcaaccaataagaatctgacgataagcagccctgctgtgtggcggctagtgtgagccttttgggcacatgtttggagattcttgcgcgcccttgtacttgtactccgtagttttgaatggactcgggtacagtacggagctgatgtcgtgatgtttctaaattagataggagacgggcagactaaaaa

SEQ ID NO: 2737 - DNA, 812 bp, Artificial
  Synthetic
cccacgcgtccgcgcaattatattatgcttgacaagttgaaactgaccaaataacaaaatacaacaacaccatggctaccaccaacggcccatccaaattcatcccagaacagctcttccacactgttctcaccataatcgactactcccacgacgcctccggcgccaaccgcacgctattcgtcctcaaaacccacggcaccctcgccgctgcaaagaaatacgccagccacgccctagaagccgtcaacttcacagccgaagactttgaagtctatcgcatccgcgccgacgaagacccagccaaaccctggacccacggcgacggcgtgctggttttcgctcgctcctttgatgggcaggagtttctcgtgggaatcgacactactccgaacaatgaggctttgaccgcgacctcggatggagagatggtgctgcccgagggcgcaaagttcttgcactaccttttgcagattacggtggactacaacgccgaccgtagcggcagctcgcagaccacggaaattgaagggacgtatgtccatcgtgcggatgcttggacggctgcgcatgtctctctcgatccaactgagtatgcagagtttgatcgtcgtggcgacgcacaatttgttgaagaatggccctttggcgaagacgttgcagttcatgccgtttctgagactggacaaaactactttattgcggtgaaaaggccccccgagcagaagcacgaggtaaagcatcactcgctgaaaaaatagttttcatgtctattgcattcggttcgtggaagtaaggacctcgtctgtcgt

SEQ ID NO: 2738 - DNA, 398 bp, Artificial
  Synthetic
cgcaattatattatgctggatgagttgaaactgaccaaataacaaaatacaacaaatccatgggctatcagcaaacgctccatccaaattcatcccagaatagttcttacacactgtgctcaccataatcgagtactcccataaagcctccggagccaaccgtacgctattcgtcctcaaaacccacggaaccctcgccgctgcaaagaaatacgccagtcatgccctacaaaccgtcaacttcacagacgaagactttgaagtctatcgcatccgcaccgacgaagaaccagccaaaccctgaacccatggcgacggagtgctggttttcgctcgctcctttgatgggcaggaatttctcgtggaaatcgacagtactccgaacaatgatgctttga

SEQ ID NO: 2739 - DNA, 501 bp, Artificial
  Synthetic
ctcgtattcgcggtgaccccaagttccacgatccgcagtcgctggtcggtttattggccgtctcagtccttcttggcaaacacgttgcatcgtctcatcatctcactcctcgtagcacaacatgtctgaagttgtggtgcgtgatgcgcgctactcagagttacccgaaattgctcgcgtgatggcaaaagcattctgggaagataatttgtttggccagctcattcaccctcatcgaaatcagtatccggatgatgtgcacctgtactggctgaggcgggctcgtgtcaacttctgggactgtcgctggcgatggctggtcgctgttgataaagatgagactggtcgtgaggttatcaccggtattgcgcaatgggcaagattgggcgatggtggtaagaggttggaccgctcgtacttggatcctcggaatttgctgaagcctctgtcttctattgccatgacaattcatgcctggttgtggccaagtcgtgcaagtga

SEQ ID NO: 2740 - DNA, 466 bp, Artificial
  Synthetic
gaaaaaggattaatcgcaactccgagatcctgctgaatcacaatgagacctactcaggttcgtctgggcggcggcgcccctcaacccaagactggccactggctcggtgactggggctcctttggtggtgccaagcagaagggcattatcgactacggcctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatgttgaattatgggtgtccaggggacacagtgtatatcagcgtctagattaggagaaaacaatagaaacgtttgactctaaaaaaaaaacaaaa

SEQ ID NO: 2741 - DNA, 626 bp, Artificial
  Synthetic
ggattaatcgcaactccgagatcctgctgaatcacaatgagacctactcaggttcgtctgggcggcggcgcccctcaacccaagactggccactggctcggtgactggggctcctttggtgagtgtgctctacttgacgaacgattgcatcagaccacccgcgaaagagactttgaggacgcaaggaaccggatggtggagggaagatgaggacgattcaatgggccgatatcttgattcagctggagcaattgaggcggaagacattgaacacgctacggagcaacaattggatcaggaattgcgtcgaaggacccgtcgggacgaactacaaagattgaaggagtcactcgcatgctaacatatgatgctataggtggtgccaagcagaagggcattatcgactacggcctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatg

SEQ ID NO: 2742 - DNA, 452 bp, Artificial
  Synthetic
gaaaaaggattaatcgcaactccgagatcgtggtgaatcacaatgagacctactcaggttcgtctgggcggcggcgcccctcaacccaagactggccactggctcggtgactggggctcctttgaagggcattatcgactacggcctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatgttgaattatgggtgtccaggggacacagtgtatatcagcgtctagattaggagaaaacaatagaaacgtttgactttaaaaaaaaaaaataa

SEQ ID NO: 2743 - DNA, 424 bp, Artificial
  Synthetic
gtcgggccttcaaagtcataccttaaagacaaaagacatcgcgtgcgttgccaaccaccttcttttacgcaaccctacaaacaacggcatctcgcccgcgcatctagtcgcctcgctccttcggcctcctccagcaacaacctcctcgcggtattctggaaatactaagacgctcgctcactcctttggatatacaacctagacagcatcttttatacaaatcgccaacatgaagttctccaccgcctccatcttcctcgccgccctcggcgcctctgctcaccccagcggccacgctcacaagcgcgcccacgactctctcgaggcccgcagcgactttgtcattgccaacaagcctgttgagcccagccctcccgtcgcgactcccactcccactccttcgcctgctgttcctactccttcg

SEQ ID NO: 2744 - DNA, 881 bp, Artificial
  Synthetic
cacgcccttaaccccccgccgccggaggctaatccaggaggaacaatggcattcatcaaagtccagaagactagggcttattttaagcgtttccaggtcaaattcaagagaaggagagaggggaagactgactacagagcaaggaatcgcctgattaatcaggacaaaaacaagtacaacactccaaaatatcgtttcgttgtccgatttactaacagggacataatcgcccaaattgtgtctgctagcatagctggtgatatgattcttgcttctgcatatgctcatgagctacctcagtatggcctcaaagctggactgacaaattatgctgctgcttactgtactggacttctcttggcaagacgagttctcaagaaacttgaaatggatgaggagtatcaagggaaccctgaggctactggagaggattactcagttgaacccgctgaaagcaggaggccgttccgtgcacttttggatgtgggccttgttagaactactactggaaatcgtgtttttggtgctctaaagggtgcattggatggtggacttgatattcctcatagcgaaaagaggtttgctgggttcagcaaggactccaagcaacttgatgctgatgttcaccgcaagtacatctatggtggccatgttgcaacatatatgaagacgttgactgaagatgagcctgagaaatttcagtctcactttagtgagtacatcaagcaaggtcttgaggctgatgatctcgaggagatgtacaagaaggttcatgctgccatacgtgccgatccaagcccaaagaaatctgagaagcagcctcccaagcagcacaagaggtacaacctgaagaagctgacttatgaggaaaggaaggccaa

SEQ ID NO: 2745 - DNA, 886 bp, Artificial
  Synthetic
gcaagtttgaggagcaagccagccatcgccaggcaccaccgtcaaaatgcctttccaaaagctcgccaagaacagcgcgtactacagccgctaccagaccaagtacaagcgtagacgtgagggaaagaccgactactatgctcgtaagcgcctcatcacccaggccaagaacaagtacaatgctcccaagtaccgcctggtcgtccgcttcaccaacaaggacatcgtcatgcagatcgtcagctctgagatcgctggtgacaaggtcctggtcgctgcctacgcccacgagctgaaggcttacggcatcaaccacggtctgaccaactggtccgccgcctatgccaccggtctcctgatcgctcgccgtgtcctcaccaagctcggcctcgacaaggatttcgtcggtgttgaggaggctgacggtgagttcaccctcaccgaggccgctgagaccgacgatggcgagcgccgccccttcaaggccttccttgacgttggacttgcccgtacctccaccggtgcccgtgtcttcggtgccctcaagggtgcctccgacggtggcatcttcgtcccccactccgagaagcgattccctggttacgacatggagagcaaggagctggacgccgagaccctccgcaagtacatctacggtggccacgttgccgagtacatggagaccctcgccgatgacgatgaggagcgctacaacagccagttctccaagtacattgaggacgatatcgaggccgacggtctcgaggacctctacaccgaggcccacaaggccatccgtgaggaccccttcaagaaggttgagggtgagaagaagaccaaggaggagtggaagggcatctccctgaagcacaagaccatcagactc

SEQ ID NO: 2746 - DNA, 567 bp, Artificial
  Synthetic
cccaaaccctaaccattccttctcccaccttctcccttctcgtcgctcttccccctccgccgccgccgcagcggagcagcaacagcaggcgagcgacatgggagggtttgtcaagacccagaagacccatgcctacttcaagcgtttccaagtcaagttcaagagacggaggcagggcaagactgactacagggccaggattaggctcaccaaccaagataagaacaagtacaacacaccgaagtaccgctttgttgtgagatttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgccgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaa

SEQ ID NO: 2747 - DNA, 596 bp, Artificial
  Synthetic
ccttctcccaccttctccgttctcctcgctcttccccctccgccgccgccgcagcggagcagcaacagcaggcgagcgacatgggagggtttgtcaagacccagaagacccatgcctacttcaagcgtttccaagtcaagttcaagagacggaggcagggcaagactgactacagggccaggattaggctcaccaaccaagataagaacaagtacaacacaccgaagtaccgctttgttgtgagatttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgccgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaaccgtgtctttggtgccctcaagggagctttggatggtggtcttgac

SEQ ID NO: 2748 - DNA, 613 bp, Artificial
  Synthetic
gcaaccatcagcaaccatggttttcgtgaaggcattgaagtcgaaggcctacttcaagaggtaccaggttaagtacaagagacgtagagctggaaagacagactaccgtgcccgcatccgtctcacaactcaggacaaaaacaagtacaacaccccgaagtaccgttttgtggttcgatttacaaacaaggatataatagcccagatcacgtatgctacgttggcaggtgatattgtgcttgcagcttcatatgcgcatgagcttccccgctatgggctgccaactggactcacaaactatgcggctgcgtattgcactggtcttctattggcccgtcgtgtactgaaacaatttgatttggataaggactatctcggaaatgaagaggccactggtgaagactacaatgtggaggaaactggggagcgacgtccattcagggctctccttgatgtagggctcataaggacaacaactggaaaccgggtctttggggcgctcaagggagctttagacggaggtcttgatatcccccacagtgagaaaaggttcgctgggttcagcagagatgacaagtctctaaatgctgacactcaccgcaaatacatcttt

SEQ ID NO: 2749 - DNA, 779 bp, Artificial
  Synthetic
atccgtcgttggagctcgacaggaggaggaggaggggcagagagacacatccgtcagcggccatggtgttcgtgaaggcgctgaagagcaaggcctacttcaagaggtaccaggtcaagtataaaagacgcagagctggtaagacagactaccgtgctcggatccgtctcacaacccaggataagaacaagtacaacactcctaagtaccgctttgttgttcgatttaccaacaaggatataactgctcagattacatatgcgaccttagctggcgacattgtgcttgctgctgcatatgcacatgagcttccccgctatggcctacccactggcttcaccaactattctgctgcctattgcactggtcttctattggcccgccgtgtcttgaagcaatttgatttggacaaggaatatgttggaaatgaagaggctaccggggaagattacaacattgaagaagctggcgaaaggcgaccattccgggctctgcttgatgttggtctcattcgaaccactacaggaaatcgagtcttcggtgctctcaagggagctttagatggaggtcttgacatcccccacagtgagaagagatttgctggctacagcaaggacgataagtctcttaatgctgacacccacaggaagtacatctttgctgggcatgttgcagactacatgaagatgttgaaagaggaagaaccggagaagtaccaatcccaattctcaacttacattgctgctggaattgaacccgaaagctttgaaagcaccttg

SEQ ID NO: 2750 - DNA, 436 bp, Artificial
  Synthetic
tggagctcgacaggaggaggaggaggggcagagagacacatccgtcagcggccatggtgttcgtgaaggcgctgaagagcaaggcctacttcaagaggtaccaggtcaagtataaaagacgcagagctggtaagacagactaccgtgctcggatccgtctcacaacccaggataagaacaagtacaacactcctaagtaccgctttgttgttcgatttaccaacaaggatataactgctcagattacatatgcgaccttagctggcgacattgtgcttgctgctgcatatgcacatgagcttccccgctatggcctacccactggcttcaccaactattctgctgcctattgcactggtcttctattggcccgccgtgtcttgaagcaatttgatttggacaaggaatatgttggaaatgaagaggctaccgggga

SEQ ID NO: 2751 - DNA, 700 bp, Artificial
  Synthetic
tttcactccccccaacccctaacgccggcggcggaggctaatcgaagaacaacaatggccttcatcaaagtccagaagacgagggcttactttaagcgtttccaggttaaattcaagagaaggagagagggaaagactgactatagagccaggaatcggctgatcaatcaggacaaaaataagtacaacacaccaaaataccgttttgttgtccgatttactaataaggacattatcgcacaaattgtgtctgctagcattgctggtgacatgattcttgcctctgcctatgctcgtgagttgcctcgttatggacttaaagtcggactgacaaactatgctgctgcatactgtactggacttctcttggcaagacgagttctcaaaaagcttgaaatggacgaagagtatgaagggaacctcgatgtcaatggggaagattactccgttgaacctgctgaaagcaggaggcctttccgtgctctcttggatgttggccttataagaactaccacaggcaatcgtgtttttggtgctctcaagggtgcattggatggtgggattgatatccctcatagcgagaaaaggtttgctggattcggcaaggattccaagcaacttgatgcagatgttcaccgcaagtatatctacggtggccacgtttctgcatatatgaaaacattgatggaagatgaacctg

SEQ ID NO: 2752 - DNA, 310 bp, Artificial
  Synthetic
ggaaggccgagcagcgcagccatggccgtcgctaaggcgcagaaatccaaatcctactacaagcgctaccaggtcaagtaccgccgccggcgagagggtaagaccgattaccgcgcgcgggtgcgattgacaaaccaggacaagaacaaatacaatacaccaaagtatcgatatgttgtgcgcttcacgaacaaggacattgtcgcccaggtcgcttatgcaactatttgctggcgatgtgatcatggccgcggcctactcgcatgaactgccacgatacggtctcaaggtcggcctgacgaactacgca

SEQ ID NO: 2753 - DNA, 636 bp, Artificial
  Synthetic
acaagacctctgcctaccactctcggttccagacccccttccgtcgacgacgagaaggtaagaccgactactatgctcgaaagcgactcgtgacccagcacaaggccaagtacaacacccccaagtaccgacttgttgtgcgattcaccaacaaggacatcatcgcccagattgtctcttcccagctcaagggtgacattgttttcactgccgcctacgctcacgagcttccccgatacggtgtcaagcacggtcttaccaactgggccgctgcctacgccgtcggtcttcttgttgctcgacgagctctcaagaagctcggcctcgacgagacctacaagggagttgaggaggttgagggtgagtttgagctcaccgaggccgttgaggacggtcctcgacccttcaaggtcttccttgatgtcggtatgacccgaaccaccaccggtgccaagtgccttcggtgttctcaagggtgcttccgatggtggactttacgtcccccactccgcttctcgattccccggttgggatatcgagtccgaggagctcgactccgagaccctgcgaaagtacatcttcgctggccacgtttccgagtacatggaggagcttgccgatgatgatgaggagcga

SEQ ID NO: 2754 - DNA, 586 bp, Artificial
  Synthetic
ggccatacgaaccgacacttcctcctactacgtacctcccccctacggcgcctatccccaaaccccggtagcgacacccaccggccagcctaaacacgaaccctatttcccgccgccaactcgaccccagcgagcgcaaggcttcgaggctccaaatcaaaacgccgcacctcccgtatcgtacaggcccgacggacggagtttcagaccgtcgctgcctccattatccacgtcgaccgacccctaccaatcttttggaagcgctggccttccatcgtcctcatcctcagatatgccgccacgaaaggtagtggcgcctccgccccctaccccagccgtcgagccgtctcctgtccggacaaaattcccgacggcccggatcaagcggatcatgcaggccgacgaggaggtaggcaaggtcgctcagcaaacgcccattgctgtgggcaaggcattagagctgtttatgatccagctcgtcacaaagagcgcagatgttgccaaggacaagggttccaagagagtgacggcgtccatgttgaagcaggtggtggaggcggacgagcagtgggactttcttagagag

SEQ ID NO: 2755 - DNA, 587 bp, Artificial
  Synthetic
agcttgatttggtgtattgatcttatttattgtttcaatcttcgataaacctaattcatgtcagaactcgatatccaaatccccacatctttcgacccattcaaggaggcggacgcgaacaatccagggacaggttctcgcgactacatccacatacgcatgcagcagaggaacgggcgtaaatgcctgaccactgttcaaggcctcaaaaaggaattcaactacaacaagatcctgaaggacgtcaagaaggagttctgctgcaatggcacagttgtgcaagactcagaactcggacaagtgatacagttgcaaggagatcagcgaaagaacgtgtaccaattcctcattcaggctggagtatcaaagaaggagaatattaagcttcatggtttttagtcagtcaatgctgccgccagtctgatttattattttgcatgctgttaattttaagcaaataatattcaggttgcaggttatacctggctttgtaattcgaccgcattttaataatcgcgtggtatagctgaaaatatgtactgtggcagcagattttatcataataatatagttacaaatttggttac

SEQ ID NO: 2756 - DNA, 419 bp, Artificial
  Synthetic
taaaaaaactgagcttgatgacagagatcgagattcaagtccccactcccttcgatcctttcaaggaggcagatgagagcagtgggacgcccgggacaggatcgaaggactacgtccatattcgaatccagcaaaggaatggtcgcaagagcctcactacggttcaagggttgcgaaaagagttcaattacaacaagatcctcaaagatttcaagaaagagttttgctgcaatgggactgtagtccaagaccctgagctgggccaggtcatccaacttcaaggagatcaaaggaagaatgtgtctcaattcttagtacaggctggtgtggcaaagaaggagctgatcaaaatccacggcttttgatagtactattggctatatatatatatatatatatatatatatatatataatatg

SEQ ID NO: 2757 - DNA, 624 bp, Artificial
  Synthetic
gtcgaccacgcgtccgggtcaagccgtgccgcgtcgtcgtctccctcgcctttcccctccgctccgcttcgccgatcaagcttgcattgagacaaagaaatcagctttcatctgggggagaccaatcaaactcaactagcaaatttcatgtctgatctcgacgtccagcttccatcagcttttgatccgtttgcggaagccaatgctgaggactccagcgttggtgctggatcaaaggactatgtacacgtgcgcattcagcagcgcaacggaagaaagagtctgactactgttcagggcttgaagaaagagtacagttacaacaaaatcctcaaggatctgaaaaaggaattctgttgtaatggtactgtagtccaagatccagagttaggccaggtcattcaacttcaaggtgatcagcgtaaaaatgttgcgacgttcctagttcaggctggaattgtaaagaaagagagcatcaaaatacacgggttttaggctacacataatgcctatgtgctattatatgatacaaaatattgaagtgtctgaagcctgaagttgtgataataccagtttttactacttctaagacatttgaatttgtgtcggtgtgagctcttggtt

SEQ ID NO: 2758 - DNA, 492 bp, Artificial
  Synthetic
  misc_feature (316)..(316): The residue at this position can be any nucleotide.
aaaaaacaccctcccccttcactcgacaatctggacataggtctctagatcgcgccaataacagtttatgtctacttctatcgaaaacctcaagtcctttgatcccttcgccgacactggtgacgacgatactcagcctaccaactacatccatatccgtatccagcagcgaaacggacgaaagactctgaccacagtccagggccttcccgaagaatatgacctcaagcgaatcctgaaggttctcaagaaggattttgcctgcaacggaaacatcggcaaggacgaagagcacggtgagattattcagctccanggagaccagcgagacaagattgtcgacttcctgactgccaagcttcagattgacaagaagaccatcaagaagcacggtttctaaatggatcccgccagtatatgtggctcaaacctgcctgacacgactcccatagcggagtgcgatataacgagattaattccaatatctgtgat

SEQ ID NO: 2759 - DNA, 804 bp, Artificial
  Synthetic
gccagcccaacctctacatttgcgccagcgcatttaaaaagctcgtcgagtcaccgcataaaaaaaaacacacaaaaggcgctcagcccctctccccgccgaccctttttttccctgtcccgcatcaccaaaaaccaaaacacctcagagaccgtcgcctttcgcagccgccggttcatcaacctcgcctcccccaaactttcctttttcccacgagaaaccccggaacatccgagtttatgtccatcgaaaatctcaagtccttcgaccccttcgccgaagccgacgacgacaccggtgatatcaaaaaggtcgagaaccatatccatattcgtattcaacagcgaaatggtcgcaagtctctgaccacggttactggtcttcctgctaaatttgaccccggcaagattctcaccttcttcaggaaggaattcgcttgcaatggcaacaaggtcaatgatgaaaaggccggcgaggtgatccagctccagggcgaccaacgcaagaaggtcatggatttcctcgttgacaagaagagcggtctcggtctcaaccccgataacatcaccgttcacggtgcctaaatcgtcctctttcgcgccgccgccccggcccgcccttccagcgacttggcttcacagcatgctggtgatgagcgtgtcggaatggggctgctcgagcagcctgtaaccttacacagacgcctaccgcaacctccatcgtctagtcgagaccgctgaacgtccatcctttgctgggggctgcgagcggtctcgtgtgataggaggccctctccggtacaat

SEQ ID NO: 2760 - DNA, 719 bp, Artificial
  Synthetic
cccccgaggaggcatccaagccaagaagagggagagcaccaaggacacgcgactagcagaagccgagcgaccgccttctcgatccatatcttccggtcgagttcttggtcgatctcttccctcctccacctcctcctcacaggttcttggtgtagcttgccactttcaccagcaaagtttcatgtctgatctcgacattcagatcccaactgccttcgatccctttgctgaggccaatgctggagactctggtgcggctgcaggatcaaaggactacgttcatgtacgcatccagcagcgtaatggccgtaagagcctgaccactgtccagggattgaagaaggaattcagctacaacaagatcctcaaagatctcaagaaagagttttgctgcaatggtactgttgtccaggacccagagcttggccaggtcattcaacttcagggtgatcagaggaagaacgtatcaaattttcttgttcaggccggcattgtgaagaaggaacacatcaagattcatggtttctgagcaactgccaaaaccattgcaaagactatagtttggggtggagtatacttggttgtgtacatgcctgcgtgttccattgtacacacaaaacctagccacctcttgactcttgagtgtatgcttgttatccgtgtgttgaagtttgtaagaggcaccatcactatagatgatggcttgtgtccctctttca

SEQ ID NO: 2761 - DNA, 628 bp, Artificial
  Synthetic
  misc_feature (534)..(534): The residue at this position can be any nucleotide.
ttttctctatttgctcagacttatccgaacgcgtgagggtttgctctttaaccacctttcccatctctccaaaccctaattttcggatcaggtctgagcatccaagtattgtgatttcagagcgcttgtcttccattctctgaaaagtttcatgtctgagctcgacctccaagttcccactgcttttgatccctttgctgaggcaaatgctgacaattctggagctgggtcaaaagattatgtacacattcgcatacagcaaaggaatggtcggaaaagtctgacaactgttcaaggattgaagaaagaattcagctacaataaaatactgaaggacctaaagaaagagttttgctgcaatggtactgttgtccaggatccagaactaggccaggttattcaactccagggtgatcagaggaagaacgtttctgcatttcttgtccaggctgaaatcgtgaagaaagagtacatcaaaattcatggtttctgattgccatcatcattcatcgagcagttatcgcatttgcagtntatcatatttgtcgtgccagcgcaggaaatgctatccaaacttagtgataataaagtttcctagtgtgttttaaacccaaacggaaaagaaatt

SEQ ID NO: 2762 - DNA, 737 bp, Artificial
  Synthetic
ccccacaacgcagctcctggtcaagtcttatctgccttcctccctcctctcgccttccgcctcgcgtgcgctccaccaccgaaaaaaaggacaggttccacataaagaccaacgagtaaaagcttgatctgtccggtgccaaccaatcaacaaacaagtttcatgtctgatctcgacgttcagcttccatctgccttcgatccgtttgctgaggcaaatgctgaggactccggcgctggccctggagcaaaggattatgtgcatgtgcgcatccagcagcgcaacggcagaaagagtctaactactgttcagggcttaaagaaggagtacagttacaacaagatcctcaaggatctgaaaaaggagttctgctgcaatggtactgtagtccaagatccagagcttggccaggtcattcagcttcaaggtgatcagcgtaagaatgttgccacgttcctagttcaggctgggattgctaagaaggacaacatcaagattcacggtttctaagctgcctatagatgctcgtatgcaatatcgtgtgctgccagatattgggaagcctctgaagctaccagttactgttctctatatttgaagtcataagactatttgttgctattaaagcgattcttgcttgatgcaagttgtgtcctcattatgcactaccggcatattatgagtatggtttgtctgggatattgtcaatctaataaaagtacttgctatttgactat

SEQ ID NO: 2763 - DNA, 692 bp, Artificial
  Synthetic
cccccggtgtgcactgacgttcactgtatgggctcggacttatccggaatttggggttttctctatcaccatcgtcttcatctctcccaaccctaaccttcggatcaggtctgagcatccaagtttcgagatttgtgtgcgcttgttgtcttctactactcaaccaagtttaatgtctgatctcgacgcccaaattcctactgcttttgatccctttgccgaggcaaatgctgataattctggggctgggtcaaaagattatgtgcacatccgtatacaacaaaggaatggtaggaaaagcctgacaactgtgcaggggttgaagaaagaattcagctacaacaagatactgaaggatctcaagaaagacttttgctgcaatggtactgttgtccaggatcctgaattaggccaggttattcaacttcagggtgaccagcgtaagaatgtttctgcatttcttgtccaggctggaatcgtgaagaaagagcacatcaaaattcacggtttctgattgttatcatcaaccttgctgcacagttatcgtacttgttacgtcagtgccagagatgctatccaaacttagttctagtggaacttgcttgtgtctaatttctgctggtttgatataaaatactgcagttgcttgcttctctatgttctgtatgttgaatatgagttatgctatattt

SEQ ID NO: 2764 - DNA, 509 bp, Artificial
  Synthetic
ctcgaatctcggcaagcgtcttcgatcgattcggtccagcggcggcgagcagtagatcaagttcatgtctgaggtcgacatccagattcctggcgcctacgatccctttgccgacgcgaatgctgaggaatccggtggtgttgggtcgggagaatacgtccatgtgagggtccagcagcgaaatggccgcaagagcttgaccactgtccagggcctgagcaaggaattcaactacaacaagatccttaaggactttaaaaaggaattttgctgtaacggcactgtggtgcaagatccggagctgggtcaggttattcagctacagggtgaccaacgcaagaatgtttcccagtttcttgtgcaagctggtgtggtcaagaaggatctaatcaagatccacggcttctaagcgctgtggctgctgctactactgctgtatcgactactgtggtgttgttgtgatgtagctagtggctaaggtggacaagggtggggaaaaaagagagata

SEQ ID NO: 2765 - DNA, 562 bp, Artificial
  Synthetic
atttatgtttcaatcttcgataaacctaattcatgtcagaactcgatatccaaatccccacatcttttgacccattcaaggaggcggacgcgaacaatccagggacaggttctcgcgactacatccacatacgcatgcagcagaggaacgggcgtaaatgcctgaccactgttcaaggcctcaaaaaggaattcaactacaacaagatcctgaaggacgtcaagaaggagttctgctgcaatggcacagttgtgcaagactcagaactcggacaagtgatacagttgcaaggagatcagcgaaagaacgtgtaccaattcctcattcaggctggagtatcaaagaaggagaatattaagcttcatggtttttagtcagtcaatgctgccgccagtctgatttattattttgcatgctgtaattttaagcaaataatattcaggttgcagattatacctggctttgtaatttgactgcgttttaataatcgcgtggtatagctgaaaatatgtactgtggcagcagattttatcataataatatagttacaaatttggttacg

SEQ ID NO: 2766 - DNA, 567 bp, Artificial
  Synthetic
tcgcttctaggccctgtttcatttgagttcaaacgcttcttctcgtctctcgttcagaatttatttcgcgtccttcaaacaactcaaaatgaagtactctgtcgctgccgtctcggcctttgccgccgtcgttctcgccaagcccgagttcctcaactctgctttccaggtccaggagggcaagccttttaccctcgagtactctggctgctcttctggctgcgagattgttctccagactggtgctagcaccaacctgaaggacgtcaaggttcttgcttcttctgccaccggctcctccactaccgtcaccctggaggacattccctctggcatctacagcttcaagatcaccgacaagagcggcgagagcaactacagccagcagttctcctaccagggcagcggcaaggccatctccagcgcctcatctgccaccagcgctgctgagtccaacacggctgctcccacctccgagacccaccacggctgagcccaccagcaccaaagcttcctccaccaaggagcactccaccacgctggtcaagtcaaccactgctcactcca

SEQ ID NO: 2767 - DNA, 652 bp, Artificial
  Synthetic
gctttagggagggggtgaggctcgaagctactgcggctgccggaggaggaggaggacctgccacgccatgggtatctcacgagattcagtgcacaagaggagggccactggagggaagaagaaggcatggaggaagaagagaaagtacgagatgggccgtcagccagcgatgacaaagctgtcaagcaacaagacagtgcggaggatccgagtgcgtggtggtaacttcaagttcagggctttgcgtcttgacactggaaactactcctgggggtcagaggccaccacccgcaagtcgaggatcctggatgtggtctacaatgcctccaacaatgagcttgtcagaacccagactctggtcaaaagtgccattgtccaagttgatgcgacccctttcagacagtggtacagtcaacattatggcctggatattggccgcaaaaagaaatccagcagcgctgccaagaaggagactgaggagggtgatgctggagatgaggaaaagaagaaaagcaagcatgttctgcgaaagctaacaaagaggcaggaaggtcagaagcttgactctcatctagaggatcagtttgcaagtggtcgtctcttggcatgcatttcgtcccgcccgggacagtgtggccgagctgatgggtac

SEQ ID NO: 2768 - DNA, 277 bp, Artificial
  Synthetic
tggtatcaacgcagagtggccattacgccggggcggctaagctctcagcaaccatgggtatctcacgagattctatgcacaagaggcgtgccactggtggcaagaagaaagcttggaggaagaagcgaaagtatgaacttggccgccagcctgctaatactaagatctcggctaacaagacagtccgacgaattcgtgtgcgtggtggcaatgtgaagtggagggcactgagattggataccggaaattactcatggggtagtgaggcagtcacacg

SEQ ID NO: 2769 - DNA, 614 bp, Artificial
  Synthetic
acagattgcaccaggagacccgacatcagcgtcttctgaacaaccgcaatcatgggtatctcacgagactctcgccacaagcgttccgcgtccggtgcgaagcgcgcatactaccgcaagaagagggctttcgagaagggccgccagcctgccaacacccgtattggcacaaagcgtgttcatcttgtccgcacccgtggcggcaaccgcaagttccgtgcccttcgtctcgaagccggtaacttctcctggggctccgagggcatcgccaagaagacccgtgtcatcggtgtcgtctaccacccctccaacaacgagctcgtccgtaccaacaccctgacccgctccgctatcgtccagatcgatgccgctcccttccgacaatggtacgaggcccactacggctcttcgctcggccgcaggaggcaggtcaaggccggtgagaaggaggaggacaagaagaagtccaactcggtcaccaagaagcaggccgaccgcttgaagaacggaggaaagattgagaacgctgttgagaagcagttcgaggccggtcgtctgtacgccgctgtctcttcccgtcccggccagagcggtcgctgcgacggctacgtcct

SEQ ID NO: 2770 - DNA, 895 bp, Artificial
  Synthetic
gtttcattcctcccacatcggacaagtcgattgccctggtgagcaccattatcatcagaaaccgcaatcatgggtatctctcgtgactctcgccacaagcgctccgcctccggtgccaagcgcgcctactaccggaagaagcgcgctttcgaggctggccgccagggtgccaacaccaagattggcgccaagcgaatccacaccgtccgcactcgtggtggtaaccacaagtaccgtgccctgcgtctcgactccggcaacttcgcctgggcctccgagggctgcacccgcaagacccgtgtcattgccgtcgcctaccacccttccaacaacgagctggtccgaaccaacaccctgacccgtagcgccatcgtccagatcgacgctgctcctttccgacagtggtacgagtcccactacggccagcccatcggccgtagacgccagaaggcccaggccgccaaggagggcaaggaggtcgaggaggtcaagaagagcaagtccgtcgagaagaagcaggctgctcgctacgccgccaacggcaaggtcgagtccgctgttgagaagcagttcgaggccggtcgtctgtacgccgttgtcaccagccgtcccggccagtccggccgctgtgacggttacgttctggagggtgaggagctggctttctaccagaagaagctgcacaaataaactcacaatggcgtgagttggatggtgttcaaggattttttcgttatcttgggcattttcagggcatgaagagctttctaacacacaaagcatcggaacgggtccatagggaaatgaaaagcttttctgcaatcatgttacttttttcacgttgtttcattcaagtatgataatgatacaagaaacaaaacaattcaacacacct

SEQ ID NO: 2771 - DNA, 610 bp, Artificial
  Synthetic
gcaggtgaggaggagaggagacccgccgccgccgccgccatgggtatctcgcgtgattccatgcacaagcgccgcgccacgggcggcaagcagaaggcatggcgcaaaaagcgaaagtatgagctcggaaggcagcctgccaacaccaagctgtcaagcaacaagacagtgaggagggtgcgtgtccgtggaggtaatgtgaaatggagggccctccgtttggatactggcaactactcatggggaagtgaggccgtgacccgcaagacccgtatccttgatgtggtctacaatgcatccaacaatgagcttgtcaggactcagacccttgtaaagagtgctattgtgcaagttgatgctgcccccttcaagcagtggtacctcactcactatggagtggatattggtagaaagaagaaggctcctgcagccaagaaggatgctgaggggcaggatgctgaagctaccacagaggaagcgaagaaaagcaaccatgttgtcaggaagcttgagaagcgccaacagggacgcacacttgacgcccacatcgaagaacagtttggcagtgggaggttgctggcctgcatttcttcccgccctgggcagtgtg

SEQ ID NO: 2772 - DNA, 690 bp, Artificial
  Synthetic
ccgctcccccccgctagttcccaaccagcagctgcggcggcgcgagcacacgaagaggaggcggagcagccggagccacctccgccgccgccgccaccatgggtatctcgcgtgactccatgcacaagcgccgggccaccggtgggaagcagaaagcgtggaggaagaagcgaaagtatgagcttggtcgccagccggcaaacaccaagttgtcgagcaacaagacagtgaggagggtccgtgttcgtggaggaaatctgaagtggagggctcttcgcctggatactggtaactattcttggggaagtgaggctgtcactcgcaagacccgtatccttgatgtggtctacaatgcgtcaaacaatgagcttgtgaggacccagacccttgtgaagagtgccattgtgcaagttgatgctgccccattcaagcagtggtatctcactcactatggtgtcgatatcggtaggaagaagaaagctcctgctgctaagaaggatgctgctgagggacaagagggtgaggctgccacggaggaagcaaaaaagagcaaccatgttgtgaggaagcttgaaaagcgtcagcaaactcgcactctggactcgcacattgaagagcaatttggcagcggaaggctcttggcctgcatctcctcccggcctgggcaatgtggcagagctgatgggtaca

SEQ ID NO: 2773 - DNA, 597 bp, Artificial
  Synthetic
cccccgagcgaggcacagctaccggcggcgcagccacacagcagcagcaggtgaggaggagaggagacccgccgccgccgccgccatgggtatctcgcgtgattccatgcacaagcgccgcgccacgggcggcaagcagaaggcatggcgcaaaaagcgaaagtatgagctcggaaggcagcctgccaacaccaagctgtcaagcaacaagacagtgaggagggtgcgtgtccgtggaggtaatgtgaaatggagggccctccgtttggatactggcaactactcatggggaagtgaggccgtgacccgcaagacccgtatccttgatgtggtctacaatgcatccaacaatgagcttgtcaggactcagacccttgtaaagagtgctattgtgcaagttgatgctgcccccttcaagcagtggtacctcactcactatggagtggatattggtagaaagaagaaggctcctgcagccaagaaggatgctgaggggcaggatgctgaagctaccacagaggaagcgaagaaaagcaaccatgttgtcaggaagcttgagaagcgccaacagggacgcacacttgacgcccacatcga

SEQ ID NO: 2774 - DNA, 671 bp, Artificial
  Synthetic
ttttttgttgagccctccgtattgagctagccgtcggaaccctatgatccttcgtcgccggcaacaatgggtatctctcgggattcgatgcacaagagacgtgccactggaggcaagaagaaggcgtggaggaagaagagaaagtatgagcttggaagacagcctgcaaatacaaagctggtgcctaatgctaagactgttaggaggataagggtccgaggaggcaatgtgaagtggcgcgctttgaggttggacactgggaacttctcttggggcagtgaggctgttactaggaagactcgtttattggatgtggtgtacaatgcctcaaacaatgagctggttaggacacaaactctagtgaagagtgcaattgttcaagttgatgcagctccatttaagcagtggtatctccagcactatggagttgatattggtcgcaagaagaagagtgctgtcaagaaggaaggagaggaggctgagactgctcctgctgcggaggaaaagaaaagcaaccatgtgcagagaaagctgcaaaagcgtcaacaagatcgtaagattgacccacatgttgaagagcaatttgctagtggccgtctattggctgcaatctcgtcacgacctggccaatgtggtcgtgctgatggttacatcttggagggtaaggaact

SEQ ID NO: 2775 - DNA, 603 bp, Artificial
  Synthetic
cgctctcctcccccccgctagttcccaacgagcagctgcggcggcgcgagcacacgaagaggaggcggagcagccggagccacctccgccgccgccgccaccatgggtatctcgcgtgactccatgcacaagcgccgggccaccggtgggaagcagaaagcgtggaggaagaagcgaaagtatgagcttggtcgccagccggcaaacaccaagttgtcgagcaacaagacagtgaggagggtccgtgttcgtggaggaaatctgaagtggagggctcttcgcctggatactggtaactattcttggggaagtgaggctgtcactcgcaagacccgtatccttgatgtggtctacaatgcgtcaaacaatgagcttgtgaggacccagacccttgtgaagagtgccattgtgcaagttgatgctgccccattcaagcagtggtatctcactcactatggtgtcgatatcggtaggaagaagaaagctcctgctgctaagaaggatgctgctgagggacaagagggtgaggctgccacggaggaagcaaaaaagagcaaccatgttgtgaggaagcttgaaaagcgtcagcaaactcgcactctg

SEQ ID NO: 2776 - DNA, 707 bp, Artificial
  Synthetic
gcggacgcgtgggcggacgcgtgggcggagcgaggaggaggcgccgcatcgtcgcggatcgatcagtcatgggtatctctcgcgattcgctccacaagaggagggctaccggtggtaagaagaagcaatggaggaagaagagaaagtacgagctggggaggcagccggcgatgaccaaactggcggccaagacggtgcggcgcattcgtgtccgtggtggcaaccataagctccgcgctctgaggctggacgctgggaactactcgtggggaaccgaagccgtggcccggaagacgaggatcttggaggttgtctacaacgcctccaacaacgagctcgtccggacccagacgttggtgaagagcgccatcgttcaggtggacgcgactcccttccgcgcgtggtacaaccagcactacggcatcgacctctcccgcaagaagaagactgccgccaagaaggaaaaggaaggcgaggaagctacgaccgaggcagcgaccgaagaggagaagccgaggagccagaacgcgctccgaaagcttgcgaggagggccgacggccacaagatcgacccgcacattgaggagcaaatggcgagcgggaggctccttgcgagcattgcgtctcgccccgggcagtgcgggcgtgcggacgggtacattctggaaggtaaggagctggagttctacatgaagaagatccagaag

SEQ ID NO: 2777 - DNA, 722 bp, Artificial
  Synthetic
gggcggacgcgtgggcggacgcgtgggcttagctgcttttagctctcagcaaccatgggtatctcacgagattctatgcacaagaggcgtgccactggtggcaagaagaaagcttggaggaagaagagaaagtatgaacttggccgccagcctgctaatactaagatctcggctaacaagacagtccgacgaattcgtgtgcgtggtggcaatgtgaagtggagggcactgagattggatacaggaaattattcatggggtagtgaggcagtcacacgcaagactcgtatccttgatgtggtttacaatgcctcaaacaatgaacttgttcgcacacaaactctggtcaagagtgctattgttcaagttgatgctgcgccatttaaacaatggtacctccagcattatggtgttgacattggtaggaagaagaagggccctgctaagaaggaaactactgaagaaggagaaggtgctgctgccgctgcagaggaaactaagaagagcaaccatgttctccggaagattgagacacgtcagaaggatcgtaaacttgatcctcatattgaagagcaatttggtggtggtaggctgttggcctgtatctcttctcgccctggtcaatgtggcagagcagatgggtacattttggagggaaaagagcttgagttctacatgaagaaactacagaagaagaaaggcaaggctggagctggtggtac

SEQ ID NO: 2778 - DNA, 650 bp, Artificial
  Synthetic
agcactccacgacaaccatgggtatttctcgagactcccgacacaagcgatcccacaccggcgccaagcgtgtctccatccacaagaagcgaaagttcgagtgcggtcgacagggtgccgtcacccgaatcggccccaagcgaatccacaccgtccgaacccgtggtggtaacaagaagttccgagccatccgaatcgagaccggcaacttctcctggggctctgagggaaccacccgaaagacccgagtcctcggtgtctctttccacccctccaacaacgagcttatccgaaccaacactctgaccaagtctgccattgtccagattgatgccactcctttccgacagtggtacgagtcctactacggcaagtctctcggcaagaagaaggctggccaggaggagcccgtcattgctgaggctgaccaggctgccgttgctgcccgacaggctgatgccaagctcgaccctgccgtcgaggctcagttcggtgctggccgactctacgcctgcgtttcttctcgacccggtcagtccggccgagttgacggttacgttctcgagggagaggagcttgctttctacctcaagaagattgtctccaagaagtagacacaaaactaaaatgtattattgcacgtgaaaaaa

SEQ ID NO: 2779 - DNA, 423 bp, Artificial
  Synthetic
gggtgcgaggaggaggaggcgggcgcgatgaagacgaccttgtcggcccagacgatggacatccccgagggggtgaaggtagagatccgggcgaagcagatccgggtgacggggccgcggggggtgctgcacaggaatttcaagcacctcaacctcgacttccagctgctggagaatgggcgcaagctcaaggtggaggcgtggtttgggtcgcgcaagaccatcgccgccatccgcaccgccgtgagccacgtgaagaacctcatcaccggcgtcaccaagggcttccagtacaagatgaggtttgtctacgctcacttccccatcaacgccaacatctctgccaccaagcaaaacatcgagatccggaacttcctcggcgacaagagggtgagaactgtcgacatgcttccgggtgtgact

SEQ ID NO: 2780 - DNA, 554 bp, Artificial
  Synthetic
caacacaatgaaattcatccagggcgacgttctgctcgatatccccgagggtgtcaccgttgacatcaaggaccgacaaatcatcgtcaccggcccccgaggtaccctcaagaagaacctgtctcacatcaacgtagccttcgctaaaggtctccgatgaccatatcaagatcaccatctacgatggtgaccgaaggcatgtcgctgctctgcgaaccgtcaagaccctcatcaacaacatgatcaccggtgtcacccgatgttacaagtacaagatgcgatacgtctacgcccatttccccatcaacgtcaagctcattaaggacggttccgtcgttgagatccgaaacttcctcggtgagaagcgattcctctaattccccatccacgagggctgcagcgctgagatctctaccaaccagaaggatgagatctgcatcatcggtaactccatcgagaacgtctctcagacctgtgctgacatccagcagatctggcgagtccgacacaaggatatccgaaagttccttgatggtatctacgtttccgagaat

SEQ ID NO: 2781 - DNA, 701 bp, Artificial
  Synthetic
ttttagcgatcgccattttcacacacacagaaggagagcggaagagagaaactaagacaagatgaagaccattctgtcatcagaaaccatggatatccccgacggcgtgagcatcaaggtgaaggcaaagcaaatcgaagtagagggaccaaggggcaaacttgtccgaaacttcaagcatctcaacctcgattttcagctgatcaaggatgaggaaactggcaagaagaaactgaagatcgacgcttggtttggatctcgtaagactaccgctgctatccgtactgctcttagccatgttgagaatctcatcactggtgttaccaaaggttaccgctacaagatgcgtttcgtgtatgctcactttcccatcaatgcctccatcaccggtggtaacaagtccattgagatccgtaacttccttggcgagaagagagttaggaaagtggacatgcttgatggggtaacagttgttcgatctgagaaggtgaaggatgagcttgtattggatggaaatgacattgagctcgtttctcgctctgctgccctcatcaatcaaaaatgccatgtgaagaacaaggatatccgaaagtttcttgatggtatctatgtcagtgagaagggcagaattgcagaagaagagtgagcagtttagaagtaggcatatcacttatgattcacatccagaatgcccattttac

SEQ ID NO: 2782 - DNA, 709 bp, Artificial
  Synthetic
gccggtaggcagtagtgagcgcagaagcagggagagacacaaaaaatgaagactatactctcatcagaaacgatggatatccccgatggggtgaaaatcaaggtaaaagcaaagcaaatagaagtggagggaccaagaggaaagctaacccgcaacttcaagcacttgaatcttgattttcagctcataaaagatgaagaaactggaaagaaaaagctcaagattgatgcttggtttggatctcgtaaaaccacagctgctattcgcactgctcttagtcacgttgataatctcataactggtgtcacaaaagggtaccgttacaagatgcgttttgtttatgcccattttcctatcaatgcttctatcactggtgggaacaaggctattgagatcaggaactttctgggcgagaaaagggtgaggaaagtcgatatgcttgatggggttactgttgtgaggtctgagaaagttaaggatgaattggtattggatggaaatgacattgagcttgtttctcggtctgctgccctcatcaatcagaaatgccatgtgaagaacaaagatattcgtaagttcctggatggtatctatgtgagtgagaatggaataatagccgaagaagagtaagttatagcagattggttgggggttgtttggggatcatctgctgatttcatacgaactcatatttgaagttaattcaaca

SEQ ID NO: 2783 - DNA, 747 bp, Artificial
  Synthetic
gacaacccccaagtcacagcagccatgaggtacattcactctcaggagatcctggaaattccagagggcgtcaaggtcaacatcaagacccgtatcgtcaccgttgagggtccccgaggcaagctcaccaagaacctcggtcacttggctgtcaacttcggtcaccccaagaagaacaccatctccatcgagatccaccacggcaaccgtaagaatgtcgccactctccgtaccgtccgctccatcatcgagaacttgatcaccggtgtcaccaagggcttcaagtacaagatgcgatacgtctacgcccattttcccatcaacgtcaacctggacaagaacaaggagaccggtctgttcgaggtggagatccgaaacttcatcggcgagaagatcgtccgacgggttaccatgcacgagggtgtcgatgttgagatctccaaggcccagaaggatgagctcatcctgaccggcaactcactcgagaacgtttcccagagcgccgcagatatccagcagatctgccgggtgcgcaacaaggatatccgaaagttcttggacggtctgtacgtttccgagaagggcaacgttgttgaggaggcttaaatgtaccggacaaggatctctgtttcttttgcgtttctgggactccggagtggcgaaggttcatcattgcatgtcacgtagcaacggggctactcttttacaaaaaatacattaaaaagtattttgtaacaaaaaaaaaaa

SEQ ID NO: 2784 - DNA, 1784 bp, Artificial
  Synthetic
gcccgccgcccgttgggaagggagcttcgaggcggccggccgcggcgcgtcggccgggccggcttggccggtggcacgggcccttgggggcttgcgcccctaacgtgggtcggggcgggcggcgggcgcaggcgccgcttgctagcttggattctgacttagaggcgttcagtcataatccggcacacggtagcttcgcgccactggcttttcaaccaagcgcgatgaccaattgtgtgaatcaacggttcctctcgtactaggttgaattactatcgcggcacggtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaactccgaaggtctaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcggcccgagggactcgggccttagagccaaaaggaggggccaggccccgcttccgactcacggaataagtaaaataacgttaaaagtagtggtatttcacttgcgcccgagggctcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcagcatccgcgaggaccatcgcaatgctttgttttaattaaacagtcggattccccttgtccgtaccagttctgagtcggctgttcgacgcccggggaaggcccccgagggggccgttcccggtccgtcccccggccggcacgcggcggcccgctctcgccgcgcgagcagctcgagcagtccgccggcagccgacgggttcggggccgggacccccgagcccagccctcagagccaatccttttcccgaagttacggatccgttttgccgacttcccttgcctacattgttccattggccagaggctgttcaccttggagacctgatgcggttatgagtacgaccgggcgtggacggtactcggtcctccggattttcaagggccgccgggggcgcaccggacaccgcgcgacgtgcggtgctcttccggccgctggaccctacctccggctgaaccgtttccagggttggcgggccgttaagcagaaaagataactcttcccgaggcccccgccggcgtctccggacttcctaacgtcgccgtcaaccgccacgtcccggctcgggaaatcttaacccgattccctttcggggcacgcgcgtggtcgcgctctctgccggggttaccccgtcccttaggatcggcttacccatgtgcaagtgccgttcacatggaa

SEQ ID NO: 2785 - DNA, 360 bp, Artificial
  Synthetic
cggacgcgtgggcggacgcgtgggcggaattcgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgacagtgtcgcaatagtaattcaacctagtacgagaggaaccgttgattcgcacaattggtcatcgcgcttggttgaaaagccagtggcgcgaagctaccgtgcgctggattatgactg

SEQ ID NO: 2786 - DNA, 710 bp, Artificial
  Synthetic
ttgtagtgccagcaccgtcaattgccgggtttttgtacggtcaccgctcaagggcttcctcgccgcagtcacgatgaagaacgggctattaccacccttgcgattccttcgcagcaccagcttcctgggcgcaaaccaggcacgatggcttcacaagacgaggccggctccgacaatcccacagcctagaccattcgtccccgacgtccagaccttcctcacgctcattggccgcggcctcaacaagcacgcctccaagttcccgtcatgggagtctctcttctccctcacctcgccacaactcaaggagcttggaatcgagcctccccgcagccgcagatacctgctgcagtggatgcagcgataccgaaagggtgcgctgggacctggcggagacttcaaatacgtcacagacggccaagctctgctgaaagtagcaacaccaccggcctctgttgtcagcgatgcgaaatatgtggtcaatgtgcctcaagaccaggaggcaggtctgggggattctgaaatccttcctcgacccaatggctacacagttagaggactcaagtcaatagcggggccgtttgcgacacccttgccgcaacaggccggtgcagtcgtcaaagttacggagggcatgtgggagcaacgccaaggacgcaagattgatggtggtgagagaagaagggcggagattcgcttcaagagacggt

SEQ ID NO: 2787 - DNA, 658 bp, Artificial
  Synthetic
ggtgaaggagctctctgtaaatcaaaggagggggttagccatggccaaggtgtatcctgctgtgagtgaagagtacaaagtcgcagtagacaaggcgaagaggaagctccgagcaatgatagcggagaagaactgtgcccccctcatggtcaggattgcctggcatagtgctggaacctatgatgtcaaaaccaagactggtggcccctttgggactatgaaaaatgcaagtgaactcgcccatggggccaatgcaggccttaataaggctgttgccctccttgaaccaatcaaggaacaataccccattctatcctatgcagacttttatcagcttgctggagtagttgctgtggaggtaactggagggcctgacattcccttccaccctggaagagaggataaaactgagagcccagaggagggtcgtcttccagatgctaccaaagggccgagtcacttgcgtgatgtgtttggtcacatgggcttgggagacaaggagattgttgccctctcaggagcccataccctgggtcgttgccacaaagatcgttctggatttgaagggccatggacgacaaatccccttttatttgacaactcctacttcactgaattgcttactggtgagaaggaaggactgatccagctcccttct

SEQ ID NO: 2788 - DNA, 521 bp, Artificial
  Synthetic
atcaagatggcctcttccggccgtcagttcgcccgcgtggcaacccgcacaaccacccgctccttcgctgccgtcccccgacaggctttccgccagcagggtcgccgcttctactcttctgagcccgagaagaagtcatcctcctctctcctgtaccttggtgctgccgccgccgccggtggtctcggcatctggttcttcacctctggtgcctctgcctcttccaagacctttgtccccacccaggccgattaccagaaggtctacaacgacatcgccgagcgtctcgatgccgattatgatgatggcagctacggccccgtcctggtccgtcttgcatggcactgcagcggtacctacgacaaggagaccaaaactggtggcagtaacggtgctaccatgcgattcgctcccgagagcggccacggtgccaacgccggtctgattgctgctcgtgacttcctcgagcctatcaaggccaagtatccctggatcttcctactctgatctctggatcctcg

SEQ ID NO: 2789 - DNA, 632 bp, Artificial
  Synthetic
tttcctccagcaatggcgaagccaatcgtcgacacggagtacctcaaagaaattgagaaagctcgtcgcgacctccgcgctctcatctccagcaaaaactgtgctcctatcatgcttcgcttagcatggcacgatgcaggaacgtacgatgctaagtctaagaccggtggaccgaatggttccatcagaaatgaggaagagttcagtcacggtgctaataatggattaaaaatcgctcttgacttttgcgaagcagtgaagtctaaacatcaaatgataacgtatgcagatttgtaccagcttgcaggagttgttgcagttgaagtcactggtggtccgaccattgattttgtccctggtaggaaggattccagtgtttctccaaaggaaggacggctgccagatgctaaacaaggtgtgccacatctgaaagatgtattttataggatgggtttgtctgacaaagatatagtggcactatctggtggtcacacactgggaagggcacatccagatagatcaggctttgatggtccatggacaaaggagccactgaaatttgacaattcatattttgtggagctgcttaagggggaaactgagggcctgctgaaacttgctacagacatagc

SEQ ID NO: 2790 - DNA, 656 bp, Artificial
  Synthetic
agaggaggcgagaggcgagaggagaggacgcattcttggatctagatcgacaatcagaatgggcaaatcttatcctgcagtgagcgacgagtacctggccgccgtcgacaaggccaagagaaagcttcgcggcttcatcgcagagaagaactgtgccccattgatgcttcgtcttgcatggcattcggccgggactttcgactgtgcgtccaagacgggtggtccctttggaaccatgaagcacgccgaagaactcggccacggcgcgaatgccggcctcgacatcgctatcaagcttctccagccgattaaagaccagtttccggtcctgagctatggcgacttctaccagcttgctggggtcgtcgcagtggagatcactggaggcccggatattccattccatccggggagagtggacagggagacatgccccgtagagggccggcttccagacgcgaccaagggagccgatcatctccgtgacgtttttgtgaagcaaatggggctctctgacaaggacattgtggctctttctggcggtcacactttgggaagagcacacaaggaaaggtcgggttttgagggcccatggacgcacaaccctctccagtttgacaactcctacttcacacttctgctgagcggcgagcaag

SEQ ID NO: 2791 - DNA, 589 bp, Artificial
  Synthetic
cgagtactagtcacaccacacgcttggcttgacgccgcacgcctccgctccgctccgccgccgcggccgatctctctagggcttccaacctcgccggcgacgcgacgccacgccatggcagccccggtcgtggacgccgagtacctccgccaggtcgacagggcgcgccgccacctccgcgccctcatctcctccaagggatgcgcgcccatcatgctccgcctcgcatggcatgacgcgggcacttatgacgtgaacacaaaaactggtggtgcaaatggttcaattagatacgaggaagagtacactcacggttcaaatgctggtctaaagattgctattgatcttctcgagcctattaaagccaagagccctaagatcacatatgctgacctttatcagcttgctggagttgttgcagttgaagttactgggggtccaactgttgagttcattcctggaagacgtgattcgtcagtttgcccccgtgaagggcgtcttcctgatgctaagaaaggtgcactgcacttgagggacatcttttaccggatgggcttatcagacaaagatatagtagctttatctgggg

SEQ ID NO: 2792 - DNA, 879 bp, Artificial
  Synthetic
cccggcccaagcctttcgagtcgtcttctccccttcttctcctcctcctcctcgattcggagctccacccgcagccatggctaagaactaccccgtcgtgagcgccgagtaccaggaggccgtcgagaaggccaggcagaagctgcgcgccctcatcgccgagaagagctgcgcccctctcatgctccgcctcgcgtggcactcggcggggacgttcgacgtgtcgtcgaagaccgggggcccgttcgggacgatgaagaccccggcggagctgtcgcacgccgccaacgcggggctggacatcgcggtgcggatgctcgagcccatcaaggaggagatacccaccatctcctacgccgatttctaccagcttgccggagttgtggccgtcgaggtgtccggtggacctgccgtccccttccacccaggaagggaggacaaacctgcacccccacctgagggccgtcttcctgatgctaccaagggttctgaccacctaaggcaggtcttcggtgcgcagatgggcttgagtgatcaggacattgttgccctctctggcggtcacaccctgggaaggtgccacaaggaaagatctggttttgagggaccttggacaagaaaccctctgcagtttgacaactcttacttcacggagcttctgagtggtgacaaggagggccttcttcagcttcctagtgacaaagccctgctgagtgaccctgccttccgcccactcgtcgagaaatatgctgcagatgagaaggctttctttgaagactacaaggaggcccacctcaagctctccgaactggggttcgctgatgctgcgccgcttatccgtatgatgttccggattatgccgagcatctacaaacagct

SEQ ID NO: 2793 - DNA, 690 bp, Artificial
  Synthetic
cccacgcgtccgcccacgcgtccgcttctccccttcttctcctcctcctcgattcggagctccacccgcagccatggcgaagaactaccccgtcgtgagcgccgagtaccaggaggccgtcgagaaggccaggcagaagctgcgcgccctcatcgccgagaagagctgcgcccctctcatgctccgcctcgcgtggcactcggcggggacgttcgacgtgtcgtcgaagaccgggggcccgttcgggacgatgaagaccccggcggagctgtcgcacgccgccaacgcggggctggacatcgcggtgcggatgctcgagcccatcaaggaggagatacccaccatctcctacgccgatttctaccagcttgccggagttgtggccgtcgaggtgtccggtggacctgccgtccccttccacccaggaagggaggacaaacctgcacccccacctgagggccgtcttcctgatgctaccaagggttctgaccacctaaggcaggtcttcggtgctcagatgggcttgagtgatcaggacattgttgccctctctggcggtcacaccctgggaaggtgccacaaggaaagatctggttttgagggaccttggacaagaaaccctctgcagtttgacaactcttacttcacggagcttctgagtggtgacaaggagggccttcttcagcttcc

SEQ ID NO: 2794 - DNA, 737 bp, Artificial
  Synthetic
gaggagagggagagaatgccggtgccggtggtggacaatgcgtacctcaaggcgatcgagtcggcgaggcgcgatctccgcgcgttcattgcggagaagaattccgcgccactgatgcttcgattggcatggcacgatgccgggacgtatgatgctgtgtccaagactggaggaccgaatggatcgatccggagcgagcgcgagtatacccacgctgccaacaatgggatcaaaatcgccatagacttttgtgagcctatcaaacagaaatatcccattatcacgtatgctgatctctaccagcttgctggcgttgttgctgtggaagtcactggaggtcctacaataaattttgttcctggccgcaaggaatcggtcgctactacacccgaaggacggcttcccgatgctcatctcggggcaaagcatatccgcgatgtcttctacagaatgggtctatctgacaaggatatcgtcgctctctctggtggtcacacactgggtagaggacacaaggaaaggtctgggtttgagggaccctggacatcgcagccattgaagttcgacaattcatacttcacggagcttttgagaggagaatcggaaggcctgttgcagttgccgacagacaagtgcttgcttgaggatccatcgttccgtccatacgtggagctgtatgcaaaggacgaagacgcattcttcaaagattacgccgagtcgcacaagaagctatccga

SEQ ID NO: 2795 - DNA, 474 bp, Artificial
  Synthetic
gtgattttctgtcgacggtgaaggagctctctgtaaaaatcaaaggagggggttagccatggccaaggtgtatcctgctgtgagtgaagagtacaaagccgcagtagataaggcaaagaggaagctccgagcaatgatagcggagaagaactgtgcccccctcatggtcaggattgcctggcatagtgctggaacctatgatgtcaaaaccaagactggtggcccctttgggactatgaaaaatgcaagtgaactcgcccatggggccaatgcaggccttaataaggctgttgccctccttgaaccaatcaaggaacagtaccccattctatcctatgcagacttttatcagcttgctggagtagttgctgtggaggtaactggagggcctgacattcccttccaccctggaagagaggataaaactgagagcccagaggagggtcgtcttccagatgctaccaaagggccgag

SEQ ID NO: 2796 - DNA, 400 bp, Artificial
  Synthetic
gagagagagagagggaggaaagaggaagaagaagaggatggcgcctccagttgtagatgatgcctaccgcggagccatcgggaaggcccgccgtgacctccgcgccttcattgccgagaagaactgcgctcccatcatgctccgccttgcatggcacgatgctggtacctatgatgccaaaacaaaaactggtggtgcaaatggatcaatacgacctgagcaggaacttctccatggggcaaatagtggtttgaaaatagccattgatttttgtgaaacactgaaggtgaagtatccagctatcacatatgctgacttttaccagctggctggtgtagttgcagttgaggttactggaggacccacagttgaattcattcctggtcgtaaggattccctg

SEQ ID NO: 2797 - DNA, 795 bp, Artificial
  Synthetic
cccacgcgtccgccagattttattatccttcctcgaaacgagatccacgattcgttgctgcgatcggcgttattatcgtcagctctctcgtttctgttctgtggttcgatattgctgagtttctaggctaatcttacgaatctgtgaaagtttttgagagatttggcttctgtagctcactcctgcttgatttagagcttagctaagatgacgaagaactacccaaccgtgagcgaagattacaagaaggctgttgagaagtgcaggaggaagctcagaggtttgatcgctgagaagaactgtgcacccatcatggtccgactcgcatggcactctgctggaactttcgattgtcaatcaaggactggaggtccattcggaacaatgaggtttgacgctgagcaagctcatggagccaacagtggtatccacattgctcttaggttgttggaccccatcagggagcaattccctaccatctcttttgctgatttccatcagcttgctggtgttgtggccgttgaagttactggtggccctgacattcctttccaccctggaagagaggacaagccccaaccacctccagagggtcgtcttcctgatgctaccaagggttgtgaccatttgagagatgtctttgctaagcagatgggcttatctgacaaagacattgtcgctttatctggtgcccacactctgggacgatgccacaaggataggtctggcttcgaaggtgcatggacatcaaaccctctaatcttcgacaactcttacttcaaggaactcttgagc

SEQ ID NO: 2798 - DNA, 646 bp, Artificial
  Synthetic
cccacgcgtccgcccacgcgtccgcccacgcgtccgcccacgcgtccgcccacgcgtccgcccacgcgtccgcccacgcgtccgagaaatcaattacaatccctcaatccagtcgcgtcagacgcccgcttatccagactctctctctctcaaatcacagtcgaacacgttcttcgcaccatccacagccatgcctcccaagaagaccgaaggtgctgcccccaaggccaagtctggcgctgcccatgccagctaccaggacatgattacggatgccattctcaatctcaaggatcgcaatggctctagccgtcagtctctgaagaagtacgtcaaggccaacaacaccttgaacgtttcggacaacatgttcgattctctcttcaacaaggccctcaaggccggtgttgagaagggcatcttcgcccagcccaagggcccctctggaggcaccaagctggccaagaagaagcccgaggccaagaaggctgccgctcccaagaaggagaaggacgccactgctaagaaggccactgccaccaagaaggccgccgcccccaagaaggccaaggagggcgccgagaagaaggaaaagaaggagaagaaggagggcgctgccaccaagaaggctgctgctcccaagaag

SEQ ID NO: 2799 - DNA, 565 bp, Artificial
  Synthetic
cccacgcgtccgcccacgcgtccgcccacgcgtccgccatgagagaaattaaggtccagaagctcgttctcaatatctccgtcggtgagagcggagatcgtctcaccagagcagctaaggtcttggagcagcttagcggccaatcccctgttttctccaaggctaggtatactgtgcggtcttttggaatcaggcgtaatgaaaagatagcttgctatgtaactgtcagaggggagaaagctatgcagctacttgagagtggattgaaagttaaggaatacgagttgttgagaaggaacttcagtgagaccggctgctttgggtttggtattcaggagcacattgatcttggaattaaatatgatccgtcaactggtatttatggcatggacttctatgttgtattggagcgtcctggataccgtgttgcccgtcggcgcaggtgcaagtctcgagttgggattcagcacagagtcacaaaggaggatgcgatgaagtggttccaggtcaaatatgaaggtgttatccttaacaagtcctcaaacattcagtgataagcttagaa

SEQ ID NO: 2800 - DNA, 572 bp, Artificial
  Synthetic
aaaaatgactgactcctctgccaaccccatgcgagagctgcgaatcgagaagctcaccctcaacatttgtgttggtgagtccggtgatcgacttacccgagccgccaaggtgctcgagcagctttccggtcagacccccgtctacaccaaggcccgatacaccatccgatctttctctatccgacgaaacgaaaagattgccgtccacgtgaccgtccgaggccccaaggctgaggagattctcgagcgaggcctcaaggtcaaggagtacgagctcaaggccaagaacttctctgagactggtaacttcggtttcggtatcaacgagcacatcgaccttggtatcaagtacgaccccaacatcggtatctacggtatggacttcttcgtcatcattggtcgacccggttaccgagttgcccgacgaaagcgatgccgagcttccgttggtatcaaccaccgagtcaccaaggaggacaccatcaagtggttcaagcagaagtacgacgcttccgtcctctaagcgggtcatttttgtatcatatcctcacccatcatgcaaaaataatcca

SEQ ID NO: 2801 - DNA, 754 bp, Artificial
  Synthetic
gacgcagcagcagaccacgtcgcaaaacaaccgcagcaatggccgccgaaaagtccagcaaccccatgcgggagcttaagattcagaagctcgttctgaacatctccgtcggtgaatctggtgacagactcactcgtgccgccaaggtgcttgagcagctgtctggtcaaacccccgtctacagcaaggcccgttacaccgtccgtacctttggtatccgccgtaacgaaaagattgctgtccacgtcaccgtccgcggccccaaggctgaggagattctcgagcgtggcctcaaggtcaaggagtacgagcttcgcaagcgcaacttctccgagactggcaacttcggcttcggtatcagcgagcacatcgatcttggtatcaagtacgacccttccatcggtatctacggcatggacttctactgctgcatgacccgccccggtgagcgtgtcacccgccgccgccgcatgaagagcagaatcggtgcttctcaccgcatcaagcgcgatgagaccgtcaagtggttcaagggccgcttcgatggcattgtccgataaacggtttaaaatccaaaccgaataaaatactttttttttcttgtcttgaaggaaatgggcatggcgaacatttgggggtacaaaggatcatatggtccatgtattcttccgcttgatttttacatcagctcgtaccaaaatttttgagtcgagcaacggcctgagagaccgaccggcgctatgccggcttcaca

SEQ ID NO: 2802 - DNA, 509 bp, Artificial
  Synthetic
gcagtcgaacccgatgcgggagatcaaggtgcagaagctcgtgctcaacatctccgtcggcgacagcggggacaggctcacccgcgcctccaaggtgttggagcagctgattgggcagagcccagttctctccaaggcgaggtacaccgtgaggtcattcggtatccgtcgtaacgagaagatcgcgtgctacgtcaccgtcaggggtcgataatgccatgcagcttttggagagtggcctcaaggtcaatgagtacgatctgctgatgaggaacttcagctagaccggatgcttcgggttcggtatccaatagcacattgatcttggcatcaagtacgacccgtcaactggtatttatgggatggacttctatgttgttcttgagcgtgctggataccgtgttgctcgccggcgcaggtgcgagtcccgtgttggaatccagcacagggtgaccaatgaagatgccatgaagtggttccaggtcacgtatgagggtgtcatcctcaac

SEQ ID NO: 2803 - DNA, 679 bp, Artificial
  Synthetic
gaatcgaaatggcttcagagaagaagttgagcaacccaatgagggaaatcaaggttcagaagttagtccttaacatctctgttggtgaaagcggagataggctcaccagagcagccaaggtcttggagcaactcagcggccaatcccctgttttctctaaggctaggtatactgtccggtccttcggaattaggcgtaatgagaagattgcttgctatgtcactgtcagaggagacaaagctatgcagctccttgagagtggattgaaagtcaaggaatacgagttgttgagaagaaacttcagtgagactggctgctttggttttggcattcaggagcacattgatcttggaatcaagtatgacccttcaaccggtatctatggtatggatttctatgttgtgcttgagcgcccaggataccgtgttgctcgtcgtaggaggtgcaaggcccgagttggaattcagcacagggtcacaaaggatgacgctatgaagtggttccaagtcaaatatgaaggtgttatccttaacaaatcctcaaacattcagtaagttgattgtggatcagtttgtcccccagcaagtttatgttttctatgcattttgtagaccaacatttaatactcctagagttcaaaggttttgaagagttgctgttatttggcatatcaggatat

SEQ ID NO: 2804 - DNA, 591 bp, Artificial
  Synthetic
ccccccccccgttttggatcttcttcgcgccatcagtaccctacaactctccctgcagctgcaacatcttccagcagaattgcgatggcttcagaaaagaaactgagcaatcccatgagggaaatcaaggttcagaagcttgtccttaacatctccgttggtgagagtggagatcgacttactagagctgcaaaggtgttggagcaacttagtggtcaatcacctgttttttctaaggcaaggtacactgtgaggtccttcggaatcaggcgtaatgaaaagatagcttgctatgtgactgtcagaggggagaaagccacgcagctacttgagagtgtattgaaagtcaaggaatatgagttgttgagaaggaacttcagtgaaaccggctgttttgggtttggtattcaggagcacattgatcttgggatcaaatatgacccttcaactggtatttatggtatggatttctatgttgtattggagcgccctggataccgtgttgctcgtcgtcgtaggtgcaagtctcgagttgggatccagcacagggtcacgaaggaggatgcaatgaagtggttccaggtcaaatat

SEQ ID NO: 2805 - DNA, 693 bp, Artificial
  Synthetic
gggccagggatagagaggaggagagtctgtcgttgtaccaggaggaggaggaggacgagtaggaggagtcctagggtttagtagaagacagcaaccatggtggccgcggagaagaagctgttgaaccccatgagggagatcaaggtgcagaagctcgtcctcaatatctccgttggtgagagtggtgatcgccttaccagggctgctaaggtgttggagcaattgagtggacagactcctgtcttctcgaaagctagatacactgtgcgttcattcggtatccgccgtaatgaaaagattgcatgctatgtgactgtcagaggagagaaggcaatgcaattgctagagagtggcttgaaagtcaaggaatacgagttgctgcgcaggaatttcagtgacactggttgctttggctttggaattcaggagcacattgatttgggaatcaagtatgacccatcgacaggtatctatggtatggatttctttgtagttctggagaggccaggattcagagttgcgaggagaaagagggcgcaggcacgtgttggcattcagcaaagggtaacgaaggaggatgccatgaagtggttccaagtcaaatatgaaggagtcattctcaacaagtcctccaacatcagttagttagttatctatctaactgcctgcaggctttgtaggacaaaattagtg

SEQ ID NO: 2806 - DNA, 696 bp, Artificial
  Synthetic
cgacccacgcgtccgaacttcatcaccaggtcgactaataacagcagccatggcttccgagaaggcaaacaaccccatgcgggagcttaagattcagaagctcgttctgaacatctccgtcggagagtctggtgacagacttacccgagccgccaaggtccttgagcagctttctggtcaaacccccgtctacagcaaggcccgttacaccgtccgaactttcggtattcgacgtaacgaaaagatctctgtccacgtcaccgtccgaggccccaaggctgaggagattctcgagcgtggcctcaaggtcaaggagtacgagctccgcaagcgcaacttctccgagaccggcaacttcggtttcggtatcagcgagcacatcgatctcggtatcaagtacgacccctccattggtatctacggcatggacttctactgctgcatgacccgacctggtgagcgtgtcacccgccgtcgccgaacaaagaccaagatcggtgcctctcaccgcatcaagcgtgaggagagcatcaagtggttcaagtctcgcttcgatggtatcgtccgataaacggttgaaaacaaaatgggtatttgaatttgcggattgggtcacggcgaaaataaggggaaaactcacatggggcatgtattttctgttgccattgctgcatcagctcgactcttttagtcgag

SEQ ID NO: 2807 - DNA, 480 bp, Artificial
  Synthetic
  misc_feature (105)..(105): The residue at this position can be any nucleotide.
ggggatattgaggaggagagtctgtcgttgtaccaggaggaggaggaggacgagtaggaggagtcctagggtttagtagaagacagcaaccatggtgtgccgcgngagaagaagctgttgaaccccatgagggagatcaaggtgcagaagctcgtcctcaatatctccgttggtgagagtggtgatcgccttaccagggctgctaaggtgttggagcaattgagtggacagactcctgtcttctcgaaagctagatacactgtgcgttcattcggtatccgccgtaatgaaaagattgcatgctatgtgactgtcagaggagagaaggcaatgcaattgctagagagtggcttgaaagtcaaggaatacgagttgctgcgccaggaatttcagtgacactggttgcttcggctttggaattcaggagcacatcgatttgggaatcaagtatgacccatcgacaggctatctatggtatgg

SEQ ID NO: 2808 - DNA, 373 bp, Artificial
  Synthetic
aacccctaatcttgagatggcatcggagaagaagctctcgaaccctatgagggatattaaggtccagaagctagttcttaacatctctgttggtgagagtggtgatcgtctcactcgtgcctccaaggtgttggaacagctcagtggtcagactcctgtcttctctaaggcgaggtacactgtgaggtctttcggtatcaggcgtaatgaaaagattgcgtgctatgtcaccgtgagaggtgagaaggcaatgcagcttcttgagagtggcttgaaagtgaaggaatacgagctgttgaggaggaacttcagtgacactggctgcttcggattcggtatccaggagcacattgatcttggaatcaagtatgat

SEQ ID NO: 2809 - DNA, 637 bp, Artificial
  Synthetic
caaaaagagaaacaaatcgatcgatcgaaaatggcggaattgagtggactgaaactggagcagaggcatggaaaatccagagtgagagtagccagggtttggaaaagtcacgatgggaagcatcactttgctgaatggagtgttaacattagcctcctctccgattgtttacctgcctatgtcgccggtgataattccgacatcgtcgccaccgataccatgaagaacactgtttatgtcaaagctaaggaatgttcagagcaactctcagctgaagattttgccattatacttgcaaagcacttcacctccttttatccgcaggtcactgctgcaattgtcaatatagttgaaaagccatgggaacgcattagcataaagggccaataccatgaacacggttttaagcttggctctgaaaaacacactaccgaagtaatggtcgataaatcgggaacattgcgcatgacatctggtatcgtgggattatcagttctaaagacaactaagtcaggttttgaaggatttattagggacaagtacactatgttgcctgaaacacgggaaagaatgatggctacagaggtcactgcatcttggaggtacttatttgaatctctctcaagtcttcccttga

SEQ ID NO: 2810 - DNA, 693 bp, Artificial
  Synthetic
gcttcattgctgagtgtgttgatagttgacgtcttggtttgtttgttcgccgcttccaatctccgtgacacctccgccaccagttctctctccctccattgaactctctcctcccgagtaaatcaccagctttcgtatcttcacacaaacaattcaattcatctcaccatcatggctactgctcacgtctccgccgcccgctatggcaaggacaacgtccgcgtcctcaagaccgaccgcgacgccgccaccggcatccacaccgtcacagaaatgaccgtcagctgcctcctcgagggcgacatcgacgtctcctacacaaagggcgacaacagcgtcgtcgtcgccactgactccatcaagaacacaatcttcatcaccgcaaagctgaaccccgtcaaccccccggagctcttcgccgccatcctcggctcccacttcatcgacacctacagccacatccacgccgcaaacgtcaaggtcatcacgcaccgctggacgcgcatggaggtccgcggaaagccgcatcctcacagcttcttgcgcgacggccaggagacgcgcaacgtcgaggcccgcatcacgcgcaagggtggcatcgtcatcaacagcggcattgagggcctgactgtgctcaagagcaccggctcggcattccacggctttgtgcgggacgagtacaccactctgggc

SEQ ID NO: 2811 - DNA, 550 bp, Artificial
  Synthetic
ggaacgtggccgtcaacggcggctccgactgcctcccctcctacacctccgacgacaactccgccatcgtcgccaccgattccatcaagaacaccgtgtatgtgaaggccaaggaatgcacggagattgtctccatggaggaattcgcggagattcttggaaggcatttcacctcgctgtacccgcaggtctcagaggcaacggggaccatcgccgagcgtccatgggagcgtgtggatgtcgaggggaagcctcattcccacgggttcagacttggtggtgagaagcacgtcacagaggtcattgggaagaagtctggaaacttgctcataaattctggagtccaaggatactccctgctaaagacaactcagtccgggtttgaaaaatttgtgagggatcgatacacacttcttcctgatacaagagaaaggattgtagcaacagaagtaactgcctggtggaggtatccttttgagcatgtttcccagattccatcaaaggcattctgcttcacacaaaggtatcaagacgtaaagaaagttcttgc

SEQ ID NO: 2812 - DNA, 551 bp, Artificial
  Synthetic
gtttgtttgttcgccgcttccaatctccgtgacacctccgccaccagttctctctccctccattgaactctctcctcccgagtaaatcaccagctttcgtatcttcacacaaacaattcaattcatctcaccatcatggctactgctcacgtctccgccgcccgctatggcaaggacaacgtccgcgtcctcaagaccgaccgcgacgccgccaccggcatccacaccgtcacagaaatgaccgtcgtcgccactgactccatcaagaacacaatcttcatcaccgcaaagctgaaccccgtcaaccccccggagctcttcgccgccatcctcggctcccacttcatcgacacctacagccacatccacgccgcaaacgtcaaggtcatcacgcaccgctggacgcgcatggaggtccgcggaaagccgcatcctcacagcttcttgcgcgacggccaggagacgcgcaacgtcgaggcccgcatcacgcgcaagggtggcatcgtcatcaacagcggcattgagggcctgactgtgctcaagagcaccgg

SEQ ID NO: 2813 - DNA, 406 bp, Artificial
  Synthetic
actcacacacacaactcaaccacactttcaactctcaactacaccacaacttacaatctcatctcgcgaccaaccaactttcacaatggagactgtcaagcaagccgtcaactacgtcgctgagtccgtccagggcgctgcctctggtatcagcaaggagaccaacaaggagattgccaaggacagcaacgtcgacgtttccactcgtttgtccgctggcaaggacgcccttggtgacaagatcgacgagactggccacaacaacaaggccgaggctcacaagcagctggctgagcacaactagattggcataaggagcttcgattgcttcacaggcgttgaaccggatcagagcgaagggaatatatagcctcactaggcaggaattgatgatttgaattcgcac

SEQ ID NO: 2814 - DNA, 390 bp, Artificial
  Synthetic
aacaatctcagatcttcatctcaactttcaatcttccacacaagcaaataaccaaccaaccaaccaatcacaatggattccatcaagcagggcgccaactacgtcggtgagaaggttcagcaggccacctctggtgcctccaaggagaccaacaagcaggtcgccaaggactccgatgcctctgtcggcactcgtgcctccgctgccaaggacgctctcggtgacaagatggacgagtccaagcacgacgccaagggcgaggcccacaagcaggccatctaaatggactgagtgagagggaacgatgacaacacttttgcttctaccccgtcttgagagacaaatagtcgatacccctatgagaactcaataatacaactttttcagcct

SEQ ID NO: 2815 - DNA, 694 bp, Artificial
  Synthetic
ccgcaatccctccctcctcgaatgggtccaattgtcgcccgcaaatcgcccgcaccgtcgccgaagccgaatcattcatcatgtccgacgaggaaggccaggagcttgtcaccaagcccttcaagtttgtcactgctggtgagattgtccaacacggccccttctacgtgaacgaaacgaccgaccggctcgggcagcttcatcaatgcattgcccatcgactgcgagctacttacccgcagcttggaatagcttgagctttgcccgtcgccggaggacccgcttcgcagatatatataccttcgttatatatgcacacatgtcgctaacccgagtgctcgcgcaggcactgatgcccgtttccccaacgtgaatcagaccaagcactgctggcaaaactacgtcgactaccacaagtgcattctcgccaagggagaggactttgcgccttgccgtcagttctggttggcctaccgatcactgtgcccttctggatggtaccagcgatgggacgagcagcgcgagtctggtaacttccctgtgaagctcgatgcttaaattccatatttgaggtggcggggtacataagcaagggtgttcacatagattaagcagccaggcggcgcatgtgctgccagaaaatgtagtagtagtcaatcacaagcaaacaggctcaatttttgactgttaaaat

SEQ ID NO: 2816 - DNA, 538 bp, Artificial
  Synthetic
agctatatcgttcttcaccagtagcagtatcaccccactgtcgctatcatggcccgcggaaatcagcgtgatttggcgcgcgcaaaaaatcagaagaatgcgtccaaacataaaggcggcaataccgagaacggatatgagcaagcaaaatccaagttgagtaacgccgagattatgaggcagaagcaagccaaagccaatgccgagagagacctagcggcagcaaaggcattacaagagaaaagggacgcaaaggcgaagaaaccgactgaattgggcgcttcagctgtggaggttactggacatgcaaataacccaagaggatagcaagagatgggagaaaacacggcacggcgaaatcaggcgctccttgagactttcacaatacggcgcaaatttgggacaatctaggtgaagagggggaagcgttttttggcttaataccaggtatagccatggataatagcgaaatggatattttgttgcggtattgctattattattctaccaaaaaaagttcgacctttgtgaaaaaaaa

SEQ ID NO: 2817 - DNA, 607 bp, Artificial
  Synthetic
agagagagagagagagagaggggggtagaggagagagagagatatagatagatagacagatagagagagagaggagagagagaattccgtcaccatgccgcccaagttcgatccctcgcaggtggtagaagtgtatgtccgtgtgacagggggtgaggtcggcgcggcctcatcgctggccccgaagatcggccccctcgggctgtccccgaagaagattggggaggacatcgccaaggagacctccaaggactggaagggcctccgtgtcaccgtcaagctgactgtccagaaccggcaggccaagattgccgtcgtccccagcgccgctgccctcgtcatcaaggcactcaaggagcctgagcgcgaccgcaagaaggtgaagaacatcaagcacactgggtccatcaccctcgacgacgtcatcgacatagcccggatcatgcgcccccgctccatggccaagcacctcactggaagcgtcaaggaaatccttggaacctgtgtctctgtcgggtgtactgtcgatgggaaggaccctaaagacctgcagactgagatcgacgagggagaagtggaaatccccgaggattaaacaaacaggcca

SEQ ID NO: 2818 - DNA, 315 bp, Artificial
  Synthetic
cccacgcgtccggaaactccaaaacacagagccatgccgccgaagttggacccgagccagatcgtcgatgtgtacgtccgtgtaaccggaggagaagtgggagccgccagttctctagctccaaagatcggtcctctcggtctcgcaccaaagaagatcggagaagacatcgcgaaagagacggccaaagaatggaaaggacttcgtgtcaccgtgaagctgacggttcagaatcgtcaagctaaggtaaccgtggttccatctgctgcagctctcgtcatcaaggcgttgaaggagccagagagagaccgtaag

SEQ ID NO: 2819 - DNA, 719 bp, Artificial
  Synthetic
aaagcccaagccctagctacactcttcctctacttttctaagtgtaacaaaaatgccgccaaagttcgatccttctcaggttgtcgaagtcttcgtccgcgtcaccggcggcgaagtcggtgcggctagttcactcgctccaaaaatcggtccactcggtctctcccccaagaaaatcggagaagacatagctaaggaaaccgccaaggattggaagggccttagagttaccgtcaagctcaccgtccaaaaccggcaggccaaagtctccgtcgtaccttccgcagcggcgctcgtaatcaaggctttaaaggagcctgagagagatcgcaaaaagacgaagaacatcaagcacaatgggaatatttcgctggatgatgtgattgagattgcgaaagtgatgaagccgagatctatggcgaaggatttgacaggtactgtgaaggagattttggggacgtgtgtgtccgttggatgtactgttgatggaaaggatcctaaggatttgcaacaggagattgatgatggtgatgttgagattcctctggattgaggaataagaggttaattttaagatgtgtttgttatatttagtattattatgtgatattttgtttatttggatttgaggataattttggagaaattgtcagttttattggcattgttaggatttgattattaccttttttatgttgatgaaatgctctattttgttt

SEQ ID NO: 2820 - DNA, 619 bp, Artificial
  Synthetic
tcgctccaaaaatcggtccactcggtctctcccctaagaaaatcggagaagacatcgcaaaggaaaccgcaaaggactggaagggtcttcgagtcaccgtgaaactcactgttcagaaccgtcaagctaaagtctccgtcgtaccgtccgccgcggcactcgtcatcaaggcattgaaggagccggagagggatcgcaaaaagacgaagaacatcaagcataatgggaatatatcgcttgatgatgtgattgagattgctaaagtgatgaagcctagatctatggctaaggatttgaatggaacagtgaaagagattttggggacttgtgtttctgttggatgtactgttgatggaaaggatcctaaggatttgcagcaggaaattgatgatggtgatgtcgaaattcctctggattaaggaggttaaattctgaaattctcgcgatatagtagttttaaaatttgaatttgtatcgttttggattttcagagagattttatcagaggataattttgatttgatatcatatcatgatgagaatactctctttggaaaatttttggaaacaaatgttggcttttatttggaattgttataagattttggatgattatgat

SEQ ID NO: 2821 - DNA, 522 bp, Artificial
  Synthetic
gaaaaaatgcctcctaagtttgaccccaatgaggtgaagatcatctacctgcgagccatgggtggtgaggtcggagcttcctccgctcttgctcccaagattggtcctctcggtctgtcccccaagaagattggtgaggatatcgccaaggccaccaaggcccacaagggtgtccgagtcactgtccagctgaccatccagaaccgacaggccaccgtctccgtcgtcccctctgcctcttctctggtcattgctgctctcaaggagcccccgcgtgaccgaaagaaggacaagaacgtcaagcacaacggtaacatccccctggaggagatcattgagattgcccgaaccatgcgatccaagtctttctccaaggagctgtccggaaccgtcaaggagattcttggtactgcccagtctgttggcgcccgtgtcaacggtaagcccgctcacgtcatgattgatgctatcaacaacggcgagcaggacatccccgataactaaagttgtcgtaaaaaataa

SEQ ID NO: 2822 - DNA, 705 bp, Artificial
  Synthetic
gctcattatcctcccctggcaagcaaaccacgagcctctgtcagataatcaatcgccatcatgcctcccaagttcgatcccagcgaggtcaaggtcatgttagttcacacaatgcgtcgcttcacgtcccgcgatcatcaggtctaacttgcagcttacagccacctccgtgccaccggtggtgaggttggtgcctcttcggcccttgctcccaagattggtcctcttggtctgtcgcccaagaaggtcggtgaagatatcgccaaggccactggtgactggaaaggtctccgtgtcaccgtcaagttgaccattcagaaccgtcaggctgccgtctctgtcgtgcccactgcctcctctctcatcatcaaggccctcaaggagcccccgcgtgaccgcaagaaggagaagaacatcaagcacaacaagtccgtcagcctcgatgagatcattgagattgcccgcaccatgcgcttcaagtctttcgccaaggagctgaagggaaccgtcagggagatgctgggaactgctcagagtgttggctgccaggtcgatggaaagaccccccaggctatcctggaggccatcgagaacggcgagattgatatccccgaggagtagagtgtctggttcagaccgcctgtcccaccgagaagaaattctcgtgcattggtgacacatcaaaaatagaaaaaaaggtcaacc

SEQ ID NO: 2823 - DNA, 670 bp, Artificial
  Synthetic
gctcattatcctcccctggcaagcaaaccacgagcctctgtcagataatcaatcgccatcatgcctcccaagttcgatcccagcgaggtcaaggtcatgttagttcacacaatgcgtcgcttcacgtcccgcgatcatcaggtctaacttgcagcttacagccacctccgtgccaccggtggtgaggttggtgcctcttcggcccttgctcccaagattggtcctcttggtctgtcgcccaagaaggtcggtgaagatatcgccaaggccactggtgactggaaaggtctccgtgtcaccgtcaagttgaccattcagaaccgtcaggctgccgtctctgtcgtgcccactgcctcctctctcatcatcaaggccctcaaggagcccccgcgtgaccgcaagaaggagaagaacatcaagcacaacaagtccgtcagcctcgatgagatcattgagattgcccgcaccatgcgcttcaagtctttcgccaaggagctgaagggaaccgtcagggagatgctgggaactgctcagagtgttggctgccaggtcgatggaaagaccccccaggctatcctggaggccatcgagaacggcgagattgatatccccgaggagtagagtgtctggttcagaccgcctgtcccaccgagaagaaattctcgtgcat

SEQ ID NO: 2824 - DNA, 597 bp, Artificial
  Synthetic
gctcattatcctcccctggcaagcaaaccacgagcctctgtcagataatcaatcgccatcatgcctcccaagttcgatcccagcgaggtcaaggtcatgttagttcacacaatgcgtcgcttcacgtcccgcgatcatcaggtctaacttgcagcttacagccacctccgtgccaccggtggtgaggttggtgcctcttcggcccttgctcccaagattggtcctcttggtctgtcgcccaagaaggtcggtgaagatatcgccaaggccactggtgactggaaaggtctccgtgtcaccgtcaagttgaccattcagaaccgtcaggctgccgtctctgtcgtgcccactgcctcctctctcatcatcaaggccctcaaggagcccccgcgtgaccgcaagaaggagaagaacatcaagcacaacaagtccgtcagcctcgatgagatcattgagattgcccgcaccatgcgcttcaagtctttcgccaaggagctgaagggaaccgtcagggagatgctgggaactgctcagagtgttggctgccaggtcgatggaaagaccccccaggctatcctggaggccatcgagaacggc

SEQ ID NO: 2825 - DNA, 522 bp, Artificial
  Synthetic
gctcattatcctcccctggcaagcaaaccacgagcctctgtcagataatcaatcgccatcatgcctcccaagttcgatcccagcgaggtcaaggtcatgttagttcacacaatgcgtcgcttcacgtcccgcgatcatcaggtctaacttgcagcttacagccacctccgtgccaccggtggtgaggttggtgcctcttcggcccttgctcccaagattggtcctcttggtctgtcgcccaagaaggtcggtgaagatatcgccaaggccactggtgactggaaaggtctccgtgtcaccgtcaagttgaccattcagaaccgtcaggctgccgtctctgtcgtgcccactgcctcctctctcatcatcaaggccctcaaggagcccccgcgtgaccgcaagaaggagaagaacatcaagcacaacaagtccgtcagcctcgatgagatcattgagattgcccgcaccatgcgcttcaagtctttcgccaaggagctgaagggaaccgtcagggagatgctg

SEQ ID NO: 2826 - DNA, 448 bp, Artificial
  Synthetic
gctcattatcctcccctggcaagcaaaccacgagcctctgtcagataatcaatcgccatcatgcctcccaagttcgatcccagcgaggtcaaggtcatgttagttcacacaatgcgtcgcttcacgtcccgcgatcatcaggtctaacttgcagcttacagccacctccgtgccaccggtggtgaggttggtgcctcttcggcccttgctcccaagattggtcctcttggtctgtcgcccaagaaggtcggtgaagatatcgccaaggccactggtgactggaaaggtctccgtgtcaccgtcaagttgaccattcagaaccgtcaggctgccgtctctgtcgtgcccactgcctcctctctcatcatcaaggccctcaaggagcccccgcgtgaccgcaagaaggagaagaacatcaagcacaacaagtccgtcagcctcgatgaga

SEQ ID NO: 2827 - DNA, 373 bp, Artificial
  Synthetic
gctcattatcctcccctggcaagcaaaccacgagcctctgtcagataatcaatcgccatcatgcctcccaagttcgatcccagcgaggtcaaggtcatgttagttcacacaatgcgtcgcttcacgtcccgcgatcatcaggtctaacttgcagcttacagccacctccgtgccaccggtggtgaggttggtgcctcttcggcccttgctcccaagattggtcctcttggtctgtcgcccaagaaggtcggtgaagatatcgccaaggccactggtgactggaaaggtctccgtgtcaccgtcaagttgaccattcagaaccgtcaggctgccgtctctgtcgtgcccactgcctcctctctcatcatcaagg

SEQ ID NO: 2828 - DNA, 328 bp, Artificial
  Synthetic
gctcattatcctcccctggcaagcaaaccacgagcctctgtcagataatcaatcgccatcatgcctcccaagttcgatcccagcgaggtcaaggtcatgttagttcacacaatgcgtcgcttcacgtcccgcgatcatcaggtctaacttgcagcttacagccacctccgtgccaccggtggtgaggttggtgcctcttcggcccttgctcccaagattggtcctcttggtctgtcgcccaagaaggtcggtgaagatatcgccaaggccactggtgactggaaaggtctccgtgtcaccgtcaagttgaccattcagaaccgtcagg

SEQ ID NO: 2829 - DNA, 298 bp, Artificial
  Synthetic
gctcattatcctcccctggcaagcaaaccacgagcctctgtcagataatcaatcgccatcatgcctcccaagttcgatcccagcgaggtcaaggtcatgttagttcacacaatgcgtcgcttcacgtcccgcgatcatcaggtctaacttgcagcttacagccacctccgtgccaccggtggtgaggttggtgcctcttcggcccttgctcccaagattggtcctcttggtctgtcgcccaagaaggtcggtgaagatatcgccaaggccactggtgactggaaaggtctccgtgtca

SEQ ID NO: 2830 - DNA, 224 bp, Artificial
  Synthetic
gctcattatcctcccctggcaagcaaaccacgagcctctgtcagataatcaatcgccatcatgcctcccaagttcgatcccagcgaggtcaaggtcatgttagttcacacaatgcgtcgcttcacgtcccgcgatcatcaggtctaacttgcagcttacagccacctccgtgccaccggtggtgaggttggtgcctcttcggcccttgctcccaagattggtcc

SEQ ID NO: 2831 - DNA, 149 bp, Artificial
  Synthetic
gctcattatcctcccctggcaagcaaaccacgagcctctgtcagataatcaatcgccatcatgcctcccaagttcgatcccagcgaggtcaaggtcatgttagttcacacaatgcgtcgcttcacgtcccgcgatcatcaggtctaact

SEQ ID NO: 2832 - DNA, 75 bp, Artificial
  Synthetic
gctcattatcctcccctggcaagcaaaccacgagcctctgtcagataatcaatcgccatcatgcctcccaagttc

SEQ ID NO: 2833 - DNA, 609 bp, Artificial
  Synthetic
aaaccccagccaccgccgccgccgccgccaccaccgttgccgttgccgcctccaccacccgccctcgaccacagccatgccgccgaagctcgacccgacccaggtggtggatgtgttcgtccgcgtgaccggcggtgaggtcggcgcggcgtcgtcgctcgcccccaagatcgggccgctcggtctctccccgaagaagatcggagaggacatcgccaaggagaccgccaaggactggaagggcctccgcgtcaccgtgaagctcaccgtccagaaccggcaggccaaggtctccgtcgtcccctccgccgcggcgctcgtcatcaaggcgctcaaggagcccgagagggaccgcaagaaggtgaagaacatcaagcacagcggcaacatcagcctcgacgacgtcatcgagatcgcgagggtcatgaggcccaggtccatggccaaggagatggccggcaccgtcaaggagatcctcggcacctgcgtcagcgtcggctgcaccgtggacggcaaggaccccaaggacctgcagcaggagatctccgacggcgaggtcgagatcccctcagcttaagcaggtttggcattggggtggttgttatgtga

SEQ ID NO: 2834 - DNA, 502 bp, Artificial
  Synthetic
gagagagagagaggggggtagaggagagagagagatatagatagatagacagatagagagagagaggagagagagaattccgtcaccatgccgcccaagttcgatccctcgcaggtggtagaagtgtatgtccgtgtgacagggggtgaggtcggcgcggcctcatcgctggccccgaagatcggccccctcgggctgtccccgaagaagattggggaggacatcgccaaggagacctccaaggactggaagggcctccgtgtcaccgtcaagctgactgtccagaaccggcaggccaagattgccgtcgtccccagcgccgctgccctcgtcatcaaggcactcaaggagcctgagcgcgaccgcaagaaggtgaagaacatcaagcacactgggtccatcaccctcgacgacgtcatcgacatagcccggatcatgcgcccccgctccatggccaagcacctcactggaagcgtcaaggaaatccttggaacctgtgtct

SEQ ID NO: 2835 - DNA, 649 bp, Artificial
  Synthetic
aaatgccgcccaagttcgatccatctcaggtggtcgaggttttcgtccgagttaccggcggtgaagtcggagctgcgagttcactcgctccaaaaatcggtccacttggtctctcccctaaaaaaatcggtgaagacatcgcaaaggaaaccgccaaggactggaagggtctccgagtcacagttaaactcaccgtccaaaaccgtcaagctaaagtttccgtcgttccctctgccgctgcactcgtcatcaaggcgttgaaggagccggaacgtgaccgtaagaagaccaaaaacatcaagcataacggtaacatctcgctcgatgacgtcatcgagatcgctaaggtgatgaagccgagatcgatggcgaaggatttgactggaacagtgaaggagattttgggcacgtgtgtatcagttggctgtacggtagatgggaaggatcctaaagacttgcagcaagagattgatgatggtgatgtcgagattcctctcgattgaacgctaattatcaactgatggtaatattatgttaatttttttttgacgttgtcatcttgaggatcattttgatataactatgactagtaaacactggaattttatatttggcaatgtagtttggattttgtttttgctcgatgaag

SEQ ID NO: 2836 - DNA, 709 bp, Artificial
  Synthetic
cttttcgtttgccactttttgatcatgcgaaactccaaaacacagagccatgccgccgaagttggacccgagccagatcgtcgatgtgtacgtccgtgtaaccggaggagaagtgggagccgccagttctctagctccaaagatcggtcctctcggtctcgcaccaaagaagatcggagaagacatcgcgaaagagacggccaaagaatggaaaggacttcgtgtcaccgtgaagctgacggttcagaatcgtcaagctaaggtaaccgtggttccatctgctgcagctctcgtcatcaaggcgttgaaggagccagagagagaccgtaagaaggtgaagaacattaagcataacggtaacatctctttcgatgatgtgactgagattgctaggattatgaggcctagatctattgctaaggagctgagtgggactgtgagggagattcttggaacgtgtgtctctgtgggatgcactgttgatgggaaagaccctaaggatcttcagcaggagattcaagaaggtgagattgagattcctgagaattaaggaacaatggagtttttttttcttcttatgggaatttgaaatgcttctgttgttatctttctcgttttaccatattttgtttttgtttgggaacttagctgctatgatgtttcacttagaatgactctcaagttttggattcttattattctctgtttc

SEQ ID NO: 2837 - DNA, 690 bp, Artificial
  Synthetic
cccacgcgtccggagaagaatcagagaaaatgccgccgaagttggatccatctcaaatcgtcgacgtctacgtccgagtcaccggaggtgaggtcggagcagcgtcttcactcgctccaaagatcggtccactcggtctggcaccaaagaagatcggagaagacatcgccaaagagacagcgaaagaatggaaaggtcttcgagtcaccgtgaagcttacggtacagaatcgtcaagctaaggtcacagtggttccatccgcagcggctctagtcatcaaagccctcaaggagccagagagagataggaagaaagtgaagaacatcaaacataatggcaacatttcgtttgatgatgtgattgagattgctaagataatgcgtcctagatctatcgctaaggaattgagtggaacagtgaaggagattttaggaacttgtgtctcttttggttgcactgttgatggtaaagaccctaaggatcttcaggaaaattaacagtggtgacattgatattcctaacgagtgataaaggtttttacttttgagttctctatcgttttattttttgtatttgattttgaggatttggtattagtaatactatatttcggaagttgagaattgttggcttttgcccatttgaatcctttcttgggattaatcaaaatgttcaattttctacaaaaaa

SEQ ID NO: 2838 - DNA, 633 bp, Artificial
  Synthetic
cgcaaaggtcgttgagcctttcttgccccagctctaccagcttccccaccacatctgggagagcatcgacagtctcgatgccctgagagagctctatgtcacgacgaatcccctgatttcaggctttgcggcctctctggttgttgggcttctcgccttgatcgtgtccgagatcaatcgcaactattctcagatcgaccgcctgtggagtatcctgcccaatctatacgttgtccacattgcgctctgggcacgtgtagctggtttgccgcatggtcgagtagatttgattgctgtctgtacaacattatggagtattagattgacgtacaactactggagacgtggcggctacaacattggctcagaagactacagatggatgattgtcaaagcgcaactcaactcagttgtctggttcatcttcaacgtcaccttcatttcgtttatccagagcatcctcctgtacctcttctcgtgtgtgccggcatacgtcatcttgctatcatctcagtttgagcctgaagttcaggcagttgatctggtctttgccggcgttgagattcttcttgtcctgagcgaatggattagcgatggccagcaatgggcttttcaaaccgccaaatacaaata

SEQ ID NO: 2839 - DNA, 586 bp, Artificial
  Synthetic
atcaaactatttcagcaattggaccctcgcgggagccgaggcgcaaagatataggccaagatgaggtcattaggagagcggttaaacctgcttcgaaagaaactcattaacatcagatgcggccccggcgcagcgatcctccccgcggaggtcacccggatacacatggacttcgccctccgtctaaaaggcggccacatgggagctaggaaattctggagagaatacctcccccgcctgaaataccacaacccttccatccccatgatcgtcaaccgccacgaccagaaccagctccccccaaccatgacaatctacctccgcaaggccggctcctcagtagcagacccagcgtcttcttcttcttcttcttcctccgaacccatcgcccagccctcatcctcccgaacgaacctctccaaggcccagccccccaccgcggacgagcgcgtcgtccacatcgacatggccaacaagcactcatcacacatcctcgagttcttcatggccgagacccgcgccgttccgctgcagcccacgaacgaggagattgccgagatgcaggccctcgaaacgctgcgcaaga

SEQ ID NO: 2840 - DNA, 80 bp, Artificial
  Synthetic
catcaaacagctcttgggatccgttctgatccagccaacaaccatcgccatgtctgaacctctcaccaagtcgactccgc

SEQ ID NO: 2841 - DNA, 760 bp, Artificial
  Synthetic
tcatccatcgtctttgattcatcaaacaggtaaacagccttgatagtccctttggcatcttctgcatctccggcttacacagtcaatccagctcttggatccgttctgatccagccaaccaaccatcgccatgtctgaacctctcaccaaggtcgactccgccgttcaaggcctgtcatcatcaccgcccaaagagaagggccataggagaacaagctctagcgcggctggtgttatgaccattgcggaaatcaatgaaagccatgctcctctagaactcgcaatagagacacagcagacagcgtggaaaataaatcagcggcccaaggatctcgacaatgatcagctgctacaggttcccctcaccaagcctcccatcaagagcataacattgaggttccctcatggcaaagaagtcgtggctcgcaacctgaagggcctgacaataggtgacgccctgtcggccattcacaaggcaaacaagaaccgagctgatgatgagcttgataatccatacctcaagggcttcgcatgggatcagggcgagaactactttgaagtacatctccagagccagccggcgacgggctcgtcaagcggcggtggcggtggcaagaagaagaagaagtccaaggacaatgacgagtaaatgaatatccacccatcctaatgtctgttcaatagttccttcaattgtttttttgtttggcttcgcctggttcgtgcgagtcggcgcccgggatattgcaactagatgttg

SEQ ID NO: 2842 - DNA, 629 bp, Artificial
  Synthetic
tctttcgatatctcatccttgcaactcgggtgtctcctgcagcaccgaatatcgtttcctggaaactttaaatctatcaaaacaacaacttccttttacacatccaccatgaagttctctagctttgctgtccttgccgttgccgcccttgttcaggccaacccagctccctctcccgccccatctcctgctcccggcctgggcgacttcatcgacgacgcttccacctggctcactggcaaggccggcgaggtcaagacctggctctccgacaaggctggcgaggcctcctccttcgccagccacgtccagtccaaagtcgacgccaacgagtccaaggccagcgcggcagccagcgccatcaaatccatcttcgacgatgcgccctccagcgtcatcgccagcctgacctccgaagccggctccaagttcagctccctcagcagcgttgccgccactgccaccggtgcagctgcctcctcggtcaacgccgacatttccaagctcagcgcctcccttgccagtgcgaccagtgaggctgccgctgccgcgtccacaaagtcccacgacgctgctcctgtccagactgcctatattgcaattggagccctgatgggcggagctgctgt

SEQ ID NO: 2843 - DNA, 569 bp, Artificial
  Synthetic
gttattgtcgtcatcggctcttcgtcgcccaattcgacgtcgttgcattccgaatggcaccagccgcgcactcatactcttcatactcttcaatggactgtttggcgtaggttgtcgatagcctcaaatatctagagagcagcgatagccacaagacactcgacaagactcgattcgagagctcgcgacaagcgcaccatagaaaatgccagctcggcggaacaggcgcttcttctcgcgagagccattccacaatgacgaccggctaacattgcagcacgccgaggggccttttggctttctcaatccaacaagagctcatttcgaccactcagcactggctccgaagccgacgcctgacgagatagcggaaccacatgagagcggcgatgatgcggaaaccaagcaccaacagacaaaacaagccgccgattcgaacgtccccgccaagaacgtcaagttcctatggcggtctcgagacaatcgaaagggtcggcatcccttgctcgttcaaaagccgctcccgggagaggaagcgcctttcgtgacaccaaggtgcacgtcgcatc

SEQ ID NO: 2844 - DNA, 571 bp, Artificial
  Synthetic
aaaaaaggaaagttagcaagcaaaggtttcgtactgtcaaaatgaacatgtcacaacaatcaccgtcaccgtccgctgaccggaggttgagtgttctggcgagacaccttgaaccatcgtcctgcgccaccgtcgaatcctctatcgtcgctgctcctacctccggaaatgctggaaccaactctgtcttctctcacatcgttcgcgctcccgaagatcctattcttggcgtcactattgcttacaataaagatagcagccccatgaagttgaatttgggagttggtgcatatcgcacagaggaaggaaaacctcttgttttgaatgttgtaagacaagcagagaagctactagtaaatgacaggtcccgcgttaaagagtacctatctattactggactggcagacttcaataaattgagtgctaagctgatacttggcgccgacagccctgctattcaagagaacagagtaacaactgtccagtgtttgtctggcacaggctcattgagggttggagctgaatttttggctcgacattatcatcaacgcactatttatattccccaacc

SEQ ID NO: 2845 - DNA, 609 bp, Artificial
  Synthetic
gaattcacaaccatggaatctcaaaactctgggttctaatatttcaatgtctcctactgcttctcatggtgattctgtttttgctcacattgttcaagctcctgaagatccaattttaggggttactgttgcttataataaagatccaagtccaattaagttgaatttaggagttggagcttatcgaactgaggaaggaaaaccacttgtattgaatgttgtaagaaaagctgaacagatattagttaatgacaggtctcgtgtgaaagagtatcttcctattactggattgggagaatttaacaaattgagtgccaagctcatttttggtgctgacagccctgctatccgtgagaacaggattactactgtccaatgcttgtctggcactggctcgctgagggtgggaggtgagtttcttgcaagacattaccatcagcgaacaatatatattccacagccaacatgggggaaccatatcaaagtattccaattggcagggttgtctgtgaaatattatcgctactatgacccaaaaacacgtggattggacttccaaggtatgctgggggatctctcttctgctccatcaggagccatagttcttct

SEQ ID NO: 2846 - DNA, 579 bp, Artificial
  Synthetic
acagggagagtagcttccattccattccatccggtagggctatggcgactagcatggcgctcaacgagattgctgctccagcggcgtccaagatgtcttccagcccagccgcaaagagcttcgttgggctccgcacggctgcgttttccacgaagaaggcatcttttccatccatgaagtgtgctgcgaaggtcaatatggctatcgctgccgacgtttctcgctttgagaacgttagcatggcacctccggatccaattctcggtgtttcagaggcattcaaggcagataacgatgctaccaagttaaaccttggcgttggtgcttacaggaccgaggatctccaaccttatgttcttaaagtcgtgagaaaggctgagaagctcatgctggagaagggagagaacaaagagtatcttcctatcgagggtcttgccgcatttaacaaggccactgccgaacttctactcggagctggcaatccagttatcaagaatggccggattgccaccgttcaaggcctatctggaaccgggtctctgcgtctgggagctgcatttattgcaagatacttcccct

SEQ ID NO: 2847 - DNA, 583 bp, Artificial
  Synthetic
atcagctatggagagcgtggcgctcaagcgagtttctgctgtagccaaccatctcaatcccgagcagcagcagcagcagcagcagcaactctccatggctgtcgccgccagcgccggcgcctcttcggtgtttgatcatctggagcaggcgcccgaggatcccattctgggaataactgtggcatacaacaaggaccctcatcccgggaaagtgaaccttggagtcggagcttaccgcacagaggaagggaaaccccttattttgcatgtggttcatcgtgctgaggaacgtcttctagctgatcgccctgctatcgtggagaagagattggtaactgcgcagtgcctttctggaacgggttccttgcgtgtaggagccgagtttctttcaagacattatggtgtgaagctggttttccttcctaccccgacgtggggaaatcacttcaaggttttcatgaatgctggacttggtgttaagacgtatcgttactatgacagcaaaactcgtggtcttgactatgagggtatgctcgaggacataagtgcagctccgaccggatcggttattctcttgcatgca

SEQ ID NO: 2848 - DNA, 708 bp, Artificial
  Synthetic
catggcgatccgagccgcgatttccggtcgttccctcaagcttagctcgtcggtaggagcgcgatctttgtcgtcgttgtggcgaaacgtcgagccggctcctaaagatcctatcctcggcgttaccgaagctttcctcgccgatcctactcctcataaagtcaatgttggcgttggagcttacagggacgacaatggaaaacccgtggtactggagtgtgtcagagaagcagagcggaggatcgctggtagtttcaacatggaatatcttcctatgggaggtagtgtcaacatgatcgaggagtcactgaagttagcctatggggagaactcagacttgataaaagataagcgcattgcagcaattcaagctttatctgggactggagcgtgccgaatttttgcagacttccaaaggcgcttttgtcccgattcacagatttatattcctgttcctacatggtctaatcatcataacatttggaaagatgctcacgtccctcagaaaacgtaccattattatcatcctgaaacaaaggggttagactttgctgcactaatggatgatataaagaatgccccaaatggatccttctttctgcttcatgcttgtgctcacaatcctactggggtggatcctacagaggaacaatggagggagatctcacaccagttcaaggtgaagggacattttgctttctttgacat

SEQ ID NO: 2849 - DNA, 1120 bp, Artificial
  Synthetic
gctccatcttcatctccccgtctttcatcgtcgcgttcccgtgcaggaggaagcaggagtttgtctgtctgtccgctgccttttccagtgctttcggtgtagtttgtcgcaggttgacactcttccgttttccatcacaaatccccatcacaatcgtcacaatgcggaccgctgtcgctctctctgtggccgctgttgcccaggccagcactttccagattggcaccatccacgagaactctgcccccgttctcagcaccgttgaggccaacgccatccccgatgcgtacatcatcaagttcaaggaccacgttggtgaggctcaggccgagaagcaccacgactggctccagagcgtccacagctccggcgagcaggagcgccttgagctccgcaagcgaagcagcatcttcggctcagacgacgtgtttgacggcctgaagcacaccttcaagatggacggcttcaagggctatgctggtcacttccacgagtccaccatcgagcaggtccggaatcacccggatgtcgagtacatcgagcgcgacagcattgtccacactatgcttcccctcgagtccaaggacaacatcatcattgaggattcttgcactcccgagactgagaagcaggctccttggggtcttgctcgtatctctcaccgagataccctcaacttcggctccttcaacaagtacctctacaccgctgagggtggtgagggtgttgatgcctacatcattgacactggtaccaacattgagcacgtcgacttcgagggtcgtgccaagtggggaaagaccatccctgccggcgacgaggacgaggatggcaatggccacggcactcactgctctggtaccgttgctggtaagaagtacggtgtggccaagaaggcccacgtctacgccgtcaaggtgctccgatccaacggatccggcaccatgtccgacgtcgtcaagggcgtcgagttcgccgccatctctcaccaggaggccgtgaagcaggccaaggatggcaagcgaaagggcttcaagggctccgtcgccaacatgtctcttggtggtggcaagacctctgcccttgacgctgctgtcaacgctgccgtcaaggccggtat

SEQ ID NO: 2850 - DNA, 762 bp, Artificial
  Synthetic
gccccggccgttctggcattgccggcctctgatgccgcattgaccagacgccagaccagcctctcaaccatcacagaccaatatctcttcaccagcgttgccatcaaagtaaaaggctctatcccctcatcatgaagtttgcagctcttctggccactcttgccccggccgttctggcattgccggcctctgatgccgcattgaccagacgccagaccagcctctcaaccatcacagaccaatatctcttcagcctcactctccctgatttcatttcccgccgcaatgccaagaacccagccacccttgactggacgtctgacggctgcaccagctcacccgataacccttttggattcccttttgttcctgcttgctaccgccacgactttggctaccaaaactaccgcatccaaaaccgattcacagagagcggcaagctcagcatcgataacaacttcaaggccgatctatacttccagtgccagacatcgagtgtccaaagcgtttgcaatgctcttgctgatgtttactacgctgctgtgagagcgttcggaggcggcgatgcttctcctggaaagcgcgaacaatcacaagaggacttggttaaggtgtatgaagagaagctggagatttacaacaacgccgtgaaggatgcccaggacaagggactgctgcccatcttggagtaaggggataaagcgtactgcatacttttatatgattgacgataccaaatatgaaataaaattcttctacatg

SEQ ID NO: 2851 - DNA, 605 bp, Artificial
  Synthetic
agccttgccttggcaaatagacaacagagaccctgtttcaagcccgttgactctgtgaagccagatctggatttggcttccatgcgtgcgtcttatactttcaggagaacgccgcagtagactacttaaagacttactctccccacgtcaagacgttcctcttcatccatcttttccaagcacgacaccatgactacccgctcccttcctagcaatggcagctctgcctttgactacatcatcgttggtggaggcaccgcaggctgtgtgattgcctcgagactctccagctatctgcccgagctccgcgttcttctcatcgaggctggtccctccgactttaacctcaaccacgtcctcaatctgagagaatggctgagcctgctgggcggcgagctagactacgactacggcacgacagagcagcccatgggtaacagccatatccgccattctcgtgccaaggttcttggaggatgctcgtcacacaacacgctcatttccttccgtcctttccgccacgacatggaccgctgggttgctcagggctgcaaaggctggacctttgagaatgtcactcgtcacattgacaaccttcgcaacac

SEQ ID NO: 2852 - DNA, 799 bp, Artificial
  Synthetic
actcactatagggcgaattcgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgct

SEQ ID NO: 2853 - DNA, 703 bp, Artificial
  Synthetic
cgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctg

SEQ ID NO: 2854 - DNA, 765 bp, Artificial
  Synthetic
gtcactatagggcgaattcgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggct

SEQ ID NO: 2855 - DNA, 739 bp, Artificial
  Synthetic
cactatagggcgaattcgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgt

SEQ ID NO: 2856 - DNA, 670 bp, Artificial
  Synthetic
cactatagggcgaattcgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgt

SEQ ID NO: 2857 - DNA, 739 bp, Artificial
  Synthetic
atcactatagggcgaattcgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggt

SEQ ID NO: 2858 - DNA, 776 bp, Artificial
  Synthetic
gagtcactatagggcgaattcgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacg

SEQ ID NO: 2859 - DNA, 592 bp, Artificial
  Synthetic
actatagggcgaattcgagctcggtacccggggatcctctagagtcggcctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactata

SEQ ID NO: 2860 - DNA, 610 bp, Artificial
  Synthetic
gctcgctaagcacctgcaaaacttaccttgacacttttgtcaatttcattctttaagaacaaccgcatcaataatcttaatcaagctccctcgagtttaattcctaataccgacaaaatgaagttcaccgctgctgtcgctctcgccgccgttggcgtttctgccgtctacgttcctcctagcaacgtcaccgttgttaccgatgtcgttgaccaatacgtcacctactgcccctacgctacccagatcacccacggcagcaagacctacaccgtcactgagcccaccactctgaccatcaccgactgcccctgcaccatcacccgccccgttaccgtcaccagcagcgttgtctgcaacacctgcggtaacgccgcccctactggtgctccctccggtggcaacggcggtggttacactcctcctgccttcaccaactccaccatcaccacccctacccaggcccctccccccagcggccctgccagcactggtggtgttgttcctactgctcctcccgccgtccccactggcggtgccagcaaggccgtcctctccggcgccggccttgccggtatcgtcggtctggccgccttcgtcctgtaaatct

SEQ ID NO: 2861 - DNA, 667 bp, Artificial
  Synthetic
ggattcttttcactaaccaattttctctcctacatttctttaaaccccattcttctctcctaagccatggcatctgacaagaagatcaagatcggaatcaatggatttggaaggattggtcgtttggtggcaagagttgctctgcagagagatgatgttgaactagttgcagtgaacgatccatttatctctactgattacatgacatacatgtttaagtatgattcagttcatggacaatggaaacaccacgagcttaaagtcaaggatgaaaagacccttctttttggtgagaagtccgtcagagtcttcggaattaggaaccctgaagaaattccatgggctgaagctggtgctgatttcgttgtggaatccactggtgtcttcactgacaaggacaaggctgctgctcacttgaagggtggtgccaagaaggtcgtgatctctgctcctagcaaggatgcccccatgtttgttgtgggtgtcaacgagaaggagtacaagccagaatatgacattgtctccaatgctagttgcactaccaactgccttgcacctttggctaaggtcatcaatgataggtttggaattgtggagggcctcatgactactgtccactcccttactgccacccagaagactgttgatgggccatccatgaaggact

SEQ ID NO: 2862 - DNA, 557 bp, Artificial
  Synthetic
accgtgcacggccaatggaagcacagcgacatcaagatcaaggactccaagactctgctcttgggcgagaagccggtcaccgttttcggcatcaggaaccctgacgagattccgtgggctgaggctggtgctgagtatgtcgtggagtccaccggtgtcttcactgacaaggagaaggctgctgctcacttgaagggtggtgccaagaaggttgtcatctcagccccgagcaaagatgctccgatgtttgtctgcggtgtcaacgaggacaagtacacttcagatattgatattgtctcaaatgctagctgcaccacaaactgccttgctcctcttgccaaggtcattcatgacaactttggtattatcgagggtctgatgacaactgttcatgccatcactgccacccaaaagaccgttgatggaccgtccagcaaggactggaggggtgggcagggcggccagttttaacatcattcccagcagcactggtgctgccaaagctgttgggaaggttcttcctgatttgaatggcaagcttacgggaatgtccttcc

SEQ ID NO: 2863 - DNA, 385 bp, Artificial
  Synthetic
aattcggcaccagctcaatttttataacggatccctctgcgatgttctcagctgatgccggggcatcttctccgtttcctcttctgaaatcacaggtgtatggaggattggtcgttcgaaggctagagttgctctgcagagagatgatgttgaactatttgcagtgaacgatccatttatctctactgattacatgacatacatgtgtaagtatgactcagttcatggacaatggaaacaccacgagcttaaagtcaaggatgaaaagacccttctttttggtgagaagtgcgtcagagtcttcggaattaggaaccctgaagaaattccatgggctgaagctggtgctgatttcgttgtggaatccactggtgtcttcactgac

SEQ ID NO: 2864 - DNA, 678 bp, Artificial
  Synthetic
gagttcctcgtttgctccgcctctctttcactcatgggcaagattaagatcggaatcaatgggttcggccgcatcggcaggctggtggccagggtggcgctgcagagcgaggatgtcgagctcgttgccgtcaacgatcccttcatcaccaccgagtacatgacatacatgttcaagtatgacaccgtccacggccagtggaagcatcatgaggtcaaggtcaaggactccaagaccctcatctttggcacgaaagaggttgcggtgttcggctgcaggaaccctgaggagatcccatgggctgcggctggtgctgaatacgttgttgagtctactggtgttttcaccgacaaggacaaggcagcagctcacttgaagggtggtgccaagaaggtcgtcatttctgctcccagcaaagacgcccccatgttcgttgttggtgtcaacgagaaggagtacaagtctgacgttaacattgtctccaacgctagttgcaccaccaactgcctggctcctctcgccaaggtcatcaatgacagatttggcatcgttgagggtttgatgaccactgtccatgccatcactgctacccagaagactgttgatgggcccctcgatgaaggactggagaggtggaagggctgctagcttcaacatcattcctagcagcactggagc

SEQ ID NO: 2865 - DNA, 691 bp, Artificial
  Synthetic
gcgcaagcatccctatcgtatcaactttcaactccagtcacaaatcagctacaatggctcccatcaaggtcggcatcaacggcttcggtcgaattggacgtatcgtcttccgcaacgctgttgagcaccccgacatcgaggtcgtcgccgtcaacgaccccttcatcgagaccacctatgctgcctacatgctcaagtatgattcctcccacggtattttcaagggcgacatcgatgtcgatggcaaggacctcgttgtgaacggcaagaaggtccgcttctacaccgagcgtgaccctgccaacatcaagtggagcgagactggcgccgactacattgtcgagtccaccggtgtcttcaccaccaccgacaaggccaaggctcacttggctggcggtgccaagaaggtcatcatctctgccccctctgccgatgcccccatgtacgtgatgggtgtcaacgaggacaagtacgacggctctgccgatgtcatctccaacgcctcttgcaccaccaactgcctggctcccctcgccaaggtcatccacgacaactacggcatcgttgagggtctcatgaccactgtccactcctacactgccacccagaagaccgtcgatggtccctccgccaaggactggcgtggtggccgtggtgctgcccagaacatgatccccagcagcactggtgc

SEQ ID NO: 2866 - DNA, 656 bp, Artificial
  Synthetic
cccacgcgtccgcgcatctcatccctcctctcgcttagttcagatcgaaatcgcaaatggcgaagattaagatcgggatcaatgggttcgggaggatcgggaggctcgtggccagggtggccctgcagagcgacgacgtcgagctcgtcgccgtcaacgaccccttcatcaccaccgactacatgacatacatgttcaagtatgacactgtgcacggccagtggaagcatcatgaggttaaggtgaaggactccaagacccttctcttcggtgagaaggaggtcaccgtgttcggctgcaggaaccctgaggagatcccatggggtgagactggcgctgagtttgttgtggagtccactggtgttttcactgacaaggacaaggccgctgctcacctgaagggtggtgctaagaaggtcgtcatctctgctcccagcaaggatgcccccatgtttgttgttggtgtcaatgagaaggagtacaagcctgacatcgacattgtgtccaatgctagctgcaccaccaactgccttgctccacttgccaaggttatcaatgacaggtttggtattgttgagggtttgatgaccactgtccatgcaatcactgcaactcagaagaccgttgatggaccctcgagcaaggactggaggggt

SEQ ID NO: 2867 - DNA, 600 bp, Artificial
  Synthetic
attcgtttttgagttcctcgtttgctccgcctctctttcactcatgggcaagattaagatcggaatcaatgggttcggccgcatcggcaggctggtggccagggtggcgctgcagagcgaggatgtcgagctcgttgccgtcaacgatcccttcatcaccaccgagtacatgacatacatgttcaagtatgacaccgtccacggccagtggaagcatcatgaggtcaaggtcaaggactccaagaccctcatctttggcacgaaagaggttgcggtgttcggctgcaggaaccctgaggagatcccatgggctgcggctggtgctgaatacgttgttgagtctactggtgttttcaccgacaaggacaaggcagcagctcacttgaagggtggtgccaagaaggtcgtcatttctgctcccagcaaagacgcccccatgttcgttgttggtgtcaacgagaaggagtacaagtctgacgttaacattgtctccaacgctagttgcaccaccaactgcctggctcctctcgccaaggtcatcaatgacagatttggcatcgttgagggtttgatgaccactgtccatgccatcactgctac

SEQ ID NO: 2868 - DNA, 699 bp, Artificial
  Synthetic
aagaaaatttgtagatcttgtgtgtggcactggtggaggaagcgctcgccatcgctaggttagaagagttttcttccttttccttttctttaaatcatccttgatatttcgatcgattctcgcccatggccgccgcaacgatgatgaaatccacactggcagcgagctgttcgtcgctagatcgagtcgccgccacgaatgcgtcgccggcagcgtcttgtaccatggtcgcgtcgccaaaggcaaaagcttttaagatgtccagtttctttgccggatccgaggtgggcttgtactcggctccattgtcgagtcgtgtggccaagggttcaatggttccagtgagggcagcacttgccgaggccccgaccaagccaaaatctgctggaacgaaagagaagactcgaattgccatcaatggctttggacgcattggcagactggttctccgggttgcgttgacaagagacgacatcgaggttgtcgcagtgaatgatccattcaccagttcgaagtatatggcttacctctttaagtatgattccactcacgggatcttccacgaggaagtgaaagccgtcgatgatagcacgcttgaagttggtggtcacaagatcaaggttttcggacagcgtgaccccgctgatattccatggggtgatgccggcgtcgacttcgtcgtggaggcctctggtgtct

SEQ ID NO: 2869 - DNA, 804 bp, Artificial
  Synthetic
ctcaaacctaccgcctccattgttcgaccttcccatcgttcccaggtatcatgtgcaggtcttcaccagagtgctaactctgtcaaattacaatcgtccatcttcggagatgctgtctcagtcatgcaatgttcgtccttattttattctggtgcctgtagcattcaacctgttagagcaactgctactgagttgcctccgacagttccaaagtcacggaccagtgggaagacaaggattggtataaatggttttggacggattgggagattggtattacgaattgcaacattcagggatgatattgaagttgtggcagttaatgacccatttatcgatgcaaagtacatggcttacatgttcaagtatgactccactcacggggtctacaactcatccatcagtgtcctggatgagtctactttggaaatcaatgggaagcagattaaagtcagtagcaaaagggatcccgcagatattccatggggtgatttaggtgcagattacgttgttgaatcttccggtgtcttcacaactgttgagaaggcctcagcacataagaagggtggtgcaaaaaaggtcgtaatctcagctccatcagctgatgcacctatgtttgtggtaggagtgaatgagagaacttacaaaaccaccatggatgttgtttctaatgctagctgtactaccaattgccttgctcctcttgccaaggtggttcatgaggagtttggcattgttgagggattaatgacaactgtgcatgcaacaacagctacccaaaagactgttgatgggccatcgatg

SEQ ID NO: 2870 - DNA, 742 bp, Artificial
  Synthetic
ttcttcgatcagcgaaaagctctctctagtttcttcgattcttctacagcgatgggttccgaaggacacaaggtgaagcttggaatcaatggatttggccggatcgggaggcttgtggcccgagtcgcgctggaacgcgacgatattgagctcgtggcggtgaatgatccattcatcagcacagactatatggcatacatgttcaagtatgacagtgtccatgggaaatggaagaaggccgatattgaggtcaaggaccaggaaactctgtcctttggaggcaaggccgtcaaggcctttggctgcaaggatccctccgatattccctggggaaagtgcggtgttgatttcgtggtggaatccacgggtgttttcaccgagaaggaaaaggcctcggcacatctcaagggtggagcaaagaaggtgattatctcggctcccagcaaggatgctccaatgttcgtcgttggtgtcaacgagaccgagtacaagaaggatatggatattgtttccaacgcaagttgcactacgaattgtcttgctcctcttgccaaggtcattcacgataagtttggcattgtcgagggccttatgaccactgtgcactcccttactgcctcgcagaagactgtcgatgggccgtcttccaaggactggcgcggtggaagaggtgccggctttaacatcatccccagctcaactggagctgccaaggctgtgggaaaggtgttacccgatctga

SEQ ID NO: 2871 - DNA, 369 bp, Artificial
  Synthetic
gacacatacaaaaatggctaccaagtccggaatcgctattggacccaacaagggccacaaggtcactgcccgaacccccgccactcgagtttctcgacgaaagggtgccctctctaagcgatccgcttttgtccgagacctcgtaaaggaggttaccggccaggctccttacgagcgacgaatcattgagttgctgcgaaactccagtgataagcgagctcgaaagctcgctaagaagaagctcggtactttcggccgtgctaaggctaaggttgaggacatgaacaacgtcatcaccgcttctcgacacgcctaaattagctagcatatgtattaaaagtatggaaatacacccaaaaatgtttgatt

SEQ ID NO: 2872 - DNA, 681 bp, Artificial
  Synthetic
acgcgtcgcatttttcgttctttttgcgtttctctctctctctcgctctctctttctgtttcctgtgaaaatgcagatctttgtgaagaccctgacggggaagaccatcaccctggaggtggaaagctccgacaccattgataacgtcaaggccaagatccaagacaaggagggcatcccccctgaccagcagcgcctcatctttgccgggaaacagcttgaagatggccgtacccttgcagactacaacatccagaaggagtccaccctccaccttgtcctccgcctccgaggtggtatgcaaatcttcgtcaaaaccctcaccggtaagaccatcaccctcgaagttgagagctctgacactatcgacaatgtcaaggccaagatccaagacaaggaagggattccccctgatcagcagaggcttatcttcgctgggaagcagctcgaagacgggcgaaccctcgctgactacaacatccaaaaggagtccaccctccacctcgtgctgaggctccggggaggcatgcagatctttgtcaaaaccctgacggggaagacaataacactggaggtggaaagctctgacacaattgacaacgttaaagctaagattcaagacaaggaagggatcccccccgatcagcagcgtttgatctttgccggcaagcagctggaaga

SEQ ID NO: 2873 - DNA, 636 bp, Artificial
  Synthetic
gagagagagagagagagagagaagatgcagatattcgtgaagaccctgacggggaagaccatcaccctagaggtcgagagcagtgacaccatcgacaatgtcaaagccaagatccaggacaaggaaggcatcccccctgatcagcaacgacttatctttgccggcaagcagctggaagatggccggacattggcagactacaatatccagaaagaatccaccttgcaccttgttctgaggctccgaggtggtatcatcgagccttcactgatggcactggctaggaagtacaatcaagagaagatgatatgccgcaaatgttatgcccgcctccatcctcgtgcagtgaactgcagaaagaagaaatgtggacacagcaatcagcttcgccctaagaagaagatcaagtagatttgacgcatccttcggagagattgaggacctataacattagtgagagtgtttttttgattatctattgccagaattgaatttagacactggtctcccatcggaacttttctaatattatataatcagtactttttgttgaaccaatagcgtgttgatcttttcatccttttcaacatatggaattgtgtcggggttaattgaaaatggctataaatgatttgg

SEQ ID NO: 2874 - DNA, 641 bp, Artificial
  Synthetic
gggcaggtagaggtggaggcaagcgggggaagatgcagatatttgtgaagaccctgacggggaagaccatcaccctcgaggtcgagagcagtgacaccatcgataatgtcaaagcaaagatccaagacaaggaaggaattccaccggatcagcagaggcttatttttgctgggaaacaactggaggatggtcgcacattggctgactacaatatccagaaagagtctactttgcaccttgttttgaggcttcgaggtggtatcatagagccttcgctgatggcgctcgccaggaagtataatcaagagaagatgatatgtcgcaagtgctatgctcgtcttcatcctcgcgctgtgaactgcagaaaaaagaaatgtgggcacagcaatcagcttcgaccaaagaagaagatcaagtaggttgttcggttgcagcctctccagatattcagaatcttgttttttttgctgatttgaggaaaagttgtttgagtgccatttaccatgttttggtgcaagtggcactcttattatgttaatctctgcgaagtaattactgacgatgagtcgtttgcatttgaattttcggaacaaaaggaatttgaattgcattttagctttcagaatcacaatatccaaaca

SEQ ID NO: 2875 - DNA, 1493 bp, Artificial
  Synthetic
gtcggattatcttctctacttctttcatcgccttcaaatttctctctcaaggtttgagaaaatttcctcaatttctcgctttaggagttcttttttattgaatcaccagattgggtgtgtcaagccctaattttgaagttcattttttcaattgtttgttgttgattttatgttataacagatgcagatcttcgtaaaaaccctaaccggtaagaccatcactctcgaggttgagagttccgacacaatcgacaacgtaaaagccaaaatccaggacaaggaaggaattcccccagatcagcaaaggcttatcttcgccggcaagcagcttgaggacggccgtactctcgccgattacaacatccagaaggaatctactcttcacttggtcctccgtctgcgtggtgggatgcagattttcgtcaaaaccctcactggcaaaacaatcacccttgaggtggaaagttctgacaccatcgacaatgtcaaggctaaaattcaggataaggagggaattccaccagaccagcagaggttgatcttcgccggcaagcagcttgaggatggtcgtacccttgccgattacaacatccagaaggagtctacccttcaccttgtcctccgtctccgtggtggtatgcagatctttgtcaaaacgctcaccggcaaaaccatcacccttgaggtcgagagttccgacaccatcgacaatgtcaaggccaaaattcaggacaaggagggcattcccccagaccagcagaggttgattttcgctggcaagcagctcgaggatggccgtacactagctgattataacatccagaaggaatccacccttcaccttgtcctccgtctccgtggtggtatgcagatcttcgtcaaaacactcaccggcaagaccatcaccctggaggttgaaagctctgacaccattgacaatgtcaaggccaagatccaggacaaggaggggattcccccagaccagcagaggttgatctttgcaggtaagcagttggaagatggtcgcacccttgcggactacaacattcagaaggagtccaccctgcacttggtgctgaggctgaggggaggaatgcagatcttcgtgaagacattgaccgggaagaccatcaccttggaggtggagagctctgacaccatcgacaatgtaaaagctaagatccaggacaaggagggtatcccacccgaccagcagaggttgatctttgctgggaagcagctcgaggatggaaggaccttggctgactacaatatccagaaagagtcaacccttcaccttgtcctccgtctccgtggtggtttctaggttgtctgttgttgatgacgtggtgtcctgttaattggctgtgttgtctgtttctagttgtggtcatgatgtgctttgtttgctgaggtctcaatgatgttccattctgtttctgttcgctgtttcttttatgttctctgttgtgaataaagattccgatttctgt

SEQ ID NO: 2876 - DNA, 200 bp, Artificial
  Synthetic
cccacgcgtccgaaaaagatgcagatcttcgtgaaaaccctaacggggaagacgatcactctcgaggtcgagtcctctgacaccatcgacaatgtcaaggccaagatccaagacaaggaaggaatcccaccggaccagcagcgattgattttcgccggaaagcagctcgaagacggacgtaccttagccgattacaacat

SEQ ID NO: 2877 - DNA, 568 bp, Artificial
  Synthetic
gggaagcgaagctttgcgttctctaatcgcctcgtcaagatgcagatattcattaagaccctcactggcaagaccatcaccttggaggttgagtcctccgatacgattgacaatgtgaaggctaagattcaggacaaggagggcatccctccggaccagcaacgccttatcttcgctggcaagcagcttgaggatgggcgtactctcgcggattataacatccagaaggagtccaccttgcaccttgtcctccgccttcgtggaggcatgcaaatattcgtgaagaccctcaccggcaagaccattaccctggaggtcgagtcctccgacacgatcgataatgtgaaggccaagatccaggacaaggagggaatcccaccagaccagcagcgtctcatctttgctgggaagcagctcgaggatggccgcacccttgcagactacaacatccaaaaggaatccaccctgcaccttgtcctgcgcctccggggcggtatgcagatctttgtgaagacccttactggcaagacgatcaccttggaggttgagtcctctgacacgatcgaca

SEQ ID NO: 2878 - DNA, 639 bp, Artificial
  Synthetic
agcggcactcctcaccttgataatcttggtgcacatagttgggaaagatgcagatattcgtgaagaccctgacagggaagactattaccttagaggtagagtcatccgacaccattgacaatgttaaggctaagattcaggacaaggaaggcattccaccagaccagcagcggttgattttcgcaggtaagcagcttgaggatggccgaacactagccgactacaacatccagaaggagtccaccctccaccttgtccttcgcctccgtggtggtgcaaagaagcgtaagaagaagacttacactaagccaaagaagattaagcacaagaagaagaaggttaagctcgccgtcctccagttttacaaggttgatgattctggtaaggttcagaggctccgcaaggagtgtcccaacgccgagtgtggtgccgggactttcatggctaaccactttgacaggcactattgtggtaaatgtgggcttacctatgtttaccagaaggctggtggtgattagatgagtgttactttgcttattacttttccccacatttcttgccttaaactctcctaatgtcttgtttgtgacaagatgtaatgaatttgaattatggtattgtgttagcagcttatgaaat

SEQ ID NO: 2879 - DNA, 638 bp, Artificial
  Synthetic
ggaaaaaggaagccggagctcgtaacgaaaatgcagatattcgtgaaaactctcactggtaaaaccattactctcgaagttgaatccagtgatacaatcgacaatgttaaagccaaaatacaagacaaagaaggaattccaccggaccaacaaaggctgatttttgctggtaagcagctcgaagatggacgcaccttggccgattacaacatccaaaaagaatcgactctacatttggtgctgaggcttcgtggtggaatcattgaaccatcgttgatggctttggctaggaaatacaatcaggacaagatgatatgccgcaagtgctatgctcgattgcatccccgtgctgtcaattgccgcaagaagaagtgtggacacagcaaccagttgaggcctaaaaagaagattaagtagatgtaaatttctattgctgcggacttgtagttgttggcggtattagatctttcagaaactgaacttggatttcttaccaaaaaaacaaattgtacttgggtttatctttgggtttctgttctttttaccccttaagattcatggcttgtatttgggaggtaaatgaaatcaatcagtatactataattgctattttgctttgatattggtttttgaatctt

SEQ ID NO: 2880 - DNA, 739 bp, Artificial
  Synthetic
ctcgaccacgcgtcggttttctttcagttgtgaatattgcttgctttctctctctctgtctctctctctctctttctgtctaccctttctctctctgtcctctgttgagccaagaagaagatgcagatcttcgtgaagaccctgaccggcaagaccatcaccctcgaggtcgaaagctccgacaccattgacaacgtcaaggccaagatccaggacaaggagggaatcccccctgaccagcagcgcctcatctttgccggtaaacagctcgaagacggccgcacccttgccgattacaacatacagaaggagtctaccctccaccttgtccttcgcctcaggggcggtatgcaaatcttcgtcaaaaccctcactggcaagaccattacccttgaagtcgagagttctgataccatcgataatgtgaaagccaagatccaagataaggagggaattccccctgaccagcagcgccttatctttgctggtaaacagcttgaagatggccgcaccctcgctgattacaacatacagaaggagtctaccctccaccttgtccttcgcctcaggggtggtatgcaaatcttcgtcaaaaccctcaccggcaagaccattactcttgaagtcgagagttctgacacaattgataacgtgaaagccaagatccaagataaggagggaattccccccgaccagcagaggctcatctttgctgggaagcaacttgaagatggtcgca

SEQ ID NO: 2881 - DNA, 370 bp, Artificial
  Synthetic
ggaagggaggaagggtggtgtgggtggatttggaggggccaagatgcagatctttgtgaagaccctgacagggaacaccatcaccctagaggttgagagtagtgacaccatcgataatgtcaaggctaagatccaagataaggaaggtatcccccctgatcaacaacgcctgatctttgctggaaaacagcttgaagatggcagaaccttggctgactacaacattcagaaagagtccacgttgcatttggttctaaggttgcgaggtggtatcattgagccatctctgatggctcttgccaggaagtacaaccaggagaaaatgatctgtcgcaaatgctatgctaggcttcatcctcgggctgggaat

SEQ ID NO: 2882 - DNA, 709 bp, Artificial
  Synthetic
aggcattgagctacacactatcatagtatcattccattctgaagaaagaagaaattctagcgccgtagtgctcctcgagttctctcctccaaagcgaagatgcagatcttcgtgaaaaccctaacaggtaaaacaatcacccttgaggttgaatcttccgacacaatcgataatgtgaaagccaagatccaagataaggaagggattcccccagatcagcagcgtctgattttcgccggaaagcagcttgaagacggccgaaccctagctgattacaacatccagaaggagtcgactcttcatctcgtgctccgcctccgtggtggtgctaagaagaggaagaagaagacttacaccaagcctaagaagattaagcacaagaagaagaaggttaagctcgctgtacttcagttctataaggtggatgattctggaaaagtccagaggcttcgtaaggagtgtcctaatgccgagtgtggtgctggaacttttatggctaaccactttgaccgtcactactgtggtaagtgtgggctcacctatgtttacaacaaggccggtgccgattgatccctatgtttagctctgttttaatgctgtcgtcaattttatctttttgtcgaacggttatttagtatggattttccttttaaatgatgtggcaaccttgggattgttgagttatttaacagtttttgctcgttcttaa

SEQ ID NO: 2883 - DNA, 658 bp, Artificial
  Synthetic
aatcgaccgaaggggagggggagcgaagctttgcgttctctaatcgcctcgtcaagatgcagatattcgttaagaccctcactggcaagaccatcaccttggaggttgagtcctccgatacgattgacaatgtgaaggctaagattcaggacaaggagggcatccctccggaccagcaacgccttatcttcgctggcaagcagcttgaggatgggcgtactctcgcggattataacatccagaaggagtccaccttgcaccttgtcctccgccttcgtggaggcatgcaaatattcgtgaagaccctcaccggcaagaccattaccctggaggtcgagtcctccgacacgatcgataatgtgaaggccaagatccaggacaaggagggaatcccaccagaccagcagcgtctcatctttgctgggaagcagctcgaggatggccgcacccttgcagactacaacatccaaaaggaatccaccctgcaccttgtcctgcgcctccggggcggtatgcagatctttgtgaagacccttactggcaagacgatcaccttggaggttgagtcctctgacacgatcgacaatgtgaaggccaagatccaggacaaggagggtattccaccagaccagcagcgcctcatcttcgctggcaagca

SEQ ID NO: 2884 - DNA, 454 bp, Artificial
  Synthetic
gcgacagttagcaggaatcatcgacaacaatgcaaatctttgtcaagacccttactggcaagactatcaccctcgaggtggagtcctctgacaccattgacaacgtcaagtccaagatccaggacaaggagggaatccccccggaccagcagcgacttatcttcgccggtaagcagctcgaggacggccgaactctttccgactacaacatccagaaggagtccactctccatctcgttctgcgactccgaggaggtatcatcgagccctctctcaaggctcttgcctccaagtacaactgtgagaaggccatctgccgaaagtgctacgcccgacttcctcctcgagccaccaactgccgaaagaagaagtgcggacacaccaaccagctccgacccaagaagaagctcaagtaaactattcgcatgtatggtatatgtataaaaattctgtt

SEQ ID NO: 2885 - DNA, 1419 bp, Artificial
  Synthetic
ggtgatttctaaacatgcagatctttgtgaagaccttgaccggcaagactatcaccctcgaggtggagagctcggataccatcgacaacgttaagaccaagatccaggacaaggaagggatcccaccggaccagcaacgattgatcttcgccgggaagcagcttgaggacggacggacccttgcggactacaacatccagaaggaatctacgcttcacctggttcttcgtctccgcggtggcatgcagatatttgtgaagaccttgaccggcaagaccatcaccctcgaggtggagagctcggataccatcgacaatgtcaagaccaagatccaggataaggaggggattcctccggaccagcagcgacttatcttcgccgggaagcaactcgaggacggacggacccttgccgactataacatccagaaggagtcgactctccacttggttcttcgtctccgcggtggcatgcagatatttgtgaagacactgaccggcaagaccatcaccctcgaggtggagagctcggacacgattgacaacgttaagacgaagatccaggacaaggaagggatccctcctgaccagcagcgcctcatcttcgccggcaagcagctcgaggatggacgaactctcgccgactacaacatccagaaggaatccacccttcacctggtgctgcgtctccgcggaggcatgcaaatcttcgtcaagaccctgaccggcaagaccatcactctggaggtggagagctcggataccatcgacaacgtgaagaccaagatccaggacaaggagggaattcctccggaccagcagcggttgatcttcgcgggtaagcagctcgaggatgggcgcactcttgccgactacaacattcagaaggagtctacactccatttggtgctgcgtcttcgcggaggcatgcagatcttcgtcaagaccctcacgggtaagacgatcaccctggaagtcgagagctcagacaccatcgacaacgtgaagaccaagatccaggacaaggagggaattcctccggatcagcagcggttgatcttcgcgggtaagcagctcgaagatgggcgcactctcgccgactacaacattcagaaggagtctactctccatttggtgctgcgtcttcgcggaggcatgcagatcttcgtcaagaccctcacgggtaagacgatcacgttggaggtggagagctcggacacgattgacaacgtgaagaccaagatccaggacaaggagggaattcctccggaccagcagaggctgatcttcgccgggaagcagctcgaggatggccgcactcttgcggactacaacatccagaaggagtctactctccatttggtgctccgtcttcgtggaggccagtagatagcatgtagcgcgttagcgcgtgaagtat

SEQ ID NO: 2886 - DNA, 892 bp, Artificial
  Synthetic
tccgcaacatctgaagattgcttaggacggcaataggtctattgtcgaggtatgtctgaaagatgctgcatttctatctgccctccatgagctccgggagcttcatgagggaatcatcgttgatgtctccctcttgagcattcttctttgtttcccggagctctattccccaaatcccgagatattgctcgttgtcgcgaagaaatttgcaacacggcaattctcgccttcttctccccaaagtcaactcacgcaggcaatgtatgctgggcaaacaaatctaacccttccagttaggcaagatgcagattttcgtcaagaccctcacggggaagacgatcacccttgaggtggagtcttccgacaccatcgacaatgtcaagtccaagatccaggacaaggagggcattcccccggaccagcagcgattgatcttcgctggtaagcagctggaggatggccgaaccctctccgactacaacatccagaaggagtctaccctccacctggtcctgcgcctgcgtggtggtgccaagaagagaaagaagaaggtctacaccacccccaagaagattaagcacaagcgcaagaagaccaagttggctgtcctcaagtactacaaggtcagcaacgatggtaacatcgagcgtctccgccgcgagtgccccagcgagacttgcggtgctggtgtcttcatggctgccatgcctgaccgtcaatactgtggtcgttgccacctgacctacgtcttcgacaagcagtaaacgacaaaactttcaaaaagggaaaaaatttattgtggattggacagctggagccatgggactgccataacacacaaaggcgttgatgtagcattagagagcacatccggcggcttctggtaatgaat

SEQ ID NO: 2887 - DNA, 658 bp, Artificial
  Synthetic
gccgccgcagcagcaaggagctagagagacaaaggggagagagccccggggaagaagaagaagcagcagctagggcgccaagatgcaaatcttcgtgaagaccctgactgggaagaccatcaccctcgaggtggagagcagcgacaccatcgacaatgtcaaggctaagatccaggacaaggagggaatcccgccggaccagcagcggctgatcttcgccgggaagcagctggaggacggacgcaccctggctgactacaacatccagaaggagtccaccctccacctcgtcctcaggctccgtggcggtatcatcgagccgtcgcttcaggcgcttgcccgcaagtacaaccaggacaagatgatctgccgcaaatgctatgcgcgcctgcaccctagggctgtcaactgccgcaagaagaagtgtggtcacagcaaccagctgaggcccaagaagaagatcaagaactagagcgtcactcgccgggttcatggactggttaaatcaatcgtcatattagacttttatgcttccgttgttatctccctggatgttgttgaaccgtgttttactgtgctggatgcttcagcttcttgttttgacggtcgtggtatatggtaattggcagcaaactatattggtcatgtcgaaattgtc

SEQ ID NO: 2888 - DNA, 604 bp, Artificial
  Synthetic
cccggaccttgctccacacccgcagcagcagcagcagcaaggagaagaagaagagccaagatgcagatcttcgtgaagaccctaacggggaagaccatcacgctcgaggtcgagagcagcgacaccatcgacaatgtcaaggccaagatccaggacaaggaaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaagtgctatgctcggctgcaccccagggctgtcaactgccgcaagaagaagtgcggccacagcaaccagctgaggcccaagaagaagatcaagaactagagtttgagatatcatttccgcggatcattgaaatcaacaggaagatcagagtttaagtttttttgtagtgtaatgcctcatgttgtatgccgaactttctgtttatcctgttgtatgttaaccttggttacgctggagagtactccagcttatt

SEQ ID NO: 2889 - DNA, 405 bp, Artificial
  Synthetic
ttttctctctttattcaaacgcctctcaagatgcagatcttcgtcaaaaccctaactggaaagacgataacccttgaggttgaaagctccgacacaattgacaacgttaaggcgaagattcaggacaaggaaggaattccaccggatcagcagaggctgatcttcgccggaaagcagctcgaagacggcagaaccctagccgactacaacatccagaaggaatcgactcttcacttggtgctccgtcttcgtggcggtatgcaaatcttcgtcaaaaccctaacagggaaaacaatcacccttgaagttgaaagctccgacactattgataacgttaaggcgaaaatccaggataaagagggaatcccaccagatcagcagaggttgatctttgctggcaaacag

SEQ ID NO: 2890 - DNA, 733 bp, Artificial
  Synthetic
cttgaggtcgagtcctcggacacgatcgagaatgtgaaggccaagatccaggacaaggagggcatccccccggaccagcagcgtctcatcttcgctggcaagcagctggaggacggccgcacccttgccgactacaacatccagaaggagtccaccctccaccttgtgctcaggctcaggggtggtatgcagatcttcgtcaagaccctgaccggcaagaccatcacgcttgaggtcgagtcctcggacacgatcgacaacgtgaaggccaagatccaggacaaggagggtatccccccggaccagcagcgcctcatcttcgccggcaagcagctggaggatggccgcaccttggctgactacaacatccagaaggagtccacccttcacctggttctcaggctcaggggtgggatgcagatcttcgtgaagaccctgactggcaagaccattacccttgaggttgagtcgtccgacactattgacaacgtgaaggcgaagatccaggacaaggagggcatccccccggaccagcagcgtctgatctttgctggtaagcagcttgaggatggccgcacccttgcggattacaacatccagaaggagtccacactccacctggtgctccgcctccgtggtggccagtaagtcctcagccatggagctgctgctgttctagggttcacaagtctgcctatttgtcttccccaatggagctatggttgtctggtct

SEQ ID NO: 2891 - DNA, 729 bp, Artificial
  Synthetic
gaattcagattctctttttgcgatctaaaggatcttcttcaattctccttcaagatgcagatctttgtgaaaactcttactggtaagaccatcacccttgaggtcgagagctcagacacaattgacaacgttaaggctaagattcaagacaaggaaggaattcctccagaccaacaacgtttgatctttgccggaaagcagttggaagatggaagaactttagctgactacaacatccagaaggaatcaactctccatcttgtccttcgtcttagaggtggtatgcaaatctttgtcaaaaccttgactggtaagaccatcactttggaagtcgagagctctgacaccattgataacgttaaggctaagattcaagataaggaaggaattcctccagaccagcaacgtttgatcttcgccggaaagcagttggaagatggtcgtactcttgccgactacaacatccagaaggagtctactctccatttggttcttcgtctcagaggtggtatgcagattttcgtcaagacccttactggaaagaccatcaccttggaggttgagagttccgacaccatcgataatgtcaaggctaagattcaagataaggagggtatccccccagaccagcaacgtttgatcttcgccggaaagcagctggaagatggtcgcactcttgccgactacaacattcagaaggagtctaccctccatttggtgcttcgtctt

SEQ ID NO: 2892 - DNA, 610 bp, Artificial
  Synthetic
gaattcacgactaagaggtggtattgcagaggtttgtgaaaacgcttactggaaagaccatcaccttagaagttgagagttcagataccattgacaatgtaaaagccaaaattcaggacaaggaaggaattcccccggatcagcagaggttgatctttgctggcaaacagttggaagatggaagaactctagctgactacaacatccagaaagaatccactctccatctcgtcctccgtctcagaggtggtatgcaaatatttgtgaaaaccctcactggcaagaccattactttggaagtggagagttctgataccatcgacaatgtcaaggccaagatccaagataaggaaggtattcctccagaccagcagaggttgatttttgctgggaagcagttggaagatgggcgtacccttgctgactacaacatccagaaggaatccacccttcacctggttctacgactaagaggtggtattgcagatctttgtgaaaacgcttactggaaagaccatcaccttagaagttgagagttcagataccattgacaatgtaaaagccaaaattcaggacaaggaaggtattcctccagaccagcaacgtttga

SEQ ID NO: 2893 - DNA, 1150 bp, Artificial
  Synthetic
tatctcctcaacttttctctctttattcaaacgcctctcaagatgcagatcttcgtcaaaaccctaactggaaagacgataacccttgaggttgaaagctccgacacaattgacaacgttaaggcgaagattcaggacaaggaaggaattccaccggatcagcagaggctgatcttcgccggaaagcagctcgaagacggcagaaccctagccgactacaacatccagaaggaatcgactcttcacttggtgctccgtcttcgtggcggtatgcaaatcttcgtcaaaaccctaacagggaaaacaatcacccttgaagttgaaagctccgacactattgataacgttaaggcgaaaatccaggataaagagggaatcccaccagatcagcagaggttgatctttgctggcaaacagttggaagacggcagaaccctagccgactacaacattcagaaggaatcaactcttcacttggtactccgtcttagaggaggcatgcaaatcttcgtcaaaaccctaaccgggaaaacaatcacccttgaagtcgaaagctttgacacaattgacaatgtcaaggcgaagattcaggacaaggaaggaatcccaccagatcagcagaggttgatctttgcgggtaagcaattggaagatggaaggaccttagctgattacaatattcagaaggagtccaccctccatttggtgctccgtcttcgtggtggaatgcagatttttgtgaagactttgaccgggaaaacaatcactcttgaagttgaaagctcagatactattgacaacgttaaggccaagatccaggataaggagggtatcccaccagatcagcaaaggctgatctttgctggcaagcagttggaagatggtcgtactcttgctgattacaacattcagaaggagtcgactttgcaccttgtcctccgtctccgtggtggtttctaaagtgtccgtcagtggtggtggtgatgtctgtgtctgtgtcttgggtctttggtctgtttggtgtttgtttgattcatgatttagtactttgtgtagtttctgttagttgttatcatgttatctttccaatagaggcgaggagtcttgttttcttctgtctctgtttgtgaataataaagtcgaattattg

SEQ ID NO: 2894 - DNA, 655 bp, Artificial
  Synthetic
ggcaagaccatcaccctggaggttgaaagctctgacaccattgacaatgttaaggccaagatccaggacaaagaggggattcccccagatcagcagaggttgatcttcgcaggaaagcagttggaagatggtcgcacccttgcggactacaacattcagaaggagtctactctgcacttggtgctaaggctgaggggaggaatgcagatcttcgtgaagacattgaccgggaagaccatcaccttggaggtggaaagctctgacaccatcgacaatgtcaaagctaagatccaggacaaggagggtatcccaccggaccagcagaggttgatctttgctggtaagcagcttgaggatggaaggaccctggccgactacaatatccagaaagagtcaacccttcaccttgtcctccgtctccgtggtggtttctaggttgcctgttgttgatgttgttgtgtcgtgttgattggctgtgtcttgttgtggtcatgatgtgttttgtctactaaggtcccaaagatgttcaattctgtttctgttcgccgtttctttcatattttctgttgtgaataaagacaccagattctgtcctagtgcttaggttttgtgctctctgttggcagtaaatgaactttcctttgttttatccatt

SEQ ID NO: 2895 - DNA, 634 bp, Artificial
  Synthetic
tctttctctttgtggtatctctgtctctctctctcttcctgagaaaatgcagatctttgtgaagaccctgacagggaagaccatcaccctggaggtggaaagctccgacaccatcgacaacgtcaaggccaagatccaagacaaggagggcatcccccctgaccagcagcgcctcatcttcgctgggaaacagctcgaagatggccgtaccctcgctgactacaacatccagaaggagtccactctccaccttgtcctccgcctccgaggtggtatgcaaatctttgtcaaaaccctcactggtaagaccatcacccttgaagtcgagagctctgatactattgacaatgtcaaggccaagatccaagacaaggaggggattccccctgaccagcagaggctcatctttgctgggaagcagcttgaagatgggcggacccttgccgactacaacatccagaaggagtccaccctccaccttgtgctgaggctccgggggggcatgcagatcttcgtcaaaactctaacagggaagacgataacgctggaggtggaaagctctgacacaattgacaatgtgaaggcaaagattcaagacaaggaagggatccccctgaccagcagcgattgatct

SEQ ID NO: 2896 - DNA, 1115 bp, Artificial
  Synthetic
acatacaaacacttctcacatctcttccaccctaaggaatatccgttaacagcgcatcttcttgcactctctacgaatctcccagcggccaacgcttaatccgccaccatgcaaatcttcgtcaagaccctcaccggcaagaccatcaccctcgaggtcgagtcttccgataccatcgacaatgtgaagtccaagatccaggataaggaaggcattcctcctgaccagcagcgtctgattttcgctggcaagcaactcgaggatggccgaactctgtccgactacaacatccagaaggagtccaccctccacctggtcctccgccttcgtggtggtatgcagatcttcgtcaagaccctcactggaaagaccatcaccctcgaggtggagtcatctgataccatcgacaacgtcaagtccaagatccaggacaaggagggtatccctcctgaccagcagcgactgatcttcgctggtaagcagcttgaggatggccgaaccctctccgactacaacatccagaaggagtccactctccaccttgtccttcgtctccgtggtggtatgcagatcttcgtcaagacgttgaccggcaagaccatcacattggaggttgaatcatcagacaccatcgacaatgtcaaatcaaagattcaggacaaggagggtattcccccggatcagcagcgtcttatctttgctggcaagcagcttgaggacggtcgcaccttgagcgactacaacattcagaaggagagcacacttcaccttgtcctccgtcttcgtggtggtatgcagattttcgtcaagactctgaccggcaagacaatcaccctcgaggtggaatcttccgacaccatcgacaacgttaagtccaagattcaggacaaggagggcattcctcctgaccagcagcgcttgatctttgctggtaagcagctggaagacggtcgcaccttgagcgactacaacatccagaaggagagcacactgcacttggtcctgcgtctgcgtggtggccagtaaatgtgtcttttgcttacgaccgcactgttacgactgaattggacggttgggcgtttttgggaactttttttcaaagcagatatgggaac

SEQ ID NO: 2897 - DNA, 400 bp, Artificial
  Synthetic
agaagagaggctcagcgttcaagatgcagatcttcgtcaagaccctcacgggcaagaccatcactctcgaggtcgagagctccgataccattgacaatgtcaagtccaagatccaggacaaggagggcattcccccggaccagcagcgtctgatcttcgccggaaagcagctcgaggatggccgcactctttcggactacaacatccagaaggagtccaccctccacttggtcctccgccttcgtggtggtatggccaagaagcgcaagaagaaggtgtacaccacccccaagaagatcaagcacaagcgcaagaagaccaagctagctgtcctcaagtactacaaggttgacggcgatggcaagatcgagcgtcttcgccgcgagtgcccccaccccga

SEQ ID NO: 2898 - DNA, 526 bp, Artificial
  Synthetic
atcttcgtgaaaaccctaactgggaagaccatcacccttgaagtcgaatcgagcgataccatcgacaatgtcaaggccaagattcaggacaaggaaggtattccaccggaccagcagcgattgatctttgctggtaaacagcttgaagatgtgctactttggctgattacagtatccagaaagagtcgactctgcatcttgtgttgaggctccgtggagggatcattgaaccgtctcttatggcattggccaggaaatacaaccaggataagatgatttgccgcaagtgctatgcccgtctgcatcctcgtgccgtaaactgcaggaagaagaaatgtggccatagcaaccagttgaggccaaagaagaagatcaagtaaacaggcggttgcatttgctgtctagatgctatgccaattgaatgattttgtagtttggtgggtttctattgttgtctgtttaactgcagcacatttgtttcaacttcagttccatttagtgctcatttttgagtttggtatgatta

SEQ ID NO: 2899 - DNA, 540 bp, Artificial
  Synthetic
cccacgcgtccggaagacgaaacacaaaagatgcagatcttcgtgaaaaccttgaccggcaagaccatcactctcgaggtcgagagcagcgacaccatcgacaatgtcaaggccaagatccaagacaaagaaggaatccctccggatcagcagagattgatcttcgccggaaagcagctcgaagatggtcgtactttggctgactacaacatccagaaagaatctacacttcatcttgtgttgaggcttagaggaggtattattgagccttccttgatgatgcttgctcgtaagtacaatcaggataagatgatatgccgcaagtgctatgctcgtcttcacccaagagctgtcaactgcaggaagaagaagtgtggtcacagcaaccagttgaggcctaagaagaagatcaagtagagagactcttatcaagaatcccatctcttgcttgcttctttttgttgtcttccctttgatagggtttgtttttcttgtttcagtgactttctatgttaaacgataatgtcagtaaaaggattt

SEQ ID NO: 2900 - DNA, 659 bp, Artificial
  Synthetic
ttctgcttttccttctctaagaagcgtttgattcccaaaaaccgtttcaaagatgcaaatctttgtaaagaccctcactggcaaaaccatcactctcgaggttgagagttcagacactatcgacaatgttaaggcaaagatccaagataaggaaggaattcctccagatcagcaaaggttgatctttgctggaaagcagttagaggatggccgaactcttgctgactacaatatccaaaaggagtctaccctccaccttgtccttcgtctgcgtggtggtatgcagatctttgtaaaaactttaacagggaagactatcactctcgaggttgagagctcggacacaattgataatgttaaggcaaagattcaggacaaggaaggcattcctccggatcagcaaaggttgatctttgctggaaaacaacttgaggatggtcgtacccttgctgactacaacatccaaaaggagtccaccctccaccttgttctccgtttgcgtggtggtatgcagatctttgtaaaaactttgacaggaaagactattacccttgaggttgagagttccgatacaattgacaatgtcaaagctaaaatccaggataaagaaggcattcctccagatcagcagaggttgatcttcgctggaaagcaacttg

SEQ ID NO: 2901 - DNA, 589 bp, Artificial
  Synthetic
  misc_feature (512)..(512): The residue at this position can be any nucleotide.
ggttgaaggaagggaggaagggtggtgtgggtggatttggaggggccaagatgcagatctttgtgaagaccctgacagggaagaccatcaccctagaggttgagagtagtgacaccatcgataatgtcaaggctaagatccaagataaggaaggtatcccccctgatcaacaacgcctgatctttgctggaaaacagcttgaagatggcagaaccttggctgactacaacattcagaaagagtccacgttgcatttggttctaaggttgcgaggtggtatcattgagccatctctgatggctcttgccaggaagtacaaccaggagaaaatgatctgtcgcaaatgctatgctaggcttcatcctcgggctgtgaattgccgcaagaagaaatgtggacacagcaatcagttgcggccaaagaagaagattaagtagatttggagaagcaatcattgcattggaacagtagatgcaggaagagggaaatgggaggaatggagatgcagcttngttattgttttactaggatctgttatacaactgaagtggctcaatgggaactagcttttaggccttagcctttggac

SEQ ID NO: 2902 - DNA, 476 bp, Artificial
  Synthetic
gtagggtttcaagtgggctgccaagatgcagatcttcgtgaagacgctcacgggcaagacgatcactctcgaggtcgagagcagcgacaccatcgacaatgtcaagaccaagatccaggacaaagaaggcattcctccggatcagcagcgtctcatcttcgctggcaagcaactcgaagatggccgaactctcgcggactataacatccagaaagagtccactctccatctcgtgctgcgtcttcgtggaggcatcatcgagccgtccctgatggccctggcgaggaagtataatcaggagaagacgatctgccggaagtgctatgcaaggctgcatcctcgcgctgtgaattgcaggaagaaaaaatgtggccactccaaccagctgcgacccaagaagaaaatcaaatagagagtttaggacgatcaactttgtttctctatatgaatgaaaaagggaaaaccttttgtctttg

SEQ ID NO: 2903 - DNA, 1035 bp, Artificial
  Synthetic
aattaggtttcttcgatagcaagtagcgatgcagatcttcgtcaagactctcaccggcaagactatcaccttggaggtggagagctccgacaccatcgacaacgtcaagaccaagatccaggacaaggaagggatccctccggatcagcagcgcttgatctttgccggcaagcagcttgaggacgggcgtaccctcgccgactacaacatccagaaggagtctacgcttcatcttgttcttcggctgcgaggaggtatgcaaatattcgtcaagaccctaacgggtaagacgatcaccctggaggtggagagctccgacaccatcgacaacgtcaagaccaagatccaggacaaggaagggatcccgccggatcagcagcgtctgatcttcgctggcaagcagctcgaggatggccgtaccctggccgactacaacatccagaaggagtcgacccttcatcttgtgctgcgtctgcgaggaggcatgcagatcttcgttaagaccctcactggtaagacgatcaccctggaagtcgagagctcggacaccatcgacaacgttaagactaagatccaggacaaggaagggatcccgccggatcagcagcgtctgatcttcgctggcaagcagctcgaggatggccgtaccctggccgactacaacattcagaaggagtctacactccatttggtgctgcgtctgcgaggaggcatgcagatcttcgtcaagaccctcactggtaagacgatcaccctggaagtcgagagctcggacacgatcgacaacgtgaagaccaagatccaggacaaggagggaattcctccggaccagcagcggttgatcttcgcgggtaagcagctcgaggatgggcgcactcttgccgactacaacattcagaaggagtctacactccatttggtgctgcgtcttcgcggaggcatgcagatcttcgtcaagaccctcacgggtaagacgatcaccctggaagtcgagagctcagacaccatcgacaacgtgaagaccaagatccagga

SEQ ID NO: 2904 - DNA, 602 bp, Artificial
  Synthetic
aagatgcagatcttcgtgaagaccctgacgggcaagaccatcacgctcgaagtcgagagcagtgacaccatcgacaacgtcaagtccaagatccaggacaaggagggtattcccccggaccaacagcgcctgatcttcgccggaaagcaactcgaggatggccgcactctgtccgactacaacatccagaaggagtcaaccctccacttggtcctccgtctccgtggtggtatcattgagccttcgctgaaggcgcttgcctccaagtacaactgcgacaagatgatctgccgcaagtgctacgcacgtctgccaccgagggctgtcaactgccgcaagaagaagtgcggtcacaccaaccagctccgccccaagaagaagttgaagtaaactactcgctcctatcggcgtctggcgaagagagcaacggggtcggtggatacgaattgcaacgattgcatgcgatggatatgagggctaggtcactactacttcttccacggcacatggcatcaatggagtgcttgtcttgtctcgcatttgggactttatgaagggaaccaggcatgtagagtgaatcgattcaaattcaaaaaccacca

SEQ ID NO: 2905 - DNA, 879 bp, Artificial
  Synthetic
cgacccacgcgtccgcttttgtgggcgattcctgggtaatttcatacagcggcaactatgcagatcttcgtcaagacactgactggcaagacgatcactctggaggtcgagagctcggacacgatcgataatgtgaagaccaagatccaggacaaggaagggatccccccggaccagcagcgtctcatcttcgccgggaagcagctcgaagacgggcgaatcttggctgactacaacatccagaaggaatccactctccatctcgtcctacgtcttcgcggaggcatgcagatctttgtcaagacgctgaccggcaagaccatcactctggaggtcgagagctcagacacgatcgataatgtgaagaccaagatccaggacaaggaagggatccccccggaccagcagcgtctcatcttcgccgggaagcagctcgaagacgggcgaaccttggccgactacaacatccagaaggagtcgacccttcacttggtgctgcgtctccgtggaggcatgcagatcttcgtcaagaccctgaccggcaagaccatcaccctcgaggtcgagagctcggacaccatcgacaacgtcaagacgaagatccaggacaaggaaggcattcctcccgaccagcagcgtctcattttcgccgggaagcaactcgaagacggtcgcactttggctgactacaacatccaaaaggaatccacccttcacctggtactgcgtctccgtggaggcatgcagatctttgtgaagacgctcaccggcaagaacatcaccctcgaggtcgagagctcggacacgattgacaacgtcaagaccaagattcaggacaaggaaggcattcctcccgaccagcagcgtctcatctttgct

SEQ ID NO: 2906 - DNA, 673 bp, Artificial
  Synthetic
ggcgaggagagcggcggcgaagaaggacaagtgtggagccatgcagatcttcgtcaagacatgtaagttctacaatccatcgccgctagcggcggcggcggcgccatcgatcttccccttgatcgattctttctccctttgttccagtgactgggaagacaatcaccctcgaggttgagtcgtcggacacgatcgacaatgtgaagaccaagatccaggacaaggaagggatccctcccgaccagcagcggctgatcttcgcgggcaagcagctggaagatggccggacgctggcggactacaacatccagaaggagtcgaccctccaccttgttcttcgcctccggggtggcggcaagaaaaggaagaagaagacgtacaccaagcccaagaagatcaagcacaagaagaagaaggtgaagctggcggtgctccagtactacaaggtggacgattcgggcaaggtgaacaggctgcgcaaagagtgcccgaatccagagtgcggtgccgggacgttcatggcgaaccactttgatcggcactactgcggcaagtgtggactcacctacgtctaccagagagctgaagcttagagaggatgacgagctttgctctctttccttgtgtttctatccaattttctttgaacgaaagtataatcttttcttttgtt

SEQ ID NO: 2907 - DNA, 590 bp, Artificial
  Synthetic
gggagaatcaacgtttcttggtaagtcatagctatggcgcttatagaattttggggcttcttgtaattcttggataatgacatgggtatgactgtttgtagatgattttccgctagatgttctatattagggtgtcgttgtccttatgttgattcctttgtctatcctagcagcaacgatgcagatcttcgtcaagaccctgaccggtaagaccatcactctggaggtcgacagctctgatactatcgacaatgtaaagaccaagatccatgacaaggaagggatccccccggaccagcacaggctcatctttgccggtaagcagctcgaggatggcaggactctggccgactacaacatccagaaggagtcgactctccatctcgtcctacgtcttcgcggaggtatgcagatcttcgtcaagaccctcaccggcaagaccatcacgctcgaggtggagagctccgacacgatcgacaacgtaaagaccaacatccacgacaaggaaggtatccccccggaccagcatcgactcatctttgccgggaagcagttcgaggatggacgaacgctcgccgactacaacatcc

SEQ ID NO: 2908 - DNA, 711 bp, Artificial
  Synthetic
tctcatccacctcgtccatctcatccttttgcttccagcagctatcaagacttgacttaaaaaaaccagtcctcataaagacatctacaatcagtcaccatgcagatcaccaagagcctcatcgctaccctctttgccgcttcgaccgcctttgcggctcccactcctgcggacaagtccatgatggccgctgtccctgagtggacaatcaccaacctgaagagagtgtgcaactccggcaatacctcctgcacatggacctttggcgtcgatacacatctcgccactgccacctcatgcacatacaccgtcaaggctaccgccaacgcttctcaggccaccggcggccccgttacttgcggcccttacactatcacatccagctggagcggccagtttggccctaacaacggcttcactacctttgctgttaccgacttttcgaagaagctcatcacctggcctgcctataccgatgttcaagttcagggcggcaaggttgtttcgcccaaccagagctacgccccgaccaacctgccatagatggaatgaatttgcttggaattactatacgcaaggtcaatttactcccaaaggaacagctggtgataattggaaacgacaatgaatcaggcgaggggggatacgtaccacaaaatttaatgtaatagatgattgactatgataatacactattgattaatgcgtctc

SEQ ID NO: 2909 - DNA, 664 bp, Artificial
  Synthetic
acactcacaaacaaacaaacaagcttctccatcttttttcagactccttgagaagagaactcggacttagacttgacttaactgtctattacacacacagctctccactaaaagcatcgagctcttacacaacaacacacaaacaactttgtcaacactcacaaacccttatccggtttcactcaactcttttctctctcaacaacaaactcactcacaatcactatgccttcttctcaaggacaaagctggtgggcccgccactgcaccccccgacccccgatcaacaaggtcgtcgcctgcccctgccactactgctacaacaagcccgcctgcgagctcgactaccccgagtcgtccaactgctccgagacgaacacccctgctcagtcgaggcctgtcagcccccgaggccgcaccagctcgtcttcgtcttttcacgttgagaaggccgagaagcagtaaacgacacattcgatcatcgaaatcattcaaatcacaaaagcgagtacatctttgaagatcctttggatactataggatatacacacactttcggtttcaacattttctttgtttcattctctctctactgagcgagcgaatacaaatataaaacgggcgcgaaaaaaaagcaccaacggcgcttctcccgatcagttcg

SEQ ID NO: 2910 - DNA, 374 bp, Artificial
  Synthetic
cagatcattacaatcaaactcttaatctctattcttaaatacatctacctctcacaatggatttcgtcaacaaggctatgggcaaggaggagcgctccactcagggcaccgctcccgctgctccccaagcaggcggccaggtccagaaggacgattacgtcgacaaggctttcgccatgggtgccaaaaagagcggccacaacatggatcgcaacacacaggagaagattacggatgcaggccgtaacatgtacgagaaggtgacaggaaacaaggtcgaccccaagtggtctaattaatgaacggacgagttatgactcacaacaagactgtacaatagtaataataacatcttatcaacgctgtctgttcct

SEQ ID NO: 2911 - DNA, 643 bp, Artificial
  Synthetic
aaattcgaggtgttttagacgcaagcttctcttttacacactgaagctgctgctgcaaccatcaccaacataccacacgcaacaacacaacaccaccacgtaataacgagcagaacacccctcgcttgaacttgttgcaaaaaacactctcgcctctatttcataaatcaaattacacacgaacaaaacaatgaatccaacagtcagaggcttctcaaccgccgcaagagtgcacccgccctttttgccacatctccgcccatcgccgcgccgagccccgatccgacgctggctaaaaactgccgccgtcatcaccgccgtcggatacgcctcaaagacctacctcgacgccacccgcgcccagcgccgcgaaaccgccctcgcacttgaacatgattccgccgagaggcagcgcatgatggagaatttgtatggtgggagggagagcttggaggatttggagaagggggttgctgagtatggcaagcggtaatcaccgaaggaaaaacaaaaaaaaacgacaacagacggaaaaaaaaacttgaagtaaattcaaggggtattattacaccaaaagcggcgaggcatttggggggatttgcatcagggctgatggtgcccttgagcgaagcatacatgggag

SEQ ID NO: 2912 - DNA, 613 bp, Artificial
  Synthetic
cgccattagagttgcatcgtatccactgctcagcagctgctaaactcatccgacgaaaatgacattcaagagaagaaacggaggtcgtaacaagcatggacgtggccacactaaattcattcgctgctctaactgcggcaagtgctgccctaaggacaaagcaatcaagaggttccttgtgaggaacatcgttgagcaatcagcagtgagggatgttcaggaagcttgtgcttttgaattgtacactcttcctaagctgtacttgaagatgcaatattgtgtctcatgtgccatccactccaaagttgttagggtccgctctgttactgataggagggtccgtgagcctccacagcgcttcagacgcccaagggatgatgctcccaagcctggtcaagctccacgccctgccggagctcctactgcagctcgttcttaagtgcctacattttgatcaactactgttaggcttttgggttttagttaatttgagatgtatttttgaagtcgatttctctatttagttttactggaactatcattaaatttgtgtatgcaaatctcaagcaaacaggcctgttgttcgtcctatagcttatatatcctttgcaat

SEQ ID NO: 2913 - DNA, 797 bp, Artificial
  Synthetic
tgggctttgcactgccaaaacggcccctccgccggcatggccataagaatggaggccttgtggaaagatcgtgaactttccatgtactttacttcgatcgtgaactgcacctcgcattacataaggtgatttatagcaggtaccacggtacaacaccaaaaagagcatacaccgccaaaatggtcaagaagagaaagaacaacggccgcaacaagaagggccgcggccacaccaagcccatccgctgcagcaactgctcgcgatgcactcccaaggataaggcgatcaagcgcttcaccatccgcaacatggtcgagtctgctgccatccgtgatatctccgatgcctctgtcttcgccgagtacactgtccccaagatgtacctgaagctgcagtactgcgtctcttgcgctatccacggcaagattgtccggtacgttgcctcccctgggagtgttacaactgcgcctttctggcgtatgtgcttcagatgagccttggttgtactttgggacgttcacacacgtcccagctctcgaacatatataccctcccccgtccccctaaaggtacgtttgacgctgacagaatcaaaatagtgtccgatctcgcgttggccgccgtaacagggctcccccccctcgtgtccgctacaacaaggacggcaagaagatcacccctaccgctgcccccaaggtttaaaaaatgggtatgacgggaatgggttggacggagtctggtttactttaacgccttcatgtaatttgcttagatgaatacccaggacaaagagaatc

SEQ ID NO: 2914 - DNA, 600 bp, Artificial
  Synthetic
aaagccctagcttctctgagcagccgtcgagttccagccgtctccgaaaatgactttcaagagaaggaacggaggtcgcaacaagcatggacgtggccacgtcaaattcgtccgttgctccaactgcggcaaatgctgccctaaggacaaagccatcaagaggtttcttgtgagaaatattgttgagcaagcagctgttagggatgtgcaggaagcttgtgcttttgaaacgtacactctgcctaagctgtatctgaagatgcaatattgtgtatcatgtgccatccactcaaaggtggttagggtccgctctcgaactgataggagggtccgtgagcctccacagcgattcaggcgcccaagggatgatgctccaaagcctggtcaagctccacgggttcctggagctgctccgacagcagcagctcgtacttgagtgcctgctgttttgatcatgttgtttagctatagtgtgaaagtgactatggagttttgttatatatggtggttttgagtacttttttggttcagtttaatgggacctagtactattttatggcatgaaattctggctggagaatagaaagatttaagttctat

SEQ ID NO: 2915 - DNA, 544 bp, Artificial
  Synthetic
agaggactctttgtaggtttttcttgcagggtagaagactcttttactagggagctatgacggttaagcgtagaagtaggggacgaagtaagcatggccgtggtcatgttaatcccatccgatgctccaactgtggtcgatgctgccctaaggacaaagcagtgaagaggttccttgtccgcaacattgtcgagcaagcggcaatcagggatgtccaggaagcatgtgtttatgatggatatgttcttccaaagctttacacaaagatccaacattgcatctcttgtgctatccactcccgtgtagtacgtgtccgctccagagaggctcggaggaacagggagccaccacagcgtttccgtagaagggaggataatgcccctggacagaaccgtccccctccccctccccgcccttgagatttgtcaggcagttcattaatcctcgagacttagtgctttttaatatcttagttgcagcctatatgaagctcccactggggcccttatttttgtcttaaaaccaatttgtgctccaaacttgt

SEQ ID NO: 2916 - DNA, 523 bp, Artificial
  Synthetic
aacagttcaatccagacaccgccaaaatggtcaagaagagaaagaacaacggccgcaacaagaagggccgcggccacaccaagcccatccgctgcagcaactgctcgcgatgcactcccaaggataaggcgatcaagcgcttcaccatccgcaacatggtcgagtctgctgccatccgtgatatctccgatgcctctgtcttcgccgagtacactgtccccaagatgtacctgaagctgcagtactgcgtctcttgcgctatccacggcaagattgtccgtgtccgatctcgcgttggccgccgtaacagggctcccccccctcgtgtccgctacaacaaggacggcaagaagatcacccctaccgctgcccccaaggtttaaaaaatgggtatgacgggaatgggttggacggagtctggtttactttaacgccttcatgtaatttgcttagatgaatacccaggacaaagagaatcctggagcctaaatgaatcggactttttttcttgttgaaaagattc

SEQ ID NO: 2917 - DNA, 469 bp, Artificial
  Synthetic
ggaagaggtagaggactctttgtaggttttgcttgcagggtagaagactcttttactagggagctatgacggttaagcgtagaagtaggggacgaagtaagcatggccgtggtcatgttaatcccatccgatgctccaactgtggtcgatgctgccctaaggacaaagcagtgaagaggttccttgtccgcaacattgtcgagcaagcggcaatcagggatgtccaggaagcatgtgtttatgatggatatgttcttccaaagctttacacaaagatccaacattgcatctcttgcgctatccactcccgtgtagtacgtgtccgctccagagaggctcggaggaacagggagccaccacagcgtttccgtagaagggaggataatggcccaggacagaaccgtccccctccccctccccgcccttgagatttgtcaggcacttcattaatcctcgagacttagtgctt

SEQ ID NO: 2918 - DNA, 585 bp, Artificial
  Synthetic
tgagaaagtagagccgcagattatactcagaagctaccatccagagcgaaaatgactttcaagagaagaaacggaggtcgtaacaaacatggacgtggccacacaaaatttattcgttgctctaattgcggcaaatgctgcccaaaggacaaggccatcaagaggtttcttgtaaggaacattgttgagcaagctgctgtacgtgatgttcaggaagcttgtgcttttgaaacgtacactcttcctaagctgtacttgaagatgcaatattgtgtttcatgtgcaattcactctaaggtggtcagagttcgttctgttactgataggagagttcgtgagcccccacagcgtttcaggcgcccaagggatgatctcccaaagccaggtcaagctccacgccccgctggaggagcccctgctgcacctcgcacttaacttgataggcttcaggttttaattaatctgatagttattttatctgttatatgtcgtggttttgactgtactgtttgatttagttgatgggaccatttaccattttatggaattgaattttgaatggaaaatgagagatctaaattttcg

SEQ ID NO: 2919 - DNA, 525 bp, Artificial
  Synthetic
ttcatccatcacctctccactccatcttataccccctcaaaaccatcttcaagatgtctgcctccgtcggttctgccaccaaggatgttgaccagagcaagaagtccttcatgggcatgcctggtttcgtcgtcgacttcatgatgggtggtgtctccgctgccgtctccaagaccgccgccgcccccatcgagcgtgtcaagctcctcatccagaaccaggacgagatgctccgctccggccgtctcgctaagccctacaccggcattggcgagtgcttcaagcgtgtcatcgctgaggagggtaccgcctccctgtggcgcggcaacaccgccaacgttgtccgttacttccctacccaggccctcaacttcgctttccgcgacacctacaagtccatgttcgccttcaagaaggagcgtgacggctactggtggtggatggccggcaaccttgcctccggcggtgccgctggtgccacctccctcctcttcgtctactccctcgactacgcccgtactcgtc

SEQ ID NO: 2920 - DNA, 589 bp, Artificial
  Synthetic
ggccaggccaggtatgagctcggtgccgtcgacaatctcggcagacgcgatcgccaggctgaagaagaaggaagatttcccggagtcaaggggggcggcgccggcggcgccgggggtgggaagcgacgaagagggatcatcaccggcggcggcggcgacgatccagagcaagacggtatgggcaaatttccccaaggatttggtggccgggggactgatgggcggcgtcgcgcacacgatcgtggcgcccatcgagagggccaagctgctgctccagacgcaggagagcaatgtggcgataatgcaggggcggcagcaccgctacaaggggatggtcgattgtatcttccgcatcgcaaaggatgaaggggtgctgtcgctctggcgcggcaatggcagcagcgtcatgcgctactatccgtcgctagcgctcaactttgccttcaaggacttgtaccgatcgcttctcatctcggacaagaacgacgctctctcccgagcaccgttcaacttcgtggccggtgccgccgccggctgcaccagcctcgtctttgtctaccccctggacatcgggcacacccgtctagcc

SEQ ID NO: 2921 - DNA, 373 bp, Artificial
  Synthetic
ctcgagcttgcggccgctaagcttttgatccagaaccaggatgagatgattaaagctggcaggctttctgaaccctacaagggtattggtgactgtttcggcaggacgattaaggatgaaggttttggttctctatggagaggaaacactgccaatgttatccgttatttccccactcaggccttgaactttgccttcaaagattacttcaaaagacttttcaactttaagaaggacagagatggttactggaagtggtttgctggtaacttggcatctggaggagcagctggtgcctcttcccttctgtttgtgtactcccttgactatgcccgtacccgtctagctaatgatgccaaggctgcaaagaaag

SEQ ID NO: 2922 - DNA, 208 bp, Artificial
  Synthetic
gtcgctgaccccgccaagaccaataagaccatgagtggtttcgccaccgacttcctcatgggtggtgtttccgccgccgcctccaagacggctgctgcccccattgaccgaatcaagctcctcatccagaaccaggatgagatgatcaaccagggccgtcttgccgccccctacaagggcattggggacctgcttcgtccgcacctac

SEQ ID NO: 2923 - DNA, 333 bp, Artificial
  Synthetic
aatctcctctcaaccttctccaccgcatgcacgatggctaagggtgatgtcgttcacgcggacaagtccttcatgggcatgcccggcttcatggtcgacttcttgatgggtggtgtttccgccgccgtctcgaacactgccgccgctcccatcgagcgtgtcaagcttctcatccagaaccaggatgagatgctcaagtccggtcgtctcgaccgcaagtaccacggtatccttgagtgcttcaagcgtacctcccaggctgagggtgtcctctccctctggcgtggcaacaccgccaacgtcgtccgttactcccccacccaggccctgaac

SEQ ID NO: 2924 - DNA, 618 bp, Artificial
  Synthetic
ttcaatctccactcgatctctttgcgcctttagatcgcaaaaatggccgataaaaagcaaagtgtgctcggcatgccgcccttcatggtggacttcttgatgggtggtgtctccgccgctgtctcgaagactgccgccgcacccatcgagcgtgtcaagctcctcatccagaaccaggatgagatgttgaagtccggccgtcttgaccgcaagtacaacggtatcgccgactgcttcaagcgtactacccaggctgagggtgtcctctccctctggcgtggtaacactgccaacgtcatccgttacttccccacccaggcgctgaacttcgcgttccgtgacacttacaagtccatgttcgcctacaagaaggagcgcgatggttacgccaagtggatggctggtaacttggcctccggtggtgctgctggtgccacttccctcctcttcgtctactccctcgactacgcccgtacccgtcttgccaacgacgccaagtctgccaagaagggtggtgagcgtcaattcaacggtctcgtcgacgtctacaagaagaccctcgcttccgacggtattgccggtctctaccgtggtttcatgccctccgttgctggtatc

SEQ ID NO: 2925 - DNA, 649 bp, Artificial
  Synthetic
aacaacaactgcacaccagcatcctctccgctcaatcatcctttctctgcttctacactaccgcaaaaatggtcgaaggagacgtcaaccagggcaagaagtccatcatgggcatgcccggcttcgtcgtggactttctcatgggtggtgtttctgccgccgtttcgaaaactgctgctgctcctatcgagcgtgtcaagctcttgattcagaatcaggatgagatgctgaagagtggtcgtctggaccgaaaatacaatggtattgtcgactgcttttcccgaacagccaaaggcgaaggtgtcatgtccctgtggcgaggcaatactgccaatgtcatccgttacttccctacccaagcgctcaactttgccttccgagatacctacaagtcaatgttcgctttcaagaaggaccgcgatggttacgccaaatggatgatgggaaacttggcttccggcggtgctgctggtgctacttccctgctcttcgtttactcgcttgactacgcccgtacccgtcttgccaacgatgccaaatccgcgaccaagggtggcgaccgtcaattcaacggtctcgtcgatgtctaccgcaagactctcgcctctgacggtattgctggtctctaccgtggtttcggtccttccgt

SEQ ID NO: 2926 - DNA, 652 bp, Artificial
  Synthetic
gctcgcagggcagggattgcagatctcgaactcccgcacccccctccctgtaatgcgagcacagtcttgctgaagcagttgaaatggctgagagaccgcaagctccgtctgctatgaataggttctctggctacacctacctaggttccaagcttactgagaaccgccaaagaagccgagggccaaacaccaccagcagctactattcgtatgcaataagccgcaatggccagcccaagcagaccccgatgcttaacctgaatggtgctgttggttcagtgaacctggacagtttccagaatgcttcccccgccaatgccgagttttttgcccctgcagcaaaggagaagggagtacaaggcttcttgattgatttcatgatgggtggtgtttctgctgcagtttccaaaactgctgctgcccctattgagcgagtgaagctccttattcagaaccaggatgaaatgctcaagtctggccgtctctctgaaccctacaagggtatcggggaatgtttctcccgaaccattaaggaggaaggcttcatctccctttaccgaggaaatgtggccaacgtcatccgttacttccctactcaggctttgaactttgcattcaaagactacttcaagaggatgttcaacttcaagaa

SEQ ID NO: 2927 - DNA, 1089 bp, Artificial
  Synthetic
ttctttttttccgggaaagcgtttgcacatcggtcaaaatgtctgagaagcctcaaaaggtcctgggcatgccgcccttcatggcggactttctcatgggtggtgtctccgccgctgtctccaagactgctgccgcccccattgagcgtgtcaagctcctcatccagaaccaggatgagatgatcaagaacggccgtctcgaccgccgctacgccggtattggtgactgcttcaagcgtaccgccgccgacgagggtgtcttgtccctgtggcgtggtaacactgccaacgttatccgatacttccctacccaggccctgaactttgctttccgtgacaagttcaagaagatgttcggtttcaagaaggagcgtgatggctacggcatgtggatgctcggtaacctggcctccggtggtgctgctggtgccacttctatgcttttcgtctactccctggattatgcccgtacccgtcttgccaacgatgccaagtccgccaagaagggcggtgagcgccagttcaacggtcttgttgacgtctaccgcaagaccctcgcctctgacggtattgccggtctgtaccgtggtttcatgccctccgtcgctggtatcatcgtctaccgtggtctctacttcggcatgtacgactccatcaagcctgttctcctggtcggtaacctcgccaacaacttccttgcctctttcgctctcggttggtgcgtcaccaccggtgccggtatcgctgcttaccctcttgacactatccgacgacgaatgatgatgacttctggtgaggccgtcaagtacaagaactccttcgatgccgcccgccagatcattgccaagaacggtgtcaagtctctcttcaacggtgctggtgccaacattctccgtggtgttgccggtgctggtgtcctgtccatctacgatcagctccagatccttctcttcggaaaggccttctccggtggctctggttaaattgctttttctacgttctgtatagacattctccgggcgtcttaacgcggagatggggttaattggccaggtgggtgtaatgcggggtccactggttgatcaaaaa

SEQ ID NO: 2928 - DNA, 1002 bp, Artificial
  Synthetic
gcgagtcgaacgcaggacttcgttcaacattgcaatggcagatatgaaccagcacccaactgtcttccagaaggcagctaaccagctacacttgagctcgagtctttcccaagatgtccatgctcgccatgtgggcgtgcaacctgctgtttaccagaggcgttttgcttatggcaaatactccaatgctggactacaaacttgtcaagccactcaggatctatcattgatcacctcaaatgcttcaccagtgtttgtgcaggctcctcaagagaaaggacttgcagcttttgccactgacttcctcatgggtggagtttctgctgctgtgtcaaagactgctgctgcccctattgaacgtgttaaacttttgatccaaaatcaagatgagatgctcaaggctggtaggctctcagaaccatacaagggaattggcgattgttttgggaggacaattaaggaagaagggatcgggtctttatggagaggaaacacagctaatgttatccgttatttccccactcaggctttgaattttgcatttaaggactacttcaagaggcttttcaacttcaagaaggaccgtgatggctactggaagtggtttgccggcaaccttgcatctggtggtgctgctggtgcttcctcattgctctttgtctactccttggactatgctcgtacccggcttgccaatgatgccaaggcctcaaagaagggaggtgagaggcagtttaacggtttagttgatgtctacagaaagacgctcaaatctgatggaattgctggtctgtaccgtggattcaacatttcatgtgttggtatcattgtttaccgtggtttgtacttcggaatgtatgactctttgaagcctgttctcttgactggaaacttgcaggatagtttctttgccagttttggtcttggttggctcatcaccaatggtgctggtcttgcttcctacccaattgatacagtcagaagaagaatgatgatgacgtc

SEQ ID NO: 2929 - DNA, 938 bp, Artificial
  Synthetic
cccccccctctagctcctcgttcttcgcccagctccatttcctctttcgacttccaaggcgagttgaacgcaggagtttatttagcaatggcggataaccagcacccaactgtttttcagaaagtagctaaccagatgcatctgagctccagtctttcccaggatgtccatgctcactatgggggcattcaaaggcctgctctctatcagagacgttttgcatatggcaattactctaatgcaggactgcaaaactgccaagccacacaggatctctcattgatttctgcaaacgcatcaccagtgtttgtgcaagctccccaagaaaaaggattagcagcttttgccactgacttccttatgggtggtgtttctgctgctgtgtcaaagactgctgctgcccctattgagcgtgtgaagcttttgatccaaaaccaagatgagatgattaaggctggtagactgtcagaaccatacaagggaattggagattgtttcgggaggacaattaaagatgaaggatttggttctttgtggagaggaaacactgctaatgtcattcgttacttccctactcaggccttgaactttgcatttaaggactacttcaagaggctcttcaacttcaagaaggaccgtgatggctactggaagtggtttgcaggcaaccttgcatctggtggtgctgctggtgcttcttctttgctctttgtttactcccttgactatgctcgtactcgtcttgcaaatgatgccaaggctgcaaagaaaggaggtgggagacagttcaacggtttggtcgatgtctacaagaagactcttgcatctgatggaattgctggattgtaccgtgggttcaacatttcatgtgttggtatcattgtgtaccgcggtttgtacttcggaatgtacgactccttgaagcctgtgctcttgac

SEQ ID NO: 2930 - DNA, 754 bp, Artificial
  Synthetic
ggatgtcatcttaacgccggaggtgtacttgaccttgtagttgacatctcgcgcggaggcaatggtgtcgacctgcagagcgatccacttggtccacgtttttcaccatgttgaatgtgtagttagtccacaatgtccgacaagtccaacttcctcgtcgacttccttatgggcggtgtttccgccgccgtctctaagactgctgccgctcccattgagcgagtcaagctcctgatccagaaccaggaggagatgatcaagcagggtcgactttcccgaccttacaagggtatcatcgactgtttcaagcgaaccgccgccgatgagggtatcgcctctttctggcgaggtaacaccgctaacgtcatccgatacttccctacccaggctcttaacttcgccttcaaggacaagttcaagaagatgttcggtttcaagaagtctgagggctactggtggtggatggccggtaaccttgcctccggtggtcttgccggtgccacctctctcgcctttgtctactctctcgattacgcccgaacccgacttgccaacgatgccaagtctgttgctaaggacggaaaggctgctggtgagcgacagtacaacggtctgatcgatgtctaccgaaagaccattgcctccgacggtattgccggtctctaccgaggtttcggtgtctccgttgtcggtatcattgtctaccgaggtctgtactttggtctctacgactctcttaagcccgttgtccttg

SEQ ID NO: 2931 - DNA, 82 bp, Artificial
  Synthetic
accatcaaacaacaatacaatccatacaggattacctctcaattcaaccacctttacgacaatcgcaactcaataaaatcct

SEQ ID NO: 2932 - DNA, 674 bp, Artificial
  Synthetic
caccatcaaacaacaatacaatccatagaggattacctctcaactcaaccacctttacgacaatcgcaactcaataagattctttcagtgtattatcactcaagatttgaatttcgattcgaccaagaaaactccaatcaaatttattacaccatataatattttcaacttcaaacatttttctcaatatgtctgctgctaccgtcacccgcgctgctgccagcactgttcgcaagcctatttccttctacactcaagtccgaagaatgggccgtgtctttgagagccacccatacgagagatttgcaaccaccatgaagcctgcaaagcccgactactacaagaacatttctttcactgctggcaaggttgtcacttatttccccatcatcggcgccatgcttggctggcccgtcctttgcaaatgggctttggacggacagatcggtcgcctgtaaagaggtgatagaggcaatggtatagagtgggacagcaaaaagatatagagatgtccatctttcgactgtatatatacactttgggcgtttggatggactatgggtgcgaagcatatttcggcgcaacacagattaattcaatttgattctctttgttaatttattcaaacgcgcgcctacacaacaatctgtgatataagaatgtgtcagccgaaa

SEQ ID NO: 2933 - DNA, 685 bp, Artificial
  Synthetic
tccgacaatccatagaggattacctctcaactcaaccacctttacgacaatcgcaactcaataagattctttcagtgtattatcactcaagatttgaatttcgattcgaccaagaaaactccaatcaaatttattacaccatataatattttcaacttcaaacatttttctcaatatgtctgctgctaccgtcacccgcgctgctgccagcactgttcgcaagcctatttccttctacactcaagtccgaagaatgggccgtgtctttgagagccacccatacgagagatttgcaaccaccatgaagcctgcaaagcccgactactacaagaacatttctttcactgctggcaaggttgtcacgtaagtaccccagacaatacaatacaacaaaccagtacatccatagagcggctgtactaacacttggatttttgcagttatttccccatcatcggcgccatgcttggctggcccgtcctttgcaaatgggctttggacggacagatcggtcgcctgtaaagaggtgatagaggcaatggtatagagtgggacagcaaaaagatatagagatgtccatctttcgactgtatatatacactttgggcgtttggatggactatgggtgcgaagcatatttcggcgcaacacagattaattcaatttgattctcttcgaaaaaaaa

SEQ ID NO: 2934 - DNA, 700 bp, Artificial
  Synthetic
atcaccaattgcaccccgccatggcttcaccaatggctgcctctcgccatgtccagcgcgtggctacacagatccgtctgcgctcagcgcgggttcccagaggccaattgaccttcaatcgatgggcatcgtccgcttcgggcagtcggcgagctcccgccagcttcggaacttcatcctcggcagccgtttggcttgcagccgccgccattggcatcacggctcccttggcctacagcttggtgagttttacacgataggcccggggagacacaattcatgccgagacctttccaacttacatgtctcttcttgtttccttttccagacaacagcagaacctgcaaagctcgacgtcacatcccttgccgaaaaggatgagcagaagaagagagaggcggttgtcaccgaagagtcgcccatgcgcctgcggatggaaaagttcatcaaggagcagcagcaaataattgtcaaggaactcgagcgcatcgacggcaagaagtttcgcaaagacgagtggacgcgacccaatggcggcggcggcataacctgtgtgctgcaggagggcaacgtattcgaaaaggccggtctcggcgtcagcgtcgtctacggaacgcttcccaagcccgccatcttgaagatgcgcgaaaatcacaagaacctcgaccccgacgtcgagtcgctggaatcttcgctgctg

SEQ ID NO: 2935 - DNA, 728 bp, Artificial
  Synthetic
atcccatcaccaattgcaccccgccatggcttcaccaatggctgcctctcgccatgtccagcgcgtggctacacagatccgtctgcgctcagcgcgggttcccagaggccaattgaccttcaatcgatgggcatcgtccgcttcgggcagtcggcgagctcccgccagcttcggaacttcatcctcggcagccgtttggcttgcagccgccgccattggcatcacggctcccttggcctacagcttgacaacagcagaacctgcaaagctcgacgtcacatcccttgccgaaaaggatgagcagaagaagagagaggcggttgtcaccgaagagtcgcccatgcgcctgcggatggaaaagttcatcaaggagcagcagcaaataattgtcaaggaactcgagcgcatcgacggcaagaagtttcgcaaagacgagtggacgcgacccaatggcggcggcggcataacctgtgtgctgcaggagggcaacgtattcgaaaaggccggtctcggcgtcagcgtcgtctacggaacgcttcccaagcccgccatcttgaagatgcgcgaaaatcacaagaacctcgaccccgacgtcgagtcgctggaattcttcgctgctggcctgagcatggtgctccatccgtacaaccccatggctcccaccgtgcacctgaattaccgatacttcgaaacgggcaatcccgacggtacctctcaggcgtggtggt

SEQ ID NO: 2936 - DNA, 835 bp, Artificial
  Synthetic
gcgaagagatttactgtcttgcttactctgttactgaactcattgttctttgaattgaaccttacgatatcaattacaacccattgagctgctgcaccaccaagctaccacacttacatacaaacacacacacacacaaatcaccactacaataaccacacaaatcaacaacaccaaaacaacaacaacaaccgtcacaatgcccgtcaactacgtcttcacagagtccgccccctcccaaaacaactacatcagatccggccgcggcggcgctggcaacattgtccgctcctcagccctccctcccacatcatcatcctccgcctcctcctcagcctcccgccagctccccaaccagcgcttcttctctggcatcggcggcgccggcaacgtccaccaggccgacaagctccagcccgctctgctgcactccctcgagacccccgccaaccagaacccatcgcgaggccacgtcggccgcggcggtgcgggcaacgtctacaaccgcaagcctagcgatgccagcagtgtgtcgagcgcgggcagcactgctagctcggttggcgagaaggccaagatgtgggcgtctcgcgtgagcggctcattctcacgaaagtagatgagatgtctacatatccatctccatctatatacctactactggttgaggatataactggacttgaaaatgaaagaaagaaacaaaatataatcaacaaaaactggcgttgaggatacaacacggtactggatgacatttggggagagcgattttgatacacaacaacacaaaaaaatacacacataaacctgtgtgatggatttacgattacga

SEQ ID NO: 2937 - DNA, 483 bp, Artificial
  Synthetic
agcaattgcgcgccaaaagactgtacacagacgtcttttgatatattttcaaaatgggtggcggtggaaaaatcccttaccccaagcacgtctggtcgccttctggtggttggtacgcccagcctgccaactggcgcgccaacacgctcatcgccggagccgccatgttcggcgtcatcgctattacgtggaagttcagcgccgacagggaacgatgggcgcataagccggagccgtgggagtggcatcctagccgatagtacgtttatttttgattgtattgggtgtggttgtgggaatttggtcgtttttgctaacgtttttcttttgcttgaagctggtcaaagcagttgatcgagtgggacaaggaggacaagctgaaggcagcaagcaacagcaaggagtagagttttctttttgggagaaggataatagacgaaattgtacaaattctatacgaacaaaaggcaaacatttcaaaac

SEQ ID NO: 2938 - DNA, 353 bp, Artificial
  Synthetic
ctttgttgatagtttggccgccactcgtaattcaattggggcgagcgagtgagttgcgagtgttggtttacgagcactactgggacgttctcctaccgataaaagaaaagaagaaaaagatggctgaggaagcatcgtttcgagacgcagttgcgtctgttcccggcctctcgggtgcttccgagtcggttgccgccgaccagcagcccaagaagttccccaagggagtggttctgggcaaggatggcaaaccatgtcgaagctgcacatcatttgcttcctgggccgcgcagacaaaaaaagacgtcgccaccggcagcagagcagtatctacaacagcaacagccgtcgcc

SEQ ID NO: 2939 - DNA, 573 bp, Artificial
  Synthetic
gcctctccctgacattcattccaccatggcgcgccgccagcatctcacagcgtccatcctgttggtcgtcgtcctgttcttcagcttctcgtatttcctgtccggctcgtccagccacgatgtggaccgaatccatgagcctgcgggagagcccaagtcggaattcaaagtggacctgggtggcatgccagctagtctgcttgacggagagtctatagcccccaagctggagaatgcaacactcaaggccgagctgggtcgtgcaacatggaagtttatgcacacaatggtcgccagattccccgagcagccctcaaaggaagagcgtaagactctcgagacgttcatctacctcttcagccgcctatatccctgcggtgactgtgcgaggcacttccgggggctgctgtcaaaataccctccccagacgagcagtaggaatgcggcggctggatggctgtgctttgtgcataaccaggttaacgagagactgaagaagccgatatttgactgcaacaacattggcgacttttacgactgcggctgcggagatgaagataagaagaaggggga

SEQ ID NO: 2940 - DNA, 410 bp, Artificial
  Synthetic
cccacgcgtccgcaacacttacaactatcaacatctaccatattcaagatgccttctttcattgtcaccctcaaggacgatgtgtcagatgaacaggttgccgcgtgagtcgggctcctgttccgctttgacgacaaccactgacacgttaccagagccaagcagaatgccaaggatgccggcggcacgatcacacacgagtacaccctgatcaagggctttgccgttgagtaccctgagggcatagttcactcgctcgctgaggacccctcagtgcaggccgtcgaggaggataaggatatgaggacgcagtaaatggagctctctattctgttcttgttgcatctacatctacatacatctacattagaaagacgtaatatagagattgtatcaacatcttcatcttc

SEQ ID NO: 2941 - DNA, 565 bp, Artificial
  Synthetic
gccatgctgtgagttgtctctcctctgtcttgtatccaacgaacctggtcctggaaggctgcagcctcactgcctcacgttctcgtacgccgccagccagtgctagcatccgcatctcccgtggctcgtcgcggtgcagcaagcccccgtcactccttggtcacagagcgccatcatcatgccagcgtcgttgtcaccaagccctcagtcctctcagtcatccctgatggagaccattccagatgacaagggtcctgatttgaccctggataagcctttgccccaacgccccaggacgcccgctaagctcttgcgtcttggggtgcggaatcgccgccacgagtacctggtgaaaactcggtcgtattttgacaatctggaacatgaacttgctggtatgatatcgcatctcatttttttcaatctctctcctgttgtcggctgatgggtcatgtcgacgatcctgtagcctcgagagagacctcatcatccctttccaaacctgacttgacctgaaaaccaaccattgcggtgtcgtgtagatcctgtcttgtatgagcgtctt

SEQ ID NO: 2942 - DNA, 306 bp, Artificial
  Synthetic
cccacgcgtccgcccacgcgatccggggggggaattgaacgggggtgagggctttatgagagaggcgagctttcgtacgagccttcggatcagataagatcaggtcgggctggtgacaggcagccacggcccaccagggtccgccataggcgtacaacgaccccgtaagatcccagtaatggctcattaattgctcctgctgtggctggcatgatcatcgtcacatggccgggtttgggcgactaaaattagcgggctgtgccagcaggatgagaccaagacggcagaggagcacggccgagaagg

SEQ ID NO: 2943 - DNA, 382 bp, Artificial
  Synthetic
gccctacctgccatggttccaaggccctctcttctccatggccactgccgccgcccgtgagaacgagaagaccaacgtccgcgtaaacgaggtgtatctgatgttccgcgttgaggttgacgaggctgccaaggagcatggcgtctcaagcagctccgaattcgcctccgtctacgaaggatttctgaacaaccctgagatccgcagctcgcgcgttcgtgttgcctcgcctgctgacttcaccgacctgaagtgggctaagaagttctaaaaagactgatgcgtcttttttaaaccttcgtgtttctctccattaagcattttgagaaatcatctccctgttgctggctgattacacatggttcagtagttgacaatactg

SEQ ID NO: 2944 - DNA, 196 bp, Artificial
  Synthetic
gaagagggactgtactgtacagtaactgtaccttatgcaattgtgcaggattatgtctctgctgtaatgtatctgcggacgtatctgcggatgccggggatggactccggtgtacttggcacggctcgcttccgtttgacataaaaatgcagtgtaacaggtagatggacgtacatgtagatgtaaatgcggtact

SEQ ID NO: 2945 - DNA, 465 bp, Artificial
  Synthetic
caacaacgattctcatcaaagaacaaacgcatcgttcaagatgagagccaaatggaggaagaagcgcgttcgtcgccttaagcgcaagagaagaaagatgagggctcgctccaaataaacgactcgctctaccacttgacttgacacatctttcacattttgaatgagttcacgataaaacacgacaagcaaagctgctgcaccacggtaccactctatgaccgattacagccatcaagttggaatcagcatattggtgcgcctctccaattcagctacgggagtcaatggacgaacgcgagagatgaggactggacaatttcagtcaggtggagacatcgttttgaggacgcgaaggccatgaagcaaaacgctgctgcaagaagcacgcttaggatcgatacgttgcttgacaaagatcaaaggcagaatttacttcatttccaaatcaagaaaaaaaaaaaa

SEQ ID NO: 2946 - DNA, 662 bp, Artificial
  Synthetic
acgcgtcggcggcgtctcctacaagaaatcgttcgtttccctctgtcattgcgagcctgttgagcaacacaacaaaaaggcgtcaacacacaaagatccaatcgccagatctaaagcctctgtgctactcagtccaacaattgcacaaagcgacacaacataccgaaatctgcaaacaatgtgtttccgcgtggagccaaaggccaaatactactaccaggaggaaatcattccctcacggccgtaccgccatcaccatcaccatcaccattcttcccaccactcgccgcgagcgagctactcggcggttgagcgctacagcccgcgggtcagcaccagcagctacagacgcagcgtgccgtcgagggtcgtgtatgaggagacaacgcggagtcggtactgaatgggcttttgattaggaccaggaatatcctgtgattttcttactctttgtttttttaacgactctatggtactggttatgggaaatgagacacatgttagaggctagaataatgggcggattgggatggaaactcgaggcaggcgatggtttcatgaggatatgagaacctggaatgcggtgacggcgttggtaacatatatttcgcctttacgatttgaatgaatgagatacataaaacacattctagatgtctcgc

SEQ ID NO: 2947 - DNA, 413 bp, Artificial
  Synthetic
gtcgacacgcgtgttttggagtagttgctgaatgctatggttggtttatatcaatatgatgagtttcagattagttcacaaaggttctttatggctcttttaaggatgggaagccgcagagagtcgtgatcctttcaaaacccaaggcgtcgcacgtccgacgctgtgtctgagcaaacattgttcacccttcaagtttccactacaacctcgaccggtaccaccatgagcggcatagaaaagcgcatgtggcttggacacctcaacaaggacctggggcccattccgaggccagaaatcccattcgccctcgtctggcttgtttaacgccttgcaggggggggagaggggaagctgagcatgggagagggagacggaaagaaacaaaaagcaaacatatttgatcatcatgc

SEQ ID NO: 2948 - DNA, 655 bp, Artificial
  Synthetic
agcagctgacatctgccgtatcatcgctcgtatcagttcgtctcaacatggcgcccctggctcaggctgtgactgtgtctctcaaggacctgcagaatggagacgtctccttcgagactctgcagaaagcctttggccctgattccctcggtatcctagtggtcaaggacgttccacaagagttcgcccagctgcgccatgtcgccctatcatatggatcctatttgggaaacctgcccaaagaggaactgggtaagtgcttgtctgccttttcttcttcttttcttttcaagccgccaccgaagatggatggatggatgaacggatggagggtagcccaggcacctgttttccctattttccaatgacacgagccgcggagcgcttaccatcgcttctacagacaggttggaaaacgccaaagcaaagtatctcaccggctggtcgctgggcaaggagactctcaagaatggccaggccgacaccttcaagggatcctactacgccaactgcgccttttacgtgaatcccaccctagaatgcgctgagcccacggccgagttctcgccagagacgttcccagaatacctgtcgccaaacgtctggcccgccgagaatgtgcttcccggcatgaagccggcagtgacaactctct

SEQ ID NO: 2949 - DNA, 659 bp, Artificial
  Synthetic
atgaataatgaccaattccgaaagttgatgctggccaagtcgggcaaagcgtcaaaagatggcgcttcatccaaaggcacgagctccggtgcgaacacgggctccttgggatctcggcagcggagcagcatacctatgactccgcgatctttgggaggtgcccaggccgatttcgcgagacagctggctgagcgcaaccaagctctaaaccctccaaagaagtttaagacatctgtaccaaagggtgtgaaactaggggaaggatacatcgatagatcgcaagttcgagagagcgaagaggacgaccgagaagagagactaaaggcgttggaaaaagctttcaaagacgaagaaattgacgaggcaacatacgaaaagctacggtttcagattgcaggcggagatctggcaagcactcatctagtcaaagggcttgattttaaactcctcgaaaggatacgaaaaggagaggatgtctacggaaataagggagtagaaaaggatagcgccgaagaagcacccatagaggacgacgtggatgacgaattcgatcgactcgaagaacaagacgtacaagccattacgaaagaaaaagcggaaaagaagaagggcactctttcaacagtgtctctggcacctgggaaaaagagaacacgcga

SEQ ID NO: 2950 - DNA, 523 bp, Artificial
  Synthetic
ggtagcattagctggaattttgttcatgcatctggcccagcaacaaggtgagaagagaaagacacgatacggatttgcaagtcggtcttcgagatctactctgctaggagacaacatcttgctcggcttttagaattctgacatgtcttgccgtggtgaaacgctcatcctccaggttaggtgctagacaataaacctcgacgggatcttcgagtcatgatgacgcacggcaaggcctccgaccttcctatcgaaacctggaagcctggtcttcttttgatacgagcaagatgtactgtacatcgtaatcaatatagctggcagagtatggacctggaaagattggcgatgcctccagactccagatcgaataaccaaattcttcgtcagaagttgccacagctgcacggtccctcgcgccctctaatcaagagagtcagctactcaactcagatagggcaacatatcccaataaacctctgcaataggcaggaggagatgcgtaatatactaataatggaac

SEQ ID NO: 2951 - DNA, 551 bp, Artificial
  Synthetic
gtacatcttgctcgtatcaaaagaagaccaggcttccaggtttcgataggaaggtcggaggccttgccgtgcgtcatcatgactcgaagatcccgtcgaggtttattgtctagcacctaacctggaggatgagcgtttcaccacggcaagacatgtcagaattctaaaagccgagcaagatgttgtctcctagcagagtagatctcgaagctaacttgatcagagactggtcttacactaggtgaccgctgcgagtgtcttgagtcaacaggaaaagaatccgcgaaggaaaaaaagaaaggagtgaactcacaccgacttgcaaatccgtatcgtgtctttctcttctcaccttgttgctgggccagatgcatgaacaaaattccagctaatgctacagtaaggagacactagccgcgactgcaaggagaaagctctagctcgcttgcacaagaccctctttcatgacagctagacgcccgcgccagtggacggctctgacttgaagttctctgaaggatgacaaatgatggacttgagatctggccacg

SEQ ID NO: 2952 - DNA, 500 bp, Artificial
  Synthetic
ctaatgataatgaatgattggagtgccagagatatccaagcttgggaaactatacctcttggacctttccttgggaaaagtttcagtaccacagtatcaccctggatcgttactatggatgccctaaagcctttcacctgtgaagctcctaagcaggaacctgaacctttgccttacttagctgaaaagaaccacgtaaactacgatattcctcttgaggtctggattaagcccaaggagcaaagtgaaccatcaatggttgcaaagagtaacttcaagcatctgtattggactttaacacagcaactagcacaccacactgttaatggatgcaatctgagaccaggggatatgtttgcaactggcacactaagcggacctgagacagaatctttgggatgtttgctggagctaacatggaatgggcagaaggagatatcagttggaaactcgacccgcaagttcctagaagatggggatgaggtcatcttgacagcttg

SEQ ID NO: 2953 - DNA, 627 bp, Artificial
  Synthetic
ggcgtgggaatatgtgcccctcggaccgttcaacggaaagaactttggctcaactatcagcccttgggttgttgtcgcggatgcgctggagcccttccgagcccagccgctgccgaatgatacccctgttcaggattatctcaaggagtcacagaaggagagcgtgtttgacattcagcttgaagtcggccttacaactgcggatggcgaccatgtcgacctgtccaagacaagcggccgaaatctgctctggtccttcccgcagatgataacgcaccataccgttggcggatgtcctctcagggccggagatttgttgggctcgggaaccattagcggctcagagcctcgggaacgtggtagcttgcttgaaatgaccgagggcggcaaggtcgatgttcagctcgaaaagggcggggtgcgtcgcttcatccaagacggtgacagcctgaacatgcgaggatactgcgagaagaacggagtgcggatcgggtttggcgactgtgagggcacgattctgcctgctcacggggcgtaaaatttgggaggggacaacggcataatgagaaatgtaaccaaaatatccattagatgaaatcaaaaacagaagccaagagctctttgggg

SEQ ID NO: 2954 - DNA, 333 bp, Artificial
  Synthetic
gcccacgcgtcggctaatacatggctctttcccgctcagatacgtttacagtagcaggtactgcctaccaggactttacttgcttttggcaacttgggtaggccacggctgtcatgaaggcgcatctaatccgtacattagcggtgataccctgcgcacctgtattttgacatcccgcgtgatgcgggattccagagccgtttccaacggccttttgggcattgatatttagttttcgatatgagagctagtacttgcagatgaacaaccatgaagcactattgcggcactagcaacaggattgcattgacatcgactcaatatgtagcaaag

SEQ ID NO: 2955 - DNA, 611 bp, Artificial
  Synthetic
gtgccatagtccctgctcttagaaacatacgacgacgagtgccagcttctcttctccaaaaccgaaacgttttgagagagagagagagaaatggagaacgttttgggcggcgctgccccgcttttggccgttttctcagtagtacccaagtagacactactgcagagctattggaatttcctggggctcgagtgcgctacacaagtgagctgaaatatatcccggagtctttggaggagcctgttccttgttttcgtgttttgaatgattatggacaacgtatcgaagggtccgaggtgcatgaggttactcaggatcttgctctaatgatgcacgagcgaatggttatgcttcaggtcatggacaatatcttttatgatgcacaaaggcagggaagaatatccttttatgtcatgactactggagaagaagctataaatattgcatctgctgcagctttatcacacgatgatgtggttttatctcagtacagggaatctggtatacttatgtggcgcgggtttacgcttcaacaatttgcaaatcagtgtttcagcaatgaggctgactatggaaaggggcggcaaatgcctgcccactatggatgtagt

SEQ ID NO: 2956 - DNA, 95 bp, Artificial
  Synthetic
  misc_feature (1)..(1): The residue at this position can be any nucleotide.
ntcgaacaatgttgaatccgctcaaggccaactcgcgcgtcttcgcaggggcctccatcctggagactgtgctcagccgtccgtctccgtcatct

SEQ ID NO: 2957 - DNA, 1053 bp, Artificial
  Synthetic
gattgtccttcttccagctgccaaaatgttgaatccgctcaaggccaactcgcgcgtccttcgcagggcctccatccggagactggctcagccgtccgtctccgtcatctccaatcccatccggagcgcgggaagcctctcgcaacggcccaattcgggatttgtgtcgttccccggcgctctcaagagctccttcaccagctctctcaagtttgagacgcccgaatcatacacagccctgccgacgtacagagtcgtggaccagaatggccaagtggttgacccctccttcacccctgacatcagcgatgaggccgtcatcaagctgtacaaggatatgctgtacatctccatcatggatctcatcatgtttgatgctcagagacagggccgactaagcttttacatggtaagcgctggcgaggaagccgtgagcgttggcacctcgagtgtgctggacaaggatgatcccgtcttctgccagtatcgagagcaggggctgttcaaggagaggggcttcacgacggaacaattcatgtcacagctgtttgccaacagaaacgacaacggccggggcaggaacatgcccattcactacggatgcaagccgttgaacattcacactgtctcctcgccattggctacacaacttccgcaggcttcgggggcggcttatgccttgaagctacagagactacaagaccccagctcgaagccaagagtagcggcagtctttttcggagagggagctgccagtgagggcgatttccatgccgcgctgaacattgccgccacacgctcttgtcccgttgtcttcatctgccgcaacaacggattcgccatttccacacccactctcgatcagtaccgaggagacggcattgcgagcagaggaattggctatggaattgataccattcgaattgacggaaacgacatctgggcagtcagagaagccacaaagaaggcacgagaaatggcactgcaggacggtggcaagccggtgcttattgaagccatgacctatcgtgtctctcatcacagtacttccga

SEQ ID NO: 2958 - DNA, 477 bp, Artificial
  Synthetic
tcatcgcttcatttcgcatatcggcgccattcgttctttccacctactgacatacaaacgcaccttattttctttcattcttactcttttcgtccagccatccgctctctttgtcttggcctcatcaccggtagcttcctgacagtaattcgcccgtctagcctgccgtcttgtttatcaaaagacaaagcgccaggaggggagaaccccagtatcgcgtctaccagccctgcggcttcgattcggctcaaccatccatctatctcggcggcgtcaaagacaagctccgacgaatccaactaaccagagcaccgagtctttgctctgcgtcaacttgaactcagctctctccttcgtctatcttacgcttcgagatattcatcatgtattcttcaaggcttatttcggtactggtcgtggtggtgtccatcctctgcatggcccaggccacttggtgggacaaccaaaaagttcacc

SEQ ID NO: 2959 - DNA, 148 bp, Artificial
  Synthetic
ggccgagataccccgtccgaaacgttctcacaatggcgtcccgcttggtacgaagcgctgtcggcgcatctcccctcctccgaaccaccatctcacgatccgtcccggccatttctgccgccgccgtgcgatactcgagcaacgtgcc

SEQ ID NO: 2960 - DNA, 623 bp, Artificial
  Synthetic
gcatcgacaatggcatccctgctgcgcacgctctctctggccgcagggcttttgcgctcttctcaggttgtcaagccgtttgcggctggcagctttgcgacggcaacgagcagcccggcttcctcgtggatgggatggttgtccaagcccgcagttggagggaccctgcagcagacgcggggcatgaaggttcacagctcggtcaagaagaggtgtgagcactgcaaggttgttcgacgaaaggccggcaagcgacacaacggatacctgtacattatctgcaaggccaaccctcgacacaagcagcgacagagctaaggcgactgcgaggatggttcttctcttttttgacgacgatgacgacgatgacacccggatgagtgggcattctgtatattattggcgtataaagggtgacgaaagggagcgacgaacaaacacacacaacggtctggcaaaaagcaattgatagacgatactacggcaatgggcttcgaagacgtggaggacatgacacgagcccaagtgcgagctttcttgcatgctcgagaaatgacggttcagagtgccgtcgtaaaaatgtacaattttatgtagtgttacatacccccgatatacctctc

SEQ ID NO: 2961 - DNA, 519 bp, Artificial
  Synthetic
gtaattgactactatgtgggcattcaataactcagtcacatgccaaagacctccccatccattgcatctccctcagtgaagaacaaagcagttagttgttggcactttgttcacccatcaacaaaaaatttcttgctccaggaattgaaagccctaaagggaaaaaaaaaattcaacagccgcgcatatagctcgtgactcgaccacaacgtgagctagtcatacgataaagctggggaaccaacaacgtgggcagatttccccccaggactcggcccacttccccagactcctccagactcctccgcagagtggaagatgcatgtttcttccaggttctgtgccgaaataagcctctggtatacttaatggcagatgtcgagctcgcacaatgcagtaaagtaataccgagctcgccaaagccctccaaagcggcatcattgggcgaactcggctatatgtctacgtgttggatagaatagagtgacaagtcacgatcaatagtactttttacaatgc

SEQ ID NO: 2962 - DNA, 408 bp, Artificial
  Synthetic
atggatttgagacaccaggaaatgcaatggacctgtctctcgctactctgctggttaatttctgactctggcgctaatacacaacgacgatggcgatgctttttccataccccatagacccgctagtcccatctgacattactcgacgatcagcacatgtcgaccatcatatccgcgcatttgggctggtacggggatatttagatgccaagggcgagcctaaatgttgagctggttgaccaacgctgcttgtgaccaacaaggagcatgagttggcctcgtcagcattgctcccgccagaaatcttttacaacacaatactacagtgtacctccttgggcttgactttctactactcgtacaggtcaagccatgtcagatagtcagaccgttggtagttccatgtgg

SEQ ID NO: 2963 - DNA, 813 bp, Artificial
  Synthetic
aagcaatatcattgtttgctcaggaggccaaagcgagcttttcgattgattgtcctctttgttctttgttacatttcatatttatttgcgtcttggggagccattgcaattgaattgctgcgctctgggcatcgtacacacgcatttttctcggcaattccggcttgagctgcacggcatacgaaattgctgccggtgcggactcttgcagctccgaggctccgctatctccatctcaccggtgattccttgtgcgaggttcggcgagaattccagcaattattgtcactctttgtcctttcacgaacggagcgaaatatatataatcagctacgctgggtaaagagaaagaagaggaacctctgcactcgccgcatcctacgaaatgattcgggcggcgtttcaatcgagagcggcaccgtttggagcggccaagagcacgacggtacaatatggagcattgagggatgcttgggcaaggctattttcgtcacagcctgtcatgaagtccccgagcaacagcagcagaacatcatggacgaggttacattcaattcagccctggcggggaaccacgcgccacggcgcttcgatgcgaccaaatgtcaggatagctgacagctttgcgaggggggcgcaaaggcggagctttatgttttcggcatggaggcgcaacactgcgcaaggagctcaggagaagttgtcgctgagcgggagattcaagaagctcctccaggaatacgggtggtcggccgtcggcgtctacttcgcgctcagcgtgctggactttccgttctgcttcctcctggtgag

SEQ ID NO: 2964 - DNA, 561 bp, Artificial
  Synthetic
ctttcataatggacagcaggagatgcaaatgcaagtggtgcgggacgaaaatttcagctcccattggagcacaaaccatttcgtgcccaaggtgccaatctgttacccaactccaacctccaagaaccaacaacggctttgccgctggggttattaacaatattatgggtgcagtagttaacacagggtttccagcaaggctgggaaggatgaatccaacagatgccaataattatcagcctcaaccgttcaacatgtcaccccagattactatgcaacctccagctgttcatggacggaagcgagcagtactctgtggaataacctaccgtgggcattccaagagtctgaaaggaagtattaacgatgttttatccatgagatatcttctggttcagaagttgggtttccccaatgcatccgttcttgtccttacagaggatgagaaagatccatacaaaatcccaaccaagggcaatatcagatcagccctacgttggcttgttcatggttgtcagccaggagattcactagtgttccactactctggccatggcacac

SEQ ID NO: 2965 - DNA, 647 bp, Artificial
  Synthetic
cccacgcgtccgcccgcctcagcatggaggatatggaccacctcagcctcaatacggcggccaccagaaccaatatcctcctcccggcggccctcccccgagccactacgcacctcctgcgcaccatcctcctccgggtctagatgcttacggctatcctctcaaccctccgactgccatgcacgcaaaggccggccccccgcctccctcggcccctcagcagtttggccacggtgctccgggcggctacaccttccagtactccaactgcacaggaaagcgaaaggcgctgttgattggaatcaactattttggcacaaaggccgagctcaagggatgcatcaacgatgtccacaacgtgtcggcattcttggttgagcgatatggctataagcgcgaggacatggtcatcctgacagatgaccaaagcaaccctgtcatgcgcccaaccaaggccaacatcgtccgtgccatgggatggcttgttaatggcgcccagcccaacgatgcccttgttccttcactattctggccacggcggccagaccgaggacaaggacggcgacgaagacgacggctacgatgaagttatataccccgttgactttgaacaagctggacatcttgtagatgatgagatccacttc

SEQ ID NO: 2966 - DNA, 508 bp, Artificial
  Synthetic
gtggatgatgatatgccagccatctagatgatttttgtggacgcgcgcagtatctccttgatcttgtgcactggccgcaaatggggcttgcctcgtcgcctgtcagaaaaggggcacatgtcagtcattccaatgacgtgtataacgagggcgagtgaatattctgatacttaaggggtgtataggcagctatgggggtctgacgagatccagtgttactcacattttactttgcgctgcctgcacgtatcgctgttaagcagaagccgacggcagaagcgattagacactggcgtcgatagtctgaaagacgaatcattgcttaccaggctgtgataccacaaggtcagtaagagtaacagcggcagggtatggaagcaggggagtcgatgcaaagataacatgtccacacacacacgcacgcacgcaccgttgcatgcgcgacagtacgcatatcaggatacatgtatgtacacactcagatgcataggagcaaaggaatgggctg

SEQ ID NO: 2967 - DNA, 183 bp, Artificial
  Synthetic
atgccagccatctagatgattcttgtggaggcgcgcggtatctccttgatcttgtgcactggccgcaaatggggcttgcctcgtcgcctgtcagaaaaggggcacatgtcagtcattccactgacgtgtataacgaggtgttactcacattttactttgcgctgcctgcacgtatcgctgtta

SEQ ID NO: 2968 - DNA, 621 bp, Artificial
  Synthetic
gaaattaatctatcgtggtgatcaattgggagcttcataccaccactgagctcgttccggcttgctcgggcttcttcttctcgccaggacgagccttcttggctgctttcgcctgctgagagcctgctgctggcagacatagcaccgcgtatgccacctggacaacggcgacgacaggcagcgcggattgcagcgtcagcaccggctctgccaccaggtcgttgaattgagcggccagtagcccgagcaggacagctactcggccgaaagcgatgccctttgacaaggcattgtcgaacgtcgggaccgcgcccacggtggcctttggcttgctgtcggtagccggagctggaggagcttttgccagtgctgaggacatggtgattgtgtctactggcgcattcctgtgattcttggagtttgagctatttggacaattcgaggttccagaaacatagttcggccaatggcggcaatcacgtgaccttgaccaagggagcttgtcgacccaacccttgcttcactctgcgtacatgtacgagtatatacttgaatctggaggtatcacgatcaaattattacggacagttgattgttgcgagcagcatataaatacaaatg

SEQ ID NO: 2969 - DNA, 508 bp, Artificial
  Synthetic
ggctgggtgagccttttgcgcatcttgacctatattacaccttagaacgacgcatatacatattcctaaacattacgcttatggcggttgataccgaggggtccgccatcaacattcctgctcccgcagctgccatgggactcacccaaacgcctggaaaaggcgctgcgagccacgatcttcacccgtcgggcaagcgggctcacggccgaggagtgcagatacttcgaggcctggctctcgctgtgtactttttaatctgctgtgtgactattgtcgcttcgcaagttcttgggtgttggctgtatttcgtgaaccgcgagatatactacgattacatggccttgaccaaacggtggtttgccatagtcgtaacttggatgacacagatttggggcccggtaatcatccgaatcagcggcgatgagtcagtcgcgggagagatccgtcccacggacggtggcggagtgcagttcaactttcctgagcggttggtgatgatagcgaa

SEQ ID NO: 2970 - DNA, 433 bp, Artificial
  Synthetic
tgtatatccgaggaatgccatgcggttgttttggtgtttgttgctgctatggaagagagtccaccagagctgaaaactgcttgctctcttccattgccattactaccaccactactgctaatgcttacgggcttggcacggtcaagcataactccaagcttgggctcgggaataaagtaaaaaaaaaaaaaagacttaacaacaatgcaattgtctctccctgagtggctctcggcttacagtactccgtatccctggcctgccatgactgcaacttgtcggctctcggcactatgcccaagggagcagcaaaaccccttcaaggcttcaagcattgcgatatggggcttatttccgtacaacaaagagagctgaagaaagatcagcatcaacatcgtacgttcctttccaggcgcctacagagggcacgggt

SEQ ID NO: 2971 - DNA, 649 bp, Artificial
  Synthetic
  misc_feature (439)..(439): The residue at this position can be any nucleotide.
  misc_feature (526)..(526): The residue at this position can be any nucleotide.
ctttgtcatgttgtaatgcaggatcacgattaatcttttcttcttctctcaacacacggccatgcggcgtgagagggatgactcagacgatgaagacattccgctgcatcacaaacgcccgtttggcgctgggctgaagcgcaagaaaattgagtttgtcaaagccacagacgcagacgcaagcaacacgatcaagaatctgggcaaggaaaccgcctctatcggagatgtctacgccagcatagtcctaggcggcagctccagggattcatcatcaaaacctgaaggcaccagcgatgaaaaggacgaccaaaaggaggacgctgttgaaaaagagccggaacctccaatatgtcccgtctgctctcttcccatcacaacgacgctgcagcaacacgaggcctcgcttgcccatcaagtcagcctggaacactcccancctccatctgcactagatcgatcgcgcatgggttttgaaagcccctggaatctcagggctgggatcccgattcccgtcttggcctgngccgagaaggcgagggcacccggttccccatcaaggtagccaggaaagaggacacgctgggaatcggggctactcgtacgcagccaaagcaggcggtccaagagaagcctcgggctctgactg

SEQ ID NO: 2972 - DNA, 267 bp, Artificial
  Synthetic
  misc_feature (186)..(186): The residue at this position can be any nucleotide.
gggagctatgatgggcttcatggcgtggaaattggtttgttttctctcattcgttgactcttttcaatcaatatacacaagcagatgggtattggttaaagagggcgagcgagagattcacttcaacgcaaagccttgaagagagaacaactactatagcagttacatcaccacgtccaaactatntcgtgcatcaggaatcctgcttcttgggacgcgcttgtggcacctcttcatcaatgggcatcagtgcgtctgccgtggcat

SEQ ID NO: 2973 - DNA, 659 bp, Artificial
  Synthetic
aacaacaccgcaaccattcagttctctcagctcttgggatcgttcctcctcttctcctccaacatcacaaacacaacaaccaccaccaccaccactcaacctacaaacaacgtcacaatggccgccaagctctccgccgatctcctcttccagatggccaaggtccgccgctccatctatcccttgaacaagactctccccatctcaacctctcgcatccacgagatcgtcaaggaggccaccctccacactccctcctcctttaacgtccagaccaaccgtgccgtcgtcctcttcggcgccgagcacgagaagctctgggacatcacctccgagaccctcaaggccattgtccccgaggaccagttcaagtccaccgccgacaagctcgccctcttcaagggcggcgccggcaccgtcctcttctacgaggacaccgacgccaccaaggccctccaggccaagttccccatctacgccgaccgcttccctccctgggccgttcagtccctcggcatggagcagctgctcatttggactgccctcgaggttgagggcctgggcgccaacctccagcactacaaccccctgattgacctcaaggttgctgagacctggggcgttcccgctcactggagactcgatgcccagcttgtctt

SEQ ID NO: 2974 - DNA, 645 bp, Artificial
  Synthetic
gaaggtataggcaaggtagaggcaggcttctctctctcgtcgtctcgttctcaggacagagggaggacacacacagctacagacaatgtcgggcaggaagaaggtgagagaggtgaaggaggagaacgtcaccctcgggcccgctgttcgagaaggggagcacgtcttcggggtcgctcacatcttcgcatccttcaatgacacctttgtgcatgtgactgatctctctggaaaggaaacccttacccgtgtcacaggaggcatgaaggtgaaggcagaccgagatgagtcctccccttatgcagccatgcttgcagcccaagacgtggctcagaagtgcaaggagttgggaataactgcattgcacatcaaacttcgggctactggtggcaataaaacaaaaacacctggaccaggtgcacagtctgccctccgtgcccttgctcgttctggcctgcgcattggacgcattgaggatgtgactcccattcctacagacagcactaggagaaagggaggtagaagaggaaggaggctctagagagtgtgcctttatttatttcagatcttgagagcgtatggagttcaaggcctggctctcttgaaggagtagttgtggaacttcaaatgttttgcagagttttg

SEQ ID NO: 2975 - DNA, 592 bp, Artificial
  Synthetic
cccggccggtctcctccgaaccctagcctgcttctcctcctcctccccgccgccgccgccgcgagcacagacgacgcagccatgtccgggaggaagaagacgcgagagcccaaggaggagaacgtgacgctcggccccacggtccgcgagggcgagtacgtcttcggcgtcgcgcacatcttcgcgtcgttcaacgacaccttcatccacgtgacggatctgtccggcagggagacgctcgtccgcatcaccggtggcatgaaggtgaaagctgaccgtgatgagtcatccccttatgctgccatgcttgcatcccaggatgttgcacagagatgcaaggagcttggaattactggtctgcacattaagctccgtgctactggtggaaacaagacaaaaactcctggtcctggtgctcaatctgcgcttagagctcttgcacgttctggcatgaagattggacgcattgaggatgttactccagtcccaactgacagtacccgcagaaagggtggcagaagaggaaggaggctgtaattccgtgtagtgcctgttatggggggaaagcaaagctatctatccttgtccttgc

SEQ ID NO: 2976 - DNA, 528 bp, Artificial
  Synthetic
ccgaaccctagcctgcttctcctcctcctccccgccgccgccgccgcgagcacagacgacgcagccatgtccgggaggaagaagacgcgagagcccaaggaggagaacgtgacgctcggccccacggtccgcgagggcgagtacgtcttcggcgtcgcgcacatcttcgcgtcgttcaacgacaccttcatccacgtgacggatctgtccggcagggagacgctcgtccgcatcaccggtggcatgaaggtgaaagctgaccgtgatgagtcatccccttatgctgccatgcttgcatcccaggatgttgcacagagatgcaaggagcttggaattactgctctgcacattaagctccgtgctactggtggaaacaagacaaaaactcctggtcctggtgctcaatctgcgcttagagctcttgcacgttctggcatgaagattggacgcattgaggatgttactccagtcccaactgacagtacccgtagaaagggtggcagaagaggaaggaggctgtaattccgt

SEQ ID NO: 2977 - DNA, 84 bp, Artificial
  Synthetic
gacaaattcctcaaaatgcctcccaagaaggtcgccgctacctaagtgagaacatctccctggtgcccctctgcccgcgatggc

SEQ ID NO: 2978 - DNA, 676 bp, Artificial
  Synthetic
aaaagggggaacaacaaaagaaaccctagcttccctttgtacctctctctgttccaaaccatgtcgaagagaaagaccaaagagccaaaggttgagaatgtgactcttggaccagctgttcgtgaaggagagcaagtctttggagttgttcacgtctttgcttcattcaacgacactttcattcacgtgactgatttgtctggacgggaaacacttgttcgcatcactggtggaatgaaggtgaaagccgacagagatgagtcctcaccttatgctgctatgcttgcggcacaagatgttgctcagcgatgcaaggaacttggaatcactgccatacatgtgaaactccgtgccactggtggtaacaagaccaagacccctggacctggtgctcagtctgctctaagagcccttgcccgttctggcatgaaaattggtcgcattgaggatgtgactccaatcccaaccgacagtacccgcagaaagggtggaagaagaggaaggaggctctgagttatttggcctctcgttggatctccttatgtagctttctcaatgtttcattttgttttttcttagtttgaaaagagttttggaattactatgttttgttatagtctcaactctgaacagcttcggatctttttctgtatgaccataagatattcaaaaattg

SEQ ID NO: 2979 - DNA, 705 bp, Artificial
  Synthetic
caacagccccgtgacgaataaccagacgtcgacaaattcctcaaaatgcctcccaagaaggtcgccgctcctaaggagaacatctccctgggcccctctgcccgcgatggcgagctcgtcttcggcgttgctcgtatcttcgcctccttcaacgacaccttcgtccacgtcaccgatctgtccggccgtgaaaccatcacccgtgtcaccggtggaatgaaggtcaaggctgaccgtgacgagtcctccccctacgctgccatgttggctgcccaggacgtcgccgcccgctgcaaggagctcggcatcaacgctctgcacatcaagatccgtgccaccggtggtaacggcaccaagactcctggccccggtgcccagtctgctctccgtgccctggcccgtgctggcatgaagattggccgcattgaggacgttactcctaccccctccgactctacccgcagaaagggtggtcgccgtggtcgtcgtctgtaattgctgtatttttttttatacaaacaaaaaaagtacggcatctgcatgcttggcgaacctttggtttgggatcaaggcaggagtttcgctatctggttcttttatgtggcgttgagaaaaaacgaggagaacggcccttaaagcctggtctccaattctaccacgctctgctcaggttcctttgtcctttttactacaaagaaggatata

SEQ ID NO: 2980 - DNA, 350 bp, Artificial
  Synthetic
aattcaaccttcctctgtattcaacaccagcagaagtctcatcagcaacaacaccatgtcaaagaggaggactagggagccaaaggaagagactgtcacccttggacctgctacgagagagggagagcttgtttttggtgttgcccacatttttgcatcattcaatgacactttcattcatgtgactgatttgtctggaagggaaacaatggttcgtattactggtggtatgaaggtcaaagccgatagggatgaatcttccccatatgctgctatgcttgctgcacaagatgtttctcagcgatgcaaggagcttggcattaatgcacttcacattaagcttcgagcta

SEQ ID NO: 2981 - DNA, 618 bp, Artificial
  Synthetic
tcccatcccatcttccaaaccacatcatcaatctctaagcgttgcccattatgaagagcgctttgatcgccgccgcggcgcttgttggctccgcccaagctggcgtccacaagatgaagctgcagaaggtctccctcgagcagcagctggagggttcaaccatcgagtcccaggtccagcagctcggccagaagtacatgggcatccgccctactagccgtgccgatgtcatgttcaatgacaaggtgcccaaggtccagggcggtcacccagtgcccgtcaccaacttcatgaacgcccaatacttctccgagattaccatcggtactccccctcagaccttcaaggttgtccttgacactggaagctccaacctttgggttccctcccagtcgtgcaacagcattgcctgcttcctgcattccacgtacgattcgtcctcctcgaagacgtacaagcagaatggatccgacttcgagatccactacggatcaggcagcttgactggcttcatctccaatgatgtcgtcaccattggtgacctcaagatcgagaagcaggactttgccgaggctaccagcgagcccggccttgcctttgctttcggtcgcttcgacg

SEQ ID NO: 2982 - DNA, 329 bp, Artificial
  Synthetic
gcgattgtctttagccgagaggcgtttggcgatcttgacatcataggagctgctcttcgttgcggcaccagaacttgcgcgcatctttgaacagaatacttcgtggagcaattgctaccccatggctcgggagcatcgtgtcagatacattaatcactcatagctgcaagtactctttgcgccgggggcagtgctaggcccatgagccgcgcaatgtcatcggtcttatgccggcattcaatcggaatacgactctggatccgtcgtgccggtctcgatatcgaagctcggggcaacaccaacaagatgtaacgtaaaataacaagacg

SEQ ID NO: 2983 - DNA, 403 bp, Artificial
  Synthetic
attgtgctcgtatctcagagctgacaagcctatcgacttgcgggctgggggatcaaatcacgccctgaccttgtgagcgggcgacttttcagcttgttcccccccaagggagtcggcgcttgctgcatggcaagtcatgtcttacgtctcgccattgcagccgccggccctgatgaaaccagggaatcgccagccagcctagcttcagatggggtttgaagttcagtcaactgaactacgtgggcggttaaaagggcctcggggattgctcgcagcaaggccagagagcgatgagatgggatggagagagagagagagggctgccgactaccggtgcactgcatgttatctgccgtaacatatacatgtacctacttagttaagatgtatcacgcacgcgacc

SEQ ID NO: 2984 - DNA, 578 bp, Artificial
  Synthetic
  misc_feature (237)..(237): The residue at this position can be any nucleotide.
  misc_feature (250)..(250): The residue at this position can be any nucleotide.
gccgagcctcgcgcagaacccaaaccaaacccgcacagcaacaacacacactccacctcgagcttctggtcttttaatcataatcgttacactccaaggctgcatttctttgctgaatactctattcaaccagactcaactcaactcgactcaccaggcttccatctcctcgctactcaaaaaggctcagccttacctatttctcctcctccaacctcatggcataaacgacacacnctctctctctccngattggtgatggcaacaggcgacaacgccgcctccgagctacgaggccgtgtccgccgctcctcctcaccctcctcatccttcacatcctcctcaccctcctccgcctcccatctccgtcgcgacgccgggcctgtctaagcgccgtcccgcctcgtctccctcgtccccgacttcgtccagatcatcgtcgtccaacccctggtcatcgcccaccaagtcttggtcatcgtcgtcatgtccgcctccgcccgcgcctgtcctgcgacgtaacgtctcgtcttctagcctctcgtcccggacggccttcggaactgacgcctctgacc

SEQ ID NO: 2985 - DNA, 90 bp, Artificial
  Synthetic
cgaagatgaagaatacgaatcctcccaggattccgacttcgcgccggacgatgcgcccgaagcagcgtctggctcctcagattctgaaga

SEQ ID NO: 2986 - DNA, 546 bp, Artificial
  Synthetic
gagccattcctgcgcaatcctgtagctgccctcacgcacatcccccggcacggtgtggcccgcgccgtccacggccacaaacgccagccggccggagctcttccacgaccccgtcgccgccatgctctccggcagctcccgccacggcgcgaggcgatagtcggccagcccgctccagcgcaggttctcgtacgcccagatgttgcccggcgtgttgacgatgtagtcctcgttgccctgcaggaccagcacgcggatgtcgcccaggttgggggttcggtaggcgtcgaggatgcgggcgacctcgcgggtggtggtccggaagggatctttggagtggacgaaggcggagttgaggaccatgtcgatgtcttcgaatatataatatgggggaagcttcagggctttcttgatgtgggcttggttgatgtaggctgacatgttgcctttcctgatgtctgcgcagaagggccagttgggacatggaatatggactgttttgcaaatattagacaactacgttcagacattcaggagaaaaaaaaa

SEQ ID NO: 2987 - DNA, 892 bp, Artificial
  Synthetic
gccggttttgagggatgaggggagacatggacaaggtgttgttggctctatcattacgggatgtttaggtgtagaatctgtattcggtttcgatggatgatagaaaagctccgttagatacacagtgcgtgggtcgagctgagcagaccgagagacacatcgtatccgggaggaacactgcagctgcgcagctccactgcactatttcggatgccgtggttgcattttgtgtcgctccgccgtggttttcgtcagagatcggcctggccttggtctggccgaggatcaaagttctagatgggccttgtctggttccagaggggtataaagagtcgagctgagaagcatctagacttcagtttgagctctcatcaaacagaagcagttaactacttatacagctactatataagctttccaaccaacccctcacctgtcgcctcaacctcatacgactcatcatcctattcctccttcaacaatttcaattcatttcacaactctcagtcaagatgcaactcttcgccgtctttgccgctgccactacacttattgccggctccaacgccctcttcatcccccgcaacatccacgtcgcagacttccgcctctacagcgccgagggctgccacgacggcaacctcggcgtctggaccgtcattgatgacgacttcaagaatggcgaatgcaagggcctcaacgatagtgagcccaagtctctgagcctgacagacattaacaagggctgcacattcacggcttacaccgacgacaagtgcaccaagggcaagaaggatttcacaaagggacattgcttcgacaacaaggccggctggaaagcctggagcatgaagtgcgactacaaggactacaagggtcctccctaccttct

SEQ ID NO: 2988 - DNA, 545 bp, Artificial
  Synthetic
actcacaatattggtttagcatttcaaaaccggcatcatggcggacgcagatttcaatcctgactctgtcaacctcacagctattgttgatcaagatggagacatcagagacatcatctgctttctcaatgctggcgacaacgactacaatggacagcttggtgcacgtgtttcggctctattcgtcatccttgtcatttcatcggcagccaccctgttccccgtcctggccactcgtgtccggcgtctacgaatcccgctctatgtctatctctttgcccgatactttggctccggagtcatcattgctactgccttcatccatctcctcgaacctgcctatgaggagattggaccggctagctgcgtcggcttgactagtggctgggctgaatacacatggccccctgcactggctctgacttcggccatgctcatcttcctgctggatttcttggccgagtactacgtcgagaggaagtacaagctggcacatgtcgaagtcgaaggcacaattacatcggatcctactgtccctcatactc

SEQ ID NO: 2989 - DNA, 482 bp, Artificial
  Synthetic
cccacgcgtccgaaccactctcaagcaacaataacaacctttacccaacttcaaagactttcagtctctcaactcaacaccttcaagatgtctccctggtgagtcttctgaggaccattggtccatcacttgctcgggagttcctctttgctttaccttcagcgttccactacctgatctatgataccttctttcccaccaccgagcaaagcactcattagacatgtcactaacgattttctttcaatagcgcatgcaactcctgtggatgcaaggacaactgctccagctgctcctgcaccagctgcagccactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccctaacac

SEQ ID NO: 2990 - DNA, 568 bp, Artificial
  Synthetic
gttttccaaggatttactccagcttgcaggggccaagatgtcactgcatgggggtttcgttaatgaagctgttcagggcatgatatggtgcatgaggatgcacgagtggatactaacatatgacagttgatgctctttttatagagcatccgtttggatataaaagcatcgagtgtcgccaacattttgatcttgttccatccatcaatcgcatcaaccactctcaagcaacaataacaacctttacccaacttcaaagactttcagtctctcaactcaacaccttcaagatgtctccctgcgcatgcaactcctgtggatgcaaggacaactgctccagctgctcctgcaccagctgcagccactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccctaacacacatataatttgcttgtgagaaaaaaaaaaaacaa

SEQ ID NO: 2991 - DNA, 753 bp, Artificial
  Synthetic
ggccaagatgtcactgcatgggggtttcgttaatgaagctgttcagggcatgatatggtgcatgaggatgcacgagtggatactaacatatgacagttgatgctctttttatagagcatccgtttggatataaaagcatcgagtgtcgccaacattttgatcttgttccatccatcaatcgcatcaaccactctcaagcaacaataacaacctttacccaacttcaaagactttcagtctctcaactcaacaccttcaagatgtctccctggtgagtcttctgaggaccattggtccatcacttgctcgggagttcctctttgctttaccttcagcgttccactacctgatctatgataccttctttcccaccaccgagcaaagcactcattagacatgtcactaacgattttctttcaatagcgcatgcaactcctgtggatgcaaggacaactgctccagctgctcctgcaccagctgcagcgtaagtcctgcttctctcccctgctttgggcattgagaaacttttccaccagaaagctaacagatgggaacatatagcactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccctaacacacatataatttgcttgtgaag

SEQ ID NO: 2992 - DNA, 544 bp, Artificial
  Synthetic
agcacggagcaccaccatggcttcaaggttgaagatctggggtgcctgcaggactctggcggtccggacgcagcccgtccgccttgcggctcagccattccgaaaccaggtttcagcgactcgattctatgccgacgatgcgaccaacaaaccctccaattctccgagcggtgcaaagagagaagcttctagatcagtttctaaatcagaaccaacaagttccagggttactgagggcacctctggagaattgacccagaaagccgcacaagagacatcttcatcacaagcctcacccattgaagcgctagacgatgcgaccttggaacaaatactatatggcggtcgacccgtaacaagtcagcgggagggcggcttgacagaggcgcaagaggaggctctatatcgcgagggtgtcattcccccaacagagcaggcggaagctatcgttgctgccgggtcaccagtcaatagtccctgttggctcagaagtgcaaaacgccggccataagtttggtcttcctcagaagccctatccggacgg

SEQ ID NO: 2993 - DNA, 666 bp, Artificial
  Synthetic
gaacccttcacgtcgtcgtcatagctgtggatgggcactcacccctccaacccctccaaagatctcaccaccggccgaaccctcctcgatctctgcgccgagaatcagctcctcctctccgaatccgtcgcttccaaatatggctccaagctgcccttcctcttcaaggtcctgtccatcaacaaggccctctccatccaggcccatcccaacaagaagctcgccgagcagctccacgcgcgggactccaaaaactaccccgatgacaaccacaagcccgagatggccattgcaatcaccccctttgagggactctgcggattcaggcctctgggagagattgcccacttcctggagacggtaaagccattgagaactctggtcggagagagcgaggcgtcgcagtttgtgcaggctgccaagcaagagggcggtgacgaggcggcaaagaagaaggccctgcagacggcattcggaggattgatgtcgtcctctgccgaagacgttgacagagaaactgctagcctcgttgcactcgccgagtctgagggcgccgacttcgctgccggtggtgtgtcatccaccaagggcgctgtcctcgccgagcttgtcactcgactcaacggccagtgtggctccgacattggcattttcgtcctcttcttc

SEQ ID NO: 2994 - DNA, 682 bp, Artificial
  Synthetic
gcaacaacacacaacatgtcgcttatccaactccaatgcggagcacaaacatacgactggggcaagctcggatccagctcggccgtggcgcggtttgccgccaagtcggacccttctctcaccatttcggaggagacgccgtacgcggagctgtggatgggcacccatccttcggtgccgtccaaggtgctgggcgacacaaacagcacgactctgcgtcagttgatttctgcgtcacccgacaagctgctgactcccgccgtggagcacaagtttggccccgagctgccgtttctgttcaaggtgctgtcgatccgaaaagccctgagtatccaggcccatcccgacaaggagctcggagcccagctgcacgcgtccgaccccgcccactatcccgacgccaaccacaagcccgaaatggctattgctcttaccgactttgagggtttctgtggcttccgacctctgtctgagattgagcactttctcgagaccgtgcccgagttccgggagcttgtgggcgacgagtctgcgaagcagtttgcttccgagcgatctgccgaccccaagaaggctctccaggctctgtttggccgtctgatgcggtcttcagacgaactcgtggcctccaaggccgctgatctcgtcaagcgagccgagtctgagggccccaagttcgcag

SEQ ID NO: 2995 - DNA, 734 bp, Artificial
  Synthetic
cagccacacatgtagcaaagcgcacaattcgcatcataagtcatctcaatagctttttcttcttcttctcctcctcctctctctcccttgttctcgtactccgcatgtcatcgccatgattgtggatatttggggtagtcgataagttcgagatggggcctgccgtcccgatttcttccaatgcaggtacttttgagccggcccggcgcgggaactgaactcctataagagtgaccacatggacgtgtgcacggggtgcgggaatggatacaccgcttattcagaccattactcgcatttgcgtccagagattggagtttgataatttttacaaacttgtacataatactgatgcattcagcccttggtcctgatggcatgagcagacatagcctcggccgacgattttgcccctgcaatggttctctgccgatgtttcccgcagcttcttggcagttggggtaatacgataatacgacgatggcatctttggcctgcacgccgaattggggtcaaatagacggtattccgaacatttcatatttaagaagctgtgctgcacgccaaccaacctttggaatggtgtgaattgtgaaggacatgatgcatggtataggccatgagctagtctcagagagatggagcctccggtgtaaaagttgtacattaatacgatcaaagcccgctacgaaaaaagaatggcaattgtattacccacgaaaaaaaaacacaaa

SEQ ID NO: 2996 - DNA, 708 bp, Artificial
  Synthetic
acacgcgtcgtgcatgtcttggacctgctctcatcatctcatctccctcttgtttgaagaagagagatcttgtctcttcccacctctcacagtttgaagctgtgcattgttcaacagcaacaaaaacatcatgtcagacgacggccacgaaaaggcgaaactcgagtctcacatagactttgtttccaccgcgccagactcacaagatgtcaacgccttcatcgatgacatggagggccagctcgaggcttctggaggtctcaagacgggcttcttccatgtgcagttcagcgacccgcggcactttacatggctgctcgtcgcctttgccagcatgggcggcctgctgtctggcctggaccagagcttgatctctggcgccaatctgttcttgcccaaggacttggacttgacggagaggcagaacagtttggtgaattcgggtatgccgttgggtgctgtgggaggcgccttgttgctgtcgcctgcgaatgagtactgtggacgcaagtgggcgattatcatctccatcctgctgtatactgttggtgctgcgctggaagctggctccatcagctttggtatgattgtttctggtcgtgtcattctgggtcttggtgtcggcctcgagggcggcactgtccccgtctatgtcgccgagactgtcgagcgccgtatccgaggcaacctcgtctcgctctaccagtt

SEQ ID NO: 2997 - DNA, 712 bp, Artificial
  Synthetic
ttgtcgccaataacccacacaacgcggcaagatgcgtacctacgaagacagcttctccggtcagaggatctaccctggaaagggtaagatctatgtccgtggcgacagcaaggtgttccgattcgtcaacggcaagtcggagtcactgttcctgcagcgaaagaacccccgtcgcattgcctggacggttctgtaccgacgacagcaccgcaagggtatctctgaggaggttgccaagaagcgcactcgccgtgccgtcaaggcccagcgtgccatcgttggtgcttccctcgatgtcatcaaggagcgccgatccatgcgccccgaggcccgatctgccgctcgcgccgaggccatccgacaggacaaggagaagaaggctgctgctcaggccgtcaagaaggctgagaaggctaagaacgccgccatcgccgccaagggccaggccaaggcaaatgtcagcaagcagggcgcaaagggcgcacaggtcaaggtcgccgcccgaacccgctaaaaatatgaatagacgggattgaggggagcgaggggagaaagatgttgtgtgcagtgcagcgcagcggatgagcaaaatgaaacaaagtatggagtctgtggttcttgtctctttccggccggttcttctacaatatcgggtgtgcatggaatgccatagggtgcattggtagttgagcaagtgacataccggtgcaat

SEQ ID NO: 2998 - DNA, 1023 bp, Artificial
  Synthetic
gaaaaaaaaaagttgcgccagacgggatgaaaggcgagacaaggggctggcttgggctttgggcatgcactgggactttgggctgaaggttgaccgaaccgagttgctcaaactgcgacatcggtgctgtatcaggctgctatctatgtatcctcgtacaaggcaaatgcacacacggctgatctgagattacgggggggaagaaacgcactcagtggccaatatggtggttcgcacacccagcgtttgctctcctatgtcgtttgtatggcgggtatgctcatgcttgggctgaggtgatgcgcgtctgattccggctagcataccgaacccactaggtagcgagttgatagtatcgccattatattggatgttggatcgatatgtcccgttgtatcgggccaaggtgcattgctctattggcgggctagcagctgaccacgagacttttgttgccagatgacttgacaggctaagaaccaacagacaacaacaatagcgggaggggggattcattcagctggtcaatatttcactatagagagaggggttgatttcaattcaattcaattacaggaggggtattcgtgggaccacctcggcagataccagtagaggcaaagggaatcccgcaactcaactcaaaacccgaagcctctccgctcccttatctagggcggcgaattctgacgttgctgatccgatatccgtcgcgcggcacggcagtcagggacgggatgcggcaaagatttggcaattcgtctgggttgctgttgcagccttcttcactagaaatggaatctcgcggatcaaaagggaagtgtgggaagctctcgcgcggtacttggtgcgagttggagcgaaagcgaagggagccgcggaaagggttcggggccgtgattccggggcaagcggccagataccgacctgggtccgagttcgccgggtcgtagatcacgaggctggtccttagactcaaaatcccaagggtttggttatggtgtgaaacaaacaaacaaacac

SEQ ID NO: 2999 - DNA, 410 bp, Artificial
  Synthetic
acgcgcatcattatgccggcatgggcccggggtctgaccctcaccatttccgagaccagagcgtgccgcatttcgacaaggcgggccatacgcggacgcacgagcgggaggatcaccggcggtggcagcggcagagaagggctgtgggggatgatggcatagagtttgagccgcagacgagcctggccgggcactttttgattgtggcggggatattggcggcgacgctgtttgtgccggcggtgtatttgcagtttatgcgcctggggaggcagaagaaggagaaggagtcgtgaggcgggtatggcgtctggagtgtgatagggaaggctgtacaaagaatagagcagacttatatagaaataggcaatgggggggcatgagcgaacaatgccgattttaacgttacg

SEQ ID NO: 3000 - DNA, 254 bp, Artificial
  Synthetic
ggaatgacccctaccaggatgtcgaattacacaacttgaacgaggggacgagccaaggggcacagcacgggaattgattcgagagtttttaaatgatacccatctcccagcgaggagattgcacttagaaaacgtggcggaggccctcgaaggagaaaatggtctttgttttgttcttcatcttctgccttgtcgaagggtcatgtatatgtcaggaatagctgtgcactaatatttaaacataagttccgtct

SEQ ID NO: 3001 - DNA, 203 bp, Artificial
  Synthetic
ggccctcggcgtacgagtagcaaaaagcgttcggtccatctgggtccggttggtaggattggaacgagaaagaggggaatgggattcgagaacgtggaacttgcttgtgccctggcagtcttcgggtaattggccgcggagattaacatggcgagaggaagcaagacgtcagaacggatcgaaaaaaagaagaagataaatcc

SEQ ID NO: 3002 - DNA, 253 bp, Artificial
  Synthetic
gggatgaggagggggggtgtttgtgttgcgataggtaacttagtacgagtagattcaagatggagggggggaatgaatcttgcttgcttgactgcagtctgtagtgtaatcaggcaaataaggcaaatgaatacctgtcaagtcgactctcggtatcgagttccgcatgtactaagcagaaacatgcgtcatactacgaataaatatccctggatgggcgattattactccaatacgcatattgataccaacc

SEQ ID NO: 3003 - DNA, 304 bp, Artificial
  Synthetic
gcaccttgttgatacagtacagaaatgctgccagtcgtacgagagccatgggtgctccgtcgagcgcctctagcttgacgccagaaggatcgaggctgattgacgatggagccctggcccgcttttggtcctgtgcgcgacagatgctgggatgaggagaatcgtgatgacgaatatgtattgatatcatatcgtgagagagacatggttggggcttactggtctctgtacgagtacgatgctgtacgttcgtgttgaattatcttgtactgtatcgtgttttgtcgatctgggtggtcagtct

SEQ ID NO: 3004 - DNA, 545 bp, Artificial
  Synthetic
ggcatgatgattgttgaacaggtacggaggttgggagacaggagactaacacaccttattgtgcaaactgtacagcacagcagaaagtggttacatcgccagaataagcttgtgattatggcctcaccttttccacagcccgcaggtgacaggccacatgcaatcttggcatactgttcctctctctctacaacagctgaactcagcccagtcgccaaggtttccttcacgctggctttcactcttatcatggagcattgacgagagccggcaccaacgagcataccaaggtgaaaaaaagttctccacaacactccgtccaatgtccaccttacatcctacagtacgcaagggccccgtaaggctattcagcttcaagcacaatcaagccatccaggcaagccgacaaaagccgtcggccgaatctctcctcgtatcgtcctaaaaagggcgcgcgtgagccgctttgaccacaagccttcacgtatcaaacttgcgcatggtgtacgagggagaagaaaaaaaaacggtcctcagccactgag

SEQ ID NO: 3005 - DNA, 446 bp, Artificial
  Synthetic
gaatgaacgtctttcttgtgctggcggcaagtaatactgtagcaggtacctcgtggagctccatcgggatggggccggttgggagtcggttgggcacaaacaaggtttctaactggatctatttctttccatgtgtcttttaatcattttgaattttattttccccggaggccgtgacacgtttttgacagatgggaggaagaggcggaggcagagagcaaaaaaacgctcacacgtgtcagtccgtagcggtgccttttttctaactgtccgtatctggtcagaggcggcggcagtaaataagtgttgcccgaatcaatagtagaagaggcgcccgctgtggtgtatcgatttggtcaatggaacttgtcaattgtctacagtagtagtagcactatcatcatttgtttccgattgtgtcattgatttttaaattctgatgaacc

SEQ ID NO: 3006 - DNA, 519 bp, Artificial
  Synthetic
gattcaatatctttctctcgacgtggttcgatttcgattcgacgtatcggtgggggggcatgaataaggtaatggttgtgtttagttgggctcgaaactaatgttacccatcagtagtatcacctattgctgacgtcggcttgaggaagtgggttcaatcgtgatacattcggctcgtacagtgcaatacagataagatgatgcgatcagagaggcaattgttaggtcatgattgacggaggattcgagccgatgatgacaaggcgacaagagctgggcaatcgaccccaattggatgattctggcaccccaagctgtgaattcggcttgacctttgaacatcaacttgctgtagggtagtgcaaccttggacgtaaagagaaggcagcgtcagcatttgttagcgcacagtacctacctgtatgtatgtatgtccgtccatacaactttgatgagaccgagaccgagataaaaagtgagcggcgtcagtgcccaacttggtataaaggcttgaagaac

SEQ ID NO: 3007 - DNA, 571 bp, Artificial
  Synthetic
tcatatagagcatttatcaatgcgaataacagaccctgagacactgaatcagagaagctttagaagctcttcttctctctgtctccgcgcctcttatcgcttacagcccctctactgctgctgctgcctttgtcaggcctgtcttttcagtgtcgcatgccccgtcttatctttctaccttgcacaactcagcctttgcgctaatcaacgacatctgcgatctgtgtcggcagcagaagagtcccagatcactgtctctcttttattctccttcttctaaacagatctgtgttgcccccaaagcaagcgagaatacgtcaagatggctcttccgaaacgcatcatcaaagaaaccgaacgccttatggcggaaccagttcccggaatcagcgccgtgcctcacgaagataacctgcgatactttgacgtcgagatccacggccctgcatcgtcaccatacgaaggcggcattttcaagcttgagctcttcctcccagatgactatcccatgactccgcccaaagattcgattccttactaagattttccacccaaacgttgacaagctggg

SEQ ID NO: 3008 - DNA, 692 bp, Artificial
  Synthetic
aaggctgaagcgttctttttcatttcgaggctctttagaagtcaattcggctctgcgcaacaccaagtagccatgtcgacaaccaccaccacaacaacggcgcagccgatcacggctgagaccatccttcgtctcttccccgacatcgataccaccagcgaagcgctctcaggccacgatgaggagcagatccgtctgatggacgaagtctgcatcgtaacggacgagaacgatgcgccaattggcaccgcaagcaagaagatttgccacctgatgaccaacatcgacaagggactcttgcaccgcgccttttccgtcttcctcttcaacgacaagaacgagctcctcctccagcagcgcgccactgaaaagattaccttcccagacatgtggaccaacacttgctgctcccaccctctgagcatccctaccgagacgggcgccaacctggtcgactctatcgctggagccaagcgtgcggctcagcgcaagctggatcacgagcttggcatcaagaaggagcaggtcccattcgaaaacttccgcttcttgacccgaatccattacaaggctcccagcgacggcaaatggggcgagcacgagattgactatatcctcttcatcaaggccaacgtcgatctcaaccccaacgagaacgaggtgcaggccacccaatatgtcaccgccgatgg

SEQ ID NO: 3009 - DNA, 68 bp, Artificial
  Synthetic
acgcgtcgaaaaagcccacaacatggcgacaatgtcaaatcagtcgctgagggcggctgttcggtcgg

SEQ ID NO: 3010 - DNA, 354 bp, Artificial
  Synthetic
acatggcgacaatgtcaaatcagtcggtgggggcggctgttcggtcggttggacgattaaatggacggacgggtaggtcttcgggccttacatcgaggcaattcagcacctcgccagctcatggtacgcagttggaacaacgggtttgagcctcgcatcatgagattctaactggaaggacaaacaggcgtcagggctgtcttcgccgagacggacaacaccgaaatgaacaagatcctcaacaccatccaagaaaacatcatcctccccggctagctccccgaaaagcagcgcagggtcgtctttgaccccaagatgaggtcctacctcgagcaaaaccccatcatcatcgag

SEQ ID NO: 3011 - DNA, 645 bp, Artificial
  Synthetic
aaaaagcccaccaacatggcgacaatgtcaaatcagtcgctgagggcggctgttcggtcggttggacgattaaatggacggacggctaggtcttcgggccttacatcgaggcaattcagcacctcgccagctcatggcgtcagggctgtcttcgccgagacggacaacaccgaaatgaacaagatcctcacacacctattccccaagaaaacatcatcctccccgcctacctccccgaaaagcagcgcaggctcgtctttgaccccaagatgaagtcctacctcgagcaaaaccccatcatcatcgaggtcgagggcctcgaacacaaattctcctccatcgaccacttcaccggtatcgaaaactcaaagacgatcctctccgaggccctcagcagcatgaagagccaggacgactgggccaacctgggaaccctcctggcggggtacaagaaggcggggatacggctcaaggcaaaccactgggggaagattgtgcgcatggcaggcaagagcggcaacattcacgccgtcattgagtgcgcgaagcagtctgacaagacgggcctcctgttcaccaaccgagagacggtggtacgggtgctctcttacatcaatgaaaaggtcagcggcagcaattgggacg

SEQ ID NO: 3012 - DNA, 747 bp, Artificial
  Synthetic
cgactcacctccctttgctcccgcgcggcccatatatatacatatatataaataccagcatataagtcatccgttcaccaagcgtccactcgcactcctccttctctcttccccttcttccacctacaccagacgaagaaagcatccaatcgttcaccatgaagccccaaactttcgttgtcgctgccctcggcctcctgtccggagaagccatggcccagagcgtgccgcctctgatctcgtctgtgtctgccgccgtctcctctgccattgcctctggcagtgccattgcttccagcattcgctccgaggcctcgtccgtcgccagcagcatccgctcagaagcttcttccatcgcctccagcgagaccaataccgcaaccactggcactgagaccaccagcagtgagaccaccttgacaactaccatcgccaccaccaccaccacccaaaccactgtcgagtctgccaccacagagcctgccactactatccccggaaccaccaacagcgagactaccagggctgccaccaccattcctgctactacccgctctgccaccactcgcgtcaccaccagaacctctgctaccacttctacctctaccggtctggccattgctcccactgctgatgccaagctgctggctcccatcctcggtgctgccgccgccgtcttgatgctgtaaacacctgtctcttggaactactactatctatttcatatgttgggcggaggacttgata

SEQ ID NO: 3013 - DNA, 1067 bp, Artificial
  Synthetic
tcgacccacgcgtccgattcaacctcttccatcagtacttgctgtcattgtcacacagtgttattttcgcgcgagagtggcacctattcgacaatgattgaggaaaagaaagactttttcccgggcttcagcgccttgtctgagcaagtctatatccgccaccccgacgaacaaaatgaggctgtgaagcgccctaccgatcctcgggccgtcctcatctattcctggggcgatggacagccaaagaacgtggtcaagtatgccgacggataccggaatctcttcccctgctcaacgcagatcgtcgtgctggcccccatctcaaaggccatgtggtcaaacctcgaccagcgcacgcaatccatgagacctgtcatcgacgccatcttcccgaaggaatcggaagatgacaaggactctcaaaaggtcgaggaccgcgtgctggctcacatcatgtccaacactggaggtatcaactatgcggcgacgttgaatgcctaccgccttgttcacgataagccgatgccgcatcacttgctggttctcgattctacacctggaagcgccatcttgacccgcgagaacttgggccgctggtcacgcgccatggccctgggcactgcaaactggttcccttggccatttgccgtcacacagacgctttgggctggattcctctgcggaaaccgcttcatcgaatgggtcattggcaaggagcccgcgccggtgttcagcgtcaaagcggtgattaacccatactacgagaccaaggatacgcgacacttgtatatctacagcgaagatgatgatctcatcccgtatcaggaaattgaagagcacattgcacaagcacggaaaaggggatacaagtctgataatcacatgttcaagggaagcggccatgtgcgccacatgcaaatgtttaatggagagtactggggagctatcggaacgtcgtggaatagagcgacgagcgagccttctgaggaggcgtaatgggttgtgctcaaggccaaaaggggtcccgatggaaatttgcgttgctttctatagacgaactcgcgttg

SEQ ID NO: 3014 - DNA, 225 bp, Artificial
  Synthetic
gcgcgatgatccccgcagcagcaaaaacggccgaaatccatcccggctgccactaagaatctccctttggggcagccgctagtgtcgggagctgttcttcccgaacacttctgcgacgtgccttgccctgtttcagacaagctgatgatgatgatgggcttgcacgaccacgcgcccgtctgtgctacacgcccggatctgccttttcgcaggtttgcttgcggg

SEQ ID NO: 3015 - DNA, 705 bp, Artificial
  Synthetic
acacacataaatacaccagcaaaacatcttctgcgatttctagtgttttttcacttacaccagcgcgaccatcgccaaagctacatacaacacaacacacaacacaatacatacacatccagacactaccgtctaacataacacaaaccgccgaaatggtcactcaaccagccaagatccccgttgccgccccaggccccctcgctagagctttcccagccgtcatcgccgtcggcgtcagtaagtcatctactgagacttcatcctcactctaccctcagtccactaacaacgactttaacttcaagtctctgccgtcgcgctaaacgttcgctcccaactcaagactcattcagccactcaggaccgcttcttctcccagtacaagaaccccgagagcgaagccgtccgccaaaaggtgtttgagggcgctgtcgaggacccccgcaagagctggttcaacgtcctgggctggtgactatttgaggattaagcaggggttttgaagacacaatcgcattgctgggcgtttattttaatttttagtatcgaggagttggaaaggatatttgttggctggtgaaggcgtcgtgcattgctgtttcgatgtgaccgcctggtgtataaatggcgaaagaagggggttgttgagaggcccgagtattgataccagccttatttagatggcactttaatcttctaaag

SEQ ID NO: 3016 - DNA, 236 bp, Artificial
  Synthetic
attgactacacacataaatacaccagcaaaacatcttctgcgatttctagtgttttttcacttacaccagcgcgaccatcgccaaagctacatacaacacaacacacaacacaatacatacacatccagacactaccgtctaacataacacaaaccgccgaaatggtcactcaaccagccaagatccccgttgccgccccaggccccctcgctagagctttcccagccgtcatcgc

SEQ ID NO: 3017 - DNA, 601 bp, Artificial
  Synthetic
taaaaaatgtcaattggaaagctgtacgacgccccctcttgtcgagttacccccctcaaggctctcgtcaagcatttcaagctcgatgtcgacattgtccagcgggacgccgagttcggcaagctcttccctctgaagaaggtgcctgctttcgtggccgccgacggaacccccatccacgagttcattgcaatctcctactacctcctgtctcagatccccaacaaccctcttgcccccaagaccaaggaggacgaggccgaggttctgcagtgggtttctttcggtaaccaggaggtcctcggtgctgcctgggacacctttggccctctgactggccgagccccctacaacaagaagtctgtcgacgccgcttccgagcagctcgacaagctcattgctctcacctacgagccccacctcaccaagaacacctaccttgttggtgagaaggtcacctacgctgacgtcgccaatgtcgctctcctgtctcgaggcttcgagtacctgtttgacgacgcctggaagaagaagtaccccgccactacccgatggtggctcaccgtctccaagaacgctgtcttcactggcttcgacttcc

SEQ ID NO: 3018 - DNA, 504 bp, Artificial
  Synthetic
gcggtgacatcctaaccaaaaagaaacttgaccctcatcgtagccgctgtcgaggcgcaacctttacctgtattgattgcatggtatactttcccggcgtcgaatatcgttctcatacatcttgcatgacagaagagcagaaataccaaggcgcattgtataagccgaagcaaaacaacaagaagcagcagcaacagcagcaacatcatcagcaacaacagcccaccatgaactcgcatcggttaggcatggccaacacgttggccctgcagccatttgtcgaagatgtcaacgaagacaaggaatacgagtcgtggcacgagtacgaagacaagtctcgacctccccccgaggcgccaacccctccatctgccgccgacgatgaccacgtcaacgtctttgacttccctagacaactctcaaaccccgactggctcaaacgtgagccatgcgcgagaccgaaaagctcctggtcccagcgacagcacctctcttgtgcgctac

SEQ ID NO: 3019 - DNA, 589 bp, Artificial
  Synthetic
gtcttatcaaggatatgggcggccctacggccaaccaccgcctccccagggctatggccagtatccccctcctcaacagggccaatatcctcctcaacagcagggccagtaccctcctcctcatgggcaatatcctccggcccagcaagggcaatacggccagcatcctccccctcagcagggaggttattaccagtctcccccgccccctccaggccagtatcccccaccacaagcgccctacggacagccgccgcctcagcaatacggggctcctcctcctcaacaccaacagccctacggagcgcctcctccaggccaatatggagcgcctcctccgcagcatggagggcattatggtgcccctcctccggcgccttacggagctcccccagtgcagcctacgccgccgtctattggctatggcgcaccccagatcattcaatgggacggcaccccagatgcccaggctttgcgcggcgccatgaagggctttggaacggacgagaagacactgattaatgttctctcgcgaaaagacccgctacagatcgaggtgattcgatccacttacgagcgcaccttcaag

SEQ ID NO: 3020 - DNA, 666 bp, Artificial
  Synthetic
tgtagaacaatctctctttgtcctgtagtctctttgacttataatctgctctatcctgctgttgcgtggaagcttcagagtcctccctttgtgtgtgcgcgtgagccgaaacaatcaccacaattgctgctcgcacgccccggaaacaacaaagagcccgctgatccgatccgccatctccggcatacaatgcgccgctgctcttcttcttcatcaatcagctctcagtggtcctctataagcgacgaccagctcaactccatcgtccacatcaacagcatcaccaccgccgccaccacagtcaccgccagcaactcgtctgttgtatcttcatctgcctctgttgcaccctcaatcatgccttcagtccacacaatgtctgagcgccgcccttccaccccccagtatgagcgcagtcgccagggaagcacatgctccgtactgagctgcggcggcatgagccctgatgcgaccaaggagctgtggaagaccatgttggagctccaagagcgatatggatgttacacctcagccagaatggatatggccgttggagcgggagacatggctctctctctaatgccaaatccatttattctcgatacgctaaacgactccgtcgtcgacctgcctgacgagggctgggagatgctcaatcgctgtctc

SEQ ID NO: 3021 - DNA, 591 bp, Artificial
  Synthetic
gatcttgctgggagctgtgattttggcagcgcgaagcgtttccgggtgccaattctcaccactgcaatcacaagtcccgagtactactctgtcaaccatggcctcgattgtgcgaccttctctgctgcggcagactgcgctggcggctcgttgcgccaagcctgctttccgaaacaacgccatcaaggcttcggctttccacacctcgactcagctctctgcctttctgcctcccggacctcagcgaattgagggcacagtcaacgaccccgtccctattcccaaacctaacgcctcccacggctcctaccactggacctttgagcgcctcctcgccgccggcctcgtgcccctctccattgctcccttcgccgccggctctctcaaccccaccaccgacgccatcctgtgctctgccgtcctcctgcactctcacattggcttccagtccgtcatcatcgactacatccccaagaaccgctactccggcctgcgaaagatcttctggtggggcttgaacctggcgaccgtcaccgtcggcgtgggattgtacgagtttgagaccaacgatattggcgttaccgaggctat

SEQ ID NO: 3022 - DNA, 611 bp, Artificial
  Synthetic
ggagctgtgattttgccagcgcgaagcgtttccgggtgccaattctcaccactgcaatcacaagtcccgagtactactctgtcaaccatggcctcgattgtgcgaccttctctgctgcggcagactgcgctggcggctcgttgcgccaagcctgctttccgaaacaacgccatcaaggcttcggctttccacacctcgactcagctctctgcctttctgcctcccggacctcagcgaattgagggcacaggtatgccgcgcaaaacgtgttgcgctctctcacatgccgaaccgaacctatgaaataactaaccacgagcctacatacagtcaacgaccctgcccctattccccaacctaacgcctcgcacggctcctaccactggacctttgagcgcctcctcgccgccggcctcgtacccctctccattgctcccttcgccgccggctctctcaaccccaccaccgacgccatcctgtgctctgccgtcctcctgcactctcacattggcttccagtccgtcatcatcgactacatccccaagaaccgctactccggcctgcgaaagatcttctggtggggcttgaacctggcgaccgtcaccgtcggc

SEQ ID NO: 3023 - DNA, 580 bp, Artificial
  Synthetic
cgttaacgagtcgtttgttgagctccttttcccttcccagtctttcgcttttgggtccgcacttctcctgcaggtcgccgtttccataccattttctaatagtatcacttccgcacatcttcacgaacgcgtctccccgtcgtcgtactatacagtcaatatggtgtctttcaaatcagccgttgccgccgccacgatggcctttgtctcgttggccaatgcgaagagctactacatcgaccctgacagtgtccctctggccacaagacagagctggtgccgttctgagacgtcgacatgccccatcatctgccagcagaccaccaacaagccgacattggtcaacgactgcagtcctgataccttgagcttcggttgtctctgtggtgataacaagcagcctaacatttctgagtacaccttgacactgccctttttcatttgccaggagtttgtggtccagtgcaggacagcttgtggctcggacaacacttgtgcgtctaactgcgccgaggataacccttgtggtgccaccgatcctaagcgttacaactcaacttcgactgctacaacaacaacc

SEQ ID NO: 3024 - DNA, 905 bp, Artificial
  Synthetic
gcccccaaagctcctggactggtccctccaaaagccacagccgcaagcttggcagattggtaaaggtccagaaccccaggccacttggtattaaagtatttctccgttaaggaatgaaagaaaggtggctgtacttcagctcatgcttagttggaacacagcccaagcaatagcacaaagaggcgtctactccaaccatatccagccattatctagacaaaatagagaaagaaacagagaaaagccacgatatcggatatcgaccaacttcaaactggcaaagctgcaatcaacccccgacgttgggcttgctctagaatccgcccagctggctgaggaagcgaattccttctcctcggcctccgttatacttccttttacgtaccgtgatattgtgatagacagacgcctccaaaaaggaacatcacaacaaagtatcgccaagaatcctcatccgcaagtacacagggggaaacaacaaaacaagcttccgactcctcgactccagtggggggcatcccagccagtcaatgataaacacacaatcaaacagagcacgatacagagagaagaagcacctcaagccgccgtcagtttcaccccccctttaaaagagatttgaacccgaaaagggccgctcgcatattcaagcctttcgccaatgagatcccccatccatcctctcacatcccgcaccctccacaccaaatgcaaaacccccaataaattctgtcgacgggagaaaaataagatatgcagagaggagctcactcagctgtggccacgtagaaagcctcggcccgttcgcaacccacagcctgtatcaagtcaaaaccatagaagggccagcgccatgcccagccggaataacgtcatgcattgcttgaatatgcctcttgtgcgtc

SEQ ID NO: 3025 - DNA, 696 bp, Artificial
  Synthetic
aaacaaccatgcctcacaaacacaagtcaaaaaagggcgaatttgaagcagagttcgtttgtgagcgtaccatgagtagatttcactgactaatcttggagctagattcgatctcgcccctacagagaaagcgcgatctcttccagtaaacaaacgaaaagcggcatcaagttctggagagcaagtcacaaagaagcgtgccagaagctcattaagaggcaatgacactccgcgagcattcaagagaatcatggctgtggcaggggggaagaaaattagatcaggcttggatgatggtcaactcgacaaaacgactacgaaggctaccgatgtaacgagcgagaaacttcaaattcgtcccggtgaaaatttaggggcctttgccagccgggttgatgcggctctaccagtatcagggcttgcgaagaaaaccagcacgaatgcagagggcaaagacgcattaggattgaaagtgtatcgcactcgcaaagagcgcaaaatgcacaaactctacgatcagtggagggcagaggaatccaagatacgagaaaagagggaggaggagctagagcgcatagcagaacgcgacttggaagacgatgctgccggcattcttacttcagctgccttcgaaaacgacaatagccacacgaaaaagaggaaggggggcaagaggaagagaatagtagaggaaga

SEQ ID NO: 3026 - DNA, 487 bp, Artificial
  Synthetic
gcgctgagaagcctgcatcgcccgccatggccattacgccgacccaattcgccaagaagacggcgcagtcgaccagctggtcggatgcgaagcgtcgagtcctttcttcgtaccgcgaatggatccgagctgcgcctgagatccagaccatgtacaatgtccctctccccatttctaccctccgaacacggatgcgacaagagttcgagcgacaccgatacacgaaccagctgtccatagttgacgtgcttctcttcaagtcccatgcagagtaccaggaaacaatgaacttctggaagcagcagactcacatcttgtcttatttcggcgaaaactttagaggtgacaagaggcttccgtccagcttcatggctggtttccttgagggtcgaaattagaaagacaatgcaagaaagtttgttttgtaaatatctctgtataaagattttgtgccgaaaccctccaataaaaaaaaacacaacaacac

SEQ ID NO: 3027 - DNA, 664 bp, Artificial
  Synthetic
cacacctgcaagccgtcggctcttccttcctattcccattgacaggataaacatacgtctaggctgcttctgcttggcaggaactacctttccgagcatctgccactgcctatctgggtattgggcattgcccaacgtggtgcgcacttgctcgatccatacctacaattacgggtaccttgatgatctggggtatcttgtagtttagtttgtatctgccgggtcacgagcagccaccaccgccaacatttggtactaggcaatacttctgggtgccgatatatcacctgtcacgtcttttcaggttttgcatctttttgctctcttcatcatcatcatctttcttctttgtcacaatcactttgccgtcttccacggacatttccgcagatctgcatcacagagatctgcatcagagaggatttcaagcttttcctctttgtttgccttcctctcctcttctcttcttggatcacaaaacaatcggcaaaattgacatctcgatattttctgcctccaatcacagccgtcataccacctgtggcgtctttgccatcaattctctgctgcggtgctacccgccctgcagcaatttttcccgctggccgtctgcaggcttgcctcggctgtgggttttccgtcgaccactgaggcttagtgccca

SEQ ID NO: 3028 - DNA, 360 bp, Artificial; identical to SEQ ID NO: 870
  Synthetic

SEQ ID NO: 3029 - DNA, 305 bp, Artificial
  Synthetic
gaagacggattactcgcacatatcgcgtgagaagagcctcctcgtggttatttgatgctagaaaccgcaggtccgtgggttgtttcgggagaggaggaaacccaggggaaagggtcgctttggatgaggctgtgccgtattagccgcgtatattgccaatgagtgtgctgtgtttggtggttgtgttgccttcaagatgcaaagtaatatatttccatcttggcatagcatgtattgctacgtacgtagtagtatgcagatggctgggattgatgctcttacatggagtatattcccagcttcct

SEQ ID NO: 3030 - DNA, 712 bp, Artificial
  Synthetic
ttcacttcctgaggccgcatctcattcagcttttaccccaccatctcacagcccatcatctatctcatccaacctctcaccacaacagcacctacatctacaagagagaacacttccctcttgaaaaagtaaacctaaataaacacatcaaatcaaaatcctccatcatggccgacaaagaccgcatcacctgccacgtcctcgacaccaccgccggccgccccgcaaagggcatccgcgtccgcctcgaaggccccgtccccagctctcccaacgcccacactgccgtcaacaccttcgagtccctcaccaacgacgacggccgcatcaccgtctggctgccctactcctcagagtcctcggccggcgaggtgcccgtctacactctcgaggacgtcctgggcgctatcaaggggccttcccggtggacgctgcgtttcgacactgccggctactttggcgaggaaaaaacattcttcccagaagccaccattgtgtttcgtgttgaagagggccagcattaccatgtgccgctgctgttgagtccgtacagctacaccacttaccggggaagctaaaggggggcatgggaggacaacgcggcttcacagccacagtcgtttcagtttcagagtcagagtcagagtcagtattcagagatacatatgacaacaatgatattgaaagcgtgctagtcgtggcaatgtcaaca

SEQ ID NO: 3031 - DNA, 818 bp, Artificial
  Synthetic
gttcgtgctgaagatttgcaatgcgcgcgcacatctgagtatcctgagacggctgcagtctactgcaacttgtactctacttggggtaccagatgctcccttcggagcaggatcacgattcaaacgcgcatcaatcacaggaaatccctgtcgtctgtgttttgttccaacccggaactgctcaaattgggaacccgaatgacatactgtttaccgccatgtgtgtggttggttctcttgagaatccgagacatattgtctgtgacaatcgcattgtcgacaaatcaacaaatcaaaaatgcgccgttgcgctgtttgccaaagttggtgggtgggatgctcttttattcattttgctcgcctttttttcttcttgcgctctagcacgccaacctggattccaaccttctgggaccacccgatcgatcgtggcagaattgaacgcacgaatagggcttttgtgtaacgctggaaaggaccacggtggccgctggtatccattctgtccgcacacttacttcggcattggggccaacgttcctggcgatgcagcgggactggtggcatgagtgggtagttgacatgttggctgcccgttccgaacttctccatcggccccatttccactgcgttgccagatccgttgggatcaagatttaggacgctggtggcctaccaacgcccgcatccgaggagaaccacagcggacgtcctccgtacttttctccccgtccgttgacgatatgctaccagcacatgcgccctgaacatgcaccatgttggactccatagtaagattgggctgatataccacgcgc

SEQ ID NO: 3032 - DNA, 894 bp, Artificial
  Synthetic
gggaaatttgttcaacctcgacaaatcaaccccgtcgcccatagtacaagatggtaagttaacagtcaaccaaaagactctaatggccacagtttgtgagtcaaatgcgcgaaagcgcaattgatgcaacagcgtctagcttttatgcaaacctgttggaaaacattccgcctgacattcacacctcgtgtgtggactgaaaggtgaagacttggctggagacacaaatgtgttgctgaaatatgccacaatgtgttctcgttagagttcagagaagactttttggcttgagcccctcgctgatgtcttcttttctcaatgacagcctcccaaatctggcaagaaggtcgcccctgctccgttccctcagagcaaggctggcaagaagggacccaagaaccccctcatcgagaagcgccctcgcaactatggcatcggccaggacatccagcccaagcgaaacctgtctcgcatggtaaagtggcccgagtatgtccgcctccagcgccagcgcaagatccttcgcctgcgtctcaaggtccccccctctctggcccagttccagcacgtccttgaccgcaacactgccgcccaggctttcaagctcctcaacaagtaccgacctgagaccaaggtcgagaagaaggagcgtctcctgaaggaggctaccgccgtcaaggagggcaagaagaaggaggacgtcagcaagaagccctacaccgtcaagtacggtctcaaccacgtcgttggcctgattgagaacaagaaggcttctctcgtcctcatccccaacgatgttgaccccattgagttggttgtcttccttccttctctctgcaagaagatgggcatcccctacgccatcatcaagggcaaggctcgtctcggcactgt

SEQ ID NO: 3033 - DNA, 456 bp, Artificial
  Synthetic
atttatcgagtttcacagggcttacaactcctgtccggggggattggcagatcttgacaactgaggaggaccggatgccgtgacgtgtagctgctaggatgaatcttggattggagatttgccagtcgatttggatggtgcctttcgggatggaggggtggagggtggagagatatgactagtgtggaggtatcacagcgtcggggggctgtggagagttcagggtaagccatttgcggctttcacgctcagtaacactcgggggtttaaaactgactgatggcccatctataccttgcagaacgaatttaggtcctcgcaagactctccctagagccgcgtcccgtcactactgctgctttggcatcaaatagtgctcaatggctaggccgagggatttgaagacgatagcaatgtaacccatacgatctgactgaacgaaaaaaaacaacaacc

SEQ ID NO: 3034 - DNA, 649 bp, Artificial
  Synthetic
tcgacatcagtcacaatggctttcggaactctcttcaccaccgccgaccaacctcgtgccgccgccatcaaggccgtcgccaaggccaacggcctcgagctcaacatctccaacgttgaggctggcaagcccactgctgagcacctcaaggctcaccctctgggcaaataccctgctttcctcggcgaggatggctttgccctgagcgagagcattgctatcgccatctacgtcacctcccagaacgagaagaccacccttctcggcaagaccaagcaggactacgcttccatcctccgatggatgtcctacttcaacaccgaggtttgccccaagatcggtgcttggatcaagcccctgaccggcgcctccccctacaacaagaaggctgtcgatgacatctccaaggaggttgcccgtgctgttgatgctgctgaggagcacctcactcaccacacctacctcgttggtgagcgcatcaccctggctgatctcttcagcgctggcctcctctaccgcggcttccagtacttcttcgacaagcagtggcgccagcagcaccccgctgttactcgatggtacgagaccattgttaaccagcccatctacactgccgtcgccgagaagctccccttcctggagactcccg

SEQ ID NO: 3035 - DNA, 592 bp, Artificial
  Synthetic
agaaagagaagctcatcagcaagtctggtcctgtttgtctctctgttacacagattcagtgaatcaaggagaagcaccttattctcttcctaatcatggctgctatcgttgaagatgctggagaggtgccctctgcgtcggcgcccactcctgttcttggggagccaatggatcttttgacggctttgcagttggttttgaagaagtctcttgcccatgatgggctctcgcgagggctccatgaatctgcaaaggctattgagaagcatgctgcgcagctctgtgtcctggctgaggattgcaatcaggctgagtatacaaagcttgtccaagccctttgttctgagcacaatgtcagcttgatctcggtccccagtgccaagaaacttggggaatgggctgggctgtgcaagatagaccccgaagggaatgctcgcaaagttgttggatgctcctgtgtcgttgttaaggattatggtgaggagaccgaaggcctgaacattgtccaggagtatgtaaaaagccactgagttgagaagaggaaaagtcaattattaaggaaaaattacactatttttgagcgaaactttac

SEQ ID NO: 3036 - DNA, 747 bp, Artificial
  Synthetic
gaaaaccccctcactaattctttacacgtcaattaatcttcgaggatcgcccgacgagaacaacaatcaagatgtcggacgtagaagagaacaacgcccccgaggtcgtcgaggaggttgaagtttccggagatgcccccaagggccagatgtccgttctggacgccctcaagggtgttctcaagctcgctctcatgcacgacggtctcgcccgcggtctccgagaagcctccaaggctcttgaccgtcgccaggctcacatgtgcgtcctgaacgagaactgcgaggaggaggcctacaagaagctggtcattgctctctgcaatgagcacaagattcctctcatcaaggttcccgatggcaagcagctcggcgagtgggccggtctttgcgttctggaccgtgagggtaacgcccgcaaggtcgtcaactgctcttgcgtcgttgttaaagactggggtgaggagtctcaggagcgttctatcatcctgaactacttccagacttcccagtaagggcatggacggcgttgatttaaggggttatagaggtgccgtcttggtttcttttcaggacgcgtgaaaaaaaaaacgactttctttagggttgtactctaggccttgtatcatggccatcttgcatgacgggaaaaataaaaaaggaatttacagaatcatctgatattgctggctcttttgtgcacactaatgctctctgataaaacatgcagttttccattttctattt

SEQ ID NO: 3037 - DNA, 514 bp, Artificial
  Synthetic
tctttcttcttccttttagctttcctttcgttttttgatttattttgaatacaggaaatcctcgaggtctcgccctcttcgtccccgtctctgcacaggacaagatcgtgaatcgaagaaaggatttcgcagtatcatggcagaagttgtggtagatgaaactgcggagaagccctcggcctcggtgccagttttgggggagccaatggatcttttaacagcattgcagttggttctgaagaaagcaatggcgcatgatggccttgcccgaggccttcatgaaggtgccaaagctattgagaaacatgcggcccagctctgtgtactggctgaagactgcaatcaggctgagtataccaagctggttcaagctctttgttcagagcacaatgtcagtttgatctcagttcctagtgccaagaaactgggtgaatgggctgggctctgcaagattgactctgaaggtaatgctcgcaaagttgtcggctgctcttgcgttgtcgtcaaggattac

SEQ ID NO: 3038 - DNA, 356 bp, Artificial
  Synthetic
acaagacattgatcctcagtggtttttgggggaatgcgcatcctttctagcctttattatctgctgtgatgttgaggggcacaagagctgactggattggcagaagataatggcaaaaaagagatgcgcaaacgttagtacaagctcgaccaagagcatcatctttaccatcacatctcatttttcaaatacatgaaatggtcagatatattcatacgtgtccaagcgttcagaaaccagccaatctcagtcttacatacttggaacatttacatagtattgagtcgcctattcatcaggaaatcctggttcaacaaaactcctccactcagaaaagaaaagaaagctaaagcacc

SEQ ID NO: 3039 - DNA, 542 bp, Artificial
  Synthetic
aaagttcctttgttctagtctctttcttttggtttcagattacagcgcggaggagagttgcggcacagtcggtcaccatgccttcgcacaagacctttctgataaagaagaaactggcgaagaagcagaagcaaaaccgtcccatcccccattggattcggatgcgcactgacaacaccatcaggtacaatgctaagcgcaggcactggcgcagaaccaagctcggcttgtgattgaatatcaatggaacatttctttctttggaaaacatgtcaaccgaactggatcctgccaaattttgccatggaatttattagttttcagagtcgtttgactgctgtttgaaactcctttttatttagtcaagtatcaaaaatgactcagcattgatggtctcctttcatatacactcttttaatgtagtcttataagaagcaatgtttttggttagattttcatcttatcctgaagtctctattgcatctttcaaattttttttgcactcagttcattattgctaatgagaccaattttattaaaag

SEQ ID NO: 3040 - DNA, 548 bp, Artificial
  Synthetic
ggaggagggaggaagaggaagaagaggaggaggaggagggaggtatctgagcgaggtctaccgccgatcaccatgccttcccacaagacgttcctgataaagaagaagctggctaagaagcagaagcagaatcgccccatccctcactggattcgtatgaggaccgataacaccatcaggtacaatgctaagcgcagacattggcgcagaaccaagcttggtctgtaagctggattgacagagatgttttgaattcagcatgctgcaatgatggaatggttcattaatttgagaattcctggaattaagcatttaaattttggttcactcagcactgattaaaattttggaaaacaatacatttctttgaatttagctctcaaatctttcgtgcaatgaacctcttttaagatgattactctggttgcttcattttcctgcctgcccggttgaaaattgtgtgtttactcatctaggttcagatgctctggatactactacatcaagtgtttgttttgactcataatcacaatttaatgtgttctttt

SEQ ID NO: 3041 - DNA, 325 bp, Artificial
  Synthetic
gtagtaaaattttattgaaatcttcgagtgtgtatgatttaaatttccactcgctatgtcatcgcataaatctttcaagatcaagcaaaagcttgccaaaaagctgaaacagaatcgacccatccctcaatggatcagaatgcgtaccggtaacaccataagatataacgctaaaagacgtcattggagaagaaccaagctcaaattgtaattacaaccggaatcgaacgtttcgttattctttaattttcatgaatctattttctagattacgtttatgatgatggtttcgttgtgtgaaatttacgaataaaacgtcaacagg

SEQ ID NO: 3042 - DNA, 367 bp, Artificial
  Synthetic
acaacttcaagcagcttcagagcttatcgccgagaatctccaaccggtgaaaatgccgtcacataagacatttatgattaagaagaaactggcgaagaagcagaggcaaaacaggcccattccttactggattcgtatgaggactgataacactatcaggtacaatgctaagcgcaggcactggcgtaggactaagctagggttttaaggtggaagacttgtgttttatttattgcttttttatgataaaaacttgtcggattatgtttttcgttcattaggagcttatgctgtgatgaaacatgatgtgttttaatttctatgaagtttatatattgaatgactgtttatgactttgtttcttgtt

SEQ ID NO: 3043 - DNA, 202 bp, Artificial
  Synthetic
aagacttcaagaccaagtccaagctggccaaggcctcccgacagaaccgacccctgccccagtgggtccgattcaagaccaacaacaccgttcgatacaacgccaagcgacgacactggcgacgaaccaagcttggtatctaagcagcgcgatgtatgctagatccgggaccccaaaaaattcaatatatggcttttgcacg

SEQ ID NO: 3044 - DNA, 547 bp, Artificial
  Synthetic
gacccacgcgggcgatcattctcaacatcacgaaaatcgtcatcatcaccagactcgatacgcaaggtcaatacgatggcgagccacaagacattccgaaccaagcagaagctggccaaggcccagaagcagaaccgcccggttccgcaatggattcgccttcgcactggcaacacaatccgctacaacgccaagagaaggcactggagaaagactcgcctgggcatctaagcgatttcgcccaatcacctggcattcccgaccctcttgcaccgacggtaccgacgtctggtttctttggcatggtttcgcggtgaaatagtggcggatggcgtaaaagaaaaagattttttatcgtctttacggcgtgtgggggagggaggatgcagacgcaatggaatgggcacggttgcctggtttctcgattcttgatattgcttcatgtcacggtcggtcatagggaaaggaatgaacctattttgatgtccattttgctttttacccgaggatcagtttccttttctttctaaacattgtgctcatgccg

SEQ ID NO: 3045 - DNA, 454 bp, Artificial
  Synthetic
cccccgggcttctccgttccaagggtttcctcgcgccgccgccgccgccatgccgtcgcacaagacgttccagatcaagaagaagctggcgaagaagatgcgccagaaccgccccatcccgtactggatccgcatgcgcaccgacaacaccatcaggtacaacgcgaagcgcaggcactggcgccgcaccaagctcgggttctgagcttggggaggagaggaggacgaggcgccggacgccgctgccctgggaagaagaagaagaaggagaagctagggcttatgggttgcgtcgtgttcgtttcgaggttttgcctgtcctgaagagactatcagtagctgtgtgtatcttggagcatcataattttgctgattaaagaaccactttcttatcctgcctaaagttgtctgaattttatctcagctgcagtggattgatcagttgaactccctt

SEQ ID NO: 3046 - DNA, 404 bp, Artificial
  Synthetic
gcagcagcagctccagctcccaggaggaattcccaaccgtgaaaatgccgtcacacaagacattcatgatcaagaagaagctagcaaagaagcagaggcagaacaggcctattccttattggatccgaatgaggactgacaacaccatcaggtacaatgccaagcgcaggcactggaggcgtaccaagttaggattttaaggtggaggatttgagttttgttcaacattttatggaaaactttctggggttttggtattttctacttttgtttactaggagcttcttctgaaatgaaatctagtagagtttctactgatgttttggtaaaagtattggagctcaagtttcagcagagtttatgtattaaatgactatttttggatttattatgttttgttgatc

SEQ ID NO: 3047 - DNA, 387 bp, Artificial
  Synthetic
gccattacggccggggagggtttcaacgttcaagcagcatcagagcttatcgccgagaatctccaaccggtgaaaatgccgtcccataagacatttatgattaagaagaaactggcgaagaagcagaggcaaaacagacccattccttactggattcgtatgaggactgataacactatcaggtacaatgctaagcgcaggcactggcgtagaaccaagctagggttttaaggtggaagactcgagctttattcatgatgttaatgaaaaaacttgttggattatgtggttcgttttataggatcttattttgtgatgaaacatgatgtgttttaatttcaatggagtttatatattgaatgacggtttatgagtttatttctggtc

SEQ ID NO: 3048 - DNA, 688 bp, Artificial
  Synthetic
gcagaatgtcccgcgccgggtctgaggccaaaatgggaagaccttcgatcagactcatctcgtcatacatcttcgactggattgttctcatcgtggttgctggagtcggttatgtcctcggtgttatcacgcccaacaagcggcccttttctctggtgaatccagacatctctttcccttttacagaacatgagaccgtcccagactggctgctctttgtcttgagctgcggtgtccctgccgtcatcatcgtcattgtctccatcatctttgtacctggagcaacagtacccaagaacacccctgcttcactgatatggaaacgtaagctatgggagcttcacaccggtcttctggggctcctaatgtccgttgcctgtggcttcttcttcgtcagcggtatcaagaacatgtgtggcaagcctcgacctgatctcctcgcacgatgcctgccagacctggagaacgcttccaagttcctgattggcggtttccaaggagagtccaagttgggcaacagcattggccagctctattcggcagacatctgccagcagaccgacaaggcgaagctcaacgacggcttccgaagctatcccagtggccactctgccgcctctgcgggtggcctcctctatctttcactcttccttgccagtaaatttgccgtaactatgccatttgtggc

SEQ ID NO: 3049 - DNA, 586 bp, Artificial
  Synthetic
gttgatcataccaggcgccttttttctgcttgagcttgtcgatatccagctgcagttgggactgccaacctccaattggatgcgcatcgtggtttgagggaacatgcgacaattaccttcctcaaacaccacagtcaatcaatcccgctgacagccgagggattgccccccatgccgccgcatctgcacccacggtcacgaatgacctcgtcactcttcgctacgacggtccttgccagcttcttcgttgttgccctaccgcacttattaccatgcccggtcccgcggacaaagtacgctgatggagagattatcgtcgacgaaaacggcagacggaagagatggaagaggagggatgtcgatacaaaagacggacttgtgcaattcaaccagacaacagacgatgagattgagcgtgcagcggagcgaatgacgagggaatgtcccgtaccgaaacccggagggatgttgggagagtggctcggattccacgccacggaagacaagacaagggcaaacagatgacgattgataccgccaaatgaataaaaagcaaagaaaaaagttcaaatatgaaaaaaaaaaa

SEQ ID NO: 3050 - DNA, 612 bp, Artificial
  Synthetic
ggaaccaatgagtctacggctagccactcggcggctggcgctgtcaagcccatcttctccagcctcattgctggcgccgattaatggagtttcacatggaacggttggcgtactgactcagcgtcgtcacaaatggtcgatcaatgtgttcaaaggatgggggaaatctagttccaaagaatctggcgacagaggccaggacccatccgcctctgaattggacgatcccaagaagcgacagcagttcctgcaaaggaatatgcggggtggagtcgaagacaacattttccaggacgagattgaggccgcgaagccggtaaccgattctccagctgcccagacgacagaggaaaggacgaaggagagcctagcaatggtggtcgatccagatgctcggagccgtatccggtggcagcgaagaaaggtcatccaatcagtgcgccgcaacgggcagctgacgagagaggagaagatcaaaatgacggagcgcgagctcattcacaagagcgactttttcccaaccagcgtcaagaaactggtcatgttggcacggcagattgccggcaagccagtcgacgaggctattcaacaaatgaaatggtcaaaaaagaa

SEQ ID NO: 3051 - DNA, 531 bp, Artificial
  Synthetic
aaccactcggcacatcatgagttcaggatacggcatgcatggcggcgtcggccgttgctttcctttctggcaggaggtcatggcctgctatgtcgtcaacacatccgccgcagacgactcaggcaagaagaagtgctcgcccgtactagaggattactacgagtgtctgcaccacaagaaggagcatgcgagagcgctggccctacaagccgcatatgcccgagctcaatcggcaaccgcacgagacgatgcgccaagtgccagccagatccggaatctaggactgctagggaagacggaggacacaaaagcggtgcttggacagggaaactgaggcaatagacgtggcggagttcgatttcttctgcgcgaatacaacccccttggcgcgcatagatagcgcagcaagttcaatataggaaaagcagacagaactggagagccttttcggatgctgattgtgaattggcggctaattctgtcagtttggaggctgtaattctgtacaaattcgacgtacattttcatcca

SEQ ID NO: 3052 - DNA, 591 bp, Artificial
  Synthetic
tttcgacacgcgtcgtgcttgcttgctagaaccacacaactcacacaaagatgtcttcaggatatggtctgaccggaggtccctcacgatgctttcccttctggcaggacgtgctagcctgctacgtcgtcaacacctcgactgatgacgactccggcaagaagaagtgcgccccggtgctcgaggactactacgagtgcctgcaccacaggaaggaggcctgccaaaatcacagcccttcaggccgcattccgccgcaaagaagccgaaacacccagagataacgtgccctccgccgaccagatccgaacattgggcctgctggaccgcaccgacgaggaagtcaacatccgtcccgccaagttcctccccaaaattgagcacatgaacggttccaggaagccagagaccagctagagaggtggaagcaaaaggatgctgggcaaaggcaaatgacacagcgtgagcaagtggttgatttacgggcgcgaggattgaaaggcggagcagcacacaacatgcacatgtacagataccacggctagagttcacatggagctgcgccctcgcggacagtctgtttttttgacc

SEQ ID NO: 3053 - DNA, 469 bp, Artificial
  Synthetic
agctcttgttaccatcgttccagcgcgcacagcgcctttgggctcaccgtcctcgccacccggagtagcggcggcggcggcggcggcggcggcggcattggatccgccccggcaacggcggcggcggcagcagcagcagtagcaagagaaggaggttcgttttccgcagtagcaaccctggcgcagaagattggcaagtcgattcgagggcctggcgccatgtccaaggcgcgggtctatgccgatgtgaacgttcttcgccccaaagagtactgggactacgaatcgctctcggtcgagtggggcgaccaagaagagtatgaagtgattcgaaaggttggccgaggcaaatacagcgaggtgtttgagggcatcaattgcgtcaacaacgagcactgcatcataaagatcctcaagcctggtcaagaagaagaagataaaacgagagatcaaaattctccagaatctc

SEQ ID NO: 3054 - DNA, 719 bp, Artificial
  Synthetic
aatccattacccaaatatataacattcccttccctcgtttgatggccgtacggccatttcacttctttgtttcattccgccaccaccacaaccatcgcctcctctctcctttcccggccacctcttctctcttcccctctctcctccgtcagttttcctcgaaaactccgtcgctctctctcacccgactcaaacacaaatcaccttcttcgttacctccgccgtcaccgtcatctccttatcttcatcgaccgtcggcgactttatccgaaaccctggcgcagaaaatagggaaatctattcggcgtcccggtgcgccgtccaaggcccgggtttatacggacatcaatgtgatccgacccaaagagtattgggattatgaatcccttactgttcaatggggagaacaggatgattacgaggtggttaggaaagtcgggagaggaaagtacagcgaggtgtttgagggaattcacactactaataatgacaaatgcatcatcaaaatccttaagcctgtcaagaagaaaaagatcaagcgtgagattaagatactgcagaatctttgtggtggacctaatattgtgaagttactcgatatcgtcagagatcagcaatcgaagaccccaagccttatatttgaatatgtgaataacacagattttaaagtgctgtatcctaatctttccgacttcgatattagatattacatctatgag

SEQ ID NO: 3055 - DNA, 635 bp, Artificial
  Synthetic
gccagcatcctttttcccttatcctcagggggtcgctgatccgtgaccgagcctgcccaagatggcgcgcgtctacgccgacgtcaaccagaacatgccccgtagttactgggactacgacagcgtcaacatcagctggggagttctcgagaactacgaggtcgttcgcaagatcggccggggcaagtactccgaggtctttgagtgcatcaacgtcgtcaactatcagaagtgcgtcgtcaaggttctcaagcctgttaagaagaagaagatcaagcgagagatcaagatcctgcagaatctggcgggtggccccaacgtcgttgcgctgctcgatgtcgtgcgagactctcagagtaagacaccgtctctcattttcgaatatgtcaacaacaccgacttccgaagcctgtaccccaagttcaacgaccttgacgtgcgattctacatcctggagctgctcaaggctctggactactgccacagcaagggaatcatgcacagagacgtcaaacctcataacgttatgatcgaccatgagaacagaaagttgcgtctgattgattggggcttggctgagttctaccatcctggaaccgaatacaatgtgcgtgttgcatctcgttacttcaagg

SEQ ID NO: 3056 - DNA, 622 bp, Artificial
  Synthetic
gaaccgacatccaacatgagcatggaaccgcgatcgaaaaacccgtactcggttgcgcgggtatttgcggacgtcaacgccaaaatgccccagcagtactgggactacgataacctcacgataacctggggcaacattgacaactacgaaatctaccgcaaaatcggccggggcaagtactcggaggcatttcagggcgtttgtgtggtcaacaagcagcagtgtgtcatcaaggtgttgaagcccgtgaaaaagaagaagattaagcgagaaatcaagattctacagaacgtggcggctggccctaacattgtgtctcttctggacgtggtgcgtgatccagtcaacaaaactccctctctcatctttgagtacgtggagaatgtcgacttccgacaggtgttccccaagttcaaggactacgacatccgatactacatctaccaggtgctggtggccctggagtactcccactccaagggaatcatgcacagagacgttaagccccataacatcatgtacgaccctcgacggggcaaggtgcgactcatcgactggggtctggccgagttctatcactcgggcacctattataacgtccgagtggcgtctcgatgctaca

SEQ ID NO: 3057 - DNA, 639 bp, Artificial
  Synthetic
gtcgaccacgcgcgattctctctcccccacccccgaaaccctagcgcgacctcgccgccggcaatggccgcatgaccgatgcgcctccgccgaggagccgcccgcacccacccagcagcagcgtcgccgtgcccgccgccgcggcggcagtgatcgcagccgccctcgcgtcctccttcctcgccctgctgcagccgccccggcgcgccccggtcgccgcgggatccagggtcggcatgtcgaaggcgagggtctacgccgacgtcaacgtgctgcgccccaaggagtactgggactacgaggcgctcaccgttcaatggggtgagcaggatgactatgaagttgtcaggaaagttggaagaggtaaatatagtgaagtctttgaaggcatcaatgttaacaacaatgagaaatgcatcatcaagatactcaagcctgtgaagaaaaagaagatcaaaagggagattaaaatacttcagaatctttgtggaggtccaaacattgtgaagcttcttgatattgtcagagatcaacattctaagactcctagcttgatctttgaatatgtcaacaatacagacttcaaagtgctgtaccccacgttgacagattatgatatccgctactacatatatgagc

SEQ ID NO: 3058 - DNA, 597 bp, Artificial
  Synthetic
aaatcttcaagcttcactacaatcaaaatgcagttctcccttgccatcgccgcctccgtgctggctgccaccgcctcggctgctcctgcaaccgtctccggcacaaacaccaacggctccatcttcatgttcggagacccagctcccgctcgcaaccttctcaaccaatttggtgcttgcggcctcaccacctacttcgtcggccaggtccccgacgacatgcccctggttgctatgcccgccaacatcttcgaccaattcggctctgctcagcacaacactctctgtgccaagatcatcaccctcacccgaaacggcgttactcgccaggctgctattgcggaccgcaacctcagcaacaccaactccattgacatgactcttgatctgtgggaggcctttggtggacacgacaacgacggcagcatcattcctggcttcagctggtccattgccaactaaggagttggtggaagtggcctgcggttgagtagactgcgacctgtacatatttctactctctttctgatgtatatatttatgacttttgagccctctcagcaggagattcttgtatatatatgatcctgcatggga

SEQ ID NO: 3059 - DNA, 659 bp, Artificial
  Synthetic
aactcatcctcaccctgccattctcatcgcatcaaccgaaagcatttgccatcgcacaatcgtcattcagctaccagaattccagttgttcaataaggagtcgcaatcatgggtggcggagatttaaacttgaaaaagtcgtttcatcccggtctgcggcggaaccagcaggccgtctacgaagaagaacaaaaggctctcgccgagcgcaaacgaacccagcagcgcatcaatgagatcaaggaggagcgcgcaaaggaggagatccagagacagctggaggctgcgggaggcaccaaaagggttgatcgcgtcgactggatgtaccagggccctaccgatggccaggctgggacaacagaagaaacagaggcctatttgctgggcaagcggaggatcgacaacctcatcaagggcaccgaccacaagaacctcgaaaaggccgctggacaggagagcttcattgcgctgcagaacgcgaacagcgcgcgcgacacagccgccaagatccgcgatgatcctctgctggccatcaaacgacaggaacaagccgcgtacgaggccatgatgaacgaccccatcagacgccgccagctcctctcgtccatgggcatcgacgatggcaagaagaaggaccgagatggagacggagacggaca

SEQ ID NO: 3060 - DNA, 606 bp, Artificial
  Synthetic
gtttttgttttttttttaatctactggtatcagatactaacactggactacaataggctcacatgcttgacgtggagtgcttcacctatttaaaccgagcattggaatcacacctcgcccccattgtggttttggcatccaaccgtggaatgtccacaataagaggtaccgacgacgttgtcgcggctcatggcattcctcctgacttccttgcccgaatgctcatcatccccacctccccatactcggcagacgagattaagaagattgtcaagctccgggccacgacagagggtgtgtctattacggacgctgccattgacaaaatttccgagcacggtgtccgtgtcagcttaagatactggctacaactgctgacaccctcaagcattcttgccaaggcgaatggccgtactcagattgacgtccaggatgtgtccgagtgcgaagatcttttcctcgacgcccgccgtagcgcctcgcttcttgctagcgaagcgggacggggctatctgtaaccttgatttgagatgagaagctgtagacgagcagggctagatcgggtgaaggggggaggatctcattgtgaaagatgacgctgggcgg

SEQ ID NO: 3061 - DNA, 489 bp, Artificial
  Synthetic
gacagcctgaaaccgcgagtacaagcatggggttggaagctcgacgtgtgagctctcctttcgtctgccgtcaaaaagtcgatgccaaggagggtattgcagatgtgttgttggccatcagcttaccactggagagatccaagcagtcatcccgtgtgcaggcacaagcccagtaagccgctgctcccaatatggaccacgtcagccatgccgccaaccgagtccctcaccgtcttccaagatggagatgctgtagggctcacccagcggtcgaaacataccgcctgtctgaggccccctccagggcatttgctagccgacctactgtactcgtgtctcgtacacggcagtcgaattggtatacctcctccgaagctggttcgtcatgcgcatgaaaagggtgtagcgagcaagactcagccggccaatcacgaatatctcgggcatccttgtccgtccaggaataggcacaccactcgaaattaagct

SEQ ID NO: 3062 - DNA, 391 bp, Artificial
  Synthetic
gggcggacgcgtgggctcagctataactggaatgattgccggttctgggaaacttgttctctcttacaatactagctctaagtcgagattcaaattcaaaaccaaacaagttatcgtggccatgggtttacacgaacgacgcttgcgattcaactggtgcccattaggaaagagaaaggaaatcagttgaaaatgctggcatgagaacactttacagcgaacgattgtaaatatcaaagtgacaaaatcaagtatcatggagccaggaagcggcaaatgtctttgttctatgcttctcgaacctttggctactaagattatagacatggctgttgccaaattaagcgatggaaaattcattgtggttcacataaaagaaaaaaaaaaacaa

SEQ ID NO: 3063 - DNA, 715 bp, Artificial
  Synthetic
gacccacgcggcggtcttgttgaacggaaggaagtagccaatccgtcaactccagacacaatctctgccctcctctggcctcacaatgtccgccatctcccgcagcatcagatcagcatccaagctgcgagtccagtcgcgagccgcaagtggtctctgctcggcctccatcggcgccgctcgctttgtctcgtccggctttgctgtgccttcaacccccgcctcgcgcagcaacttctcgacttccattcccaagctttctggagcgcccatcatgtcttcctcgcgcgagtacgatcctgagatcaaggacattgccgactatgtcgccaacaagacaattgactctgagctagcttttgacactgctcgatggattctcctcgacaccctcggctgcggtcttgagggcctccgcttcaaggagtgcgccaagctgctgggcccgattgtccctggcaccgtcgtgcccaacggcacaaaggttcccggcactccctttgtgctggatcccgtcaacggagccttcaacattggcgccatgatccgatggctcgacttcaacgactgctggctggccgccgaatggggccacccctctgacaacctgggtgccatcctggctgttgctgactggatcaaccgcaccaacaaggccggcggcaacctggctggcggcaagatcttcaccatccgagacgtgctcgagggcatg

SEQ ID NO: 3064 - DNA, 564 bp, Artificial
  Synthetic
ggatcaagacacacaatgcgagctttcagatctgccgccaacttcggagctgcttctaacatctaccgaaagtccttcacccccgcttctattgcctctaaccgatttgtctctgccagaatgagctccatcatgaccgacaacgcccgacctaacaccgacaaggttgttcaggacattgccgactacatccatgactacaagatcgactcctccgtcgccatggagactgctcgactctgtttccttgacactctcggctgtggtcttgagggtctcaagtaccagcagtgtgccaacattgttggccccgttgttcccggcaccattgtgcccaacggaaccaaggtccccggtaccgactaccaggttgaccccgtccgaggtgccttcaacattggtaccatcatccgatggctcgatttcaacgactgctggctcgccgccgagtggggacacccctccgataaccttggcggtatccttgccgttgccgactggcagactcgatccgccaaggccggtcttgagggcaaggtcttcaaggtcaaggatgtcctcgag

SEQ ID NO: 3065 - DNA, 610 bp, Artificial
  Synthetic
gctcgttattatcttttgtgtttaatcggttgattgagaaatcatggcgacgactgtgtcggaggcgcccaagatgggcattgagatgatgctggagcgcatcatgggcgcgatggagaagcagaaccaagaattgactgagctgcgaaaagaatgctcagatcttcgtacgtcgaacaagagcatggagattatgctccagaacattgctcaaggacgcagcaatagccctccgggtctctccgccggcatgtctcccagcattggccgcgagcgagcccgctcgcctttcttgcctcgccgctccacagccccccaggctggtccttctcaggtcttaatcacatcgccctctcacgatatcaccacccactcttttcccttcccggatgatcgtgagatccccggattctacgtcgtcatccctgcaggcggtgctggtacccgcctgtggcccctctctcgcgagaaccaccccaagtttctcctcgatgtcaacctttgcggcaacagcttgctgcagtcgacctgggaacgacttcttcctctggctggcccttcacgaatgactgtcgtcgcgggacctgctcactccgagggcattttgggc

SEQ ID NO: 3066 - DNA, 582 bp, Artificial
  Synthetic
aaaggaaacgctcaaaggtacgtttattacgggggacagctgcgagactcccatcagccataagaaaaccaaagaaaaacggggtttgttcatcatgtcacatccaccacctccaggcacgaatctccctgcgcgcccgcccgccagcacatcgaggccgggcttcagatcgagcttcaacccgtcgggccagaattctgccgccccggtatcatcgtcgtcgacgtcgtcgtactcgaatgcaaactccgcgcgagcagccgccgcctcgagctacccagctgcccaaacccactatggctcgtcctactcgagctatcctagccacggtgcgggctcgtccgtgaaccgctctggttcgggatactcgtaccctcaagcaggcaatcagcagcaacactatccccagcaacaacaagcgcaaagctacgcccctcatgcctattcgcagcaacaaccgcagtcgtaccagggccagtcataccaggctcagccataccaagggcagcagtaccaagcagcaccgcgtatccagaacccttttcctacgccgggtgctgctgctgccgctggacccgatta

SEQ ID NO: 3067 - DNA, 392 bp, Artificial
  Synthetic
agcgcagcaacagcccacgggacaggcgggaggacagtcgcagtcgggacaatctcagtcgcaggttccccagcacaagcgcgtctaccaggcgtgcatcccgtgccgtcgccgcaaggtgcgctgcgacctgggcagggtcgacaacccgcacgacccgccgtgcgtgcgctgccgccgcgagagcaaggagtgcttctttagtgctacgcgccgcaagagaaagacggacgaggacgacagcgatgccgacgagtacgtggtgcgcaacggccgcaagaagctgcacgccgccgacagcccgcccttttcgcgcttcgacaagcgccagtacagcgacacgcccctgacccccgggggatcccatggcaggacccagccgctgcgcaggc

SEQ ID NO: 3068 - DNA, 454 bp, Artificial
  Synthetic
agtgacggcacttttcgacgacgaattgacgagcaattgatcgatacacgcggttcccgctgccagaacaagtcaagatggtttctcagactcccttccgcgctgcggaattcaagagcgcctacggccccaagtacgctttccagcccaactaccgcggcatcaccgtccagactgccacccgatatggcttccgagctgccaccatcggcggtggtctcggcgttgctctgatgctcttcgcctccagcctgccccgtgtccgttctgacatcctcgtaaaaatccccttggttggcggcttctgggagaagcaggaggttcaccctgccgacaaccctttctaaatgcacttgttggatggtgtttgtaaaattgtaacaaggctttgcgcagcttgcctttgtataagagatacacaatagacttttcctaaaccaaaaaaaaaaaagaa

SEQ ID NO: 3069 - DNA, 239 bp, Artificial
  Synthetic
ggttaatttcggattgccacagaataggagacttgccactccggtggttattctcggcatatatgcgacgttagaataacctgtttaatcgtatatagtcactgtgaaggaatccatgagggcaatgttgatgaatgttgtcagtgaagttggaagtatagaacttagccggctacaaacttaaagagcgttgcccaaaatgaagccctatccattccaattcaacagcacatcctcgt

SEQ ID NO: 3070 - DNA, 622 bp, Artificial
  Synthetic
agggactgctgctggcggccatccgaagcaatgacccctgcatcttcatggagcccaagatcctgtaccgagccgccgtggaggaggtccccgtggcgccgtatgagttgcctctgtccaaggcggaagtcatcaaggagggcaagaacgtcacaattgtttcatatggtcagccgttgtacaactgcatggcggccatcaagcaggcagaggaggatttgggcatctccgtcgagctgattgacctgcgcacaatctatccctgggacaagaagactgtgtttgaaagcgttcagaagactggaagagtcctggtcgtccatgagtctatggtgaacgctggtgttggtgccgaggtggctgccgccattcaagagaacgcagataccttcaacaggctcgaggctcccgtgtctcgtgttgctggatggagtatccacaacgctctgatattcgaaaagtttcacgtcccagatgttgcaagaatttacgacagtattaaaaagacggttcagtactaagaatgtggggagcgagtaacgtgtgactttatctttgaatttctagagcttcttcctagcataagtgtaaataatagagaataaagctttctgtaacacac

SEQ ID NO: 3071 - DNA, 691 bp, Artificial
  Synthetic
tggtatcaacgcagagtgccattacgccggggactcacaacagaaatagctactaaacaaacagcaaaagataaccagaaaagatggcgactttccctgttgttgatttggggttgcttcaaactgggaaaagggctgaaacattggataaaatcaaagatgcatgtgaaaactggggtttctttgagcttgtgaatcatgggatttcccatgaagtgctggacacagttgagaagcttactaaggagcattacaagaaatgcatggagcaaaggttcaaggaaatggtggcaagtaaaggtcttgaggctgtccaaactgagattgatgatctggattgggaaagcactttttacttgaaacacctccctgtttccactgtgtatgaagttccagacttagaggataaatacagaaatgttatgaaagacttcgcgttgaggctagagaaactagctgaagatcttcttgatttgctgtgtgaaaatctcgggctcgagcaaggttatttgaagaaagcattttatggttcaaagggtccaacttttggtaccaaagttagcaactatcctccttgccccaaaccagaactgatcaaaggcctacgtgctcacactgatgctggtggcctaatcctgcttttccaagatgacaaagtcagtggtcttcagttactgaaagacggtaattg

SEQ ID NO: 3072 - DNA, 507 bp, Artificial
  Synthetic
gacacacagacgcactcacacactcagctgaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggcaggtgatgaatcaatttgcgtcggagatcgagaagctctcggagagggtgctggacctgctgtgcgagaatctgggcctggagaagggttacct

SEQ ID NO: 3073 - DNA, 440 bp, Artificial
  Synthetic
ctcgagcttgcggccgccaagctcaatggggaagagagagaccaaaccatggctctaatcaatgaagcttgtgagaattggggcttctttgagatagtgaaccatggattaccacatgacttaatggacaagatcgagaagatgacaaaggaccattacaagacatgccaagaacaaaagttcaatgacatgctcaagtccaaaggtttggataatcttgagacagaagtcgaagatgtcgattgggaaagcactttctacgttcgtcacctccctcaatccaatctcaatgacatttcagatgtgtctgatgaatacaggacggccatgaaagactttggtaagagactggagaatcttgctgaggatttgttggatctactgtgtgagaatctagggttagagaaagggtatttgaagaaagtgtttcatggaacaaa

SEQ ID NO: 3074 - DNA, 676 bp, Artificial
  Synthetic
gtaatattcgctattctattaatttattgtatcacatttttcacacactcaaaaattaaacacatattttaccaagaaagctatggagaacttcccaattatcaacttggaaaagctcaatggttctgagagagctgacaccatggaaatgattaaagatgcttgtgagaactggggcttctttgagttagtgaaccatggtattccacatgaagtaatggatacagtggagaaaatgacaaagggacattacaagaagtacatggaacagagatttaaagaattggtggctagcaaaggtcttgaagctgtgcaagctgaggttactgatcttgattgggaaagcactttcttcttgcgccatcttcctaattctaacatttctgcagtacctgatcttgatgatcaatacagggaagtaatgagagattttgctaaaaggttagaaaatttggcagaggagttactggagttgctatgtgaaaatcttggccttgaaaaaggctacctgaaaaaggtgttttatgggacaaaaggtcccaattttggaactaaggttagcaactatcctccatgcccaaaaccagatttgataaagggactgcgcgcccacacagatgcaggtggtataatccttctcttccaagatgacaaagtaagtggccttcaactcctc

SEQ ID NO: 3075 - DNA, 445 bp, Artificial
  Synthetic
cccccccggcacacacagacacacagacgcactcacacactcagcttaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggcaggtgatgaagcaat

SEQ ID NO: 3076 - DNA, 1058 bp, Artificial
  Synthetic
aaaatacatagaaagatggagagtttcccagtggttaacatggagttgcttaacactgaacaaagggctgcaacaatggagaaaattaagaatgcttgtgagaactggggcttctttgaggtggtaaatcatgggatctgtcatgagcttctggacacagtggagaagttgacaaagggacactacaagaagtgtatggaacaaaggtttaaggaaatggttgcaagtaaagggcttgaagctgttgagactgaaataaaggatttggattgggaaagtactttcttcttgaaacaccttcctgtttcaaatatctcagaagttcctgatcttgaagatgaatacaggaatgtagggaaaatcatgaaggagtttgctgaaaagctagagaaattagcagagcaacttttggacttgctctgtgaaaatctaggactggagcaaggttacctgaagaaagccttttatggttcaaatggtcctacttttggcaccaaagttagcaactatccaccatgtcccaagcctgatttgattaaaggccttagggctcacactgatgctggtggaatcatccttctattccaagatgacaaagtcagtggtctccaactactcaaagacgacaaatggatcgacgttccaccaatgcgccactccatcgtcattaacctcggagaccaactcgaggtgattactaatggaaagtacaagagtgtggagcatagggtgattgctcagcctgatggaaacagaatgtccctagcttcattctataacccggggagtgatgctgtcatctatccagcaccagaattgttggagaaagagaacaaagtcatttatcctaagtttgtatttgaggactatatgaaattatatgcaggtcttaagttccaggctaaagagccaaggtttgaagcaatgaaggctgtggaaactactgtcaactctgccccaatagctactgtttgagactttgatggagtattaattagaaaactgattaatgagaagaaaatggcttagtattaagattatgatgatgtattgatgat

SEQ ID NO: 3077 - DNA, 642 bp, Artificial
  Synthetic
cccgactagattcttaatacacaacccagctggtgaaagagaggaacttgagagttagctagcatggcggcagcattgtcgttcccgatcatcgacatgagtctgctcgacggggcagagaggcccgcggcgatggggctgctccgcgacgcatgcgagagctggggcttctttgagatcctgaaccacggcatctcgacggagctgatggacgaggtggagaagatgaccaaggaccactacaagcgtgtgcgcgagcagaggttcctcgagttcgcgagcaagacgctcaaggaaggctgcgacgacgtgaataaggcggagaagctggactgggagagcaccttcttcgtccgccacctcccggagtccaacatcgccgacatacccgacctcgacgacgactacaggcgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtcaagggcctccgcgcccacaccgacgccggcggcatcatcctgctcttc

SEQ ID NO: 3078 - DNA, 697 bp, Artificial
  Synthetic
  misc_feature (176)..(176): The residue at this position can be any nucleotide.
cccctcgaccacgcgtccgggagattccggtgatagacttcagtaagcttgactgtgaggagagaagtgcaaccatgacacttctccatcacgcttgtgagaaatggggcttctttatgatagagaaccatggaattgacactaacctgatggacaatgtgaagcagtacgataantagcactatgaagccaatatgaagaaacggttctatgaatcagagctacctatgagcttagagaagaaagaaaaactcagcaacacagactgggaaagcaccttctttctttggcatcgtccaagttctaacatctatgagattgaaggtctctcaaaggatctttgcaacgcagtagatggatacattgatcagctgattaatcttgctgaaaatctttcagaactaatgtgtgagaaccttggcctagagaggagttacattaaggaagcattttcaggaagcaagggtccttctgttggaacaaaagtggcaatatatcctcaatgtacgcgccctgaattagtcaggggattgcgtgagcacacagatgctggtggtatcattctcttactccaagacgaacaagttcctggtctggaattctttaaagatggacattgggtgaaaattccaccttccaagaacaacagaatttttgtaaacactggtgatcaaatcgaaattttaagcaatgggat

SEQ ID NO: 3079 - DNA, 251 bp, Artificial
  Synthetic
aacaaaagttcaatgacatgctcaagtccaaaggtttggataatcttgagacagaagtcgaagatgtggattgggaaagcactttctacgttcgtcacctccctcaatccaatctcaatgacatttcagatgtgtctgatgaatacaggacggccatgaaagactttggtaagagactggagaatcttgctgaggatttgttggatctactgtgtgagaatctagggttagagaaagggtatttgaagaaa

SEQ ID NO: 3080 - DNA, 739 bp, Artificial
  Synthetic
aaacagcaaaagataaccagaaaagatggcgactactttcccagttgtggatttggggttgcttcaaactgagaaaagggctgaaacaatggataaaatcaaagatgcatgtgaaaactggggtttctttgagcttgtgaatcatgggatttcccatgaagtgttggacacagttgagaagcttactaaggagcattacaagaaatgcatggaacaaaggttcaaggaaatggtggaaagtaaaggtcttgaggctgtccaaactgagattgatgatcttgattgggaaagcactttttacttgaaacatcttcctgtttccactgtgtgtgaagttccagacttggaggataaatacagaaatgtaatgaaggatttcgcgttgaagctggaaaaactagctgaagatcttcttgatttgctgtgtgaaaacctcgaactcgagcaaggttatttgaagaaagtattttatggcttaaagggtccaacttttggtaccaaagttagcaactatcctccttgtcccaagccagaactgatcaaaggcctacgcgctcacactgatgctggtggcctaatcctgctggttcaagacgacaaagtcagtggtcttcagttactgaacgatggcaaatggattgatgtcccacctatgaaacactcaattgacatcaaccttggcgaccagctcgaggtgataacaaatggaagatacaagagtattgagcacagagttatt

SEQ ID NO: 3081 - DNA, 655 bp, Artificial
  Synthetic
cccacgcgtccgcttcatatcttcttattcatacactaaataaaagcacatttcttcaattcattctgcaagaaagatggagaatttcccaattatcaacttggaaaaattaaatggttctgaaaaagctgccaccatggaaatgattaaggatgcttgtgaaaactggggcttctttgagttggtgaaccatggaatcccacatgaagtaatggacacagttgagaaattaacaaaagggcattacaagaaatgcatggaacagaggtttaaggaattggtggccagtaaaggtcttgaaggtgtacaagctgaggttactgatatggattgggaaagcactttcttcttgcgccatcttcctgtttctaacatctctgaagtccctgatcttgatgatcaatacagggaggttatgagagattttgctaaaagattagagaatttagcagaggagctcttggatttgctctgtgaaaatcttggtctagaaaagggatacttgaaaaaggtattttatggatcaaagggtccaaattttgggactaaagttagcaactatccaccatgcccaaaaccagatttgattaaaggactgcgcgcccatacggacgctggtggcataatccttctcttccaagatgacaaagtaagc

SEQ ID NO: 3082 - DNA, 726 bp, Artificial
  Synthetic
aacaaataaatcaaggtttcgcctcgctgattccagtctagaaaccactgactcgccgctgcttcgtaagatcaagcaagtgtacaatcatctcattctctatctacttattagtcatggggaaaagaagcgaaagtgaaagcggctcaaagccggagcgggaagaatctcacggcgcaccggctgagcttccgcaagaggtgatccctttcgacccggtgccgacatacgaagaatcgaggccagggccatcggattcggcctcactttccgtctcccattcactctctgccacagtctcggcatcaacaccgcagccgccggccggaacctcagccctggccccaaccgttacctcgccatttaatttccctaccgatggcaaaggcaaagacggctccgtgaatgctcctccaccagtctacaaggtcgggtcatccagtagcagctccagcgccgcccgaaccattgcctttcctcagatcaaaccagatccagactcgcctttcctggtggcctatgcccctgttcttctcagctatggcatcaccgaagaaacatggcggtctttcatgaccaccatctcggctttcctgacggccaccatctcagatcgtgccctatcacatgccaccgatgtagctgctcacattggccaaaatcccaaaaacttgggcagaaatgttgctgcccatgccaaatccatcggcaggaacgtgtcggaca

SEQ ID NO: 3083 - DNA, 657 bp, Artificial
  Synthetic
ccccccccgggtgcttttgcttcggtcgcccggtcagtgctgcagacaagccacccccttcctcgcgtagactgctccccccacaaacaaaagcaatcctaatctcggattcgaggcgaacgagcggcggcgagggagggggactagcggcgatcgcgattggagtcgggtggacaccgatcgcggcggcgctctgggggatcggggtgtggaatcgagggggagggaggaggagacggaggcgatggggcggctgttcgtgatgcacctggaagggaaggtgtacagctgcaagcactgccacacgcacctcggcctctcctccgacatcatctccaagtccttccattgcaagcacgggaaggcgtacctcttcaataaggttgtcaatgtgacttctggagtaaaagaggatcgcatgatgataaccggaatgcatactgtgtctgatatcttctgtgttggctgcggatccattgttggatggaaatatgaagctgcacatgagaagagccagaggtacaaggaagggaaatttattttagagaggtataaggtgtctggtcctgatggcagccactactttgttacacatgatgctcatgttgggggaagcgacgtggacgacgtatgaagcacaactcgacatgctcaagc

SEQ ID NO: 3084 - DNA, 602 bp, Artificial
  Synthetic
  misc_feature (158)..(158): The residue at this position can be any nucleotide.
gagagagaaagagagaggagcatagcaaagccaagccaagagatagatagatagatagatagatagatagagagacagcataaccaaaccaagccaagagagagagagagaggagcatagcaaagcaaagccaagcctccttcatgggtttccctggntgaaaggtatccatttttttcctagagtgggggagatatcataattatacatatgggaaggctgtacttagtgcagctggaaggcaaagtctatggctgccgcttctgcaagagtcacttggccagctctagcgagttagtctcaaagagttttcattgtaagaatgggaaggcataccttttcaatacagtagtcaatatttcccaggggcctcaggaagaccggatgatggcaacaggactacaccgggtttctgacatcttttgcaaaggctgccatcagcttgttggctggaaatatgaagctgcatatgaagagtgtcagaagtataaggaagggaagtttattttagagagtacagagcaaggacaatagatggagatggtactcaattcttcttggatgtgagtcaaggcagcagtgatggagaggaggcctgatac

SEQ ID NO: 3085 - DNA, 777 bp, Artificial
  Synthetic
tctttcgtcgctgcggcgcgtcttctctcgatctccaggtgatagagggccgccgtcatgtctgcgcgcaagaagatccagaaggaggaggggaaagagccggattctttcgagctcacggttgcccaggctctgtctgagctggagggcgcaaaccaggagcttcgaggagacctgcgcgacctctcgatcaattcggcgatggaggttgatgtctctagcaaccgcaaggccgtcgtgatcaacgtaccgtaccgcttaagaaaggcgtaccagaagattcaacccagactggtgcgagagcttgagaagaaattcagcggcaaggacgtgatcttgatcgcaaccaggcgcatcctgaggcccccgaagaagggcgccgccgtgtctagaccgaggagccgaactctcaccgctgtgcacgacgccatccttgaggacctggtctaccccactgagatcgtcggcaagcgcatccggtaccgcttggatggctccagaattctgaaggtttaccttgacccgaaggaacgcaacagcaccgagtacaaggtggagacgtactcgggcgtctacaagaagctgactggcaaggatgtggtgtttgagtttcccgtgcaagaaacggcctagactcgtaatggagcatttcccttttttttgctctgatgagtggcttaagcgctaaaaattttgacttttggttcttaagtggggtttccagtttcgggccggtttgacggcttctcgaatacatggttttccattatgggcgtc

SEQ ID NO: 3086 - DNA, 761 bp, Artificial
  Synthetic
cacacacacacacaccagctctgtagttgcctcttacccgcagatctgtgaagatgtacacgtcaaagcaaaagattcacaaagataaagatgctgaacctactgagtttgaggagtctgttgcgcaggctttgtttgatttggaaaacaccaatcaagagctgaaaagtgaattgaaggacctatacatcaattcagcagctcaaattgatgtgtcaggaaacaggaaagctgttgttatccatgtgccctacagactgaggaaagctttccgcaaggttcatgttcgccttgttagggagttggagaagaaattcagtggcaaggatgtaatttttatcgccactcggaggatagctagacctcccaagagaggttcagctgctcaacgaccccgcagcagaactcttacttctgttcatgatgccatattggaggacttggttgttcctgctgagatagttgggaagcgcactaggtatcgcattgatggctccaagataatgaaggtgttcttggaccccaaggaacgcaacaacaccgagtacaagttggagattttttcagccgtttacagaaagctttcaggcaaagatgttgtgttcgagtaccccatcactgaggcataaggaaacaaaatgcttatcttcatcaatttgatgtgaaactacagtttagtggttcctttgaaattttgacaatttcattttgtttagaatgcagagaaccatgtgaagtttctattgattttcacttataac

SEQ ID NO: 3087 - DNA, 537 bp, Artificial
  Synthetic
acccacacacaaccatgtctgccgccctcaagatcatcaagcaggacccctccgagctcgagctccaggtcgcccaggcctttgtcgacctcgagaactcctctcccgacttcaagtccgagctgcgacttttccagttcaagtctgcccgagagcttgaggtttctgccggcaagaaggccctcgttatctttgtgcctgtccccgccctccccgctgtccacaagatccagcagcgactcacccgagagctcgagaagaagttctccgaccgacacgttgtcttccttgctgagcgacgaatcctccccaaggccggccgaaaggctctgccctctcagcctcgacccatgtctcgaaccctgaccaaggtccacgaggctctcctcgaggatctcgttttccccaccgagatcattggcaagcgagtcaagtaccaggttggtggcactcgaatccagaaggttttcctcgactccaaggactccaccttcatcgacaacaagctcgagtccttccagtctgtctacaacaagc

SEQ ID NO: 3088 - DNA, 648 bp, Artificial
  Synthetic
gctttgcataggcttagcgtgcgttagagcaggccattcacaaacaaggtaggaagctgtatcgagcattcgccatgtttactgctcatcggaaaatccagaaggaagcaggccatgagcctgatgagttcgaggagactgtggctcaggccttgtttgatttggagaatagcaaccaggagctaaggagtgatttgaaagatcttcatattaactctgccaagcaagttgatatttctggtggtaggaaggctgtggttattcacgtgccttacaggcttcggaaggcattcaaaaagatccaccccaggctggttagggagctggagaagaaatttagtggaaaggatgttgtggtgatagccacccggcggattctccggcctcctaagaagggttctgcaatgactcgtccccgcagcaggagtctgacctccgtgcatgaagccatccttgatgatcttgtacatcctgctgaggttgttggcaagcgagtccgctttcgccttgatggctcccgaatcatgcgggtatacctagatcccaaggagagaaacagcacagaagccaagcttgagacctttagtgcggtctacaagcgccttactggcaaagaggtcgtttatgagtaccctgttcaggaaactg

SEQ ID NO: 3089 - DNA, 768 bp, Artificial
  Synthetic
tggtatcaacgcagagtggccattacggccggggggatcttctgtcagagcaagtgattccggcacactcacagatctgtccgctgttgccgaacactcagagatctgtgaagatgtatacatcaaggcaaaagattcacaaagacaaagatgctgaaccttctgaatttgaggagtccgttgcacaggctttgtttgacttggaaaacaccaaccaagagctgaaaagtgaattgaaggatctatacattaattcagcagctcaaattgatgtgtcaggaaataggaaagctgttgttattcacgtaccgtacagactgagaaaagctttccgcaaggttcatgtccgtcttgttagggagctggagaagaaattcagtggaaaggatgtaatcttcattgccaccaggaggatagtgagaccccctaagagaggctctgctgcccagaggccccgcagcaggactcttacttctgttcacgatgctatattggaggacttggttgtaccagctgagattgttgggaagcgaactagatatcgcattgatggatccaagataatgaaggtctacttggacccgaaggagcgcaacaacaccgagtacaagctggagaccttttctgcagtttacaggaagctttcaggcaaagatgttgtgttcgagtaccccatcacagaggcttaaaacatacaaaatagtggtcttgatctctttgacgcagaactataaattagtggctactttataaaaatttggcatttaa

SEQ ID NO: 3090 - DNA, 530 bp, Artificial
  Synthetic
agaagggttctgcagccactcgcccacgaagccgaacccttacttctgttcatgaagccattcttgacgacttagtctaccctgctgaggttgttgggaaacgtatccggttccgccttgatggctctcgaatcatgcgggtgtacctagatcccaaggagagaaacagcacggaagcaaagctcgagacattttcagcagtttacaaacgtctcaccggaaaagaagttgtcttcgagtaccctgtccaagaaactgcttgaggcacccttcttgcacatttttgaatgtgaggtagttgagctagataactttgaatggcatctttccctaattttgccatcaatttatgatgatgagtcatcatcatcctcttttcaacatgcattttatagatgttcaaaatcctacttaatatttactcggcaatatttttcttaatgatccatcgaactgttctttagttagtgtgcctaatgttattgttgctaccaagtttcttctcaatatatcaaagagttcgtttggga

SEQ ID NO: 3091 - DNA, 509 bp, Artificial
  Synthetic
ctcccgttgagcatcaccagtcaagatgagcgccattaacaagatcgccgccaacagcccctcgaggcaaaacccctccgagcttgagcagaacattgctcaggctctcttcgatctcgagaccaacactgccgacctcaaggttgccctgcgacctctgcagatcgtctctgcccgtgagatcgaagttggccacggcaagaaggctattgtcatctttgtccccgtcccttccctgcagggcttccaccgtgttcagcagcgcctgacccgtgagctggagaagaagttctccgaccgccacgtcctcatcctggcttctcgccgcatcctgccccgccccaagcgctctgcccgctcccgcaacacccagaagcagaagcgccctcgttcccgcactctgactgctgtccacgacgccatcctggctgatctcacctaccccgttgagatcgtcggcaagcgtatccgcaccaaggaggacggcagcaagaccctcaaggtcatcc

SEQ ID NO: 3092 - DNA, 674 bp, Artificial
  Synthetic
cccggccgcctccgaatcgtagcgccggcgctgccagtgtccctcgctctcgcatcttctcctcgcgcccaggggccaggtaagcgaagatgtacaccgcgaggaagaagatccagaaggagaagggcctcgagccctccgagttcgaggactccgtcgcgcaggctttctttgacctcgagaatggcaaccaggagctcaagagcgagctcaaggacctgtacatcaacaatgcagtccagatggatattgccgggaacaggaaggctgtggtgattcacgtgccgtaccgtctgcgcaaggcattcaagaaaatccatgtcaggcttgtcagggagctcgagaagaagttcagcggcaaggatgtggtgattgttgcaacaaggaggattgtgaggcctcccaagaagggctcggctgttcagcgccctcgcacaagaactcttaccgctgttcatgattgtatcttggaggatgtagtctacccagctgagattgttggcaagcgcatcagataccgtctggatggtgccaaggtcatcaagattttcttggacccaaaggagcgcaacaataccgaatacaagcttgagaccttctccgcagtctaccgcaggctttgtgggaaagatgttgccttcgagtaccctatgactgaaactgcttgaagatgc

SEQ ID NO: 3093 - DNA, 895 bp, Artificial
  Synthetic
ggagcgcactgcgaagcgaacccttctccgccgcctccgctcttcgctgcacggtgctagctcgccgccgtccgtctcgcgcgcctcaagggttatcacaagatgtatacagcaaggaggaagatccagaaggacaagggtctggagccaactgagtttgaggacactgttgctcaggcattttttgaccttgagaatgggaatcaggagctgaagagtgacttgaaggacctttacatcaatggagcagttcagatggatttacctggcaacaggaaggctgttattattcatgttccatacaggctgcggaaggcatataagaagatccatgtgaggcttgttagggaacttgagaagaaattcagtgggaaggatgtggttctggttgcaactagaagaatagtgaggcccccaaagaaaggctcagctgttgttcgccctcgtacccgcacacttactgctgttcatgatggcatcttggaggatgttgtgtatccagcagagattgttgggaagcgtgtcagataccacttggatggtagaaaaatcatgaagatcttcctggacccaaaggagcgcaacaacaccgagtacaagctcgacactttcagctctgtctacaggaggctctgtgggaaggacgtcgtgttcgactaccccatgaccgagactgcgtaaaccatgtcatagttagtcgacggctatctttggccgcaaatgctgctactcttcctaaaatagactataactgtggtttcctatatgcgaaaagttttgacagtcctgtgatctgcatatctgattgctagaactggtttaaattgttcaggtgttttccaactgcagttgtagaacttgttgctatgttcaatggtagtattttcaacgtgcg

SEQ ID NO: 3094 - DNA, 587 bp, Artificial
  Synthetic
atcttctcgcgctcaggggccaggtaagcgaagatgtacaccgcgaggaagaagatccagaaggagaagggcctcgagccctccgagttcgaggactccgtcgcgcaggctttctttgacctcgagaatggcaaccaggagctcaagagcgagctcaaggacctgtacatcaacaatgcagtccagatggatattgccgggaacaggaaggctgtggtgatccacgtgccgtaccgtctgcgcaaggcattcaagaaaatccatgtcaggcttgtcagggagctcgagaagaagttcagcggcaaggatgtggtaattgttgcaacaaggaggattgtgaggcctcccaagaagggctcggctgttcagcgccctcgcacaagaactcttactgctgttcatgatggtatcttggaggatgtagtctacccagctgagattgttggcaagcgcatcagataccgtctggatggtgccaaggtcatcaagattttcttggacccaaaggagcgcaacaataccgaatacaagctcgagaccttctccgcggtctaccgcaggctttgtgggaaagatgttgcctttga

SEQ ID NO: 3095 - DNA, 637 bp, Artificial
  Synthetic
ctcaaactaaacgtagctagggtttcccgccggcgctgttccttgcctttctctcacagatctgtgaagatgtacacgtccaggcaaaagattcacaaagataaggatgctgaacctactgaatttgaggagtttgttgcacaggccttgtttgctatggaaaacaccaaccaagagctgaagagcgaattgaaggacctatacatcaattcagccatgcaaattgatgtgtctggaaacaagaaggccgttgttctccatgtcccctacaggctgagaaaagctttccgcaagatccatgtccgccttgttagggagctcgagaagaaattcagtgggaaggatgtaatcttcattgccacccggagaatagcgagacctccaaagagaggttctgctgctcaacggccccgtagcaggactcttacttctgttcatgatgccatattggaggatgtggttgtacctgctgagattgttgggaagcgtgttaggtatcacgttgatggatccaagataatgaaggtattcttggacccaaaggaacgaaacaacaccgagtacaagctggagactttttcagctgtttacaggaagctatcgggcaaagatgttttgtttgagtaccccatcactg

SEQ ID NO: 3096 - DNA, 705 bp, Artificial
  Synthetic
tctccattctggctttgcataggcttagctgcgttagagcaggccattcacaaacaaggtaggaagctgtatcgagcattcgccatgtttactgctcatcggaaaatccagaaggaagcaggccatgagcctgatgagttcgaggagactgtggctcaggccttgtttgatttggagaatagcaaccaggagctaaggagtgatttgaaagatcttcatattaactctgccaagcaagttgatatttctggtggtaggaaggctgttgttattcacgtgccttacaggcttcggaaggcattcaaaaagatccaccccaggctggttagggagctggagaagaaatttagtggaaaggatgttgtggtgatagccacccggcggattctccggcctcctaagaagggttctgcaatgactcgtccccgcagcaggactctgacctccgtgcatgaagccatccttgatgatcttgttcatcctgctgaggttgttggcaagcgagtccgctttcgccttgatggctcccgaatcatgcgggtatacctagatcccaaggagagaaacagcacagaagccaagcttgagacctttagtgcggtctacaagcgccttactggcaaagaggttgtttttgagtaccctgttcaggaaactgcttaggtggctataatcccgaaaggttatttttttgtcttgcgcccg

SEQ ID NO: 3097 - DNA, 346 bp, Artificial
  Synthetic
gattcacggcgacatccgctgaatatcccggcacgcgcttgaaccaggacgtggattggaacctagaggcggcgaaagtcagagcagccagttgcgtctttcttgggagccttgcgcaaggctcttcaatccctcaccatggcgtcgtctctccccaccgagctcggcagcaccatccaggccggccatatcagaagacatcccgaccctcgacaagacattgcgccatcaaccgccgccgacaagaggcagctggtggatttccacagcgcgagacgcggtgatatcgacaacgacgacgacgatatcccgtacagcgtcttgcgtcctccaaagaagcactaca

SEQ ID NO: 3098 - DNA, 317 bp, Artificial; identical to SEQ ID NO: 912
  Synthetic

SEQ ID NO: 3099 - DNA, 609 bp, Artificial
  Synthetic
aaaccaccgtcatcatgcctccagcaagctactcgcgcccgccacaacacgactcgtggttcgcgcctctatccgtcgacctgatcctcaaggttctcaacgtcaccatcttccatcccttcatctgctggctgatcccgctgtgcctgcgcgcccagacgaccaaatgggaggcgccgcccatggtgggcgccattgcctgggccatcttcatctcggccatgtggatcgcgagcgcggtcaaccagcgcattgccaacggcgcgccgcgcgaggtggacctgggcgaggaggtgattgtggtgacgggcggcgcgagcgggctgggcatgctggtggccgaggtgtacggcatgaggggcgccagcgtggccgtgctggatgtgaacgagatggagaatggcgaggcgaggggcgtgacgttttacaagtgcgatgtgagcgacaaggagcaggtggccaaggttgccgttgagattgagaaggatctcggtacgcctactgtgctcattaacaacgctgctattgtcgtgggcaagccgctgctggacctctccatcgatgagatcgagaccagcatcggcaccaacctcctcggccccttctact

SEQ ID NO: 3100 - DNA, 543 bp, Artificial
  Synthetic
ttgaccgaaagccgtctttaaccctccccccagctgcacgaaagcggaggataggcagccggaacggagatctcttcccaaagctggaccaaagggcagggcgcgccaagtacggagcttgtgcactgccgtcccaagtacctggcagcctggcagtacctcggacgcacgctgcctgcccctcaccacgcggagtatccaggtacctcggtgtgcaggtgcaggcagctctccctgtcctgcaggaaaatgcaggatagaggaaagacccggagacaagtctggtgattctggtgattccatcctgccgggggtcaggtttttacataaggcactctcgacttccatcttatttccccactcgatcccgatctctctctctcttgcaccagcagggaaggagtgggcgaccccgaaaaaaaaaacaattagaaaaaaaaaaagaaaaaaagaggcgaacgaaggaacgagcgaacgagcgtcgtcgagaaggcgcgaacaaggagaacggagcctgcggggtaccttggtggacttcctgac

SEQ ID NO: 3101 - DNA, 625 bp, Artificial
  Synthetic
aattgacgaccaccagcgccgccagaatgttcgccgcacgatcaagggcagtctgcgccgcccgccagctgcagcggacaacccgaacctacgcctccgagtcccacggccaccactcgcccgctccggtcaacgagtcctttggggccggatctgttattgccctgggcgctttcctgggcaccgtcctagtctaccagttccgccccacggagagcgacaactggacgccctctgccctgctcaacaagtatcgatcaaaggccgaggactgggaggccgtcaacactctgcacacaaaggccatggagcaggccggctatgacaggaatctgttcgagaacggctccaacaagcaccgatttgtcgacgtcgcataccccgaagctctccaatcccacgccgcgcgaaacatccaggccggccaccttgccaacattgaccatgctgtggaacactaccgacagcagcacctgaagatggaggagaagaaggcggccaagctggcggctgccaaggcagagtagttgcagttgctacagtatatccaatttatagaacaaagtttgcaacacattggggccaattcaatgcgtgataatgattccagttgccggatgtacct

SEQ ID NO: 3102 - DNA, 1040 bp, Artificial
  Synthetic
gaaaactcaaaattaaattaaacataaagacaggctcccaaaaggctgtgacctcttcttattacatctttacaagcctccatagcgtaagattccctccacaagggtcgggctgattttatcctgtcggaataatcacttgcgtaattcgacgtcgtttcgctcgcttcttacggcaagcctacaaatcccattccggcagcgagctcgcctggcgcgtgccaaaatacgacgaccgaaaacaccaagtgcatgtgccaacggtgattggatttgtgcgctccgagatacccaaaccaaaagtacatgttaggatgcacgcgaccacgccatgatcggcgcttgatcacgggcccataatcgagagagaggcgccgctaccggacgatagaacggagggaatagacagatagacgatagacgggacgagcgatcgatcaagtcagagacaacaaataccgagtggcgatgccttcatccgatagtcttgggaggcgggcctcacacggcgctgccagcctggcgacgtcggcatcttctatacacggcgcagcagttgggtttcgagaaggcctgggcttggctggagttgcgaggaggacgttgggaatctgctttctgctattgacggtgtttctatggacgctgtccaactttctcgccagctttatcttttccgatgcaacctacgataagcccttcttcctcgtctacttcaacacctccatgttcgccatctctttaatacccatgtttgtacgatatctgctccagaaaggattccatggcctacgaagcgacgtcaggcgcatgtgggcggagcatcgataccaagccgccccaggcagtcccgcgatagataaagaagatcacctagctcaagaacgcttgctagtagacgaacgagaccccatggcaccaacctcgactccttcaaaagagaagctcagcttccgagaaaccgcagtactgagccttgagttctgcatgttgtggttcctcgcaaactattttgcgtctgcatgtctcgagtataccag

SEQ ID NO: 3103 - DNA, 702 bp, Artificial
  Synthetic
gatgcctgcattgtctttggtaacgcatgggcctgcgaaggatacgaccgtcctgctatccgagatgattatacagactccctcatcaagtcagtggctgaccagtgcagcaagaccgttgttatctttcacaacgcggggcctcgattggtagacggttttgttgatcatccaaatgtcacagcaatcatctttgcccatttgccaggtcaagagagcgggccagcactcgcttcactactctttggggataccagcccttccggcaagcttccgtacacagtggcgaagaatgaatctgattatggcgatgtcctcgatccagtacagccagaaggcgaattcgtcaactttccccaggccgatttccacgaaggagtttatcttgactatcgctactttgacaaaaagggcattgaacctcgatacgagttcggctttggacttggttacacgacctttgcatattccaacatatccatcaactatattcagggggcaaacacgtatccatggccgggcggccctattgtcagcggcggacaaacggatctatgggatgcaatcgccaccgtcagcgtaaacatcaagaatacaggcagcgttgctggtgccgaagtggcgcagctctacattggtattccaggggctccggcgaagcagcttcgcggctttgaaaagccctttttgcagcctaatgag

SEQ ID NO: 3104 - DNA, 92 bp, Artificial
  Synthetic
gcaactcagcatccaacagcatctccaaacctctactccttaatctccaatcctctagtcttcaagaaaacccaaaactccattcaaaatga

SEQ ID NO: 3105 - DNA, 666 bp, Artificial
  Synthetic
acaactcagcatccaacagcatctccaaacctctactccttaatctccaatcctctagtcttcaagacaaaccccaaaaactccattcaaaatgaagttcttcactgttgccaccgtcttctttaccgctgtcctcgctgccccaggcggctactaccctcctcctcctcctcctacctataccctgcctcccaatggcaacggcaacggcaacggcaacggcaacggcaatggcaatggcaacaccaacactggcggttctgccctgtgcccttctggcctctactccaaccccaattgctgcgccaccgatgtcctcggcctcgctgatctcgactgcagcgttccttccacaactccacacgatggcgctgctttccgaagcatctgtgcggcgactggcaagagagctcgctgctgtgttctccccgttgctggcgtagctgttctttgccaggaccccattggcgccaattaaaaggcatcgccaatatgactcacgaggtcctttgatgaatgtgttattgcacatggctcggacctacggtatcaacactgaacactgacttgaacatatgagtcgtgagcttttggatatatggaatatgacggttacttatcttctatctaagttggatatagatttgtatacacatgacgtactta

SEQ ID NO: 3106 - DNA, 474 bp, Artificial
  Synthetic
gcttacatattacaaactgtcctcttacatattacaaatatccaacatagacagtagacagtatcaacgccatgacccgaattgcagagcccacgccacttcccccctcagctcccataaacggcagtgagaaacaccaagaccaaccccgagatgagcacaaggaaaacttgggcaccttctccgtgccaaacatccagctccagatccgggacctcaagcaccccggctcaaagcgcttcctcggcgccgtcaacgcaaccgatctcctcaccacaggcactctgaacgtcctcaagctcttgtacaacactcccccaaacccggagacgaccgttccgccaaccagctccgtgacgctcgtcctcgaggatatgcccggcgtggcctacacagtcggccataacgacaataacaacatcaaggaaatccacttttcgctctcgtacattgcgcaaatcaacgcttctcgcg

SEQ ID NO: 3107 - DNA, 813 bp, Artificial
  Synthetic
tgagcgtcgcattccgcacaaggaacgagaacaaagaacaaaccgatagcttcaaagttaccggccaacattgcgacgcaaccacaaaggggaggctttgacactcaactttctttgagctccacccggcactaggcggaagaggcgcgtctaactgaaaaaagaaaaaagctttttttctccgagcagtgttccctctcgctttctctctctcgcgcggacaacggaacgaatcgaaacagcctcgtctttgtccaagctccaagctccaagctccaaagctcagcctcgcatccgcccgccatggacgccgtccggtctctcgtccagcccatcacacacaacctgccggcccccatccgggacctaggcgtgtcgatcgtgggcgaaacctgctacaaggcgctgctactcgacgtcgacgtcgaaaacacggaatgcatcaagctggccatcagcaagggcctgggcatcggcatcgtcggcgcatcggccgtcgtcaaggtgccccagatcctcaagctgctgcggtccaagtccgccgagggcgtgtcctttttgtcgtacctgctggagacgagcgcgtacctcatctcgctggcctacaacgtgcgcaacggcttcccctttagcacctttggcgagaccgcctttatcatgggccagaacgtcgtcatcgccatgctcgtcctcaactacagcggccggcccgccacggctgcgctgtttgtcgccgcgctggctgtcagtgcggcggcgctgtttgcggacaacattgtggatatgcaggctttgagttacctgcaggctggt

SEQ ID NO: 3108 - DNA, 623 bp, Artificial
  Synthetic
atcgagtaggaggatctctgagggatatggcatccaagagaattctgaaagagctcaaggatctgcagaaagatcctcccacctcttgtagcgctggcccagttgctgaagatatgtttcactggcaagcaacacttatgggtccatctgacagtccttatgctggcggagtgtttcttgttaccattcattttccacctgattatccatttaagcctccaaaggtagcttttaggacaaaagtttttcacccaaacatcaacagcaatggtagcatttgcctcgacattttgaaggaacagtggagcccggcactcacaatatctaaggtgttgctgtccatctgttctcttctaacagacccaaatcctgatgatcctttggtgcctgagattgctcatatgtacaagactgataaaagcaagtacgaagccactgctcggagctggactcaaaaatatgccatgggttagttgctgaaacacaaatatttggcttttatctatgatgtattaagaaattgtgttatgcataattaactcaagggaaaggttgaattgtggccctctgtaaaacacttaattttcctcatgtttgtaagattaaatggttttgaaattctg

SEQ ID NO: 3109 - DNA, 809 bp, Artificial
  Synthetic
aggggggagagttcctgacctttcgtagccacgtttcttttcttctctctctctctctctctctctctctgtctttcgctttctctctctcctctcctttcctcttttccttctcattgttctcaaactacacccgctctctctccccttctctccttctctctctctctctctcttttgggtgccttccttgcgtatcgggaggagaacggaagaatggcttcgaagcggatcctgaaggaactgaaggatttgcaaagggatcctcccacttcctgcagtgcaggtcctgttggggaagatatgtttcattggcaggcaactatcatggggccaactgatagtccttatgccggtggcgtcttcatggtcactattcatttccccccggactaccccttcaagcctcccaaggttgctttccggacgaaagtgttccacccaaatatcaacagcaatgggagcatctgccttgatatattaaaagagcaatggagtccagcccttacaatatcgaaggtcttgctttcgatttgttcacttctcactgatccgaatcccgatgacccccttgtgccggagattgcacacatgtataagacggatcgagccaaatacgaaggtactgcaaggagttggacacagaagtatgcaatgggttgagttgagtctttcttcactcaattgctactcgctcttaatatatcccccccccttgatgtaataaatatatgttggcagacaagttaaaatatcggcatacaaaaagccgtgtttctgaatgatcttgtttcaaaactgaatgaatg

SEQ ID NO: 3110 - DNA, 625 bp, Artificial
  Synthetic
cccacgcgtccggtcgttgcttaattactgttcattcacaggaggatcctaatctctttcaggagtcgctatggcttcaaagcggatcttgaaggagctcaaagatcttcaaaaggatcctcctacttcgtgtagtgctggacctgttgctgaggacatgtttcattggcaagcaacgataatgggtcctccagatagtcctttttctggtggtgtttttctggtgacgattcattttcctccagattatccattcaagccacctaaggttgctttcaggacaaaagttttccacccaaacataaacagcaatgggagcatatgccttgacattttaaaggaacagtggagccctgccctaacgatttccaaggtgttgctttcaatatgttctcttttgacggacgccaatcctgatgatccgttggtcccagagattgcacacatgtacaagacagacaggaacaagtatgagacaactgcaaggagctggacccagaagtatgccatgggctaaacgtacctttgtatcatggggtcaagggcattttactttcagatacttcactatttacattcaatgtactaatctgttctttgagttgtaacatggagtccatgtctt

SEQ ID NO: 3111 - DNA, 669 bp, Artificial
  Synthetic
gtacaaatgtcttctctctctctctctctctctctcgttcctttcgtttctttgccttccctataacggcggtggctatttaagaactccaagtagcagaagttatagttgaagagggatctggatctgaatctgaatctgtgtcatggctagcaagaggattttaaaggaactcaaggatctgcaaagggatcccccaacctctatgtagtgctggtcctattgcaaatgatatgttccattggcaagccactatcatgggtccctttgatagtccatatgctggaggagtttttctggttaccattcatttccccccagactacccatttaagcctcctaaggtgtccttcaaaaccaaagtcttccatccaaatgtcaatagtaatggaagcatttgccttgacatcttgaaggaacaatggagtcctgctctaacaatagcaaaggtcctactctcgatatgctctcttttgactgatcccaatcctgatgaccctctcgttccagaaatagcccacatgtataaaacagacagggcaaagtacgagacaactgcaaggagttggaccttgaagtatgctatgccctaaataaagctcacctcttgccttgcatatagttgaggtatatatattatatatatacacacacgttattacatatgca

SEQ ID NO: 3112 - DNA, 672 bp, Artificial
  Synthetic
ggttcaattctcgctaatcaggttaagactcatatttcttcgattgtttggttgggaatggcttcgaaacgaatattgaaggagctgaaggatctccaaaaagatcctcctacctcatgcagcgccggtcctgttggagaggacatgtttcactggcaagctacaataatggggccctctgacagcccttacgctgggggtgtatttttagtcactatccattttcctccagattatccattcaaacctcctaaggttgcttttaggacaaaagttttccatccaaatatcaacagtaatgggagcatatgcttggacatactgaaggagcagtggagccccgccttaactatttccaaggttttgctttcaatctgctcacttttgacggacccaaaccctgatgatccccttgttcctgagattgctcacatgtacaagacagacaaggccaaatatgaagcaactgccaggagttggacccagaagtatgccatgggctaactattgcctatggcggcttgaattgatataaagaaaaacaaatttcaatgtcctccttctatgctctctccattaacaagttgtataatagcattaagcattgccctctgcaggaagagactaatgatgctttgaattttgtttatataggtaataatattttatgcg

SEQ ID NO: 3113 - DNA, 609 bp, Artificial
  Synthetic
ttcccatctctctctttctctctctctaggtatggcgtcgaaacggatacagaaggagctgcaggacctgcagaaggaccccccgacgtcatgcagtgccgggccggctggggaggacctcttccactggcaggccaccatcatgggcccctctgatagcccctacgacggcggcgtcttcttcatcaccattcacttcccccctgactaccccttcaagccccccaaagtcagcttccagaccaaggtttatcatccaaacatcagctcgaacgggagcatttgcttagacattctaaaggaacaatggagtccagcgttgacgatttcaaaggtgttgttatccatctgctctctgcttacggatccaaatccagatgaccctcttgtccctgagatcgctcacatctacaaaacccagaaggctcgctacgaggagaccgcccgagcatggacccagaaatatgcaatgaactagttgaaaaatttccttacatatccttgcccacccttcaaactataataagcataaggtatgctttctatatatggaggctaatcgttattgtttctccgttgtctttctctatcatcaatcacagtttcttg

SEQ ID NO: 3114 - DNA, 529 bp, Artificial
  Synthetic
acgacaccaattttaaaaaatggctttgaagcgaatcaacaaggaactcagtgatcttggacgtgatcccccctcctcttgctctgctggtcctgttggccaggatctgttccactggcaggctactatcatgggaccctcagactctccttactccggaggtgttttctttctgtctatccacttccccactgactaccccttcaagccaccaaaggtgaccttcactacccgaatctaccaccccaacgtcaacaccaacggatccatctgtctggatattctcaaggagaactggtctcccgcactcaccatctccaaggtgctgctgtccatctgctccatgctcacagaccccaaccctgacgatcctctcgtgcccgacattggccacctgtacaagaacgaccgagcacgatacgacgccactgccaaggagtggaccaagaagtatgccgtctaggatgtatatagggagcaggcatgagcctatgcaagcgaatggctgtgacgatacaactagccaatg

SEQ ID NO: 3115 - DNA, 607 bp, Artificial
  Synthetic
acccacgcgtcgacaacaagaagaagaatcgagactgacgtcatgaagttgctaatgagcgactacgaagtgacgctggtcaatgatagcatgcaggagttttacgtgcggtttgaaggaccggaagaaacaccgttccagggaggaatatggaagatccacgtggaactgccaaacgagtacccatacaagtcgccctccatcggctttgtcaacaagatcttccacccaaatatcgacgagctcagcgggagcgtgtgcctcgatgtcatcaaccagacgtggtcccccatgtttgacatggtcaacatctttgaggtcttcctgcctcagctgctgcgatatccgaatcccagcgatcctctcaacggagaggcctcgggtatgctgatgcgagagcccaagcagtacgaggagaaggtcaaggactacgtgaccaagtacgccagcaacgactctgtgtcggcagagaaggacatttctgacgatgacgatctcagcagcattggctcgttttctgacgacgacgaggagcccgccggagagttggaagtctagtgcatatttatataacattaagagtgcgactgagagtcgtttactgtct

SEQ ID NO: 3116 - DNA, 604 bp, Artificial
  Synthetic
gaaccgaaccgaacgtccacgatcgatccccctgctgcaagctttatagccacgagagacgctactgcaagtgacgacgccgggagccacacacctcgagaggctcagacatactcagcatctcatctccacatctgcttcttataattgcccttccgggccagagagtcccttgacagttgcccatcatgagcagcccacgccgtcgaattgagactgatgtcatgaagatgttgatgagcgactatgaagtgacactagtgaacgataacatgcaggagttctttgtcagattcaagggcccggcagaaactccgttcgagggaggtctttggaaagtacatgtcgaacttcccgatacgtatccgtataagtcacctagtattggcttcgtgaaccgaattttccacccaaacatcgatgagctatctggctctgtgtgtctggatgtcatcaaccagacatggtcccccatgttcgatatgatcaacattttcgaggtcttcctgccgcagcttcttcgataccccaacccgacggaccctctcaacggcgaagcagctgctctgcttattagggagcccaaaagctacgacgcaaaagt

SEQ ID NO: 3117 - DNA, 659 bp, Artificial
  Synthetic
tacctaatagtattttacataggagcgtttctcgttcgcgtccattttcattttgcgtctacagcgaagcgatactcttccagcactacgcgatacccccttttgtctatactcacaccaccaaacgtagcgacaagcacagcgacgcaacatttacaatgagcgcaagaagcggagcgaaacgactcatcaaggagcttgagagctggcgcaaggagcgcaaggacgaaaagggcgtggagaggctgggtccgatcaatgaggatgatttattcgagtgggaggccgtcatcaacgggagggagattggatcgggctatgatgagggccgctggctcatacacatccaaatccccgcgcagtatcccttgcagccgcccaagatgcgcttcgtgacgaccattgtgcaccccaacattgcgctgcagtcgggcgagatctgcctcgacctgctcaaggacaagtggacgccgacgtacagcgtgctgcagtgcgtgcgcgccgtgcgcatgctgctgagctatcccgagacggacagcccgctcaacgtcgatgtcgcggcgctgcttagaggaggcgatgttttggggacgcgaaagctggtgcaatattggtgctcggagccggagggaagatatgatggcccgtaagggggtgtg

SEQ ID NO: 3118 - DNA, 627 bp, Artificial
  Synthetic
acaggaccgccatcagggactctgcacccccgatcagataaagcctctacctagcgctcaggacttgcagacggtcgccttgcatcgtctccaacgtccgcctaggatcttttgattctttctttgcctcctcgatccgagatcgatcttccaccacccttttagataccacataccctcatcacaatggccctgaagcgcatcaacaaggagctcaaggacctcggcactgacccgccatcatcctgctccgctggtcctgttggagaagatctgtttcactggcaagctacaatcatgggacccggtgattcaccatactcaggaggcgtcttcttcctgaagatccagttccctacggattaccccttcaagcccccgaaagtcaacttctccaccagaatctaccaccccaacatcaacagcaacggcagcatctgcctcgatattcttcgagaccagtggagccctgctctgaccatttccaaagttctcctttccatctgctctatgctgacagacccgaaccccgatgatccccttgtgcctgagattgcgcacgtgtacaagaccgaccggccccggtacgaggcgactgctagggaatggacccgcaagtacgccgtc

SEQ ID NO: 3119 - DNA, 752 bp, Artificial
  Synthetic
aagcctcttcgaccaccctctgccatcgtcagccttcgactctcttcaccaaacctcaacaagcgacaaattatcgccagggtgctccaacgctcgctccgccatcgccagtatcctttggacccatactttcgctctacaacacacacaacccctcttacgcccacatagcttcggctacgtcaagtttcggcatcatgtctagcagagatcgccgtataatgaaggagctgcaggatctgaccgaggacaaggacacttccggcattcatgctgccctagaacaagagggctcgctgaccgctctcaagggctggttctttggccctggaaatacgccgtacgctggtggcaaattcgtgattcacattcagcttcccaccgactaccccttcaagccacccaagatgaagtttgagaccaggatctggcatcctaatgtcagcagtcagacgggcgtcatttgtctcgacaccctcaacaagaactggtcgcctgtccaaacgatcaagacggctctcctctccgtccgaatgcttctcgaaaacccaaacccctcagatccacaggacggcgaagttgcacggatgctgctcgacagtcccgactcgtttgtccagatggctcacgagtgggcagtcaggcacgccggtgcgccgcgacagcgaaacctcgacgtaactatattcagaagcctggccagaccaacaactgctgtcgatgcgagccgataccatggatacaagccagtc

SEQ ID NO: 3120 - DNA, 666 bp, Artificial
  Synthetic
cccaactccattattgattcttgcaaggaggaagagcagctagaggcgaggcaagaaaagaagtgaaatctctccgttagacaggaagaggaaaagcaagggggaattggggatggcgtcaaagaggatacagaaggagctcaaggatctgcagaaggatccccctacatcatgcagtgcaggtcctgttggtgaagacatgttccactggcaggcaacgataatgggtccatctgatagcccatatgctggtggagttttcctagttaccatccacttccctcctgattatcccttcaaaccacccaaggtggcgtttcgcaccaaggttttccatccaaacatcaacagcaacgggagcatttgccttgacatccttaaggaccaatggagcccagcactaaccatttccaaggtgttgctgtcaatctgttccctgctgactgatccgaaccctgatgatcctctggtccctgagatcgcccacatgtacaagacagataggcacaagtacgagaacacagcaaggacctggactcagaggtacgccatgtagcacctcagatatcgatggacatgtcgatgttgtaacaacattatcaacgggtgtgtctccctctcgccttgtgtggtgtaaggatcaaaaccggctttgcagtgcactct

SEQ ID NO: 3121 - DNA, 552 bp, Artificial
  Synthetic
ctcgtgtccgctgcgaagaaaaggggcatatcatggcattgaagcggatcctcaaggaactaaaggacctgcagaaagatcctccaacatcatgcagtgcaggtcctgctggtgaggatatgttccattggcaggcgaccattatgggtcctccagatagtccctatgctggtggagttttcttagtgaatattcatttccccccggactaccccttcaagcctccaaaggtatcttttaagacaaaggtcttccatccaaacatcaatagcaatggaagcatatgccttgacattcttaaggagcaatggagccctgctttgaccatttctaaggtgttgctttcgatctgctcgctgctcactgaccccaacccggacgaccctcttgtccctgagattgcccacatgtacaagacggatcgtccaaagtatgagacgacagcccgcagctggacccagaagtatgccatgggatgatgaaacccacaagccctgaattcaaacctgctgcttaaatgcagacagtcgtggtaattgtcccatgaaaact

SEQ ID NO: 3122 - DNA, 707 bp, Artificial
  Synthetic
gaattcagcagctaacaacaataccccaataccaaaccctaacccttaatctcccgcagctgtataaaaccctaatcattagatcctgagaagaatcggagttttttctcacagctttttcttacggctgtgaggatgtcgaccccttcgaggaagaggttgatgagagatttcaagagattgcaacaggatcctccagcaggcatcagcggtgcaccgcaggacaataacataatgctatggaatgctgttatatttggcccagatgatactccctgggatggaggtacctttaagttgtctctgcagttttcggaggactatccaaataagccaccaacagttcggtttgtttcgcggatgttccatccaaatatctatgcagatggaagtatttgcttggatatcttacagaatcagtggagtcctatttatgatgtagctgctattctaacttctatccagtcgttgctttgcgacccgaacccaaattctcctgctaattctgaagctgcaagaatgtttagtgataacaagcgtgactacaacagaaaagtacgcgaagtcgttgagcaaagctggacagcagattaactgctcatccctaacatgtggatgtcatttgacttattctgtaaagtttgaagtctacgtaagtaaacatttccacttgaaaacaattgtaatacagacataagagttatata

SEQ ID NO: 3123 - DNA, 599 bp, Artificial
  Synthetic
gaattcaaaaagactataaaatccaatcaacctctccaattcccggaatcctccttcctcctccggtttcttcctttttcagagcaccgagttcctctggatcctctctcctggtttcttcaaataccctttggtttttttcctttacccctcttgtaaaatctagggtttcgagagaaaaaaatcttcagagaggatggcctccaaacggatcttgaaagaactcaaggatcttcagaaagatcctcctacttcttgctccgcaggtcctgttgccgaagacatgtttcactggcaagcaacaataatgggtcccccagacagtccatacgcaggaggagtctttctagttactattcatttccctccagattatccattcaagccaccaaaggttgccttcaggacaaaggtattccaccctaatatcaacagcaatgggagcatctgtcttgacatcttgaaggagcaatggagccctgccttgaccatttccaaggtgttgctatccatttgctcattgttgacggacccaaacccagacgatcctttggtgccagagattgctcacatgtacaaaaccgacaggagcaagcatg

SEQ ID NO: 3124 - DNA, 694 bp, Artificial
  Synthetic
cccgcacttcttccaacgtactggtgtactattattggcccaaaatcctcttccagctctgcaatctccgtctccgtcaattttcagtcaaccgaaatccaccatctttcattgttcatcaccttcaggttagggtttggatttgaaggtacaaggggctaattgatggcgtcgaagaggatattgaaggagctcaaggatctgcagaaggatcctcctacatcatgcagtgctggtccagtggcagaggatatgttccattggcaagcaactatcatggggcctacagatagcccttatgccggaggtgtatttttggtttcaattcatttccctccggattatcctttcaagcctccaaaggttgcctttagaactaaggttttccaccctaacatcaatagcaatggaagtatttgtctggatattctaaaagagcagtggagtccagcgttaaccatatctaaggtcctgctctccatctgctccctattgactgacccaaatccagatgatccacttgtaccagaaattgcccacatgtataagactgaaaggtctaaatacgagaccactgctcgtagctggactcagaaatatgctatgggataatggcaaaggtgtcaccaggcatgtctgagactttgtaactgcaatgtcttattgtgcttgtagtgaatgaataaattcggct

SEQ ID NO: 3125 - DNA, 621 bp, Artificial
  Synthetic
  misc_feature (573)..(573): The residue at this position can be any nucleotide.
tctttctctcctatctctctcctctctctctctcatggcttccaaaaggattcagaaggagctgaaagacttgcagaaggaccccccctcatcatgcagtgcaggtcctgttgcggaagatatgtttcactggcaggcaacaattatgggaccagatgacagtccttatagtggtggtgtgtttttggtgacgattcatttccccccagattatcccttcaagccccccaaggttgcttttaggaccaaggttttccacccaaacatcaacagcaatgggagcatttgcctggatatattaaaagagcaatggagtccagctctgacaatatctaaggtcttgctttcaatctgctcacttctcactgatccaaaccccgatgatcctctggtacctgagattgcacacatgtacaagatagacagagcaaaatatgaaggtattgcaaggagttggacacagaagtatgcaatgggttgagccttttttttcggcaaaagataacaacttttatcagtctatctcatatctaaaaagaatcggtttacaactttctgtttctgcatcttgtnggtccaaagctcaaatcacacgtgtatctttactttcatagccaagga

SEQ ID NO: 3126 - DNA, 690 bp, Artificial
  Synthetic
atcataagtggggcaaaaaaagggttcatggcgaaggcgcacgaatccactgcggcactccccttcttgatcgattaggtcagatcgaagtaggtcgatcgattgatagatagattggaaagggatcggcgaagatgctcgatgtgtcccgcgtccagaaggagctggtggagatcgagcgcgacaagaagctgtcgggcgtgagcattcaagtcttcgacgatgggttgagtcgaatgcgaggaacaatcacggggcctgttggcaccccctacgagggcggaatcttcaccatcgatattcagttaccttctgcttatcctttcgaaccaccaaagatgcaattcatgactaaagtctggcatccaaacatcagcagccaaaacggagctatctgcctggacattctaaaggatcagtggagtccagcgctgacgctaaagactgcgctactgtcgctacaagcgctgctttcgacgccggagccgggggaccctcaagacgcggtcgtcgcaaagcagtacctgagtgagtatccggttttcgagagcactgcgagatactggaccgaaacgtttgcaaagagatcgtcccttggcatggaagaaaaggtagcgaagctagtcgagatgggatttacggatgaggttgcgaccgctgctctagagtgctgtggcggcgacgagaatg

SEQ ID NO: 3127 - DNA, 651 bp, Artificial
  Synthetic
gggcggacgcgtggggggcgattagggtatattggctttgtcgcggctatggcgtccaagagaatcctcaaggaattaaaggacttgcagaaggatccgcccacttcgtgtagcgcaggtcctgtggccgaggatatgtttcattggcaagcgacgataatgggtcctcccgatagcccctacgcagggggtgtgtttttggtcaccatccatttccccccggattatccctttaagccccccaaggtcgcatttagaacgaaagttttccacccaaacatcaacagcaatggcagcatctgcctcgacattctcaaggagcagtggagcccggccttgacaatctccaaggtgctgctatcaatctgctcgttgctaaccgatccaaaccccgacgatccactggtgcccgagattgctcacatgtacaagacagacaggcccaagtatgaatcgaccgccaggaactggacgcagaagtacgccatggggtaagcccgggcttgtgagcggcggcggcggcggtggcggtggcatggctcgctatgatgtttgtgataccatttggttgcctatctataagttgaaagcagggattgtctttgattatggaattcttttgattactgtatatagaatttctatcacgtc

SEQ ID NO: 3128 - DNA, 631 bp, Artificial
  Synthetic
tctgactcctctctctctctctctttagatctctggtctccgtctccgtgtccgtctccgttactgtgtctgtctcccttccgtcgagatctgtggatcttatagcctagccctaaaggggaacagcaagctttggactttccatggcctccaaacggatcctgaaggagctcaaggatctgcagagggatcctcccacatcatgcagcgcaggacctgttggggaagatatgtttcactggcaggcaacaatcatgggaccgaatgatagtccatatgctggcggtgtgtttatggtgaccattcatttcccaccggattaccccttcaagccgccaaaggttgctttcaggactaaagtttttcaccctaacatcaacagcaatgggagcatttgcttggatatattaaaagagcaatggagtcctgctcttacaatatcgaaggtcctgctgtcaatttgttcgctcctgacggatccaaaccccgatgatccccttgttcctgagattgcgcatatgtacaagacagacagagccaaatatgaaggcactgcaaggagttggacgcagaagtatgcaatgggctgaatctctgacctctctcgcccctttgtaataatcaaaagata

SEQ ID NO: 3129 - DNA, 474 bp, Artificial
  Synthetic
ggggagacgtttgaattgggaataggaagagagcaaaaatggtggacttggcgagggtacaaaaggagctgcaagagtgcaacagagatgttggggtttcaggaataagtgtaacccttaaaggtgacagtctcactcacttgattggtacaatccctggtcctcttggtactccttatgaaggtggttctttcaagatcgatatcactcttactgatggctacccattcgagcctccaaaaatgagatttgccacaaaagtttggcatcccaatataagtagccaaagtggagcaatatgcctagacatcctgaaagaccagtctagcccagcgctgactctcaagacagctctcctttctatacaagcattactctttgctcctgaacctgatgatccacaagatgcagttgttgcacaacagtatctcagagaccatcagacctttgttggcacagctcgttactggactg

SEQ ID NO: 3130 - DNA, 764 bp, Artificial
  Synthetic
aaattattgggggtagctgaaaatacctagcaaagatacataacggaccaacggtatactgtcacgacatatctgcttataaaaaaggagtcctaatttcactgtaaacttctcgctttctcctcggtcccctccagaatctgaattgcaacgtgtaggaggatctctgaaggatttggtgaatcatggcatccaaacggattctcaaagagctcaaggatctccagaaagatcctcctacctcttgcagcgctggtccagttgctgaagacatgtttcattggcaagcaacaattatgggtccgcctgacagcccttatgctggcggagtgtttcttgttaccattcattttccacctgactatccatttaagccaccgaaggtagctttcaggacaaaggttttccacccaaacatcaacagcaatggtagcatttgcctcgacattttgaaggaacaatggagtccggcacttacaatctccaaggtattgctgtcaatctgttctctgttgacagaccctaatcctgatgatccattggtgccggagattgctcatatgtacaagactgataaaagcaagtacgaaacaactgcccggagctggactcaaaagtatgccatgggttagttgcagtgaccatctctggaggggctccttttcttctgtggtattctgtatatctattatgtattaagaaatggtgttcttatgcataatcaactcaaggggaaatgttgaacaggcccctgtaacaatttg

SEQ ID NO: 3131 - DNA, 715 bp, Artificial
  Synthetic
cccacgcgtccgcgcacggtgatattgagaatcgccgacctgaatcgatcggaaaactttctctgattaccggcggtcaacaccgctgaacacatatgtttgtttgacgacctcttctctccgcgatctttacctcaacaacgagatctgtttccacgaaagaaaggaggatgtcgacgccagcaaggaagaggttaatgagggatttcaagaggttgcagcaagacccacctgcgggtattagtggtgctccacaggacaacaacattatgctctggaatgctgtcatatttgggcctgatgacacaccatgggatggaggtactttcaaactctcactgcagttctctgaagattatcccaataaaccaccaacagttcggtttgtgtcacggatgtttcatcctaatatttatgcagatgggagtatctgcttggacattctacaaaaccagtggagtccaatctatgatgttgctgctatacttacctccatccagtccttgctctgtgaccctaatccgaattctcctgcaaactcggaagctgctcggatgtacagcgaaagcaagcgcgagtacaacaggagagtgcgtgatgttgttgagcaaagctggactgctgactagtagtagtttgttgtaagcgttgtagctctctctactttctctcaatcacgattcagcaacagctttcttctcttttcattcatgtc

SEQ ID NO: 3132 - DNA, 671 bp, Artificial
  Synthetic
cccacgcgtccgatctcttctattcataagttgtaaattcttattattgggattttttccctttttaattcaatccaagaattgagtaggactaatggcatccaggagaattcacaaggaactaagggagttgcaaagagaccctcctacttcatgcagtgcaggtccggtggcacaggatatgttccattggcaagcaaccattataggtccaaatgacagcccttatgcaggtggtgttttccaagtggccatccattttcctcctgattaccctttcaaacctcccaaggtggctttcaagaccaaagttttccatccaaatataaataataatggaaatatttgtttggacattcttaaggatcaatggagtcctgccctcaccatatcaaaggttttgctttccatatgttcactactaacagatccaaatccagatgatccattggttccagaaattgctcatatgtacaaatctgatcggaagaaatatgaatcaatggctcgtaattggacccaaaagtttgctatgaattgagttgttgtattcatataaagctcatgtgctataatttgtaacaaaagatcaatgattttctcctccgcaggcatgtaataaaagcacaaaattataatacttgtgaaatgagaatttttcacacttgata

SEQ ID NO: 3133 - DNA, 522 bp, Artificial
  Synthetic
ccaataatgggtccatttgatagtccttattcaggcggtgtctttctcgtaaccattcacttccctccggattatcctttcaaaccaccaaaggttgcattcaggacaaaagtgttccaccctaatgtcaacagcaatggaagcatttgccttgacattttgaaagaacaatggagtcctgcactcaccatatcgaaggttttgctttcgatatgttcattgttaacggacccaaacccagatgatccattggttccagagattgctcacatgtacaaaaccgatagagcaaagtatgagtctactgcgagaagctggactcagaaatatgcaatgggatgaaagtttgtgtcctttgatccctcacagactcggttttaatagagagagagagagaaagagagaggacttcttcacatagggatcttccatgaaataagttagattcctatgttttatcatctctttgtttgaaacctctttaatctcaaacaaaaacattacttcacctctttattatcc

SEQ ID NO: 3134 - DNA, 541 bp, Artificial
  Synthetic
aaggatcctcctacttcatgtagcgcaggacccgttgcggaagacatgtttcattggcaggccacgataatgggtccatcggatagcccttattctggaggagtttttcttgtaaccatccatttccctccagattacccatttaagcctcctaaggtggcttttaggacgaaggtgttccatccaaacattaacagcaatggaagcatctgcctcgacatcttgaaggagcagtggagtcctgctctcacaatttccaaggtgctgctatcgatctgttctttgttaacggatccaaacccagatgatcctttggtccctgagatagctcacatgtacaagacagacaagaacaagtacgagtccactgctcggacctggacccaaaagtatgccatgggctgacacaaatactgtccttaaggaagagccctaataattaaactcttcttatttctatgtaatgatcttttatagacttgtctgtcttataaaatttgtgaagacaggatcagtaagaaattatttgatctccattcaa

SEQ ID NO: 3135 - DNA, 506 bp, Artificial
  Synthetic
gatgagacctgttcggaagattctgcaagcgactcatttcaaacccgtaatgaaagatggcaagagaatgttgacgccttgctctccaggagacccggagaagattgagatgacgtacgacgatgtcaagccggaagaactgtcggctccggacgtgacactccaagattttgagatagctttggccgactcacatcctacagtgtccaaggatgacattgagaagcagattgaatggacgaatgaatttggaagcgagggagcttaggcaatggggcgtgtctttgagagtacatggcacagcggcgctttgaggagttagaggggcatctaggcactctttgcacatacaatgttgaattcgggaatcgtaatgcatctgtcttactggaaaagaagaagaagctgttcatattcgattctttttatggtagatagtgggccggcatctttgtaggatgtgattaattttgagtccaagatgaattggtaaaaaaaaaaaacaa

SEQ ID NO: 3136 - DNA, 970 bp, Artificial
  Synthetic
gacgatgagaatacatgtattcagacggccaatcaccgaaacagcacaaataagaatataagcaattattggtatgatattgcaagctacatgagtcaaacatcataaagcacctaagatacagagagtgaaatttaagctgcctgcttcgtcagagcttcgctaatacgccagagcttttctgcctgtgcgggatcaacagccccaggcaacaagccctcttttgtcaagactccgtcggccaagtagtagccatccttgtctgacaaaatgtgttagtatttgattaggttacatgagtgaagttgaggtataggaatgctgggatacactgggtgtgacgtactggacagtcgagagtcgaaagcggcgataattccagttgaggatccctcagccaaggtcttggccttaatcgccgagttcaggttaccgttgtcatcgatccagcctatcgcatattagcattgtgacaaattcagaaagacaagcaatgaacagtaggatcaacgctgaaagagcgcaatccccgctggccaaagtgctggaccaagccgactgacaagagaacatcgcatgccttggaattgctgtaagccgtccacttctcatagtctttgccgttgttgtatgaaaggtcgtccaagaaggacagattggcgcgggattgagcttcgcttgagtaagtcacaacgacgccgtgctccgaggcgagcagcttctcaatcaataaattgatgaagagaaagtgacccaggtggttaacagcgaattgcatctcaatatcgtccttggacttctcaaatgatggcacagccatgacgccggcggtacagatcatggcatcaagaaccgtaacagagctgtttacctcggcggcagccttgcgggtggtttccaatgaggagagatcgagcacgatgggctgcacgacggtgcctttagggatgtctagggacttgatcacctc

SEQ ID NO: 3137 - DNA, 682 bp, Artificial
  Synthetic
cccacgcgtccgcccacgcgtccgttaaaatacagatctgtgtgtgagaagaaggaacgcatctgaaaatcgatggcacccgcagcagatatcgaggatgagatcaaggacgagaagaaccctcccccacttgatgaagatgatattgctcttctcaagacttatggcttgggaccttattccacaagcataaagaaagctgaaaaggaaatcaaggaaatggccaaaaagataaatgatttgtgtggtattaaggagtctgacactgggctagctgcaccaagtcaatgggatctggtttctgataaacagatgatgcaggaggagcaacctcttcaggttgccagatgtacaaagataattagccccaatactgaagacgcaaaatatgttataaatgtcaagcaaattgcaaagtttgttgttggattaggggacaaagtttcacctaccgatatagaagaaggcatgcgagtcggggttgataggaataaatatcagattcagattccattgccccccaaaattgatcctagtgttaccatgatgacagttgaggaaaagcctgatgtaacatataatgatgttggtggatgcaaggaacaaattgaaaagatgagagaggttgttgagttgcccatgcttcaccctgaaaagtttgtgaaacttggaattgatcccc

SEQ ID NO: 3138 - DNA, 598 bp, Artificial
  Synthetic
accaccaccacaaaccaccacatacaatgccaccaaaatctgattgggaaaagtacaaggcccccatcgacgaggatgccgcgcaggagaagatcattcctctgtccgagggcgacatccaggtactcaagacgtacggaactgctccctatggtactgccctcaagaacatcgagaaggacatcaaggacatgcaagcacgaatccaggagaaggtcggcatcaaggagtccgacacaggtctggccccgcaccacctgtgggacacacaaatggacaagcagcgaatgagcgaggagaatcctctccaggtggctcgatgcaccaagattatcgagactgctgaagaccccggaaagagcaagtacgtcatcaacgtcaagcagatcgccaagtttgtcgtgtcgctgggcgagcgagtgtcgcccacagatatcgaggaggggatgcgagtgggagtcgaccggtccaagtaccagattcagctgcctctgccaccccgaatcgacccttccgtcaccatgatgacggtcgaggagaagcccgatgtcacctactcggacgtgggaggctctaaggagcagctggagaagctgcg

SEQ ID NO: 3139 - DNA, 469 bp, Artificial
  Synthetic
attccaaacgcgcatcacgaccagcgattcttacttcctcgaacggaccaaacgaatactctggacgagcttaaaatccctcaaactcattcttttatacgccatagatcccctaattctacggacgttgcgtccagtccgcagagcccatcatgccttctgcgaccggtcaaaactgggagaaatacaccaagaaattcgccgacgatgagatagaggagaagaagatcacacctctcaccgatgaggatattcaagtgctcaagacatacggtgctgccccatatgcatcgaccatctcaaagctcgagaagcaaatcaaagagaaacaacagagcgtagatgagaagattggcatcaaggtatgagtcggcgcaactgcgatgcgtctacggctatctaacgtgttgacgtaggagtccgatactggtctcgcaccgccgcatttatgggatgtggccgacgaccg

SEQ ID NO: 3140 - DNA, 565 bp, Artificial
  Synthetic
agcttggattccatggcgccagcagcagcagacatggacgacgacattctcaaggagaagaatccaccgccgctcgacgaggatgacattgcgctgctcaaaacatatggtcttggtccctatgctacctccacgaagaaagtggaaaaggagatcaaagaactggcgaagaaagtaaatgatctgtgcgggatcaaggagtcggatactggtttagcagctccaagccaatgggatctggtgtctgataaacaaatgatgcaagaagagcagccattgcaagtggctcgttgcaccaagatcatcaacgcaaacgcggacgacacaaagtacgtgatcaacgtcaaacaaatagcaaaatttgtagttggtcttggggataaggtgtctcctacagatatcgaggagggaatgcgcgtcggtgttgatcgcaacaaataccagatccaaatacctttgcctcctaagatcgatccaagcgtgactatgatgaccgtcgaggagaagccggacgtaacttacaacgatatcggcggttgcaaggaacaaatagaaaaatgcgtga

SEQ ID NO: 3141 - DNA, 374 bp, Artificial
  Synthetic
ggggtgcgatgtgaggctgatttggggtgtatgattcgtgagcgtgtaagaggaggcagcccacgactttctctctgtgtctgtgcttgctcacttgctcgcctccttggattcggcctgttgatccgaatcagaagtaaatgtgtttgagactgagacttggtctggtcgagacgatatgagatgtggcatggaattagaaacacgtgtttggtatggcgattgcgatgcgatgatccgcagaaagcaagatctcagggcgactaacacggatatacggaggttcgaccaagacacgaggaatgatggggaaagtctcagtatgtcactacggaatttatgattacgtagcaatgtatgaattatcatttcac

SEQ ID NO: 3142 - DNA, 779 bp, Artificial
  Synthetic
cgtcatcagaagcaccctgaattcgaacttgttgcccagattggaagccatggccacatcaggaagcggaggctgggctcagctacgccagcaggcccgatctttggagaaccagacggagagtctgtttcataccttttcccagttctcgactggatccaacatcccacctaagccatcagcagaggagcgtgacatagaagcgagattggaggatgtattagacaagcgcgacaatgtcatcgcccagctcgcccgacttctggattctgaagcatccctcaacacatccgcgctcaaacaaaacaacctatccctgctccgagagaagcttgcctctcatcgccgcgacctgacccgtctcaagtctacactgcagcaagctcgcaatcgcgccaacctcctcagcaacgtgcagtccgatattgacgagtaccgcgcgaacaacccggaagctgccgaggccgattacatgttggacgagcgtaatcgcatcgacagaagtaacgatgcgacagacagcgtcctcagccaggcatatgctatcaacgaaagttttattatccaaagggagaccttggcgagcatcaaccggagaataaccatggccgccagcaaagtgccaggcatcaactcaataattggacgtataagtaccaggaagaggagagatggaatcattatgggaacttttatcgcattgtgctttatcgtcttcttctggttcaggtaaacgggccatcatacattcaccggtgctgcacatgtcgtttggcgtt

SEQ ID NO: 3143 - DNA, 666 bp, Artificial
  Synthetic
cccccccccgaacagtagaaagctcgggcacttccctttcccctttgtttcacagatctttgtatcaacaaaaatggcgacaacagggaagaaaacgaagaagacccatgagagcatcaataacaggttagctctggtaatgaagagtggcaagtactctctcggttacaagaccgttctgaagaccctcaggagctctaaagggaagttgatattgatatctaacaactgcccaccattgagaaagtcagagattgagtactatgctatgcttgctaaagttggtgttcaccatttcaatggaaacaatgttgatcttggaacagcatgtgggaagtatttccgtgtttcatgcctcagcatcattgacccaggtgattcggacatcatcaagtctctgcctggtgatcattaagcgatattcaccagggttttgttaaaccattttagtgagttgagaaaatctgtactatctttttattcttgtatttcagagttataccaagattatagaggatgttggtattatctagttttgttggttttatcatttctccagaagttttgaggtcaggtacattatgatttattcacagatcaatttccctataccattttgcttttctaaatgagttcactagattttcttgttgttaaaggaaaaaa

SEQ ID NO: 3144 - DNA, 604 bp, Artificial
  Synthetic
gctaatcgcaagatcgcagctcgcgcccaaaatcagtcaaaatggcccctcagaagaagagcaagaaggatgccaacagcatcaactccaagttggcgcttgttatgaagtccggaaaggtcactctcggctacaagtctactctcaagtctctgcgatccggcaaggccaagctgatcatcattgctggcaacactcctcccctgagaaagagtgaactcgagtactacagcatgctgtccaaggctcccatccaccacttcgctggtaacaacgtaagttttgcaatctcagacgccctggacaagtgaagacctggaaacgggtatatctacttgcgccattacacacttctcgcttctttcagaagctactcttgctacccgagaattgccaattcttgcggaattgcccagagaagaagtctttcagactttggagggttcacattggcttacattattcgtaaaacagattgagctcggcactgcctgcggaaagctcttccgctgctccacccttgccatcctggatgctggtgactctgatatcctcagcgaccagcaggcttaaatagccgaaatctagtgcattcaaaacggcg

SEQ ID NO: 3145 - DNA, 642 bp, Artificial
  Synthetic
tgaccctagcaagaagaagaagaagaatattagttccatctctttgccggaagttcaacagagaaggcaatcatggtggccgctaagaagacgaaaaaggcccaagagagcatcaacaataggctagccctagtcatgaagagtggcaagttcactcttggatataagaccacattaaagtctctacgcggtggcaaagggaagcttattattatctccaataactgtccccccttaaggaaatcagaaatcgagtactatgctatgctctctaaaactggagttcatcagtacagtggaaacaatgtggacttaggcacagcctgcgggaagtactatcgggttagctgtcttagcatcacagatcccggtgattcggacattatcagaactgttgaatagagcttagagaggattaaaggcggtaatgcttatcatattagctcatctcgagggggcttctttggaagacttgcatgaatttccctagttttcttttcttgctttattggatcagagaaaccaattaatatatatggctaaattaaacatggaaaattaaatttgtagtagccgactgttttgccgtgtcattggtgttgcaagtaaggttctcgtttttgtgccaaaaaaaaaaaacaa

SEQ ID NO: 3146 - DNA, 478 bp, Artificial
  Synthetic
gagaggagagatccaagatggtggtcgccgggaagaagcagaagaagacccaggagagcatcaacaacaggttggcgctggtgatgaagagcggcaagttcactctgggctacaagacggtgctcaaatcgctgcggagtgggaaaggcaagctcgttctcatctccaacaattgcccgccgctccgcaagtcggagatcgagtactacgcgatgctctccaaaaccaacgtccaccattacagtggaaacaatgtggagcttggtaccgcttgcggcaagtactatcgggtctcttgccttaccatcacagatccaggcgattcggatatcatcaaatccatgtccgccgagtgaaaatccatccatcgatcagcgctcctctgttttgtttcgctgttcaacttcttgtaggcctcttactctagaaatatggaactttaatggaaaaacatttccttcataaaacaaaacaaaaa

SEQ ID NO: 3147 - DNA, 714 bp, Artificial
  Synthetic
agggggtgatattggaatacctagggacgcctctcaaaccggcctgttccatgaaggaaaccctgcagcagcgccgttagactgacctgacttgacgaaagcaccggtcgagacaggatgaatttgcgcagccgggcatcgcagccgcacccgcagcgcatcgcatcgcatcgcatcgcatcgcagcgcatccaagacaaggccggtccgggtccggcccagccagctgctttttttcatcatcttctttttgtttcggcgcccctcatgatatcagtccagtgacgctagagcaggtgtcacatggccgatgacaacaacgtggtggtgcagctaagctccggctagctgttatctggcgacggaatgtgtgtgatgccattgggtggtgttgcgaatggctgctggttcgcgcgggctcacactcacaccatccatcaccaacagcccaatgacctgttcaacgtcccttgccccatacggtactgtacatacatgtactcgtgcagtccagtccagacaatctcgctgacggaggggcgcgccacaagtggaatcaatggagtgatccaatgtgaaggcatttctgtcttcttggacaggcagggggtagcagtacctgcacgcactgcagcgcattttagcgccgctccgtacttgtacatgagaagggggtccagcgcgccacttttgtgcagccaagtgccatctcgg

SEQ ID NO: 3148 - DNA, 674 bp, Artificial
  Synthetic
tgtttcttcgctcgctttccggagtaccacgaggatctcagcgaaggagcgatgttgattcccaagaaaaacagggttgaggtgtacaggtacctcttcaaagagggggtgctatatgccagaaaagatttcaaccttcccaaacaccctgaaatagatgtgcccaaccttcaagtgatcaagctgatgcagagcttcaaatcaaaggagtatgtgaaggagaacttcgcgtggatgcattactattggtatctcacgaatgatggtattgaatacctcaggcagtatctcaacttgccttcggagattgttccggatacattgaaaaagtcggcacgacctcctggtcgtcccatgggtggccctcctggagatcgtcctaggggacctcctcgtgatggtgacaggccaagatttggtgaccgggaaggttaccgtggtggtcccccacgtggacctggaggattcggtgacaacaaaggaggtgcacctgatagcttccaaccatcattccggagtcgccctggattcggacgaggggctggtggctttgggagtggcggtgaaagcggccctgcttaagcttcttctctgagtaaaataaccatcggttagctactcaatagcacttggggtacccgacatgtcttgcaattgtgctcctttatcaattt

SEQ ID NO: 3149 - DNA, 746 bp, Artificial
  Synthetic
cccccccccgagtccgtccctttgctgctgcatttgggtggaggcttcagttgatttcccacttctcctcaattttcgagcagctatgattatcccagagaagaaccggagagagatctccaagtacctcttccaagagggagtatgctttgcaaagaaagactacaatttggcaaagcatccgaatatcgatgtgccgaacctgcaggtgataaaattgatgcagagtttcaagtcgaaggaatacgtgcgtgagacctttgcttggatgcactattattggtatctgaccaatgacggcattgagttcctcaggacttacctcaatcttccttctgaaattgtccctgctactctcaaaaagtccgctaagcctcttggtcgtcccatgggtggccctcctggcgaccgtccccgtggaccatctaggtttgagggagataggccaaggtttggtgacagggaaggttatcgtgctggtccaagaggtccacccggtgagtttggaggtgagaagggtggagctccagctgactaccagcctgcattcaggggtggtggtggaatacctggattcgggcgtggggcaggaggtttcggtggtgcaccccctagctcaagcttctcatagattgatcatatctttattgtagctagtttttatgcatttttgataatcacatgttggaattaacttgcagcggtcgaaagcacttggttcaattgggcataaacttctttattgg

SEQ ID NO: 3150 - DNA, 639 bp, Artificial
  Synthetic
gtttcgggttcctcgacctctcgccgccgtcgtcccgcgcgcttggaggtcggcctgctcgacggttgtcgccatgatcatccccaagaagaaccggaatgagatctgcaagtacctcttccaagagggggttttgtacgccaagaaggactacaatttggcaaaacacccacagattgatgtgccaaaccttcaggtcatcaagctcatgcagagcttcaagtccaaggagtatgtcagggagaccttctcctggcagtactactactggtacctcactaatgatggcattgagcacctgaggaattaccttaacttgccgtctgagattgtacctgctacactcaagaagtctgcaaggccaccaggccgcccatttggctctggcccccctggtgatcgcccaaggggcccacctcggttcgaaggggacagaccaaggtttggagaccgggatggctaccgtggtggacctcgtggtgcgcctggtgattttggtggtgagaagggtggtgctcctgcagaattccagccatcattcaggagttctggtggtagacctggctttggacgcggtggcggcggtggtttcggtgctggtcccacctcttcctccatggagtgaaaggagctcaggat

SEQ ID NO: 3151 - DNA, 475 bp, Artificial
  Synthetic
gccaaaatgttgattcccaaggaagaccgaaagaagatccaccagtaccttttccagcagggcgtctgtgtcgctaagaaggactttaaccagcccaagcacgaggacattgacaccaagaacctttacgtcatcaaggctctccagtctctgacctctaagggcttcgtcaagacccagttctcttggcagtactactactacaccctcaccgacgagggtgttgagtacctccgagagtacctccaccttcccgagggtgttgttcccgagacccacaagaagactgcccgagaggagactgcttctcagggccgaggtggccgacccgagcgaggtccccgacgacaggagggtgagtaccgacgatacaactccaacaaggagtctgctcccggtaactaccagccttctttccagtaaatgggaggatatataaaaatgtattattcatgttaaaacaacaaaaaaaaac

SEQ ID NO: 3152 - DNA, 728 bp, Artificial
  Synthetic
ttttggttgtacgcctgttcccgaaaaaccgtcaactttccaacatcgaccctccgagcagcaaaccgccacgatgttgattcccaaggccgaccgcaagaagattcacgagtacctcttccgcgagggtgtcctcgtcgcgcagaaggacttcaacctccccaagcaccccgatattgacaccaagaacctgttcgtcatcaaggctgctcagtccctcaactcccgcggctatgtcaagactcagttctcttggcaatactactactacaccctgacccccgagggtctcgactacctccgggaatggcttcacctgcctgccgagatcgttcctgctactcacatcaagcagcagcgatcacacgctcctccccgtggcatgctcggcgagggcgagcgtgagcgacgacctttcggtcgtggacgtggcggcgaccgtggtgaccgtgagggtggataccgaaggagggatgctggcgagggcaaggagggtggtgctcccggcgagtttgctcctcaattccgtggtggctttggccgtggacgtggtgctgctcctccttcctaaacgaatctgtctctttcggggttaacaaatcttatgatgcatggcgcaataagacaacggcatgtagtctaaaaaacgtgaggcaatcctcaccatgagtccactcatgaagaaatgggaagtgaggggggatatcgtgggagtcttggaggttaga

SEQ ID NO: 3153 - DNA, 577 bp, Artificial
  Synthetic
gaattcaagagagagagagagaaacagaagagaaaaacataaaagaagaagagcttccgtcgtctccaactcgccgcaaccatgattatgtccgagaagaaccgtcgtgagatttcaaagtacctcttccaagagggagtattgtatgcaaagaaggatttcaacttggcaaagcatccagacattgatgtaccaaatctacaagtgattaagcttatgcagagttttaaatcaaaggaatacgttcgtgagaccttcgcatggatgcattactactggtttttgactaatgatggtattgagtttttgaggacttacttgaacctaccatctgagattgtgcctaacactttgaagaaatctgctcaaactggaagagcaccacagggtgacagacctaggcgtaattatgaaggtggtgacagacctagatttggtggtgatcgagatggataccgtggtggtccaagaggaggagcaccaggggaatttggaggagataagggtggtgctccagcagagtatcagccacaatttaagggttctggaggtaggggtggttttggtcgtggtggtg

SEQ ID NO: 3154 - DNA, 524 bp, Artificial
  Synthetic
gtaaaggaggatctgaggaggtcgaaacgatgttgattcccaagaaaaacagagtggaggtgtacagatacctcttcaaagagggagtgctgtatgcaagaaaagattttaatcttccgaagcacccagaaatagatgtgcccaatcttcaagttatcaagttgatgcagagcttcaagtcaaaggaatatgtgaaggagaactttgcatggatgcactactactggtatttgacaaatgatgggattgagtacctcaggacgtacttaaacttgccatctgagattgttccagacactttgaagaagtcagcaaggcctccgggtcgccccatgggtggcccccctggaggggaccgtcctagaggcccacctcgttttgacggagacaggccaaggtttggtgatcgtgatgggtatcgtggtggtcctcctcgtgactctgctggatttggtgacaagggaggtgcaccagatagttttcaaccatccttccggagtcgtcctggctttggtcgtggcggt

SEQ ID NO: 3155 - DNA, 617 bp, Artificial
  Synthetic
gttgttaggttggaggagtaaaggaggatctgaggaggtcgaaacgatgttgattcccaagaaaaacagagtggaggtgtacagatacctcttcaaagagggagtgctgtatgcaagaaaagattttaatcttccgaagcacccagaaatagatgtgcccaatcttcaagttatcaagttgatgcagagcttcaagtcaaaggaatatgtgaaggagaactttgcatggatgcactactactggtatttgacaaatgatgggattgagtacctcaggacgtacttaaacttgccatctgagattgttccagacactttgaagaagtcagcaaggcctccgggtcgccccatgggtggcccccctggaggggaccgtcctagaggcccaactcgttttgacggagacaggccaaggtttggtgatcgtgatgggtatcgtggtggtcctcctcgtgactctgctggatttggtgacaagggaggtgcaccagatagttttcaaccatccttccggagtcgtcctggctttggtcgtggcggtggtggctttggaagaggtggtgaccccctgctcttacagagtaatatatctggcagtggagccactcgtttgcagt

SEQ ID NO: 3156 - DNA, 645 bp, Artificial
  Synthetic
ggttcttgattggccggccctagtagagcggcagcttgggaagaggctggaggcgacgccgcgaagatgttgatctccaagaagaatcgcgtggaggtctacaagtatctgttcaaagagggtgtgctctatgccaagaaggactacaacctgcccaagcacccggagatcgatgtgcccaatctccaggtgatcaagctgatgcagagcttcaagtccaaggagtacgtcaaggagtcgttcgcctggatgtactactactggtacctgaccaacgatggcatcgagtacctgaggaccttcttgaacctcccgtccgagattgtccccgccacgctcaagaagtcggccaggccaccgggccgtcccatgccccagcagcctccaagaggtcctccacgatacgagggggacaggccgaggttcggggaccgcgagggatacaggagcggccctcgagggggtggattcggggacaagggtggagttccaccagaattccaaccttcgttcaggggtccaagaactggatttggacgtggtggcggcggctttggaggccccagtgctcccggcgctctcaccgagtagagagtttgtacatgttgtggatcactcgcatgctctaatgctaaatttgatgtg

SEQ ID NO: 3157 - DNA, 705 bp, Artificial
  Synthetic
ataagaagttaaagcaaaacacatacaaacgcagtcaccttctctgtcgcctccttcttcaatctcatcgcaatcatgatcatatccgagactaatcgccgtgagatctccaagtacctcttcaaagagggtgttttgtttgccaaaaaggatttcaatttaccacaacatcctttgattgagagtgttccaaatctgcaagttatcaagttgatgcagagtttcaaatctaaggaatatgtgagagagacctttgcttggatgcattactactggttcctcacaaatgaaggtattgactttcttaggacttaccttaatctcccatctgagattgttcctgctactctgaagaagcaacagaagcctcttggtcgaccttttggaggtggtggtgaccgtccccgtggccctcctcgtggtgatggagagaggaggtttggtgacagagatggataccgtggaggtcctaaatcaggtggagagtatggtgacaaggctggagcacctgctgattaccagcctggcttcaggggtggagctagtggagcaaggcaagggtttggtcgtggagctggtggttttggtggtggtgctggtccagctgctggatctgatctaccttgaaaaggactctcttgtttctttttggtcttatttaaggttacatagcaccttattgagaacgaatgtgtcttttggaac

SEQ ID NO: 3158 - DNA, 747 bp, Artificial
  Synthetic
tgaggcttcagagtgatttctctcagttatccgctctcttcttgcagcagccatgattatttcagagaaaaaccgtagagagatctccaaatacctcttccaagagggagtatgctatgccaagaaggactacaacttggcgaagcatccattgatcgatgtgccgaacctacaggtgattaagctgatgcagagcttcaaatctaaggagtacgttcgcgagacattcgcttggatgcactactactggtaccttacaaatgatggtattgagttcctcaggacgtacctgaaccttccttctgaaattgttcctgctactttgaaaaaatctgctaagcctcttggtcgtcccatgggtggacctcctggcgatcgtcctcgtggaccaccaaggttcgagggtgataggccaaggtttggtgatagggaaggctatcgtgctggaccaagaggtccacctggtgagtttggaggtgaaaaagggggagctccagctgactatcagcctgctttcaggggttctggtggaagacctggatttggtcgtggatctggaggttttggtggtgcaccccctagttcaagcttctcttaagtccttgctatcttaggctaggtggttgcaattttgattatcagatggaaacacttggttgttcattttcttgtcaaacttaaaattccaagctgggaaagtttatctttatgggtttttagagaactataagttttacttctgtttct

SEQ ID NO: 3159 - DNA, 397 bp, Artificial
  Synthetic
gcaccatctcgctccggacacgggagagactgcgctgtccatctgatggcctagattggcagacgccggggcaattggcacgtacgctgccaccgactttgcatccccggggtcctgtcctgtctctccaaatccaaagacctcttctccatcgcacacgaagcatcgagccagagcatccagccccgcccagatcccagcccgagtacgttgcgtgaatgagcggccaagacgggacaaatctcgaggttacgctgcatctgttctaacctgccacgctgctacagtacaaggacaccctcaatcacatacggatcggccctgcgaatcagccctgcgactaataatagccctgtgaatcggcccctgctgaaccggcatccgaaaaaaaaaaaac

SEQ ID NO: 3160 - DNA, 265 bp, Artificial; identical to SEQ ID NO: 940
  Synthetic

SEQ ID NO: 3161 - DNA, 308 bp, Artificial
  Synthetic
tggccgcctcctcacaagtttgaagaagcgctcaaggacggcatcacggagtgcaatgaagctgtacaaggtcagagaggtcatggtaaagagatggtcgagcaatcgaaaccgatgaatggactgttgatgtctatttcaatttctacattttcctttgcagtgtctttttgtgtaacattacggcgatacctggggaatttattgaatgtgcaaatgctatgggaatacacgtcggcgacaacgtgtgtaatgtatacgagaaacgatggaacgaatctggatcaaattacagatgcattttaaac

SEQ ID NO: 3162 - DNA, 502 bp, Artificial
  Synthetic
ggctggcgccagacgcggttcgtgaatgcataggtgctctgctggcaactgacgtcttggggcttgggttgagggatgcgggcgtgttgtatggagaggtgcatgatgtgggagagagggcccctggtgagaccccaccgggtgagcggtggccatatgagctagcagaaggcgggatagagatggaagacacgaagaagccgggtcgcgaagaggcgctgttcagcattgatgtcgcggattgagggcccgacgacaggcgaggagtaggagaaccgcgggatgcaccttggccagacatcatgtgtaagccaaggtcgtccgatgctgggctggcggcccggcgcttctgacctgcgcctgcgtatgcatcttcaatgtgaagtctcttgacagaggatgtctcatcaatctccatatcgtcagcaaagctgccctgggtggaagtggcatcatcgctgttgttccgtcttgacctgcctcggggtgaacgatctggtcc

SEQ ID NO: 3163 - DNA, 650 bp, Artificial
  Synthetic
gggcgaagatacgcaattccacaatcgccatggcgaagccgtatgtgccgcatgacgtccttgacgagacggccaagacttcattggtcggcctgggcagcggcttcttcattgccgccatccagaatgccctgtcgaagcgcaacgtgggcgctatgagcgtctttacgcggggagctcccatcattggcatttgcgctgccggtcccggtgcctacgccttcttctcccggacgatgatgaacctgcgggagaaggatgatgcttgggccgccgcctttggaggcttcatgtgcggcagtgtcctcggacttcctttccgacgcacacccatcgtgctggctcttggtgctttcgttggcactgcccagggccttttccacgtcaccggaggaaaactggacagcttctacaaggaggaggatgagtttgagcgcaaggagactgttagacggacaacccggttgcccgttgagcagactattgccgagctgggcgagggacgaggcatccgtcctcctggatatgaggagagaagacgagagcgcatcaaggaaaagtatggcttcgaagttaaccctgtgagcgccaccgctgagggtagccaataaaatgatatcaaaaaaaaatatgaaagaattaaagtcagc

SEQ ID NO: 3164 - DNA, 542 bp, Artificial
  Synthetic
ggccaatgagattcttttctatttcgagccccaagcagagctcattcgttagcatcttgctacctacaccctgcatgcgcatacgcgatgaatgggcacccggtctgtctgcactctcgtaccctctgctcaaacaagcgagaaacagacgcctctgtcgtctcactcgctgcgccagcgccttggcctgggtaaagcggctgggtaatgcaatccggcgcaacggcctttgccatgtctggaacgcaatgctacgcaagtaacagtaatgcctgcgtttggtgcaggtcgtcgctcgccaccgctggctggctgacagccggcagtgccgcagacacgtataatgatcccactccaatacgtacagagacaactggcacacacccccaggcctgaacgagagacttggatctgggagcgagcaaattgatctgatgctggctagcacgtactacccgacttgacttgctaccatgttgatactgtatgcctcgactcgccttgcacgaaccatctcatcgcaagtctgatccgacgtggag

SEQ ID NO: 3165 - DNA, 473 bp, Artificial
  Synthetic
cccacgcgtccgcggacgggggggcggacgcttgggttcgacagaagccgagttaagcggcgatagaagcaacaaaggtgaagttgtgccggtctggtggtttattggaaagaaacgaagagaagaatgttccggtcaagggaagcggcctttggtcagtagccaaagggcagatcaagcgccgccttggaggattaaaagggcggctgcaggggtcccaaggctggtgcgcctcatggaattgtatcgaagaaagtcgatggtgtggcggtgcccgataacgcaaaaagctggcaacctttgtgctgccatgcgggctagcagcgggtaccgccgagtatttgtttgtcactgtacagaggcgagacgtgaggccgagattcgcattggttcggagtctggagtagggaggacaatatggtagcacgattgtcattgtgattgctttgtttattagtacttaaaaaaaaaat

SEQ ID NO: 3166 - DNA, 133 bp, Artificial
  Synthetic
ggccaatatgtggcctgcatgctgtttctgatacaaatcctcgtaatgcacagacgtgaatagtgctggcacaagtcacattgctgctgccttgaagggttccatttacattttggtgcagctctaccaaccg

SEQ ID NO: 3167 - DNA, 762 bp, Artificial
  Synthetic
tcaacatttcaccgtgatgataatagtcaaagaccaaatctcttctacggacattgagacgatatcaatgagccgagacaaaatggaaaaagcggaagcactaacgattcaactctttcttctccttggcgctgccctagtgtccatcggcggacgattatacgcccgatggcggcaggtcggaatgaagaatcttggtcttgatgatgggcttgccattacaggagtgattctctttgtgcccaatgtggtcttggcatacatgatgaacacgcggacccattggatgggcaatcattctgtcggcaacaatactacaacacagccgagccataacgaagatcaaatgagggaactgggatcgaaactctatctatacagctggttatcctattccgctgcattatggacgttcaaggcagcctttctcgcaaatgtccttcgtcgaattcccgaatccggcagacgacaaacccaccagtatctcggctttggcttcctggctgcaacatgggtagcaacgacgatggctctcctccaaagctgtcgaccgttgccccacatgtggcaggtttatcccagcccaggactgtactgccagcctgctacttcaccggtgctggcgtgggtttacttcagcttcgatatcgttacaaacctctatctagcgtctgcagctactcctgtcgctactagaaaagacaaacccacatgggaaaagcttcagtgggtcgcaacgcttgtttgcgggcttctagccac

SEQ ID NO: 3168 - DNA, 341 bp, Artificial
  Synthetic
gaacaatgcagctggtgacaggtttgtcaagtggcaggggagaatcgtattcgtgtggcgatggtgatgtcgaatttcgaatgagggagccttggcgcgaagaaaaaagaagagagagagagagcggagaggagaggagaggagagtgaaacaaggagaagtacagaggagagaggagagagacgctgtggtgctaagcaaccacgagagaggaacatgaatgcggtttacaaggttgacattggcgaacgagcttggaccgctttgacaatgtgatgtgatgcaggctgggtactccaaatgtttccaattgaacgaatatccaatcagacaagtagaga

SEQ ID NO: 3169 - DNA, 614 bp, Artificial
  Synthetic
ggaggagtggccgccttggtagcgggcaaggatggcgatgaaacgtcaatcgtgcttgacccggtagctttggagcatgagtctgttcttgctgcctgctgcgttgcatatctacccaacagagatgagatcacaaatctgtggttcaaaggtcggctgccctcaacagcatctcacaatcatcagtcacttgtctcaagggcagtgcacgcgagtaaaggaacacatgggttgatatcggcggctctcagcgaagttattggcaattctcaaaactaaaagtacaccgcgttgagtaataatgacgataataacgataatctggatcatgtatgcgcattgcatacattcgacattcgcgtaggccaggtgggtgtgctccagaggggcatctcgaacatctggtgagcgaagagaggtcagcaccgctgtaagtgcaaccaatcaaattcattacgaataccattggctattgatggagacaatcaccaatgttaggtggtatgaggcattgctataaaatgctacttgttcgttaccacaatcagagaaatatcaagtatatttattaagatctatctaaagccttcatttccataccatatcgggcgggg

SEQ ID NO: 3170 - DNA, 499 bp, Artificial
  Synthetic
caattgacacccaaagcttcaataacctaaccaaccctcttatccacaatgaagaaagctgcgcctgcggcaaacgctgcccgagatgccggatctcacgatcatatgctccaaggaggccatgccataatgaaagacgaccctgaagacttcaacgctcccaagctttccgagaacatgtcgaagcagactggtcttgggggatccaagcagggcagcttgcaaggcagcgccggcactggcgatagtatgaggcagcgagacactcaaagccatgtaggtcaaacatgcggtggtatacaattgtgctgactagtatgagtgatgaatacggccacgtaaaaaacgagaatgcattgccgattcgaaaagctggtatcagtgggacatgcacacgatgataggagttgacgagaatcccgagtttgaaacatgttgaaataggttgtataatatcatggcgagcaaaaccaatattgaaactatttataaacgcttt

SEQ ID NO: 3171 - DNA, 476 bp, Artificial
  Synthetic
tcccatccgtgctcttgatccaaaaaccaattgacacccaaagcttcaataacctaaccaaccctcttatccacaatgaagaaagctgcgcctgcggcaaacgctgcccgagatgccggatctcacgatcatatgctccaaggaggccatgccataatgaaagacgaccctgaagacttcaacgctcccaagctttccgagaacatgtcgaagcagactggtcttgggggatccaagcagggcagcttgcaaggcagcgccggcactggcgatagtatgaggcagcgagacactcaaagccattgatgaatacggccacgtaaaaaacgagaatgcattgccgattcgaaaagctggtatcagtgggacatgcacacgatgataggagttgacgagaatcccgagtttgaaacatgttgaaataggttgtataatatcatggcgagcaaaaccaatattgaaactatttataaacg

SEQ ID NO: 3172 - DNA, 415 bp, Artificial
  Synthetic
gaaaatactccaaaatcaatcgtatcaccaattctatcaactgcatcgccaaatcgccatgcctgagggacgtcaatctcctcctcccgagcgccaatccgccgcccaagtagggaacactggatccggcaaggcctcagatatcagcaagaccagccaaaaggacccaaaatcccagctcgactgtctcacatcgaaccccaagggaccgatggacgatgtgcttaaacacaagttttccagggagcctggaaactgtgagcgctaattagagcgactcgtcttccgcagttcgcgactaatgaattatcatagacactccgttgaacgcttagggagaataaatcgtcatgttgtacaatagtcattcatagcatcaattattgcatcgctatactataacaaaaaaaaaaaa

SEQ ID NO: 3173 - DNA, 553 bp, Artificial
  Synthetic
gctgactgaaaatgtttgaatcttgccaatagagtcctagatttgttcctgctatgggttcgacagcattttggcacaaggggacgtattttcgggttcaccgaaaaaaggaatcgtttgtcaacactcattcgtggggaggcccaatgaaagacctagaagagattaaggtttcttgctttggtcgttccatcgatccaatcaaagagttactcgcggatgccaaagctctttattataatgacacgcgccaaaagacgaccatctatcgtcccagagtcaaggagcaacgaagggaccataacatgtggcagcaagtagcacgacggcccgttagacccatgtcaacagttgtgctcgactctggcgaaaagcatgatattctggccgacgtcaacgaatatctgcacccctggacgccgcgatggtatgcatctcgaggtattccgttgaggcggggatatctgttccacgggccaccaggcaccggaaagacgagcttctcctttgcgctggcgggcgtgtttgggatcgacatttatgtgattagcct

SEQ ID NO: 3174 - DNA, 664 bp, Artificial
  Synthetic
cgagctcggtacccggggatcctctagagtcgagctgcaggcatgcaagcttgagtattctatagtgtcacctaaatagcttggcgtagtcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttct

SEQ ID NO: 3175 - DNA, 735 bp, Artificial
  Synthetic
tactcactatagggcgaattcgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcag

SEQ ID NO: 3176 - DNA, 764 bp, Artificial
  Synthetic
tcactatagggcgaattcgagctcggtacccggggatcctctagagtcgacctgcaggcatgcaagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggct

SEQ ID NO: 3177 - DNA, 581 bp, Artificial
  Synthetic
ggcaagtgcgtcttcttctcgtgtccactaccaacgtttggcgcatcacagccgcggcagagcccaacttgattatcacatccttggtcacatccttgggttgttgtcgattcgccttccatcccctccatctaggcctaatttcatccacctccaaccttccgcccccaacctcctttctccttgtttacaacaacaacaaacgaccatcgattcgacagctcgcgtgcgcatacaacacacatatcgtcgccaacatgtcgttcatgggaggcgcagagtgctcaacggctggcaaccccctgagccagttccagaagcacgttcaagatgacaagacactacaacgcgatcgtctcgtcggccggggaccaggcggccagctgggaggctttcgcagctcgcctgccaatgcgccccaggatgagatgatgaacggtttcctcaatggtggcccaggtcttcaacaagagtttccaaccttgccaggcgggcctgctgcccacctgagcgctgcccctatgggcccttcgcctgcggcatgggcacaagacttcaacgcccagcccggcatggacgtc

SEQ ID NO: 3178 - DNA, 242 bp, Artificial; identical to SEQ ID NO: 960
  Synthetic

SEQ ID NO: 3179 - DNA, 456 bp, Artificial
  Synthetic
acaaaaacaacaatgtctctcaaggtcgacggcttcacttcttctatcatcttcgacgtcatccgtgacggtcttaacgacccctctcaggccaagcagaaggctgagtccatcaagaaggccaacgccatcattgtcttcaacctcaagaacaaggctggcaagaccgagtcttggtaccttgacctcaagaacgacggtgacgtcggcaagggcaacaagtcccccaagggtgatgctgacatccagctcactctctctgacgaccacttccagcagctcgttgagggtaaggctaacgcccagcgactcttcatgaccggcaagctcaaggttaagggcaacgtcatgaaggctgccgccattgagggtatcctcaagaacgctcagaacaacctctaagcgcatcatttattgattaattgatgatttactatatcgaagaaaaaaaaaaaa

SEQ ID NO: 3180 - DNA, 649 bp, Artificial
  Synthetic
ccacgcgtcgccaagacgaaaatggaagactacagcaacgaccccaaacatgacctcaccccagaggctgccgccctggcacaactgggtcacaagcaggaactcaagcgaaatttctccctgatttctatgctgggtcttgcctttgccatcctcaacacatggacggccttggcagcttcaattacactcgctctcccctctggcggcgctagttccgttatctggggtctgatcgtggccggtatctgcaatctgtgccaggctgcttctctcgccgagttcctttccgcctaccccacagccggaggtcagtatcactgggccgccattgtttcatggaagcgatggagccgcggtattagctatgttactgggtggatcaatgtatccggctgggttgctcttagtgccaccggtggtttgcttggcagcacattcatcgtgaacatcatttcgctgcttcaccccgactatgagcctaaggcttggcatcaattcctgatttacatcggcttcgctctcattgccttggtcatcaatgctttcatgaccagaattctgcctctcttcaccaaggccgcgttcttctggtcggttgccggcttcgtcatcatcagcattacggtcttggccaccgcgtccccgg

SEQ ID NO: 3181 - DNA, 656 bp, Artificial
  Synthetic
gaattcaagaagaaaacaaacagaaacttcgttgggccttaaaatgtgtaattttttttctcagttaattacttaacaaaattaaccaaacaaaaatcaatcccattactgaatcctgatcctaatcctaatccaaatccaacaatattattttatttatctcttcgttttcagagataaaaaatcatataagtctctattcccaagaaatttattagtcattactctgttatttctcagtatcaggataaacttaaaattgagagaaaaaaatggatcagaaaggagaacaagtatacgtgggatcaattgatcaaggaacaacaagtacaagatttataatctatgataaatcatctaaaactattgcatctcatcaaactgaattcactcagttctatcctgaatcaggatgggtagaacacaatccgatagagatattaaaaagtgtgagactttgtatggcaaaagcattagataaagcaacagctgatggatataatgttgatgaaggattaaaagctattgggattacaaatcagacagaaactactcttgtttggagtaaatcttctggtttacctctacataatgctattgattggatggatgccaaaactactaatatttgcaggatattagagaaagaattatca

SEQ ID NO: 3182 - DNA, 95 bp, Artificial
  Synthetic
tctcagtcgtgtctgtcattattactcgaccagcgcagctctgctctgtagtgtctgtatattaagacgtcgttcctgccatctcttccccctta

SEQ ID NO: 3183 - DNA, 611 bp, Artificial
  Synthetic
gggccgcgaatctgccgcattcatcggggcgatcgaccagggcaccacaagcactcgatttatcctctacgatcgcgatgcgaaggccgtcgcgtcgcatcaggtggagtttgcgcagatttatccccaggccggatgggtggagcatgatcccatggaaatcctcaagaccgtgaaggtttgcatggaagaagcttgcggcaagtttgcaagcaagggtgtaaacttcgatgtggaagctatcgggataacgaaccagcgcgagacaaccattgtgtggagcaagagcactggcaagcctctctacaatgccattgtttggatggatactagaacaagctccatttgcaaacgcttggaacaaagtctctctggtggaaacaagcacttcgttgagaactgtggacttccaataagcacgtacttcagcgctttgaagctactgtggctgctggagacggtccccgacgtgaagtccgccgtgctctccggcgacgctctcttcggcacagtcgatagctggctcatctggaacatgaccggcggcatctccggcggtcttcacgtcacggactgctccaacgctgctagaaccatgctcatggacctca

SEQ ID NO: 3184 - DNA, 562 bp, Artificial
  Synthetic
accacaagacccaccacaaaccccacaacatgtcttcctacgtaggagctctcgaccagggtaccacctccacccgtttcattctcttttcgcctgacggcaagcccgtggcatcccaccagatcgaattcacccagatctacccccaccccggatgggtggagcacgaccccgaggagctcgtgagctcgtgtctggagtgcatgtcgtcggtggccaaggaaatgcgaacccagggcatcaaggtggccgacgtgaaggcgatcggaatcaccaaccagcgagaaaccaccgtgctttgggacattgagaccggccagcccctgtacaacgccattgtgtggtccgacgcccgaaccggcgacaccgtcaagaagctcgaggcccagcccggcgctgacgaaatccccaagctctgtggcctgcccctgtccacctactttgccggagtcaaggtccgatggatcctggataacgtcaaggaggcccgagagtgctacgatcgaggcaagctggccttctccaccatcgactcgtggctgctctacaacctcacgggcgg

SEQ ID NO: 3185 - DNA, 536 bp, Artificial
  Synthetic
agggtatcgttcttcccgtgccgccgccgccggcggcgcttcatcccgacgccgaaagcccgaaacctaaacacctcctcttcctcgcacgcccatctccggattccaaccaaatctccgggatggcctcgaactgcttccgcgccgccgcccgcatggcctcctccgcctgccgctcggcggcctcccgctcaatcccctccgccgcgcggcgcggcgcccctcgcatctccaggctgccggtggagctcgggtgcagcgcggggttgtcgctgctgccgctgcacagcgcggtggcggcggcgaggctgacgtcgcggctgagcacggcgtcgcggagctgctgcgcgctctctcagggcacatgacttgctagttcttgaaagattttaccaggagcttgctgttttgcttcacaatcatcgagaatgagtgccttaacatgtcaaattgtaatcaagactagcgttatgttgtttaagctagaatcttagctgcctatgttgaggggcaacatgatggaataaagtaacatc

SEQ ID NO: 3186 - DNA, 523 bp, Artificial
  Synthetic
aataatccaattctttcaacattcacttgacgaaatggcaaaccttgctactgggattcacaaattccaagggccggacattgaactaacttatacggtgcgaagatccggaccatatcttattattcaggcagcaggatggggaatttcttctcagtatcttcaaattgggctttcgcctcttgaggctcaatttaccctaatatacatggagccccgcggctcaggcccctccgagcgaccacaagaagacataatgagcacttccgatatgactgacgacctcgagcttttacgaaaacacttggaatgtgaacaaattaatttgcttggtcattctaattgaggcaccatcgccttagcgtatgctgagcggtagcccgcctcagtccgaaacttgatcctcctcacacattggcccgaaggatacgatgacagtcgcacttggcaacgatttctagatgagagaaagggcaatccagcattttcaaaagcccttgcggtgcttgagatagccgaaact

SEQ ID NO: 3187 - DNA, 695 bp, Artificial
  Synthetic
cccacgcgtccgagttgctgactgaccaggtgtaactaggagcgggcagtagtacacagtctttgtcttgtctttgtcttgtttcttcgttgatataccgccgcctatcatgcgccgtctcctctccgtcagcgcctctgccagtgcccgcggattgactgccgcttcccctcggtctaccattgcccttgccaagatggcctccaaggctcaggctgccacagccgtcaggaggattcatgccacggctcagcagctcaagccaatggacgccctgtcgtccacggccaccagcttccccacgacgcacgagcagatcgagaatgtgcagaacacgccctacttcatcaacaacaagtttgtccagtcgacgacggacaagttcatcgacctgcccgacccggccaccaacaacctggtgacccgcgtgccgcagatgacgcaggccgagatgaaggccgtcatcgagagctccgagaaggccttccagtcgtggaagaacaccaccgtgctgttccgccagcagatcatgttccgctacgtgcagctgatcaaggacaactgggacagactggccgccagtatcacgctcgagcagggcaagacctttgctgatgccaagggcgatgtgctccgtggactgcaggtcgccgaggctgccgttggcgcccccgagctgctcaagggcgaggttc

SEQ ID NO: 3188 - DNA, 350 bp, Artificial
  Synthetic
ctctgtcgtctctctccatatcgaatcttctcttctcctttgataccctctcggtgttgcagacagaatcatcagtcacaatggcttctcagcagatccgcactcccatcaccgatcttttcaagatcaagcaccccatcttactggccggcatgaacgtcgccgccggtcccaagttggcggctgccgtcaccaacgccggcggcatgggcgtcatcggcggtgtcggatacaccccagagatgctcaaggagcagattgccgagctcaagagctacctcaacgacaagaacgctccctttggtgttgacctgcttatcccccaggttggtggcaatgcccgtaagacc

SEQ ID NO: 3189 - DNA, 456 bp, Artificial
  Synthetic
gtggtgtcgatccaaggggacgcgtggcaaccgctgcacagcccgcgtgtggtgactagaggcggctaacaggtggtaagtaatcggatctgctgtttctcttgtgcagtctcacacatgtcgcaggggtgggttttgaatggagacgaagcttgttgcgatgaatcaagtcatgctagctgcatgcctgaccgagatgaggaggagagatggagagatggagaagagaacggagcagtgggagaaagaaaagaggaagagaaagaggctaggaagcattgccacattaagtacaacaggggggttgattcagatcgaggagagcagaaggggagaagtggatagaatagggctttgtgtctgtgctgtggaggaggcatgtggccgtgctgatgaaagaattggaacatgaagcttacctctatattaggaccaaagtacggagtagaccctacc

SEQ ID NO: 3190 - DNA, 228 bp, Artificial
  Synthetic
cggacgcgtggggactagataggtagagatggtttggcggtcaatgctgtgctcgttagatgtctcacgggggcccgcatgtatctccatgtagttcctcgcacgcagcaagaaagaggcaaaacccgcgcggtgttagtagcgtttgccatcggaagacgatcgcccagcacgtcaaagaggccatttgatcagttactcgattggtgctcgcacgggttggttacg

SEQ ID NO: 3191 - DNA, 595 bp, Artificial
  Synthetic
agtattccttacaatggcttccgtcacccgtctcagcaactctgccctgagggcttcattgcgagcccctgcccgggccacggctttcaatgccacccgctgctactccgccaaggctcagtccctcaaggaccgctttgccgagcttctccccgagaagattgagcagatcaagactctccgaaaggagcacggttccaaggtcgtcgacaaggtcaccctcgaccaggtctatggcggtgcccgtggtatcaagtccctcgtctgggagggttccgttctcgacgccgaggagggtatccgattccgtggaaagaccatccctgagtgccaggagatcctccctaaggctcccggtggcaaggagcctctccctgaaggtctcttctggctccttctgaccggtgaggtccctaccgagcagcaggtccgcgacctgtccgccgagtgggctgcccgctccgatatccccaagttcgtcgaggagctcatcgaccactgccctaccgacctccaccccatggcccagttctctctggccgtcactgctctcgagcacacctcttccttcgccaaggcctacgccaagggtatc

SEQ ID NO: 3192 - DNA, 687 bp, Artificial
  Synthetic
tgcaagaaaggaaacgaatcgtccactcagctcggctcaatcatcatcacaatggctctcaacctcaccacgtcggctcgagccctgcgctccttcaagccctacacccgtgctgctctccttgccaacgccgcgcgatgctactctaccgctgagcccgatctcaagacaaccctcaaggaggtcattcccgccaagcgcgagctgctcaagaaggtcaaggcccatggcagcaaggtcattggcgaggtcaaggtcgagaacaccctcggcggcatgcgtggcctcaaggccatggtctgggagggatccgtcctcgatgccaacgagggcattcgcttccacggccgcaccatcaaggactgccaaaaggagctccccaagggcaagacgggaactgagatgctccccgagtccatgttctggctgcttctcaccggccaggtcccctccgtcaaccaggtccgcgagttctcccgtgagctcgcctccaaggcccagatccccgccttcgtcaacaagatgctcgacgagttccccaaggatctgcaccccatgacccagtttgccattgccgtctcggccctcaactacgagtccaagttcgccaaggcctacgagcagggtctcaacaaggctgactactgggagcccacctttgacgattgcatttctctgctcgccaag

SEQ ID NO: 3193 - DNA, 682 bp, Artificial
  Synthetic
ggcgatggcattggcgatggcctccagggcgcgtaatgcggcgtccaagcttcgccgcatttcggatggatgcgagttgtcgccgcattggttgtttcggcgattgctcacgacggatcttcgatcccggcttatgcaactcattccggaagaacaagagagattgaagaaattgaagaaggagcatggatcggtacccctcggccaagtcacgatcgatatggctattggaggaatgcgaggtatcaaagggatgctatgggagacgtctttactcgacgctgaagagggaatccgattccgaggcttgtcgattccagaatgccaggagaagcttccggctgctgtgcctgatggtgaaccaattccagaaggattgttttggcttcttgtcactggtgaagttcccagcaaggagcaagctgcgaccttgacgaaagactgggcttctcgatctgacattccaggtcatgtgtatgatgttgtgaacgctcttccaaagaacgcgcattcgatgacacagttttcggctggagtgatggctttacaaaccgaaagcgagttccaaaaggcctacgagaaaggaatcaacaaatccaagttctgggagccagcgtacgaagacgcaatgaacctgattgcgaggttgccaggcttagctgcctacgtataccggagaaaa

SEQ ID NO: 3194 - DNA, 617 bp, Artificial
  Synthetic
aaatctgaaatatcaatcatgatttctgctattcgtcccgccgttcgatcttccgttcgtgttgcccctatggccaacaccgccttccgggcctactctacccaggatggtcttaaggagcgattcgccgagctcatccccgagaacgtcgagaagatcaagaagctccgaaaggagaagggtaacaccgtcatcggcgaggtcatcctcgaccaggcttacggtggtatgcgaggtattaagggtctcgtctgggagggatccgtcctcgaccccgaggagggtatccgattccgaggtctgactatccccgacctccagaagcagctcccccacgcccctggcggaaaggagcctctccccgagggtcttttctggctcctgctcaccggcgagatccccactgatgctcaggtcaagggtctgtccgctgactgggcctctcgagccgagatccccaagcatgttgaggagctcatcgaccgatgcccccccaccctccaccccatggctcagctcggtattgccgtcaacgctctggagtccgagtctcagttcaccaaggcttacgagaagggtgttaacaagaaggagtactggcagtacacctacgagga

SEQ ID NO: 3195 - DNA, 613 bp, Artificial
  Synthetic
gcaacaacacaatgatccctcttcgaaccgcccgtgttgcccgaacctccgtgtcctccatggtccagaagcgatttgcttctgacctcaagggcgccctcaaggaggccatccccgccaagctggagctcttcaagaaggtcaagtccgagtactcccagaagtctctcggtgattgcaaggtcgagaacctgctcggaggcatgcgaggcctcaagtgcatgctctgggagggctccgttcttgacgctgatgagggtatccgattccacggcaagaccatcaaggagtgccaggaggtgctccccaaggccgttgagggcggcgagatgctccccgagtccatgctgtggttcctcttcaccggcaaggttcccactgaggagcaggtccgaggcctgtctcgagagctcgctgagaagggcgaggtccccgagtttgtcaacaagatgctcgacaacctgccccctaccctgcaccccatgacccagttctccatggccgtgtctgcccttaaccacgactccaagttcgccaaggcctacgagcgaggtatccccaagtccgagtactgggagtacaccttcgatgactccatcgacctcattgccaa

SEQ ID NO: 3196 - DNA, 512 bp, Artificial
  Synthetic
gtccaattaggcattgacagcaaaccaattccctccataactgggcctcttcacacccgtactcagaatgaccgacagaatattccgcatctttaacccgggagaaccaaagggtgatcccgttgagaagaggcgcgctcagctgcgacgtgcccaacaatcttatcgagatcgcaaggacaagtacaccaaggcgctcgaggctgaactagcacggtctcggaagagcgaggcgggcttgacgttccagatcgagcagcttcgtgtcaaagttcagaaactggccagtctcttgtcccaaaatggcatctcacttcctccagattttgacaatgaggaacaacttcatgatgatgtaccgcgtatagattcatctccgctcacaacgcgtggacaaccacaaaccgctgaaggcttcctatcaagtacagattcaacctctcctgagtcggtgacggaccaaggagctatcttaaatagtggaaaccgcactctacggcagtacagttcga

SEQ ID NO: 3197 - DNA, 337 bp, Artificial
  Synthetic
cgaacggcggcgcactacgtggtctcttggggtgtagcaatcaatacttgtgtacacgtagatacagtagtctatgtccgtgtgcttctgggggtgggcattgattatctccgtgcggaggaatatgggggtgttcgtgtgtcttggtatcaatcaggctatgcgggaatacgatgtagttacgacgcctcctctactgtacattactgacatgccctgtaaagacaaggtgagcatacgagacaatgccgctgtctctttgggagggaattcgttagagtcagccaagagcgccatgttgaatgaaagaatcggacatggcttatcttagtcccct

SEQ ID NO: 3198 - DNA, 597 bp, Artificial
  Synthetic
agacgaccagctcgcgcgctcggatctcagccatggagaaggcgatcgatcgccagcgcgtcctcctcgcccacctcctcccctcctcctcctccgaccaatcgctcctctccgcgtcggcgtgcgccgcctgggacagcgccgcctaccagaggacttccgcctacggggacgacgtcgtcgtcgtcgctgcctacaggacacccatatgcaaggccaagcgaggaggtttcaaggatacatacccagaggaccttcttactgttgttctaaaggctgttctggacaacactaagatcaaccctggtgaaattggtgacattgtagttggcacggtgctaggtccaggctcgcagcgtgcaatcgagtgcagggctgcggctttctatgctggagttcccgaaaacgttcctgttagaactgtcaaccggcaatgttcctctggattacaggcagtggctgatgttgccgcggccattaaagctgggttcgacgacatagggattggtgcaggcctggaatccatgtcagtaaatgctatgggttgggaaggacaagtaaaccctaaagtaaatgaagtccagaaagcacaggatt

SEQ ID NO: 3199 - DNA, 596 bp, Artificial
  Synthetic
atttgtactaaaaaaataatcttgagatcaaatggagaaagcaattgagagacaaagagttcttcttcaacaccttcgtccttctcaaacttcttcttccttggaaaatattgaatcatccattgctgcatctgtatgctcttctggagacagtgctgcttaccaaaggacctctgtctttggagatgatgtcgtcatagttgctgcatataggactcctctttgcaaagcaaagagaggaggcttcaaggatacttatcctgatgatctacttgctccagttctaaaggcgttgatggaaaagactaatgtgagccctagtgaagttggggatatcgttgtcggcaccgtgttggccccaggttctcagagagcaagcgagtgcaggatggctgcgttttatgctggttttcctgaaactgtgccagttagaactgtaaaccggcaatgttcatcaggccttcaagcagttgctgatgtagctgcagctattaaagctggattttatgacatcggtattggtgctggattggagtctatgaccacaaacccaatggcctgggaaggatcagtcaacccaaaagttaagatgatgg

SEQ ID NO: 3200 - DNA, 673 bp, Artificial
  Synthetic
tcttcctctgtctgctatctttcctcctatctcagtcacccatccatccttttcctcccatcttttcacacattattacaaaatgggcgccgccgacagaatttcccagattggaggccagatctccggcaaccctaccgccggtggtcgcgacaagatcctcgagaagcgccctgacgatgtcgtcgtcactgccgcctgccgtaccgccttcaccaagggcggcaagggtggcttcaaggacacccccgctggcgaccttctcgctggtgtcctaaaggccatcatcgaacgctccaagatcaaccctgcgctcgtcgaggacgtcgccgtcggcaacgtgcttgcgccgggtgccggtgccactgagttccgcgccgccgcttttgtcgccggcttcacagaggagacggccgtgcgtgcggtcaacagacagtgctcttctggcctgcaggcctgtgtcgatgtcgcgaaccagatccaggctggtatgattgatatcggtattggtgccggtgtggagagcatgaccctgaactatggccccaacgccgtgtccgaactctccgaagacttccagaaggtcaaggaggctgccaactgcaaggtccccatgggtgttctctccgaggccatggccgtggatctcggcatcacccgtgagacccaagat

SEQ ID NO: 3201 - DNA, 612 bp, Artificial
  Synthetic
acaaaaatggaccgacttaacaacctcgccacccagctcgagcagaaccccgccaagggcctcgacgctatcacctccaagaaccccgatgacgttgtcatcaccgccgcctaccgaactgcccacaccaagggaggcaagggtctgttcaaggacacctcttcttccgagctgctcgcctctctgctggagggcctcgtcaaggagtccaagatcgaccccaagctcatcggtgatgtcgtctgcggaaacgttctcgctgccggtgccggtgccactgagcaccgagctgcctgccttgttgccggcatccccgagaccgttcccttcgtcgctctcaaccgacagtgctcctctggtctgatggccgtcaacgacgttgccaacaagatccgagccggccagattgacattggtatcggctgtggtgtcgagtccatgtccaaccagtacggtcccaactccgtcacccccttctccaacaagttccagaacaacgaggaggctaagaagtgcctgatccccatgggtatcacttccgagaacgttgccgccaagtacaacgtgtcccgaaaggcccaggacgcctttgctgccaagtcctacgagaag

SEQ ID NO: 3202 - DNA, 157 bp, Artificial; identical to SEQ ID NO: 408
  Synthetic

SEQ ID NO: 3203 - DNA, 504 bp, Artificial
  Synthetic
aaccacgccgccgtcctccccgactgcaacaagaaccacttcatcaacagtgtcgtgggagctgcctttggagctgccggtcagcgctgcatggccctgagcacactggtcatggttggcgagaccaaggagtggctctctgaggttgctgagcatgcgcaggcgctcaaggtcgatggtggcttcgaggagggtgccgatctgggccccgtcatctccccccagagcaaggagcgcatcttgagcatcattgacagcgccgagaaggagggtgctacgatcctgctcgacggccgtggcttcaagtctgaaaagtaccccaacggcaacttcatcggacccaccatcatctccaacgtcactcccgacatgacctgctacaagcaggagatcttcggccccgtgctggtgtgcctcaacgtcgagaccatcgacgacgccattgagctcatcaacaagaacgagtacggcaacggcgttgccatcttcacaaagtcgggcgcc

SEQ ID NO: 3204 - DNA, 466 bp, Artificial
  Synthetic
tcgaccgacgctcggcaacaatggcgacaattgcaagcggcttgcggcatgcgagatgcgcaagctcgattgctgcagctcaatggcggccggcaatcttcccgcggtcgaactttcaactcgccatccggtctataaccagcgactctcaaaagcctcccagtcttgaacttgaagccgccgagtccgtcccgatcccataccagggcgttacgcatgcgcgagttgttccggcgacaccatcttatttctcaagagaaccccagttcaacgatttatacattggaatctccaagctgctcaccaagtacaaccacctgcccacagtgccgccaagtgaggctccgcaaatgccatggacaaagctggaggagatgcgggcgcagatgggagagcccatcaagtcatcacactatgcgaaggtcatgcgagtggccaagcgcttgaacctcatcgagcccagcct

SEQ ID NO: 3205 - DNA, 934 bp, Artificial
  Synthetic
gcccgggaaagacatttgtcgctttggtttgtgaagactaccttaggctaggcaatacccgacgcttctgcttattcttcctagtcctgtccgcgaatgctgtagcagcgaaattgcaccgagcagcgtttcccattctgcggcacccgatcccatgagccgcggtatctgagcggatctccagcagccgatataaacaccacgccgccttgacaaggccgtcccccctttgcctccgtctatcctgccatgttgtcagcaatccgttcccagagaccgacaaatacctttcgacaggttgccatctcttctacccatcgcatcgccatggcaccgcctaaacgcaacagcagctcgctgcctgccggctatgtcgaggacaagtcgaagggcgcaatgctcagattccaagactcgcttcctcgcctcccagtcccgaccctcgaagagaccgccaagcggtatctcaagagcttacaccccataatctccgccagtgaactcgagaagagcacagcggccgtcaccgagttcatcaagcccggcggagttggcagcaaactccagcagaagctcgttgccaaggcccaagaccccaagacaaagaactggatgtacgagtggtggaacgatgctgcgtacctgagttaccgcgacccggtagtgccgtatgtcagctacttctactcgcacagagatgatcccaagcgacgcaaccctgccaagcgggctgcggcgctcaccagcgctgtcctcgagttcaagaagcttgtcgacagcggcagcctcgagccggagtacatgaagaaactgcccatttgcatggacagctacaagtggatgttcaacgcgagccgtgttgccgccaagcccgcggattatcccatcaagttctcccacgaggaaaacaagcacattgttgtgattcgcaaga

SEQ ID NO: 3206 - DNA, 795 bp, Artificial
  Synthetic
  misc_feature (745)..(745): The residue at this position can be any nucleotide.
ataaatagtagctgcttgttgtgaagcactgctttcatcaaaacaagtactctccaatcacatctggtgttcgaacaaggtcaccacccaacaacatttcgcatattccatcaggtcgatcgattcccaagtccgacaatcaccatggctgacgaaaccgtcaacatcgctcccaatgagaaggagaccaacggtgtccagcagcagacggcggtaccgcgccagggcttcacacacaaccaccacagcgacttcaatgagatgaccattggccagtatgctcaggcttttggtggtgctctccaacccggggcatggaggccatatgagcaccgcaagctcgccaaccccgcccctctgggtctttctgctttcgccttgactacctttgtcctctccgccatcaacatgcacgctcgaggagtctcggcccccaatgtcgtcgtctctctcgcctttggttatggcggtcttgttcagctgcttgctggcatgtgggaggttgctgccggtaacacctttggtgctactgctctgggttcatatggtggtttctggatctcatacggtattctcttgacccccgaatggggcatcacggctcctgatggcccgtacgagggcaacgttgctagcgtgcttggcttcttcctgactggctggttcatcttcaccactgtgcttctgctctgcaccctgcgatccactgttgctttcttcctcctcttcttcttccttgacctgncctttttcttcctcgccatggagcaatacgctgccgacttgggcaacgcg

SEQ ID NO: 3207 - DNA, 79 bp, Artificial; identical to SEQ ID NO: 529
  Synthetic

SEQ ID NO: 3208 - DNA, 707 bp, Artificial
  Synthetic
tgcttgttgtgaagcactgctttcatcaaaacaagtactctccaatcacatctggtgttcgaacaaggtcaccacccaacaacatttcgcatattccatcaggtcgatcgattcccaagtccgacaatcaccatggctgacgaaaccgtcaacatcgctcccaatgagaaggagaccaacggtgtccagcagcagacggcggtatttctccagggcttcacacacaaccaccacagcgacttcaatgagatgaccattggccagtatgctcaggcttttggtggtgctctccaacccggggcatggaggccatatgagcaccgcaagctcgccaaccccgcccctctgggtctttctgctttcgccttgactacctttgtcctctccgccatcaacatgcacgctcgaggagtctcggcccccaatgtcgtcgtctctctcgcctttggttatggcggtcttgttcagctgcttgctggcatgtggtaagtcatgagctccgggatttcatagtattacaaacctggacctatactgatggttcgtctttagggaggttgctgccggtaacacctttggtgctactgctctgggttcatatggtggtttctggatctcatacggtattctcttgacccccgaatggggcatacggctcctgatgggccgtacgagggcaacgttgctagcgtgcttggcttcttcct

SEQ ID NO: 3209 - DNA, 627 bp, Artificial
  Synthetic
gcgacaaaacatcacagtgcacatcatggcgcgagtacttcgcaatagagcggttgcgtcaccgaaaaccaccgacgccgtaaagcctgacagcaccccaaagggcaagagaaaggccgccgaagagtcttctcccgttgtgctgaagaagcagaaatccgccaagaaggaagatgtcgagaccaaggcagccaagtcacccaaggcagccaagtcaccaaagactaagaaggaggaaaagaagaaagaagaagaaaagaagcaagatgtgattgacatggaggaagattccgagtctgagggacaagaagatgagggaaatcttcaggctttggccgtcaacattgacccggaagaagaggcccccgtgaacgacgaagaattccagcccggtcaggacgttggcaagatccccaaggtctcgaaagacgtccagaagtcgatcaaggcatcgaaggaagaacctggcgtcgtttacattggccgaataccccatggtttctacgaatacgaaatgaggcagtacctgtctcaattcggccccatctcccggctgcgtctatcacgcaacaagaagactggcgccagcaagcactttgcctttgtcgaatttaacgaagccagcac

SEQ ID NO: 3210 - DNA, 565 bp, Artificial
  Synthetic
aaccgtctcatcttacatggccttgttcctttccatactccattcttccccaaccccaacaccccgccagccgttctgtcagcgccacagcgcattagcctcatcacctcattgctcactggtctgcaaacattgcgcaaggcggtgaatttttcatgtcgagaattgacattatataacagcacgtattctaagattcatgtattaagtgccgaggaaattcatttcttccccatccgtcaaagtcctaggtaagtaacaatgcattaatcgtaatgtccaactcggagagttttcaatactccttatcgataagtcattatgtaatcaatcctgccgggaagggaaattttgctcctctcccaaacctcaaatcgcatctccaaagccctgtgacgacatacaacacccgaacagcaatatcaaacccccaaacaccaaggaacaagccctcaccccgtattttacctcccagtttacaaaaacaaaacacaagaataaaacaacaaccatgtctttcctcggaatcggtcgtccccagcccacctcggagcaaaagattgct

SEQ ID NO: 3211 - DNA, 739 bp, Artificial
  Synthetic
cccacgcgtccgctctttccttctctcaccgcgagagtaaccgagagacatgattctgataaactctaattctccgacgctaatctcagccgttagattcgtgggctcatctccgttcaccactcgggggctttctcagtccactgtctcaatctctagaaacaaaagcttcttcttccacttcaccgagacgaaggagaagaacgcaagaagagattatttgagagtatcaatcgtgtgtgacgcaggagggatgtttccggtggatccatgggctccaaccattgattcacagagcatagcatcacaactcttcgctgtatctctgtttccttacattggctttctctatttcctcactaaatccaaatcagctccaaaactcacacttttcggtttttacttcttgcttgccttcgttggagctacaattccagctgggatttatgctaaggtgcattatggaacatcgttgtcgaatgttgattggttacacggaggagctgaatcacttcttgctcttaccaatttgtttatcgtgttgggtcttagacaagctctgaggaagtctcaagatgatgatgatgataaacttggtaatgatgatgaagttccaacaactcaagaacaagggaaattttcagtgtagtaaaacaaatgtaaattttttaattacgcagtttcacttgttttttaattagattatatatagtcgacgcccatctaattcccattttag

SEQ ID NO: 3212 - DNA, 739 bp, Artificial
  Synthetic
cccacgcgtccgctctttccttctctcaccgcgagagtaaccgagagacatgattctgataaactctaattctccgacgctaatctcagccgttagattcgtgggctcatctccgttcaccactcgggggctttctcagtccactgtctcaatctctagaaacaaaagcttcttcttccacttcaccgagacgaaggagaagaacgcaagaagagattatttgagagtatcaatcgtgtgtgacgcaggagggatgtttccggtggatccatgggctccaaccattgattcacagagcatagcatcacaactcttcgctgtatctctgtttccttacattggctttctctatttcctcactaaatccaaatcagctccaaaactcacacttttcggtttctacttcttgcttgccttcgttggagctacaattccagctgggatttatgctaaggtgcattatggaacatcgttgtcgaatgttgattggttacacggaggagctgaatcacttcttgctcttaccaatttgtttatcgtgttgggtcttagacaagctctgaggaagtctcaagatgatgatgatgataaacttggtaatgatgatgaagttccaacaactcaagaacaagggaaatcttcagtgtagtaaaacaaatgtaaattttttaattatggagtttcacttgttttttaattagattatatatagtcgacgcccatctaattcccattttag

SEQ ID NO: 3213 - DNA, 857 bp, Artificial; identical to SEQ ID NO: 985
  Synthetic

SEQ ID NO: 3214 - DNA, 389 bp, Artificial
  Synthetic
tctcattcccgatcagatctcaacgacgacgagccatggcttcaactttcagcggcgatgaaactgctcctttcttcggattccttggcgctgccgccgctctcgttttctcctgtatgggagcagcgtacgggacagcgaagagcggggttggtgtagcgtcgatgggtgtgatgagaccagagcttgtgatgaaatcgattgttcctgttgttatggctggagttttaggtatttatggtttgatcattgctgttatcatcagtaccggaatcaaccctaaggccaagtcttactatctattcgatggctatgctcatctctcttccggtcttgcttgtggtctcgctggtctctccgccggtatggctattggaattgtcggcgat

SEQ ID NO: 3215 - DNA, 662 bp, Artificial
  Synthetic
taagggatagatccgtggatagccggggaggagaatcggatccatggcgtcgaccgatgcgttcagcggcgatgagacggcgcccttcttcggattcatcggcgccgccgcagctctggtcttttcctgcatgggagctgcgtatgggacggcaaagagtggtgttggcgtcgcgtccatgggtgtgatgcggccggagctggtgatgaaatcgatcgtcccggtggtcatggcgggagtgctgggaatttacggcctcatcatcgctgtgatcatcagcaccgggatcaacccaaaggccaagtcgtactacttgttcgacggctatgctcatctatcgtcgggcctggcctgcggtctctccggtctctcggcaggcatggcgatcggcattgtcggtgatgcgggtgtccgggccaatgcacagcaacccaagctttttgtgggaatgatcctcatactcatctttgccgaggctttggctctatacggtctcattgttggaatcattctgtcgtcccgtgccggacagtccagaggataagcagcagcgttaattttaaggtggtttatatgcgagcattcttcttagcgttttttgttttgcttactgcttgtattattattccttccaacaaataattctcgcttattaaaaaaaa

SEQ ID NO: 3216 - DNA, 631 bp, Artificial
  Synthetic
cattgaatcagagagagagaggatggcgacgatggagttcaatggcgatacgacagcccctttctttggattccttggggctgcctttgctctcatcttctcttgcatgggtgctgcatatggaactgcaaaaagtggtgttggagttgcgtccatgggagtgatgaggcccgagctagtaatgaagtctatagtcccagttgttatggctggtgttttgggtatctacggcctcattattgcggttattatcagtactggaataaatcccaagagcaaagcttattacttgtttgatggctatgcccatctctcatcagggttggcttgcggtctttctggtctctccgcagggatggccattggcattgtcggagatgctggtgtaagagctaatgcacaacaaccaaagcttttcgtgggcatgattctgattcttatctttgctgaggctcttgccttgtacggtttgatcgtgggaatcatcttatcgtcccgtgcaggacaatctagggagtgaggctacgcatggtttcgtgatctgtttatcgaataatcaagaacgccggtttcacaaggctacccttgaagtttcgtgatgccatatgagtgcggcagattgtcccgatga

SEQ ID NO: 3217 - DNA, 421 bp, Artificial
  Synthetic
ggtcatcttcagatccatcggtgcagagagagagagagagagaggagagaggagagagagaagagagagagagagagagatggcaactgtggatttcaatggagacacgacagcccctttctttggatttctgggcgccgcctttgctctcatcttctcttgtatgggagctgcatatggaacagcgaaaagtggagttggagttgcttccatgggtgtgatgaggcctgagctagtcatgaagtcgatagttccagttgttatggctggtgttttgggtatctatggtctcatcatcgccgtcatcatttctaccggaatcaagcccaaaagcaaggcttactacctttttgatggttatgcccatctctcatctggattggcctgtggtctttctggtctctctgcgggaatggctatc

SEQ ID NO: 3218 - DNA, 745 bp, Artificial
  Synthetic
gagaaagagagttagacacgtatatatgtgtgtgtgtagatagatagatagatagatagagaggtacacacccacacatatagagagagatgcatagagagatctgattcatctctctgataataaatcaaattgatcattgaatcagagagagacaggatggcgacgatggagttcaatggcgatacgacagcccctttctttggattccttggggctgcctttgctctcatcttctcttgcatgggtgctgcatatggaactgcaaaaagtggtgttggagttgcgtccatgggagtgatgaggcccgagctagtaatgaagtctatagtcccagttgttatggctggtgttttgggtatctacggcctcattattgcggttattatcagtactggaataaatcccaagagcaaagcttattacttgtttgatggctatgcccatctctcatcagggttggcttgcggtctttctggtctctccgcagggatggccattggcattgtcggagatgctggtgtaagagctaatgcacaacaaccaaagcttttcgtgggcatgattctgattcttatctttgctgaggctcttgccttgtacggtttgatcgtgggaatcatcttatcgtcccgtgcaggacaatctagggagtgaggctacgcatggttttgtgatctgtttatcgaataatcaagaacgccgggttcacaaggctacccttgaagttttgtgatgccatatg

SEQ ID NO: 3219 - DNA, 378 bp, Artificial
  Synthetic
ggatcccccgggctgcaggaattcggcacgagtctgaatctaatcaacttctcagatccaaactccgatcggaacaatgtcctcgactttcagcggcgatgaaactgctcctttcttcggcttcctcggcgccgctgcggctctcgtcttctcctgcatgggagcagcgtacggaacagcaaagagcggtgtaggagtggcgtctatgggagtgatgagaccagagctggtgatgaaatccattgttccggtggttatggctggtgtgttgggtatttatggtctgattattgctgttattattagtactggtattaatcccaaaacaaagtcgtattacctgtttgatggatatgctcatctctcctctggtctcgc

SEQ ID NO: 3220 - DNA, 606 bp, Artificial
  Synthetic
gatcaataagcctttttttccctctcagatcgcgaatcgcttcaataccaattcgaagaaaaaaaaatggcatcgacttttagcggcgatgaaacggcaccgttcttcgggttcctcggtgctgcagctgccttagtcttctcctgtatgggagcagcttatggaacagcgaaaagtggggtaggggtagcatcgatgggagtaatgaggccggaattggtgatgaagtcaattgtgccagttgttatggctggagttttgggtatttatgggttaattatagctgtgattattagtactgggattaatcctaaaacaaagtcgtattatttatttgatggatatgctcacctttcatctggacttgcttgtggtcttgctggcctttctgctggtatggctattggaatcgttggcgatgctggtgttagagctaatgcacagcagccaaagctttttgttgggatgattctgattcttattttcgctgaagccttggctctttacggccttattgtcggcatcatcctctcttcccgcgctggtcaatctagagcagagtagagaaagatcttctcttgttccatatttgtgtagtatctttgt

SEQ ID NO: 3221 - DNA, 735 bp, Artificial
  Synthetic
agagaacgagggaggagcaaccagaaacagatctattcaactccaaaactcaaaaacactgtatatttacagttctcagatccaaatcctaacgacaatgtcgaccttcgccggagatgaaactgctcctttcttcggcttccttggcgccgccgcggccctcgttttctcctgtatgggggcagcttatggaacagcaaagagtggtgttggagtggcgtcaatgggagtgatgagacctgagttggtgatgaaatctattgtgccagtggttatggctggtgtgttaggtatttatgggttgattattgctgtgatcatcagtactgggattaaccccaaaacgaagtcgtattacctatttgatggctatgctcatctctcctccggtcttgcttgtggtcttgctggcctttctgctggaatggctattggtattgttggtgatgctggtgttagggctaatgcacaacaacctaagcttttcgttgggatgatcctcattctcattttcgctgaagctttggctctttatggacttattgttggcattatcttgtcttcccgagctggccagtctagagctgagtgaagttaactccattcttaccgcgttgtatgtgggacttcagtagaccaaggcagtcaaaagtatctaatacgtgtattgttattcattatcccacagctggaacttaattcagtggtgcaatgttctgtctgtagaaataggaa

SEQ ID NO: 3222 - DNA, 635 bp, Artificial
  Synthetic
gcaatggattccaatggagatgccaccgctccttttttcggcttcctcggggccgccttcgctctcatcttctcttgtatgggggctgcatatggaacggcaaagagtggtgttggggtggcctccatgggtgtcatgaagcccgagctagtgatgaagtcgatagttccggtggttatggctggtgttttgggtatctacggcctcatcattgcagtcatcatcagtactggaatcaatcccaaaagtaaatcatactacctctttgatggctatgcccatctctcgtctggattggcttgtggcctttctggtctatccgctggtatggccattggtatcgttggggatgctggagtcagagctaatgcacaacagccaaagctattcgtaggcatgatcctgattcttatctttgctgaggcgcttgcgttgtatggcttgattgtgggcattatcttgtcatcacgcgctggccagtccagggagtgaacttgagactccggtatgcattgaatgatcaaggactcgtctcttttgtgagattagcctaagttttttaatggtagagacgccttatcaagacatgtttcatcatattcaagtgatagcctgtgctagagcatctgctatag

SEQ ID NO: 3223 - DNA, 538 bp, Artificial
  Synthetic
gcagcatgcagactccgcacactacttcaaagcaagggcaatattgtcattcttgtgtaatgttccaccaccatatccaaatctgctgctacaacaacaacaacaactccaacgccggttcttactcgatggtcttctccatgcaaaacggtggcgttttcgagcacaacggtgaggactatcatcactcttcctccctcgttgactgcactctctctcttggaactccttctaccaggctttgtgaggaagatgagaaacgtacacgctctacttcatctggtgcttcttcttgcatctccaacttttgggacttgattcacaccaaaaacaacaactccaaaacggcaccgtacaataacgttccttctttctccgctaacaagccaagtcgcggttgtcccggtggtggtggtggcggaggaggcggtggcggatgtgactctcttctcgctacacgctgtgccaactgtgacactacttctactccactatggaggaatggtcctacaggccctaactccctatgcaacgcatg

SEQ ID NO: 3224 - DNA, 367 bp, Artificial
  Synthetic
ttatcatctggtaaagtcatggacaagacttgccctatccgctacattaagcctccaagaaaggaacggaacaccgccgtgagcaccgtcggattcaacgttgtttgctactccactgccgtaatcatccatgaacctgatctcatttgccggataattacacggaaccctctgcgtcgagtggtgatgagcccacggagtaccattattattgttgttattagtggcagcatggtaattattgtagccagagttgtgatgcccgtactggtcggtttgaaccggtgcagctccgacgacggtgtttcctgtaaccgcagtagttcttctctcttccttcttgaaacgaatgccggatgcgttgcat

SEQ ID NO: 3225 - DNA, 590 bp, Artificial
  Synthetic
gcagcatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttttagttgaaatcgaaaacgcgcagaaaagggagattgagcttgacaatgagaacatctatctaagaactaaggtagcagaagtggagaggtatcaacaacaccatcatcaaatggttagtggttcagagattaatgcaattgaagct

SEQ ID NO: 3226 - DNA, 540 bp, Artificial
  Synthetic
gcggcacggaggcgtttccaaatctcggcaagcactgcaaccactcctcgtgtggccagctcgatttcctgcccttcaaatgcgatgcgtgttccaaggtcttttgcctggatcatcgttcctatgcagctcacagctgccccaaggcgaattccaaagactctacagtgatcgtctgcccgttctgtgcctcgggtgtcaagaccgtggcaggcgaagatccaaaccttacaattgacagacatctccagacttcttgcgatccaagcaactacgagaaggtgatgaagaaaccaaagtgttgtgtccgaggttgcaaagatgtgttgaccttctccaacaagttccactgcaaggtctgccgcaaggacacctgcatgaagcacagattccccgcagaccacgcatgccaggccgcggcatctgctcacaagtccgcacgaaacgttggtggcgagctggcgacgaagttctttcaggctttgtcgatcaggacgggcagcgagtgtgggactagcagcagcagcagcaacagcagca

SEQ ID NO: 3227 - DNA, 758 bp, Artificial
  Synthetic
gcagcatgggaactccagaatttccagatctgggtaaacactgctccgtcgattattgcaaacagatcgatttcttgcccttcacatgcgatcgctgccttcaggtgtattgtctggatcatcgtagctatatgaaacacgattgtccaaaaggaaacagaggagatgtcactgtggttatttgtccattatgtgctaaaggagttagattaaaccctgacgaagatcccaacatcacctgggagaaacatgttaatacagactgtgatccatctaactacgaaaaagctgtcaagaagaagaaatgtcctgttcctagatgcagagaactcttgacattctccaatactattaaatgtcgagattgtagcatcgatcattgtttgaaacatcggtttggacctgatcatagttgttctggacccaagaagcctgaatcgagtttctcattcatgggtttcttgagtacaaacacaaaagaagctcctgcatcatcatcatcttcttcgagatggtctagtcttttcgcttctgcggaagcaagtattagtagactcggtaacgatataagccagaagttacagtttgcgagtggcaatgatggcaattcagagaaaacgcaagagaggaatggaaaacagaattgtggcaaagttacggttgatgtttgtcccaaatgtagtagagggtttcgtgatccggtggatctattgaagcatatcgataaggatcatcgtgtcacttctaaagcctagtaa

SEQ ID NO: 3228 - DNA, 253 bp, Artificial
  Synthetic
actgcagcgagtcttcttgtcacctgctcgatttcctccccttcacttgcgacaattgcagccaggtcttttgccttgagcatcgatcgtaccaagcccacgattgccccaaggcggatctcaaggacgtaagcgtactgctctgccccgtgtgtgcgtcttccgtgcggagagtgagtggccaagaccccaacctcactcttgaagcccatctcttgggaggggcatgtgacccgaccaattatgagcgcac

SEQ ID NO: 3229 - DNA, 618 bp, Artificial
  Synthetic
aagaaagaaaagcaaaggtgaaaagaaaaacatgggaggaggaacagaagcttttccagatttaggaagccactgccaacattctgattgccgtcagctcgactttctcccctttacctgcgatgcgtgtcaaaaggtattttgtgtggagcacagatcatgcgagtctcatgaatgcccaaaatccgatattaacagccgaaaagttctagtttgcgaaatctgttccatgtctattgaaactactggttgtcaaggtgaagacgataaagtgctattgcaaaagcacgagaaatctggggattgtgaccccaagaagaagaagaaacctacctgtccagtgaagagatgcaaggagattttgacattctcaaacaccagcacttgcaagagttgcaggattcaagtttgcctcaaacaccgctttcctgctgatcacgcctgcaaacggagttcttcattatcccagccatcggctaataacaagtttttgattgctctggctgctaggagtgggaatgattgtggaaataaaagccgcgcatcaacttcacgctccaccaccccttctgttaaagcttattgattgtttcagaaaaattgctatacatttaaaga

SEQ ID NO: 3230 - DNA, 503 bp, Artificial
  Synthetic
gcagcatggattattcttcgatgcatcagaatgtgatgggagtatcttcatgttcaacacaagattatcaaaaccagaagaaaccattgtcggcgactaggccagctccaccagagcaatcattaagatgccctcgctgtgactccaccaacacaaagttctgctactacaacaactacagtctctctcaacctcgctacttctgcaaatcttgtaggagatactggaccaagggtggaatcctaagaaacatcccaatcggtggtgcttaccggaaacacaaacgctcctcctccgcaaccaaaagcctcagaacaacccctgagcccacgatgacccatgacggcaaatcattcccaacggcgagttttggctataataataataacattagcaacgaacagatggagcttgggttagcatatgccttgttgaacaagcaacctctagggggttcttcacatctagggttcggaagcctctcagtctccaatggccatgga

SEQ ID NO: 3231 - DNA, 595 bp, Artificial
  Synthetic
gcagcatggtggaacgtgctctgatcccaaaagtcccattgcctgaagcagctctaaatggccctagatgtgactcaaccaatactaagttctgttacttcaataactatagccttactcaacctcgccatttctgcaaaacatgtcgtcgctattggacacgtggcggtaccttgaggaatgttcctgtaggaggaggctttaggaggaacaacagaagcaaatccagatcgaaatctacggtcgtggtctcgactgataatactactagtacttcatcacttacttctcgcccaagttactcaaatcctagcaagtttcatatctacggtcaaatcccggagtgtaataccaacttgcccatcttgcctcctctccaaagccttggagattacaattcaagcaacactggattagattttggtggaactcaaataagcaatatgataagtggtatgagtactagtggtgggatcttggatgcatggagaatacctccatcacaagaagcctcagcaattccctttcttgatcaacactaccggattggtgcaatcttcaaacgccgttatatccattactacaaggcggggtt

SEQ ID NO: 3232 - DNA, 863 bp, Artificial
  Synthetic
gcagctttctgcaacttctccaaatctcatactttccagaaaatcattttcccaagaaaaataaaactttcccctttgttcttctccccccaacagcaatcacggcgtaccaatcggagctaggaggagattcctctcccttgaggaaatctgggagaggaaagatcgaaatcaaacggatcgagaacacaacgaatcgtcaagtcactttttgcaaacgtagaaatggtttgctcaagaaagcttacgagctctctgttctttgtgatgctgaagtcgcactcatcgtcttctctagccgtggtcgtctctatgagtactctaacaacagtgtaaaagggactattgagaggtacaagaaggcaatatcggacaattctaacaccggatcggtggcagaaattaatgcacagtattatcaacaagaatcagccaaattgcgtcaacaaataatcagcatacaaaactccaacaggcaattgatgggtgagacgatagggtcaatgtctcccaaagagctcaggaacttggaaggcagattagagagaagtattacccgaatccgatccaagaagaatgagctcttattttctgaaatcgactacatgcagaaaagagaagttgatttgcataacgataaccagattcttcgtgcaaagatagctgaaaatgagaggaacaatccgagtataagtctaatgccaggaggatctaactacgagcagcttatgccaccacctcaaacgcaatctcaaccgtttgattcacggaattatttccaagtcgcggcattgcaacctaacaatcaccattactcatccgcgggtcgccaagaccaaaccgctctccagttagtgtaataa

SEQ ID NO: 3233 - DNA, 424 bp, Artificial
  Synthetic
ttatcatccacgcattagatcaatgtccatatgggggtgatgcatatccattgaccttgaaccagttgaccaaatgcctacaggagtctgaacaatgttctgactttgctgaggaacaggaggtgacgttgctgctgtgttatcgttgttgttttccaaagcatcagtatcttggacatcttcagaagtttcttcacgttttttaatcttccctttcggaattgcccaaatgaagctgccaacaatgacctggacttggcttgctgctattagaggacctccaattccaccaccaatgacacgaccatcggggctagcaagtgagaccgctagacttccagtgcggtttgggtagtcattgtcagttgtgttcagataagaagttgagagagatatgagctcgaatagaccctcgtatataata

SEQ ID NO: 3234 - DNA, 663 bp, Artificial
  Synthetic
gcagcatggcgttatccgggtcgggttcttactatatccaaagaggaatccccggttctggtcctcctcctcctcaaactcaaccaacgtttcacggatcacaaggatttcatcatttcaccaattccatctctccttttgggtcaaacccaaacccaaatccaaaccctggaggtgtctctactggattcgtgtctcctcctttacccgttgactcttctccggctgattcgtcagcggcggcggcgggagctttggttgctcctccttcaggtgacacgtctgtgaagcggaagagaggacggcctagaaaatatggacaagatggtggctctgtttcgttggcattgtctccttctatctccaacgtttccccgaactctaacaaacgtggccgtggaagacctcctggctccggcaagaagcaacggctatcttccattggtgaaatgatgccttcatcaactgggatgagcttcacaccgcatgtaatcgtagtttccattggtgaagacattgcttcaaaggttatatcgttctcgcatcaaggtccacgagcgatatgtgtcttatccgcaagtggtgctgtctctactgcaactcttcttcagccagcaccttctcatggaactattatatacgagggtctattcgagctcatat

SEQ ID NO: 3235 - DNA, 524 bp, Artificial
  Synthetic
gctattgtggatcgattcttcctcctcgatctgtggggatcgctttgatctataggcgcagagcgcgattcgcggtcttatgaatgctgggcagctggaaatggtagggttgatggcgaatccagcgcttccatccgacgaagcggtgtccaagaagatccggaagccctacaccatcaccaaatccagggagagctggaccgagcaagagcacgacaaatttctagaggccttgcagctgtttgatcgggactggaagaagatcgaagcgtttgtaggctctaagacagtaatccagattagaagtcatgcccagaaatattttctaaaggtccaaaaaaatgggactggagaacacgtccctcccccaaggcccaagcgaaagtcggctcaaccatatccacaaaaggctgtcaaaccagctcccacttcgcgggcaactccacaacagtcaccaccggattttgcttacatggttccgcagcaaatgtaatatgtatgttccagcagtcactggaaatccc

SEQ ID NO: 3236 - DNA, 671 bp, Artificial
  Synthetic
gcaaaggtttagggttttggggacatgtcgattgcgcggcagcagcaacagcagcagcagcagcagcagcaaatgccggactgcgatgccgcgagaaagattcgcaagccctacaccatcaccaagtcgcgagagagctggacggagcaagagcacgacaagttcttggaggcgcttcagctctttgatcgggactggaagaagattgaggcgttcgtcggcaccaaaactgtgatccagattcgcagccatgcacagaagtatttcttgaaagtccagaagaatggtacgggggaacacgtaccgccgccgaggccgaagagaaaagccgcaatgccatatccacagaaagctcccaaagtcgtgcctcctcctgttattgtcgaaaggttaccgcatagtcccagcagcagcggtggcagtgacgatgtttctcctgcagcatcagcaccgaacttcgcagcagtgtatcagttcctcggcagcgtcttcgatccaagctcgtcaaaccatctcgacaccttgagtggaatggatcagatcgatcgagagacggttctacttctcatgaggaatttggcactcaacttatccaccaccgaactcaccgaccatctaagatatctgtcgctctgtcctgttggagtctaagcgggtaaaaatttcgtcgg

SEQ ID NO: 3237 - DNA, 654 bp, Artificial
  Synthetic
gaagagaaacaactgttgtatgtcaggacaagctagcatctgtttaatgtctgggggcaaacattgtgccagttgcttcacatattggggcgcacttcacgaaatatgctttatgttctgatatatgtcaatatactaaaaagcaagctatgcagatacgtagccatgcacagaaatactttctgaaggtccagaagagtgggacaagtgaacatgtacctcccccacgcccaaagagaaaagcagctcatccttatccacaaaaagctcctaaaaaggttgtgtcccaagttggcagcatccagtttcaacctccaggagctttccctgaaccaggatttggtatcgggcctgattctctagcattgcctggaaatacaattaatttctctccctggacttacgacaatgtgcctgctatcatcacaacacacatgcgaaaagatgacgcacaattatccagcggaggagtcgtgcaaaattgcagcagcagcagtaacgaaagcatgcataggatttgtatgactaaagagagcaatgcccaaacggagagcaagaagcaaatgaaagttatgccagactttgcacaagtttacaggttcattggcagtgtctttgatccatgtacgagggaccacttacagaggctaaaaa

SEQ ID NO: 3238 - DNA, 676 bp, Artificial
  Synthetic
gcggaggaggcgatggaatggggacgaggcggcgacgaggcggccatccaggcggcgctagggtccctgatccacggattccgtaagagattgtgatctcgagctctcttccacgccgtttgtttggggagtttatcctttgatggtcgcagggcagtgatgactgatccagctcctgctaggacgctgagccaggatactcgagatcatcaacaaaacaagctcttggaaccgggtgtgaagcagcagcaacaattcggtgatgtttctgctgcgtttggagacgactctcttgcgaaagtgaggaagccgtatacgatcacgaagcagcgagagagatggacagaggaagagcatcaaaagtttctggaggctttgaaactctatggtcgtgcatggcgtcggatcgaagaacatattggcaccaagactgcagtccagataagaagccatgctcagaagttcttttccaagctggaaagagaccaggcaactggaagcatcgtgccaggtactgcgcaggacatcgatattcctccgcctaggccaaaacgaaagccgagccatccatatccgcggaaagcaaacacagaagtttctccagtggctcttccagcggctgattttgatggaaagcagtgtcctacctcgatggatgtgacagaaagtcgtcggg

SEQ ID NO: 3239 - DNA, 671 bp, Artificial
  Synthetic
gcagcatgagtttaccaagctccgatggatttggttcgattccggccacgggacggaccagtacggtgtcgttttctgaggatccgacgacgaagattcggaagccgtacacaatcaagaagtcgagagagaattggacagatcaagagcacgataaatttctagaagctcttcacttattcgatagggattggaagaaaatagaagcctttgttggatcaaaaacagtagttcagatacgaagccacgctcagaaatactttctcaaagttcagaagagtggtgctaacgaacatcttccacctcctcgacctaagaggaaagcgagtcatccttatcctataaaggctcctaaaaatgttgcttatacctctctcccgtcttcgagtacattaccgttgcttgagcctggttatttgtatagctctgattcgaagtcattgatgggaaaccaggctgtttgtgcatctacctcttcttcgtggaatcatgaatcgacaaatctgccaaaaccggtgattgaagaggaaccgggagtctcggccacggctcctctcccaaataatcgctgcagacaggaagatacagagagggtacgagcagtgacaaagccaaataacgaagaaagttgtgaaaagccacatagagtgatgccgaattttgctgaagtt

SEQ ID NO: 3240 - DNA, 653 bp, Artificial
  Synthetic
gaattcaatgcttcaaccgccatggatgatggtcggaattatatggaagttggctcacagtctggaaatgcaatgcaatttaaggacaattattcatctggagaagataatttacttaaggctaggaaaccttataccatcactaaacagcgtgaaagatggactgaagatgaacacaagaagtttctagaagctttaaggttgtatggtcgagcttggcgtcggatagaagaccacgtcggtaccaagactgcggttcagatccgaagccatgctcagaaatttttcactaaggttgtaagagaatcaggtagtaatgatgcaggctcagtgaaaccaattgaaattcctcctcctcgcccaaagagaaaacctatgcatccttatccccggaaaatggtttctccagctaaaaaacaaacgttggcttctgagaagcttgaaaggtcaatgtcgccgaatttctcagaacaagaaaaccaatcacctacatctgttttatctgtcgtgggaccagatgctatgggatcctcattttcaaatacccaaagccgttctcaatcaccagtgtcatctgtttctgatgttaagcatgttgtctcatcatctaccaagcaagaaattggttccccttcaacttcttcatcagctga

SEQ ID NO: 3241 - DNA, 576 bp, Artificial
  Synthetic
tcaaactctccttccatggctactaacaactcaacacctacccagtcatctggcaaaaaggttcgaaaaccttacaccataactaagtctagagaaagctggactgaagaagaacacgacaagttccttgaagctcttcaactgtttgaccgtgattggaagaaaattgaggatttcgtaggctcaaagacagtaattcagattcgcagtcatgctcaaaagtacttcttgaaagtccacaagaatagtacaacagcacacgtgccaccacctcggcccaaacgcaaagcagctcatccttatccccagaaggcaccaaaaaatgtttcagtaccactgcaagcctctatgggttacccttcttcaatgaattcccttccacctggatatccatcatgggatgacacttccttactcttaaattctccatctggcggaacaatccatcacaagatgaataccattttcaaagaattcaggggagctacattgattagtaacagcggcatcagtggcattagaagttccagcagaacagcgcggagttctgaactaccagagcagagcaaactaggt

SEQ ID NO: 3242 - DNA, 560 bp, Artificial
  Synthetic
cccccccttttggctgctcttttgtggttggccgcacaaaggtgaaatactgggagtgttggcgtgatatagaggtctaggaggaggtatgaggtactacttgtgtcaggtccagcgtttggttggagatatggaaggaggagtgcttttgtttgtggaagacctcaactctaactgacaaagcgaccaattgccaacacttctgttatatttcttctttttcttgaattgggaatggagattaattcctctggtgaggaagcggtggtaaaggtgaggaagccatacacaatcacaaagcagagggagcgttggactgaggcaaagcacaacaggttccttgaagccttgaaactgtatgggagagcctggcagcgcatagaagagcatgttgggacaaagacagctgtgcagatcagaagtcatgctcaaaagttcttcaccaagttggaaaaggaagctatcaacaatggcacttctccaggacaagctcatgacatcgacatacctccaccacgaccaaaaagaaaacctaacagtccatatcctcgaaaaagttg

SEQ ID NO: 3243 - DNA, 633 bp, Artificial
  Synthetic
gtttggacggaacatcggggcagctatggctatggcgtctagggttttctccctttctccggcagctatggcgtccaagcttggcggcagtgttgatccccttgcttcccttccccgccgcctttccttccctctgccctcccggaattcctttaggattgctgtggcctcttcttcttcttcttcttcctcccccccttctgtccctaacgtggcgaaatccgaggaggaatggcgtgctatcctttccccagagcagttccgcattcttcgcttgaaaggcaccgagagaccaggtagtggagaatatgacaaattttatgaagagggcgtgtatgagtgtgcaggttgtggcactcctctttacaaatcttctggcaagtttaattctggatgtggttggcctgctttctatgaaggcttaactggcgccatcaaatcaactgttgatgcagatgggcgcaggacagagataacttgtgctgcgtgcggggggcatttgggtcatgtatttaaaggggaaggctttcccactcctaccaatgagaggcactgtgtcaatagcgtctctatcaagtttgttccagctaactaactcaaatttgcttctcttttttatcctataatgattgt

SEQ ID NO: 3244 - DNA, 489 bp, Artificial
  Synthetic
gggcggacggaggcggcgtgaagaagagcgaggaggaatggcgggcaatcctgaccccggagcagttccgtgtgatccggcgcaagggcacggagtttgctggcacgggaatctacaacaagcactttgaggagggtgtctacgaatgcgccgcctgtgggacaccgctctacaagtcggacaccaagtttgattccggctgtggatggcctgcattctttgaaggcctgcccggcgctatcaatcggaacgccgatgccgacggtcggcgcgtcgagataacctgtgccgcgtgtggtggtcacctgggacacgtcttcaaaggcgaggggtaccgaacaccgacagacgagcgtcactgcgtcaacagtgtctcgctgaagttcacacccgatgacgaagattgataatcagttagtgggatgatgtctgctcaacaaataaacaatcaagtaagcaaacctcttctgtttttcttctctcgctagg

SEQ ID NO: 3245 - DNA, 434 bp, Artificial
  Synthetic
ttatcactgagatgtgatagcggaagagaacttgagagcaacgctgttgacgcaatggcgttcgtcagttggtgttggaaaaccttcattttttaagacatgacctagatgtccatcacattttgtgcaagttatctcatatcttaatccagctctctcctcggttcggttaatggcgccaggaatagcatcaaaaaaagccggccaaccgcaaccggaatcgaatttagtggttgatttataaaccggatttccacaaccaacacaacagtagattccttcctcgaacaacttcacatattctcctgaccctctcttttcaatagatttctctctaagaatcttaaactgttcaggagatagaaccgtacgccactcctcgttggactttttgatcataccagcttcaggagccgccttcgtttccatgctgc

SEQ ID NO: 3246 - DNA, 419 bp, Artificial
  Synthetic
gcagcatggcggctccgggatcggttcagaaaggagatgaagagtggcgtgcgattctttcacctgaacagtttcggattcttcgtcaaaagggcactgaatatccaggaacaggggaatatgtcaacttcgacaaggaaggagtttacggttgtgtaggatgcaatgctcctctttataaatccaccacaaagttcaacgctggttgtggctggccagctttctttgaaggaatccccggtgccattacccgaacgacagacccagatgggagaagaatagagatcaactgtgcaacatgtggtggacatcttggtcatgttttcaaaggagaaggtttcgctactccaaccgatgaacgccattgcgtgaacagcgtttcgcttaagttcacacccgcagcgtcttccttgtaataa

SEQ ID NO: 3247 - DNA, 389 bp, Artificial
  Synthetic
aattcggcaccagaatcgttgaatccgattcgatttgcctctcttccggcgtagcttcgacggtggcaatggcggctccgggatcggttcataaaggagatgaagagtggcgtgcgattctttcacctgaacagtttcggattcttcgtcaaaagggcactgaatatccaggaacaggggaatatgtcaacttcgacaaggaaggagtttacggttgtgtaggatgcaatgctcctctttataaatccaccacaaagttcaacgctggttgtggctggccagctttctttgaaggaatccccggtgccattacccgaacgacagacccagatgggagaagaatagagatcaactgtgcaacatgtggtggacatcttggtcatgttttc

SEQ ID NO: 3248 - DNA, 428 bp, Artificial
  Synthetic
gcagcatggcggatcttgtgacggtggttaaaaaaacagaggaggagtggcgtgcagttctttctcctgaacagtttcggattctccgtcaaaagggcactgaaacgccgggaacagaagaatatgacaagttctttgaggaaggaatcttcagctgcatcggatgcaaaactcctctttataaatccaccacgaagtttgacgccggatgcggctggccagctttctttgaaggactccccggtgccattaaccgagcccctgatccagatgggagaagaactgagatcacttgtgccgtatgtgatggacatttaggccatgttcataaaggtgaaggttatagtactccaaccgatgaacgcctttgtgttaacagcgtttcgatcaattttaacccggccaaaccttcctctataacctgataa

SEQ ID NO: 3249 - DNA, 647 bp, Artificial
  Synthetic
gcgccaatgtcgcccgggacgatctatctcgatgtcccggaatcgccatcgctcgacagcacggaatccacggccgatgccgatgtggtgtcagtgaccgcggtgggggcagcagcggcagcggcctcctcgacgccatcggcctcttccggatcgtccaaggcctgccccaaatccaccagcagcgtccatgagctcctggaatgcccggtttgcaccaactcgatgtatccacccatccaccagtgtccaaatggccataccctttgttctacttgcaaagttcgtgttcacaatcgttgtccgacttgccgatacgagcttggaaacattcgctgcctggccttggagaaggtggcggaatcgctggagctcccctgcaggtaccagggacttggatgcccggatattttcccttactacagcaagctcaagcatgaagctcagtgttgcttccggccttacggctgcccctacgcgggatccgagtgctcggtcagcggcaacattccgactttggttgctcacttgcgagacgatcacaaagttgacatgcacaatggctgcactttcaaccatcgctacgtgaagtcgaatcctcaggaagtcgagaatgctacttggatgctcacggttttcaactgtta

SEQ ID NO: 3250 - DNA, 956 bp, Artificial
  Synthetic
gcagcatggatgtgacagatgatgaagagatccaccaagatcgccattcctacgcttctgtttccaagcatcatcatactaataacaacaccaccaacgttaatgctgctgcttctgggcttctccctaccaccaccagtgttcatgagcttctcgaatgtcctgtctgcaccaattctatgtaccctcccattcatcagtgtcacaatggacatacgttgtgttcaacctgtaaagccagggttcacaaccgctgcccaacttgtagacaagagctcggtgatatccgttgtttggcactggaaaaagtagccgaatcacttgaactaccttgtaaacacatgtcacttggatgtcctgaaatcttcccttattacagtaagctcaaacatgagactgtatgtaacttcagaccttatagctgcccttatgctggatccgagtgttctgttacgggcgatatccctttcttagttgctcatctgagggatgatcataaggtggatatgcattctgggtgtactttcaaccatcgttatgtcaagtctaatcctcgtgaagtcgaaaacgccacatggatgttaactgtctttcactgcttcggtcaatacttctgtcttcactttgaggcattccagctcggaatggctccagtctacatggcgttcctgcgtttcatgggggacgagacagaagctcgaaactacaattacagtttagaagtgggaggttatggtcggaagctgatatgggaaggaacaccaagaagcgtaagagacagccacaggaaagttagagacagtcatgatggactaattatacaaagaaacatggctctcttcttctcaggtggagataggaaagagctgaaacttcgagtcactggaaggatatggaaagagcaacaacaaagtggtgaaggtggaggagcttgtatcccaaacttgtcttgataa

SEQ ID NO: 3251 - DNA, 600 bp, Artificial
  Synthetic
agctcatcaagaacgggaatagatccatcgattagcggcatttttcgctggaattcagctccaattgcggtgccgagtcgtcgccagcgaatcatgggggcatcgcagtcgagtaaggattcatcgtcttcttcggtcagtgacacagaatttaagggtgtgagcgatgacgagtggaagaagcggctcacggacgagcttttttacgtcacgagaaagaaagggaccgaaagagctttcgcagggcagtactgggatacaaagactactggaatttacgagtgcatttgctgtggaacaccactattcaactccaagaccaaattcgacagcggcaccgggtggccatcgtactacgaaccgatcggaaacaatgtcaaaagcgagagcgactggtccattccgttcatgcctcgcacagaagtgaagtgtgccaagtgcgacgctcacttgggacatgtcttcgacgatggtccgcctcccactggaaagcgatattgcatcaacagtgcttcgcttaacttgaagtcgagctcatagaaaggtcagccctttcatgtcgtaaatatcaatccaataagttgcagaaggttttccatc

SEQ ID NO: 3252 - DNA, 660 bp, Artificial
  Synthetic
gcagcatgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgtt

SEQ ID NO: 3253 - DNA, 633 bp, Artificial
  Synthetic
gcagcatgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatg

SEQ ID NO: 3254 - DNA, 845 bp, Artificial; identical to SEQ ID NO: 1000
  Synthetic

SEQ ID NO: 3255 - DNA, 524 bp, Artificial; identical to SEQ ID NO: 145
  Synthetic

SEQ ID NO: 3256 - DNA, 664 bp, Artificial
  Synthetic
gcagcatgggttccaattttcattacacaatagatctcaatgaagatcaaaaccatcagccttttttcgcttctcttggatcctctcttcatcatcatctacaacaacaacaacaacaacaacaacattttcatcaccaagcctcttctaatccctcttctttgatgtcaccgtctctttcctactttcctttcttgataaactctcgccaagatcaagtatatgttgggtacaacaataacacttttcatgatgttcttgatacccatatctcccaacctctcgagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaa

SEQ ID NO: 3257 - DNA, 355 bp, Artificial
  Synthetic
ttatcacccgtgaaccattccgtgcgatagagccattagtaaaatggcagcctccttctcatcttgagggaaaacttgctgataagctgaacttttgctcaacagtaatgctagatcatcgaaatagatattgtctgaagatgataacatcgtggagttgctctgggtctccaaatcctcggctaatgcggtctcctctagtgtgatcattctcttacacgtgtttacctttaggggcaaaggagataagattttacaaactccatttgatatcttgttcttgtgttgcatcttcttcttcatgaccggtggggatacgccagggactgcggttgcggttgccgtggccatagcg

SEQ ID NO: 3258 - DNA, 723 bp, Artificial
  Synthetic
gggttttttttggggggtggaattctacaaatagctcaagaatttagcccaaaagaaagatggctgcaggtacttcatcagctgtgtttcttgcaatgagagaagaagaacaaaaccaacaaatgaaacaacaacaacaagaagaatttctcattcaacagcaagcaccacaaaagaagagaagaaatcagcctggcacaccaaatccagatgcagagataatagcactatcacctaagaccctaatggcaacaaacaggttcgtatgtgaggtatgcaacaaaggttttcaaagggaacaaaacctacagctacacagaagaggacacaatttaccttggaagctaaagcagaagagtacaaaagaagtgaaacgcaaagtttatttgtgccctgagcctacatgtgttcaccatgacccttctcgagcccttggcgatctcactggtattaagaaacattactccagaaaacatggtgagaagaaatataagtgtgaaaaatgttgtaaaaaatatgctgtccagtctgattggaaagctcatactaaaacctgtggtactcgcgaatacaaatgtgattgtggcacccttttctcaaggcgtgatagtttcatcacccacagagccttttgtgatgcattggcacaagaaagtgcgagaaatccaccaagtttgagcagcattgggagtcatttatatgggagtagcaacaacatgagtt

SEQ ID NO: 3259 - DNA, 271 bp, Artificial
  Synthetic
tagactcgttttttcacctctatgtttttgtctcttttaagaagcttccatggaactttgtgacgtcttctatgcatctggagattctggtctctttgaaacccttggttacagatctcacatatgtatctgtctgattcaagaagagttcttggtgataaagacacaacttctgcatctggatctggggtacctgcaggtcttcttttcctcttctgagtggatgtgtttgtggtggtgaccccattttctgaagaggagaggaaaggat

SEQ ID NO: 3260 - DNA, 560 bp, Artificial
  Synthetic
gcagcatgcggattttgtgcgatgcttgcgagaacgcagccgcaatcatcttttgcgccgccgatgaagctgccctttgtcgcccctgcgatgaaaaagttcatatgtgcaacaagctagctagtcggcatgtacgtgttggtttagctgaaccaagcaatgccccatgctgtgatatatgcgaaaatgcacctgccttcttttactgtgagatagacggtagttctctttgtctgcaatgtgacatggtagtacatgttggtggcaagagaacacacggtcggtttcttttgctgagacagagaatcgagtttccaggggataagcctaaagaaaacaatacgagggacaatttgcagaaccaaagagtctctacaaatggaaatggtgaagccaatgggaagattgatgacgaaatgattgatctaaatgctaatccacaaagagtacatgagccatcatcaaataacaacgggattgatgtaaataacgagaacaatcacgagcctgcaggccttgtaccagttggaccctttaaacgagagtctgagaagtgataa

SEQ ID NO: 3261 - DNA, 249 bp, Artificial
  Synthetic
ttatcaggggtatgacggccagccagatgaatcaaacagcatcggattgttgggtggagcgtaaacttgattccctccggtgatttgatttgcgttcatattctccgttcttggatgagctaccaccaccgatgaaatctccaccgtgtcttcctcaccggaaactttgatggtcccggcagagatttgcttcttgatcaaaccctggtctcttagtagagctctcagcttcttcacctcatcgtgtaa

SEQ ID NO: 3262 - DNA, 606 bp, Artificial
  Synthetic
aacgcgacagcttcgcctcgtctctcccccccgagtccccaacccctcctcctcctcctcttccccttccccgcgccgcggcgagatcgctccccccgggggcagcagctagatcccgatggcttcgcgccgccgcaccctcctcaaggtcatcatcctcggcgacagcggggttgggaagacgtccctgatgaaccaatatgtgaacaagaagttcagcaaccagtacaaggctacgattggcgcggatttcctcaccaaggaggttcagttcgaggataggctcttcactttgcaaatatgggatactgctggccaggaaaggtttcagagtcttggtgttgcattctaccgtggagcagattgctgtgttctagtttatgatgtcaattctatgaagtcatttgataatcttaacaactggcgtgaagaatttctaattcaggcaagcccatcagaccctgataacttcccttttgttcttttgggcaacaaagttgatgtagacggtggcaacagccgtgtggtctctgagaagaaggcaaaggcatggtgtgcctctaaagggaatatcccatactttgagacatctgccaaggatggtac

SEQ ID NO: 3263 - DNA, 917 bp, Artificial
  Synthetic
acgaagaaagaagggaaagcggtgccatcgcgggcaggagcagggccagatctgagctgcgccgccatcgatcgacgacccaatccactgccgcagctaaggcgccgcgagatccggaggtcttttgcagggatttcggggattcgctggtttttcttgatctcttcctcggttctgcgaagaagacgcatcggcagcaatgaatcccgagtatgactatctcttcaaactcctcctaattggcgattctggcgtcgggaaatcgtgcctgctgctacgattcgcggatgattcttaccttgagagctacatcagcaccatcggggtggacttcaaaatccgaacagtggagctggaagggaagactatcaagctccaaatctgggacactgctgggcaagagcgcttcaggactatcacgagcagttactatcgtggagctcatggcataatcgtcgtgtacgacgtgactgaccaggaaagcttcaacaacgtcaagcagtggctcaacgagattgatcgctacgcgagcgagaatgtgaacaagctcctcgtcgggaacaagtcggatctcactgccaagaaggtggtcgacactcagactgccaaggcctttgcagacgagataggaatcccgtttctagaaaccagtgccaagaacgcgaccaacgtagagcaggcattcatgaccatggctgcggagatcaagaacaggatggcaagccaaccagcgatgagcaacaagccgaccaacgtgaatatcaacaaggggcaacctctcaaccagaagaatggctgctgctaggaggaggaagcaaaagaagcacaagatttacgtagatgatgctgcgatgaatggtcgatcgttgtttcaattttttctttttcttctctccagtggatattttttagtactc

SEQ ID NO: 3264 - DNA, 677 bp, Artificial
  Synthetic
tttgcgggagagctctcgccgaaggcctgatctgtgctgggatctacaccaggagctcaagcatggcatccaggaagcgaactctcctcaaggcgatcattctcggcgacagcggcgtcggcaagacatcgctcatgaatcaatacgtgaacaagaaatttagcaaccagtacaaggcgaccattggagcggattttctcaccatggaagtccaagtggaggataggctagtgacgatgcagatatgggatacagccggtcaggagcgattccaaagccttggtgtggccttctatcgaggggctgattgctgtgtgttggtatacgacgtgaatgtgatgaagtcgtttgataatctggacaactggcgcgacgagttcctcatccaggcaagtccttctgatccagagaacttcccttttattgttcttggcaacaaggtcgatgtagacggggggaacagcagagtggtatccgagaagaaagccaaggcctggtgcgcgtcgaagggcaacattccatactttgagacgtctgccaaagaagactacaacgttgaggctgcctttcaatgtatagcgaagaatgccttgaggagtgaacccgaagaagacttctaccttccggacacgaatgacctcgcaaacaacaacagagtgacgagatcatctgggtgt

SEQ ID NO: 3265 - DNA, 670 bp, Artificial
  Synthetic
cccacgcgtccggagagagagagagcttggattttttggaaaggagagagagagagagggtgcacctctttttttcactcttaagtttatttttgctctatttttatatttcctcttcttcgatccgcatcgctctgctctgctctgctcctccctcgtcagaactttgtgcagaacctagggtcctttcggggggaaaggggggggcagagaaggacccatcatggcctacagagcagatgaagagtatgactatctattcaagcttgtgctcattggagactctggagtgggcaagtcaaacctcctctctagattcactcggaacgaattcagtctcgattccaaatcgactattggtgttgagtttgccacgcgtagtctaaacgtcgacgggaagatgatcaaagcccaaatttgggacaccgccggccaagaaaggtatagagccatcacaagtgcatactatcggggcgcagttggcgcattgcttgtgtttgatgtgactaggcatgtcaccttcgagaatgtcgagaggtggttaaaagagcttaaagatcacactgacgcgaatgcggttgtcatgcttgttgggaacaagagcgatctccgacaccttcgggcggtttcaacggaggacggccaagccttctccgagagagagggcctc

SEQ ID NO: 3266 - DNA, 345 bp, Artificial
  Synthetic
cccacgcgtccgctacaattcctctgtcgctctcaccagttaacagctacagcacataactgtaaccacgcttaccaactcttaaacctgaaatagagaaagagagagagagatacatggagtatgtgtgcgattttatggcttgtttgattgacgatgcagcatatcatttttttagcaaaagatcttgataagagtgactatgaccgatgacaaaacccgagcaaaagcaatgacaaaagcagttcagtttaaagccgtggaaataaaaggcgatcacaggaaccagatagaggtaaccggcgttgaagttgatatgatccctcttatccaaatactcagaaa

SEQ ID NO: 3267 - DNA, 636 bp, Artificial
  Synthetic
ctttttttctcttcctcaattttctctcttctctctctttccgccgattccagatctcattttcgagagagtgaagaagaagaagagaaccagaattgaataaaatggcggcagtatcgccattagcaaaatacaagttggtttttttgggagatcaatctgttggaaaaactagcatcattactcgcttcatgtacgataaattcgacaccacctaccaggctacaattggtatcgattttttgtcgaagacaatgtaccttgaagatcgaacagttcgcttgcagctctgggatactgctggtcaggagagatttaggagtcttattccgagctacatcagagattcttctgttgctgtaattgtctatgatgttgccaaccgccaatcatttctaaacacttcaaagtggattgaggaagtacgtactgaacggggcagtgatgtcataatcgttcttgttgggaacaaaactgatcttgttgataaaaggcaagtatccatcgaagaaggcgaaaccaaggctcgtgaatttaacgtaatgttcatagaaaccagtgctaaagctggattcaatatcaagcctctgttccgaaagattgctgctgctttaccgggaatggaagccctttcgt

SEQ ID NO: 3268 - DNA, 572 bp, Artificial
  Synthetic
gtcctttgactgcttttgtccttcccatggccgcctctggaccagcccgcgctcgtgaccacgactacctcatcaagctgctgctcatcggggatagcggtgttggcaagagttgcttgcttctacgattttctgatgatacattcactacaagtttcatcacaaccataggaattgatttcaagataagaaccattgagatggatggaaagagaataaagctccaaatatgggatacagctgggcaagagcgctttaggacaattactacagcatactacagaggcgccatgggtattattcttgtgtatgatgtaacggatgaatcatctttcaacaatattcgcaattggattaggaatatagaacaacatgcttcagataatgtcaacaagatattagtgggtaacaaagctgatatggatgagagcaagcgggctgtgccacatgaacgtggtcaagcacttgccaatgaatataacttgaagttctttgagacaagtgccaaaacaaatatgaatgttgaagaagtctttttttccattgcaagagatatcaagcagcggttatca

SEQ ID NO: 3269 - DNA, 633 bp, Artificial
  Synthetic
caaccccaacccctcttcaaaccacttatcacgcgctctgctacctccccatacaacacacacacacacacacttaatttctctcgctaaacccacgaatccatactcccatttgctttccccgtgatcattttccggcgagatctctgatactccgtcggaaaatcctgatcggatccgctatctctgaactgcgattcactttgcgatttcgaaagatccgattagatatggctccagtttcggctcttgcgaagtacaagctcgtcttcttaggagatcaatctgtcggcaaaaccagtattatcacgcgattcatgtatgataaattcgataacacttatcaggctacaattggtattgactttctgtctaagactatgtaccttgaagatcgtacagtacgattgcagctatgggatactgcaggtcaagagagatttaggagtctcataccaagctatattagggactcctctgttgctgtcattgtgtttgatgttgctagcaggcagtccttcttaaatacttcaaagtggattgaggaggttcgaactgagaggggcagcgatgttattattgtccttgttggtaacaaaactgatctagttgacaaaaggcaagtttcaatcg

SEQ ID NO: 3270 - DNA, 581 bp, Artificial
  Synthetic
cccctctccgcctcgcgaatctcctcccctcccccacgcaactcgccgcctgcgctgccgctgctcgtgagggggagacgacgccggaggagatcgccgccgccgccgccgccgcctcggacggccgcgcccccccgccgcgcgtgtaccacgggcttgggggattgattggtagcgatggcggcgccgccggctagggctcgggccgactacgattatctcatcaagctgctcctcattggcgacagcggtgtaggaaaaagttgtctcctcctacggttctcagatggctctttcacgactagtttcattaccacaattggtattgacttcaagataaggaccgttgagttggatggtaaacggattaaattgcaaatctgggatactggtggccaagaacgctttcgaactattaccactgcttactacaggggagcaatgggcattttactcgtttatgatgtcaccgatgaatcttcattcaacaacataagaaattggatcagaaacatcgaacaacatgcctctgataatgtgaacaaaattttggtggggaacaaagctgatatggatgaaag

SEQ ID NO: 3271 - DNA, 442 bp, Artificial
  Synthetic
acgtttttgcatctgaattctgccgcgaacaatcagattccgtacaattctcgccggtagatctctcaatattccggtgactttcgtgtgcttttaatcgccatgaatccagaatatgactacctgtacaagcttctgcttatcggtgattctggtgttgggaagtcatgtctccttttgagatttgctgatgacacatatcatgagagctacataagcacaactggagttgattttaaaatccggacagtggatcaagatgggaagaccattaagcttcagatttgggatactgctggacaagagcgtgttaggacgatcactagcagctactatcgcggagcccatggcataataattgtctatgatgtgacggatcacgagagcttcaataatgcgaagcaaaggctgaatgaaattgatcgttatgctaccccaaacg

SEQ ID NO: 3272 - DNA, 636 bp, Artificial
  Synthetic
gagagtgctctcaagcaaaggatttctctagagagagagagagcgagagagtgtgtctgtgtgagtgtgagaaagagagagagaaatagagatggcaaggagaccggacgaggagtacgattacttgttcaagatagtgttaatcggagattcaggagtaggcaaatccaacttgctctccagattcactagaaatgagttttgcttggagtccaaatctactatcggcgttgaattcgccactcgtactctccaggttgagggaaggatcattaagtctcagatctgggacactgctggacaggagagatatagagccattacaagtgcttactatagaggtgcacttggagctcttctggtatacgatgtgacaaaacctatgtcctttgaaaatgtcagccgatggttaaaggaactgagggatcatgcagactccaacattgtgattatgctcattggaaacaagactgatctgaagcatctccgagcagttcctacagaggatgctcagggctatgctgaaagagaagggcttctttcattgaaacatctgctttggaggcaacgaacgtagaaaaagctttccagatgaatctttcagaaatctatcggataatcagtaagaagtcactt

SEQ ID NO: 3273 - DNA, 660 bp, Artificial
  Synthetic
accttgctctccgtcattttccggcgacgatccctttttccgctatttccggccgtaaggaacagaaacatccccgttcccttcgccctttggatcagtcagcttcgcaaaatcatgaatcccgaatatgactacttgttcaaacttttgttaataggagattcaggtgttggaaagtcatgtcttctcctgagatttgctgatgattcttatttggacagctatatcagcacaattggtgttgactttaaaatacgtacagtggagcaagatgggaagactattaaacttcaaatttgggacactgccggacaagaacgtttcaggacaattacaagtagttactaccgtggagcacatggcattataataacttatgatataactgatcaagaaagcttcaacaatgttaagcaatggttgagtgaaattgatcgctatgcaagcgaaaacgtaaacaagcttctggttggaaataagtgtgacctaactgacaaccgagctgtgtcatatgatacagcaaaggcgtttgctgatgaaatcggcatcccgtttatggagactagtgcaaagagtgccactaatgttgagcaagcgttcatggcaatggcagctgaaataaagaataggatggcgagccagccgacatcaaacaatgca

SEQ ID NO: 3274 - DNA, 607 bp, Artificial
  Synthetic
ctcccttctaacagttgattataggaggacttcaatttctgaaagatcgtttcaaatttactggtttttattcattttttagctccgtttaacccttttgaacaaaaataatggcagctcgaaggcggatgcttctcaaggtcataatcctaggcgatagcggggtgggaaagacatctctgatgaaccagtatgtgaatcgtaagtttagtaaccaatacaaggcgacaatcggagctgatttcttgacaaaagaaattcagtttgaggataggttatacacattgcagatatgggatacagctgggcaggaaaggttccaaagcctgggtgtagctttttaccgtggagcagattgttgtgttctagtatatgatgtgaatgttatgaagtcatttgagaatcttaacaactggagggaagaatttttaatccaggcaagcccatctgatcccgagaacttcccatttgtcgtagtggggaataagatagatgttgatggtggcaacagtcgagtggtctctgagaagaaagtaaaggcatggtgtgcttccaagggaaacataccatattttgagacctcagcaaaagagggattcaatgtgga

SEQ ID NO: 3275 - DNA, 643 bp, Artificial
  Synthetic
ttcttgacgtcaaccatcctcttccttttttcaagtcctaattctaatcaaaaccctaatcgaacgatcacaaaaatctccatcacgaccaaataatcatttctcttctgcaaatttcgatcaattaacaactatggcaaccggtggaaacaagaatatgaacgccaaattggtgcttcttggagatgttggagctggaaaatctagtctagttctgcgttttgttaaaggacaatttattgaatttcaggaatcaactattggtgctgcatttttctcccaaacagtagcagtgaatgatgcaactgtaaaatttgaaatatgggacacagcaggccaagagagataccacagtcttgctccaatgtactatagaggagctgcggctgctataattgtttttgatatcacaaatcaagcatcatttgatagggcacaaaagtgggttcaggagcttcaggcacaaggtaatccaaatatggtgatggcacttgccgggaataaggcagatttgttagatgcaagaaaagtggctgcagaggaagcccaaacatatgcccaggagaatggccttttcttcatggaaacatctgcaaaaactgcatctaatgttcatgacattttctatgacatagcaaagaga

SEQ ID NO: 3276 - DNA, 593 bp, Artificial
  Synthetic
gatcgaagccccaaaaacatgcgcagaaaaggtcggttgtccagataagggagtagtacatattatgctcaataacaactactgggcatcaatcatcaattctactggaaacgtctaaaattgccaactgtctgtcttcctcacgccacacacacacacacataccggcgcggagttttctgaatttagtctcgttttgtcagatcgaagtccgccgaagatgccttcacgccggcgaactcttttgaaagtcatcatcctcggtgatagcggggttgggaagacctcgttgatgaatcaatatgtaaataagaagttcagcaaccagtacaaagcaactattggggctgatttcttgacaaaggaagtgcagtttgaagatcggctctttacattacagatttgggacacagctggccaagagagatttcaaagtcttggtgttgcgttctaccgtggtgctgattgctgcgtccttgtgtatgatgtaaattcaatgaagtcatttgaaaacataaacaattggagagaagagtttctaattcaggctagcccatcggatccagaaaattttccatttgttgtgctgggaa

SEQ ID NO: 3277 - DNA, 647 bp, Artificial
  Synthetic
cccccgagcagcgctcgtgttcggtcaaaagcctcgccgcggcgagctcgagctcatgggcattccggaggggagggagggatgggggacgagtcggagggggagacggaggagtacctgttcaaggtggtgatcatcggggacagcgcggtggggaagagcaacctgctgtcccgctacgcccgcaacgagttcaatctccactccaaggccaccatcggcgtcgagttccagacgcagagcatggacatcaacggcaaggacgtcaaggcccagatctgggacaccgccggccaggagcgcttccgcgccgtcacctccgcctactaccgcggcgccttcggcgccctcctcgtctacgacatctcccgccgctccaccttcgacaacgtcggtcgctggctccaagaactcaacacacattcggacacgactgtagccaagatgttggtgggcaacaagtgtgatctggataatatccgtgaagtgccggtagaggaaggcaaagcacttgctgaagctgaagggctgttcttcatggagacctctgctctggactcgacaaacgtgaggacagctttcgagatcgtaatcaaggagatctacagcaacgtgagcaggaagatcttgaattcggactcctacaa

SEQ ID NO: 3278 - DNA, 613 bp, Artificial; identical to SEQ ID NO: 207
  Synthetic

SEQ ID NO: 3279 - DNA, 437 bp, Artificial
  Synthetic
gcagcatgaatagaaaatacttggatcgtcgatcatattcatggtccggatcacaagcaagaccatacatatgcgaattttgcgagagaggtttttccaacgcacaagctttaggagggcacatgaacatccacagaaaagacagggcaaaacttcgacaagcgaacctaaaagaagaagacagtgaagatgccatttgcaccacttcgagaaatcggtttgggcaagagcttattgagttacctttcttcgttgatacggtcggtccaagaagaaaaggagaagatgataaaagcgaaaaaggtttaggagatgaagaaaagaaaaatatgaggatacttcaaaaggctttatctcaaagtgcagacgtgatagatcttgagctccgtctaggattagatccttataaaaaaacaacaagtacaagtacgtaataa

SEQ ID NO: 3280 - DNA, 770 bp, Artificial
  Synthetic
ttattaaagatgaagatcgagactcacatgatcttgcacgttagggctcaatccgtaaccgtacgatgacattctgttctgagcagcggagccacccacttgcgatgatagttgagtttgagaacgggtcaacaacggtaaagtcgaattagaagaagaagaagagccattactagtaaacgctgcgtttgagttataaacgccttgaacgcgaggcggtagacgccatagtcctaactgactcccatagctgggtcgtgtataataccccgacggcttaggaccagaagaaaatcctccataggacctagccgcggttaacggaccattggtccacgacgggtaatgacggtaactgtaagggttattgtcaggatgataaaagtaagaggaaacaccgcgtttggcaagctgacgttcgcgtttgtgagcgttttggtgtccacctagggcttgtgaagtaggaaaatttctaaagcaatagtgacactcgaatctcctgttgtggctgatgctattattgtccgtactgttgtctccggtttggtcttcttcctcttcttcttctttgtttttggtctggtaaggatcggtgtagtcttcttgaccggtagtaatagagaaatctctgccggtgaaatcttttccgaagacacgaatgggtttagggttcttatctttaggacggcgaatgaaaggaagctgagagaaggattcgacgttcacgaaatcttgagtttctgtttctccggtagcgtcgtccatgctgc

SEQ ID NO: 3281 - DNA, 217 bp, Artificial
  Synthetic
gcagcatgactcaaaagctgtttatacagtatagtctacggtcttacatcgtattttggaaatatgaccaaattaccccttggtttgtccataaatatcaagctccaacaatgcaattcttcccttttccccttctaatttctctcatctctctattagaaaaattattagcaattatgttgtccactgcaccggccttttcattctccgaaccggg

SEQ ID NO: 3282 - DNA, 603 bp, Artificial
  Synthetic
ttatcattgaagatgagggtggttttgttcagtcatgatcattctccggttatgtagttcccattgttgctgttgttgaagttgtctaatgatcagaatccgacgcatctccgacaatcttagccggagtatctcttgttctgtcacgagccggttattgtcggaattcactcgttgaagctggtgtaaaactaaccggagtcggttcccgagctcacggttttctaaatccaaccggtttacttgctctcgtaagttatcaatgtgactttgtttacgcattcttgaccgtttcgctgattcccggtttgactccatcctcttcctcttccgctcgtcggtcatctccggttggatcatttttttccggttatggttattctctcccgaaccgaaatttgtgatggctgtcaattgttttgtgtcgtccgagtccggttcatctgcttgagagcacggtagatcgtttgatatgtcggcgtcgtcacgacgaggattaattttgacgaaaccggcacaagattcgtcagaaccggttttcatgtcatgagaaccggaattaattttgacggaaccagtgtcggattcaccataacaaggact

SEQ ID NO: 3283 - DNA, 525 bp, Artificial
  Synthetic
gcagcatgggtcaaaagttttgggagaatcaagaagatcgagcgatggttgaatccaccataggctctgaagcttgcgactttttcatctcaacagcttcagcttccaacactgccttgtccaagcttgtctcaccaccaagtgattccaatctccaacaagggttacgtcacgttgttgaaggatctgattgggattatgctcttttctggctagcgtccaacgttaatagctctgatggttgtgtcttgatctggggagatggtcattgccgtgtcaaaaagggtgcttcaggtgaggattactctcagcaagatgagatcaaaagacgtgtgcttcgcaagcttcacttgtcgttcgttggttcagatgaagatcatcgtttggtgaaatcacgagctcttactgatctcgacatgtctgatctggcttctttgtactttccctttaggtgtgataccaataagtacggtccctgctggaacctatgtgtctgggaagcctctttgggctgcacatttgcct

SEQ ID NO: 3284 - DNA, 414 bp, Artificial
  Synthetic
acggttattactgtgatacagaggcaaggagcttgtccttcaactgctcagcggtgcaggcaccctgaggccggacagtgaatgtgtgaaccacaccctcctctgtgatggccacgttggaatcatgaggcataacttcattctccctcaacgtctgtatcacctttgaaactggatgagtttccaacggacagcttagccttacaactgcatcatcatgcctctgttgataatcaacctctgctggagttatctgattactctccctcctcttcattatctgcttctctgtttcatacaccctgattttcttctgcatatccgtgatgtaagtgattgggtctgcaaggagcgaagccttgtccactcttggagatgttaggcaccaccgctctcaaagcgtagaatctctgg

SEQ ID NO: 3285 - DNA, 959 bp, Artificial
  Synthetic
gcagcatggagagacgaacgagacgagtgaagttcacagagaatcgtacggtcacaaacgtagcagctacaccatctaacgggtctccgagactggtccgtatcactgttactgatcctttcgctactgactcgtctagcgacgacgacgacaacaacaacgtcacggtggttccaagagtgaaacgatacgtgaaggagattagattctgccaaggtgaatcttcttcctccaccgcggcgaggaaaggtaagcacaaggaggaggaaagcgtagtggttgaagatgacgtgtcgacgtcggtgaagcctaaaaagtacagaggcgtgagacagagaccttggggaaaattcgcggcggagattagagatccgtcgagccgtactcggatttggtttgggacttttgtcacggcggaggaagctgctatagcgtacgatagagccgcgattcatctcaaaggacctaaagcgctcacgaatttcctaactccgccgacgccaacgccggttatcgatctccaaacggtttccgcctgcgattacggtagagattctcggcagagccttcattcaacgacctctgttataagattccacgtcaacgaggaaacagagcatgagattgaagcgatcgagctatctccggagagaaagtcgccggttataaaagcaagaagaagaatcgtcgccggttttggtgttcccggatccgtatctgttaccggatttatctctcgccgccgaatgtttttggcataccgacattgcccctgaccttttgtttctccgatgaagaaaccggatcacaatcaactttgttaccatacacagaggtttcgatacaaggagaaacccaaactgcagatttcgagtttggtttgattgatgatcttcgagtcttccccatgggatgtggatcatttcttcgaccatcatcatcactctttcgattaataa

SEQ ID NO: 3286 - DNA, 595 bp, Artificial
  Synthetic
gtcgagccacgcgtccgcggggacagatatgacggccgccctgcaagcgctgctcgaccggagggcgctgtccttgggcctgcccacgccggcgatcaacaaggaggagtacctcgccatctgcctcgccgcgctcgcctgcacgcgggcggggaaggccctggtgggagtgggaggccagcagcaggtgcaggcctgcaataagtggctgtgcccagcgcccgcggcgcctgaggagctccgcttccggtgcaccgtctgcgggaaggccttcgcctcgtaccaggcgctcggcggacacaagtccagccaccggaagccgccttccccgggagaccactacggcgccgccgccgcggcgcagcagctggcatccgctggtgactcgaaggaggactcggcgtcgtcagcggccgggagcactggcccgcaccggtgcaccatctgcaggaggagcttcgcgacggggcaggcgctcggcggccacaagcgctgccactactgggacggcacgtcggtgtccgtctccgtctcggcgtccgcgtcggccgcctcgtcggccgtcaggaacttcgacctcaacctgatgccgctg

SEQ ID NO: 3287 - DNA, 547 bp, Artificial
  Synthetic
gcagcatgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttttggaaaattactagtaa

SEQ ID NO: 3288 - DNA, 995 bp, Artificial
  Synthetic
gcagcatgaatcttgaccaagaactcgccgagatcagagctagcagttccgaccacaccaattacttctacagctcggagaggagagagcacatgttcgacaaagtgttgacaccaagtgacgtcggtaaactaaaccggctcgtgattccaaagcaacatgcagagaacttcttccctttagaggacaatcaaaacggcacagtgttggatttccaagacaaaaacggcaagatgtggaggtttcgttactcgtattggaacagtagccaaagctacgtgatgaccaaaggatggagccgtttcgtcaaggagaagaaactcttcgccggagacaccgtctctttctaccgtggctacatccctgacgataacgcacaaccggagagacgacggaaaataatgttcatcgattggaggcctagagccgagataaactccgtacacaacattaacaatcataacttcgttttcgggtctccgacatatccaacggctaggttttatccggtgacgccggaatattccatgccataccggagttttccaccgttttatcagaaccaatttcaagaacgggaatatttagggtatggttatggtagagttgttaatggtaatggagtgcgttactacgcaggatcaccgttggatcaacatcatcagtggaatcttggtcgatctgagccgttggtttatgactcggttccagtttttccagcggggagggtacctccgtcggcgcctcctcagccgtcgacgacgaagaagctgaggctgtttggggttgacgtggaagagtcttcatcttcaggggatacacgtggcgaaatgggagtagcagggtactcttcctcgtctccggttgtgatcagagacgatgatcaatcattttggaggtcgccacgtggcgaaatggcatcgtcttcttcggctatgcagctaagtggtgatgaagaatataagaggaaagggaaatctttagagctttgataa

SEQ ID NO: 3289 - DNA, 573 bp, Artificial
  Synthetic
tgataaggtagtcacccccagtgacgtcggcaagctcaatcggttagtcatccccaaacagcacgctgagaagtatttccctcttgattcatccaccaacgagaaaggcctgctcctcaatttcgaagacagaaacggaaagtcctggcggttcagatattcttactggaatagcagccaaagctatgtgatgaccaaaggttggagccgatttgtcaaggagaagaagctcgatgctggggatattgtctcttttcagcgcggagtacgtgaattaggcaaagatcgtctgttcatcgactggagacgccgtccagatgccccgaccgaccatctccacacccacttcatgactcatgtgccgctttcaccccatttctctaataatttccagtaccgctccaatattaatcatcaatacccagctgcttggaatcaaccgctctttttgcagccagaccattcacctttacattcccgtcatgccggcagcatgtctcatcagcagcaatatagctacagcgcctatggaattcggaacagtccctaattactacgatacagcttctaatt

SEQ ID NO: 3290 - DNA, 206 bp, Artificial
  Synthetic
cccacgcgtccgctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaagga

SEQ ID NO: 3291 - DNA, 576 bp, Artificial
  Synthetic
tttcttcccctcaaagaaaattagatagagaaaaaagaagaggaagaggaacaagaacaagaagcaagcgaagcaagcgagcaagcattggagatggatcttcacgtaggaatcggcggcggcggcggcggcggcggcagcaatgcgtttggatcgggggacagcggcggtgtcggcagctgcgacagcccgaccatggcggcgctccacaagttcctgccctccaacaacgaagactcgtggtcggccgagcacctgtacgcctgcgacgagttccgcatgttcgagttcaaggtccggcgctgcatgcgggggcgcagccacgactggaccgagtgccccttcgcccacccgggggagaaggcgcgccgcagggacccccgccgcttccactactcggggacatcctgccccgacttccgcaagggctgctgcaagaacggggacagctgcgacctggcgcacggcgtgttcgagtgctggctgcatcccgcgcgctaccgcacccagccctgcaaggacggccgcaattgcaagcgcaaggtgtgcttcttcgcgcacaccccggagcagctc

SEQ ID NO: 3292 - DNA, 1066 bp, Artificial
  Synthetic
gcactattgttgttctatacacgaagatccaaaaaaatgatgatgatcggaagatcacctcactcacatccgaccgtccaagtccctccttgggacgttatggatgatccaacggttgatgttccttccccattttccgttacacacaactactccactagtcctgattctggtttcgacgccttaacggcgttgcagcgttacctgccgtcgaatggtaacgacgttttgttcgactctgacggcttggacattcccgtggatgcgttctcatgtgataatttccgcatgtatgagttcaaagtgaggaagtgtgcacgtggaaggtcacatgactggacggaatgtccgtacgctcatcccggcgaaaaggctcgccgtcgggatccgcggaagtatcattactccggcactgcttgtccagattttcgtaaaggcctgtgtaagaaaggtgatgcatgtgagtacgcgcacggcgtattcgagtgttggcttcaccctgctcgctatcgcacgcagccttgtaaggatgggacccactgtcgccggcgcgtgtgcttctttgctcacacgctggagcaactgcgtgttctccctcagaacagtccgcgaagccatgctgctgagtcttgtgactcgttcgacggatcgccgagtcgactcggttttgactcgttttcttcatctcccccgtttgactcgcctccgatgaccccgagtggatcactgagtctcaactcggttaccggactcgctgagtcgatgtgtaatatgcagattgggatggttaggggtatggttagccctacatggggattgcaaatgggttctcccgggttcggttcaccacggagcccatcaacattccgacccggattcatgagtcttccaacaactccgacccgaaacccgacccgatctggactggctgtattcgatcagtgggagaagacttacgaagaggagccaccgatggagagggtagaatctggaagggatctccgggccagaatttatgcgaaactcagcatggaaaactcgcttgactcgggtgctccggatgttg

SEQ ID NO: 3293 - DNA, 182 bp, Artificial
  Synthetic
gcagcatgatgatcggagaaactcgcaagacttatcccactgttgagatacctccatggccgatacttgaatagcttacaacgtctgagttttttcctccgggtgatgaatagtccacattgtatcatgcttgaagctttggaggagttgcaacgtgattggccgtctaacgaaacggatcc

SEQ ID NO: 3294 - DNA, 1078 bp, Artificial
  Synthetic
gcagcatgatgatcggagaaactcgcaggacttatcccactgttgaaatacctccatggccggtacttgaagagcttacaacgtcggagtttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcccggagaaaaagctcgccggagagatccgaggaagtaccattactctggtacggcttgtcctgattttcgtaaaggtggctgcaagaaaggtgactcttgtgagtttgctcatggtgttttcgagtgttggcttcatccagctcgttaccgtactcagccgtgtaaagacggtggtaactgtctccggaaaatttgtttctttgctcattcaccggatcagcttaggtttttacatactcggagccctgacagagttgattcttttgacgtttcgtctccgattcgtgctagagcatttcagctgtcgatttctccggtttctggttcgccaccgatgagtccaagagctgactcggagtcttctccgatgactcagtcactgagtcgatctctcgggtcttgttcgataaacgacgtcgttccttcgtttaggaatttacagtttaattcggtaaaatcatttcctcgtaacaatcctttattcggattcgggtcgccccgtggatcgatcttgggtcctgggtttcagtctctgcctacaacaccgacccgaccagggaatctggatatttgggagtatggtttggaggaagaacccgtaatggagcgtgtcgttgagtcgggtcgtgagctacgagaaaagatgcgcgagaaactgcacaaggagaattgcatggatcgagttgcccaggatccggatcagaatttgggtgaggctcctgatgtcgggtgggtatctgcctgctcatgtaataa

SEQ ID NO: 3295 - DNA, 563 bp, Artificial
  Synthetic
ccccgtgaagccgtgctcccgcgcctactcccatgactgggccgagtgccccttcgtccaccccggcgagaacgcgcgccgccgcgaccctcgccgctactcctacagctgcgtgccttgcccggagttccgcaagggcggctcgtgccgcaagggcgacgcgtgcgagtacgcccatggcgtgttcgagtgctggctccacccggcgcagtacaggacgcgcctctgcaaggacgaggtcggctgcgcgcgccgcatctgcttcttcgcccacaagcccgacgagctccgcgccgtcaacccctccgccgtgtccgtcggcatgcagcccaccgtatcgtcgccgcgctcctcgccgcccaacgggctcaacatggcggcggcggcggcggcgatgatgagccccgcctggccgtcgtccccagcgagccgcctcaagacggcgctcggcgcgcgggagctcgacttcgacctcgagatgctcgcgctggaccagtaccagcagaagctgttcgacaaggtgtccggcgcgccgtcgccgagggcgagctggggcgccgcgg

SEQ ID NO: 3296 - DNA, 568 bp, Artificial
  Synthetic
atccctattccgcttcttgtttccttgcattcaacattactttcatgtccccaactttctaaaagtctgtcaattcaatccaccaatatttcttgaaaagcctagaaatggaagggctttgtgctgaacaacatcatcacaagtttcatccttctcaccacctttaccttaacaagaaatctcttcgtgatattgacattcccccaagaaaactcctcagccgccgttctaatctttccgccgaccctgtctccgacatgtttatggactcacctaaatcagattcagacacccttttccagaaattcttaccttacaacagccttgacgaggatgattctgatccgtactcttccgaccactttcgtatgtacgagttcaaggtccgccgctgtactcgtagccgcagccacgattggactgactgccctttcgctcatccaggtgagaaggctcgtcggagagacccaagaaggttccattattctggaactgtttgctctgaattccgtaaaggaaattgtaaccgaggtgataattgtgagtttgcacacggggtatttgaatg

SEQ ID NO: 3297 - DNA, 511 bp, Artificial
  Synthetic
cccccccgggcttacacatcggaccactctctctgggcgcgtccataggccgagtccacgagatctcgccgtagtccatacaccggttgatcggaggtcgtgttgccgccggcggtggccatgatgatgatgggggaaggagtcagcagcgtcccgccgtggtctcacctccccgtgagcggagtcgatgtactcggcggcggtggtggcggtggggatgaaatgaccccgtacgtgatcgccgcgctgcgggattacctgccggcgaatgatgtcggggtgggggctgacaaggaggaggaggccgcggcgatggccgcggcggtggacgcgtacgcgtgcgacgagttccggatgtacgagttcaaggtgcggcggtgcgcgcgcgggcggagccatgactggaccgagtgccccttcgcgcacccgggggagaaggcgcgccgccgcgatccgggcaagtaccactattccggcaccgggtgcccggacttccgcaagggcgggtgca

SEQ ID NO: 3298 - DNA, 653 bp, Artificial
  Synthetic
gcagcatgaacaacaatcattcctatgatgatcgcagttttcacatgccacttcatccttctaacacaagcaaccctaatccaaatctccagtttgctttatcttcaagctacgatcacagtcctaagaagaaacgcaccaaaaccgttgcttcatcctctagttcttcaccaaaatccgcgtcaaaaccaaaatacaccaaaaaaccagacccaaatgcccccaaaatcacacgtccatgtactgaatgtggcagaaagttttggtcttggaaggctctctttggtcacatgagatgtcaccctgagcgtcaatggcgtggcattaatcctcctcctaactaccgtgtgcccaccgcggcttcttcaaaacagttaaaccagatattaccaaattgggtctcatttatgtccgaggaagaccatgaagtcgcttcttgtctcttaatgctgtctaatggtacaccatcatcatcgagtattgaacggttcgagtgtggaggatgtaagaaagtgtttggatcacatcaggctttaggaggacacagagcgagtcataaaaacgttaaaggctgtttcgctatcacaaacgtaaccgatgatcctatgacggtttctacttctagtgggcatgatcatcagggaaaaatcctt

SEQ ID NO: 3299 - DNA, 599 bp, Artificial
  Synthetic
ggcgcgcaaggtccggagaagtagggagctgtgaaagaaggcgaggaagaaaaaagagaattttattttttgttcgtggttggatcatcttgctctcgagatatttgacgtagagcaagctttgtctttcattgctttgatcgttgtatagctttttggttttgagaggaagagatgggaaggtcaatggatcctttggttcttggacgagtgattggagatgtgttggatatgtttgtcccggctgtggacatgagtgtttgctacggaagcaagcaagtcaacaatggttgcgagctcaagccgtcggcgactcaagcccgaccaaccgtccaagttgtatctcctcacgaagaaggcgctctctacaccttggtgatggtcgatcccgatgctccaagtcccagcgagccgtccatgagagaatgggtgcactggatcgtcgccgatatcccctctggtgcggatgcgagccaaggaagggagatcctccagtacatcggcccgaagccaccgactggaatccacagatacgtcttcgttctgttccggcaaatgggaccagtcctcatgctcccgccgctgatgaggaacaactt

SEQ ID NO: 3300 - DNA, 537 bp, Artificial
  Synthetic
gcagcatggagaatatgggaactagagtgatagagccattgataatggggagagtggtaggagatgttcttgatttcttcactccaacaactaagatgaatgttagttataacaagaagcaagtctccaatggccatgagctctttccttcttctgtttcctccaagcctagggttgagatccatggtggtgatctcagatccttcttcactttggtgatgatagacccagatgttccaggtcctagtgacccctttctaaaagaacacctgcactggatcgttacaaacattcccggcacaacagatgctacgtttggcaaagaggtggtgagctatgaattgccaaggccaagcatagggatacataggtttgtgtttgttctgttcaggcagaagcaaagacgtgttatctttcctaatatcccttcgagagatcacttcaacactcgtaaatttgcggtcgagtatgatcttggtctccctgtcgcggccgtcttctttaacgcacaaagagaaaccgctgcacgaaacgcta

SEQ ID NO: 3301 - DNA, 298 bp, Artificial
  Synthetic
ggacgtgaacgcgctggatccgcttgtcttgggcgggatcatcggcgatgtggtggatgatttcgtgccatgctgcgagatggctgtctactacggtcaatatcaggtggtaaacggctgtgacattggtccatctgctgccagttcggctccaaacgtccagattgccggcaatttcgacgatggctctcaattcacactgattatgactgatcctgatgctccaagtccatccgatccatcactgcgcgaatatcttcactggctggtgattgatattcctggagcaacagaccca

SEQ ID NO: 3302 - DNA, 695 bp, Artificial; identical to SEQ ID NO: 1020
  Synthetic

SEQ ID NO: 3303 - DNA, 674 bp, Artificial
  Synthetic
tcaggcctgttccgatggaggaggcaaattaagatctagatctaacagctgagatctcttctccatcccaccttcgaaatcaacgaccgatgacgaatcagagtcgctttgggcaccacaagccatcttcgtcgcaacatgcaccaccggcgatctaaacgccgatgtcacaggaggaggctgaccacgacctacgttaccgatccccatcaggtccaaaaagtagacaggacgcgacatcgggatctgataacacgagccgccgcctcctccgccgagactaagctcgagctgcgggggaacattcccagccgtcgctgaaggcacaactaacgtcggaggagaagcacagtcgagcgtgctgctctggctagggctacgcgcgaaaccggtagggaccttctggtcactcagctcgagaaaagttgggaaattggtcttagccttagcaccacgaaaatcacgcgccgccgtatcgtaagtacgcgccgcctcttcagccgtatcgaaagtgccaagccagacgcgggttttcttgcccggatctcggatctcggcggcataacggccccaaggacgcttcctaacgcctctgtaacgaatctccttggcattattgtgggtctggttagtagtagccgggtcgggtttcaagcccatcttggccatgctgc

SEQ ID NO: 3304 - DNA, 70 bp, Artificial
  Synthetic
gcagcatggccaaaatgggcttgaaacccgacccggctactactaaccaaagccacaataatgccaagga

SEQ ID NO: 3305 - DNA, 97 bp, Artificial
  Synthetic
gcagcatgatgcatcagatgttgaataagaaagattcagctactcattccactttgccataccttaatactagcatctcttggggagtggttccaac

SEQ ID NO: 3306 - DNA, 635 bp, Artificial; identical to SEQ ID NO: 164
  Synthetic

SEQ ID NO: 3307 - DNA, 646 bp, Artificial
  Synthetic
tctttttataattgaaaaatatactaagtgacaagaaaaagttcaaagcttgctcttagcatttctcttcctttttcagctctcttctcattcactttctgtacaatttttcccactgaaaaccaaaaaaaatagtgaattttcaagaacttgcaataatgaagagatttcgaagttctgattctttgggcgtgccattgatatccatgtgtcaaaatactacagatgaccaccaccaatggaacagccaagtatattcaagggactttcaatccatgttagaattagggttagaagatgaaccctgtgtagaagaatccggccatggatcggagaagaagcggcggctaagggtggatcaagtgaaggctttagagaagaattttgaagtggataacaagcttgaacctgataggaaagtgaagttggctcaagaacttggtttgcaaccaagacaagtggctatttggttccagaaccgccgtgcacggtggaagacaaagcaattggagagagattacaatgttcttaaagcaaattttgattctctcaaacataactatgaatctctccaacatgacaatgaagctctcttgaaagagatttgtgagctgaaatcaaagctaaatgggggaaataatgaaag

SEQ ID NO: 3308 - DNA, 316 bp, Artificial
  Synthetic
cccacgcgtccgcacatgggtctatcggagaagaagagaagattaaaagttgaccaagtcaaagctcttgagaagaatttcgaacttgagaataaactcgaacctgagaggaaaactaaattagcacaagagcttggacttcaacctcgtcaagtagctgtttggtttcagaaccgtcgtgcacggtggaaaacaaaacagcttgaaaaagattacggtgttcttaagggtcaatacgattctctccgccacaatttcgattctctccgccgtgacaatgattcccttctccaagagattagtaaaatcaaagcta

SEQ ID NO: 3309 - DNA, 908 bp, Artificial
  Synthetic
gcagcatgtctgtagatttctcatctgagcgtgtttgctatgtccactgcagcttctgcaccacgattttagcggtaagtgtaccatacgcaagtttgttcacacttgtgacggtgagatgtggccattgtaccaatttgctatccctcaacattggagtttcacttcatcaaacctcagctcctcccattcaccaagatcttcagcctcatagacagcacacaacctctctggtgacaaggaaagattgtgcatcgtcttctaggagcaccaacaatttatcggaaaacattgatcgtgaggctcctagaatgcctcctattcgcccaccggagaaaagacaacgtgttccttcggcctacaacagattcatcaaggaggaaatccaaaggattaaggcttgcaatccagagattagccaccgtgaggcatttagcactgctgctaaaaattgggcacattttcctcacattcactttggattaaagctggatggcaacaagaaaggcaagcaattagaccagtcagttgcaggccaaaagtctaatggctattactaaagcctttatatatatacacacatatatacacttatacgtatatatatgtgtatagatatatatgcgtgtgtatgatttatgtttatctttgtacgtacgcattaatgaatgtgtaagcagagagctgatgatggaaagagatcaggcgaggaagaagaagatcatataacgttacatatatatacatgtgtgtatatatgttcctttcttttttcttgcgtgtgcttcatctataacttcatttctagttttattctcctaataagtgaagtctataaatttgaacctaaaatgtttaggaagaatcttctttctgaagattgtaatataactttcaactttactcaa

SEQ ID NO: 3310 - DNA, 270 bp, Artificial
  Synthetic
ttattactatacatgaaaattttggcctgcaactgaatgctctaattgcttgggttgcttgttgccatccaacttcaatccaaagtgaatgtgacgaaaatgtgcccaattataatcagtagtgctaaatgcctcacggtggctaatctctggatcgcaagccttaatccttaggatctcctccttgatgaatctgtcgtatgccgaaggaacacgtagtcttttctccggtgggcgaataagaggcattctatgaacctcacgatcaat

SEQ ID NO: 3311 - DNA, 340 bp, Artificial
  Synthetic
agcctaaagcctttccatagtattaacccaaatcgagcaaattttttctcatcttggtagctttgattcttcgtcttctttgcggggatcgattgatcttgaggagcttaatatatcgattgagatagcaaatggggaggcagccgtgctgcgacaaggttgggctgaaaaaaggtccatggacggcggaggaggaccaaaagctcgtcagcttcctcctcggcaacggccaatgctgctggcgtgccgtccccaagctcgccgggttgctccggtgtgggaagagctggcggctccggtggacgaactacctccgggcggacctgaagcgtggtctcct

SEQ ID NO: 3312 - DNA, 529 bp, Artificial
  Synthetic
ccccccgctattactactagtacaaaaccaacgcgaagggctcgtcgcgcacaaccaactcgacaccggggcgaggcgaaccaacgggcggcgtgggcatggggaggtcgccatgctgcgagaaggcgcacacgaacaagggggcgtggacgaaggaggaggaccagcggctgatcgcctacatcaaggggcacggcgagggttgctggcggtcgctgcccaaggcgggggggctcctccgctgcggcaagagctgccgcctccgctggatgaactacctccgccccgacctcaagcgcgggaacttcaccgacgacgacgacgagctcatcatcaagctccacgcccttctcggcaacaagtggtcgttgattgcggggcacctgccggggaggacggacaacgagatcaagaactactggaacacgcacatcaagcgcaagctcctgagccggggcatcgacccgcagacgcaccgggcggtcagcgccgggagcagcgccgccgcggcgagcgggctgaccacgac

SEQ ID NO: 3313 - DNA, 914 bp, Artificial
  Synthetic
gcagcatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccatgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaaggtcaggatcggccgaagaagaggagatctgttagctttgattctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggagaaggacgtagaggtgagtttatgacggtggtgcaggagatgatagaagctgaagtgaggagttacatggcggaaatgcagaaaacaagtggtggattcgtcgtcggaggtttatacgaatccggcggcaatggtggttttagggattgtggagtaataacacctaaggttgagtagtaa

SEQ ID NO: 3314 - DNA, 576 bp, Artificial
  Synthetic
gcagcatgaacggagaaatctctcgtccgccggagctaatatcgtcccggaatccttgcaagagttttgaaaatgcaatacacaaagcagttgaggcagagctcgccgagctagcgaaaagcgacgcgaacggcggcggaaagagtaaagtgaaaggaccttggttgccggagcaagatgaggctctcacgaggcttgtgaaaatgtgtgggccgaggaactggaatctaatctcccgtggaatcccaggtcgctctggtaaatcttgccgattacgttggtgtaatcagctcgatcctatcctcaaacgaaaacctttctctgatgaggaggagcatatgataatgtctgcacaggcggttcttgggaacaaatggtctgtgattgctaaactcttacctgggagaacagataatgccattaagaatcattggaactctaatcttagacgtaaaccagcagaacaatggaagattcctctattgatgtctaatacagagatagtatatcaactgtatccatcaatggtcagaaggatatcaaacgcatcccccaaagaacatctacctcaagaag

SEQ ID NO: 3315 - DNA, 624 bp, Artificial
  Synthetic
gcagcatgggaagaacaccttgttgtgacaagattggtttgaagaaaggtccttggacgcctgaagaagatgaggttcttgttgcgcatatcaagaaaaatggacatggaagctggagaacacttcctaaacttgctggtttacttcgctgtgggaagagttgcaggctgagatggacaaactatctgagaccagacataaagagaggtcctttcactgctgatgaagagaaacttgttatccagcttcatgccattctcggcaacaggtgggctgctattgcagcacagcttccaggaagaacagacaacgagatcaagaacttatggaacactcatttgaagaaacgtcttttatctatgggtcttgatcccagaactcatgagccattaccttcatatgggttagctaaacaagctccatcttcaccaacaactcgccacatggctcaatgggaaagtgctagggttgaagctgaggcaaggctttctagagaatcaatgctctttagcccttctttttactctggtgtagtaaaaactgaatgtgatcacttcttacgcatttggaattccgagattggtgaagctttcaggaatctcgctccattagatgaatcaacta

SEQ ID NO: 3316 - DNA, 515 bp, Artificial
  Synthetic
gcagcatggctacagctacgtatccgcctcctccaccatattacagactctacaaggattactcagaaaaccctaattctgctcctgaacctcctcctccgattgaaggcacctacgtctgttttggaggcaactatactactgaagatgttcttccaagcttagaagaacaaggagtgcctcaactttatcccaaagattctaatcttgattacaagaatgaactcaggtcactgaatagagaactacagttacatatattggagcttgctgatgttcttgttgacagaccttctcaatatgcgaagaggattggtgaaatttcttctatcttcaagaatttgcatcaccttctcaattccttgaggcctcaccaagcgagagcaacgcttattcacattatggaacttcaaattcaacagaggaaacaagctgtggaagacattaaaagaagaagagaagaagcacagcgacttctaaaggatgcttacctcactttagatggtcaatagtaa

SEQ ID NO: 3317 - DNA, 555 bp, Artificial
  Synthetic
aaacagcccctattgctctctcctttctctcacccaaacacaccacaaacagtagagagagaaaaaagctgagttctagagagataaactgagttctagagagagaaagtgagtgctttcggaagggaagctaatcctctggtgcttctcgatctttgattgctctaatcggtatcaaaggggtcggtcttttgttgtttctttcgacttgtggccatgcggagaggtagagcaaccgcggcggcgaagcaagcggcggaggttccaaccgaggctggatctggaggattaaaagagattaggtttcgtggtgtcagaaaacggccgtggggaagatttgcagcggagattacagacccgtggaaaaaaactagggtttggcttggcacttttgattctgcctaagaagccgctaaagcttatgacgctgcagctcggactcttaggggacctaaagccaaaactaatttccctttaccaccgtattctcacttcaatcaaactgtaaaccctaacgacccgtttattgacccgaggttatactcacaggaaagt

SEQ ID NO: 3318 - DNA, 592 bp, Artificial
  Synthetic
caaaaagaaaaaaatttacaaaaacgaaactgatttctgcgtaaaacttttctgctgagagaaaacaaaaagcatgtgtggtggtgctataatctccgattacactgccccgagccggacttctcgccggctcaccgccgagttgctatggggccgatccgatctgagcaataagcaaaatttttttaacaattatcactccaagcggttgagatcccaagtagttgaccttgacgatgacttcgaggctgattttcaggacttcaaagatttctccaatgatgaggatgttcaagtcgatgtcaagcgatttgccctctctgcttcgaaaaactctactgttgaaggctccaaatctatgaaaacggttgattcagacaaggatgctgatagattctctaagagaaagaggaagaatcagtatagggggatcagacagcgaccttggggtaagtgggcagctgaaatacgtgacccaagaaaaggagttcgggtctggctgggaactttcaatactgcagaagaagctgccagagcttatgatgttgaggctaggaggatcagaggtaataaagctaaggtaaactttccc

SEQ ID NO: 3319 - DNA, 323 bp, Artificial
  Synthetic
ttcttcctaattacaccatgcccaacatcaccatgggtttgaaacccgacccggttgctccaacgaacccgactcatcatgagagtaatgctgccaaagagattcgttacagaggcgttaggaaacgtccatggggaagatacgccgctgagatccgagatccggttaagaaaactcgagtctggctcggtacgttcgacaccgctcagcaggcggcgcgtgcttacgacgcagccgcgcgtgactttcgtggtgttaaggctaagaccaatttcggtgttatcgttggtagtagtcctactcagagtagcaccgtcgtcgac

SEQ ID NO: 3320 - DNA, 412 bp, Artificial
  Synthetic
ccccccccggccaaattccaacgcaccaccggggcgggagcaagcacccaccatccaccggtcgaacagttggcgctctcgcccgccttagctcgctctgctcgtggtgctcgacccgagcaagaacggacatggctcccaggaacgccgccgaggccgtcgccgtcgccgtggcggagggcggaggagccggcttggagcccaggttccgcggcgtgaggaagcgcccgtggggcaggtacgcggcggagatccgcgacccggccacgaaggcgcgggtgtggctcgacaccttcgacaccggcgaggccgcggcgcgcgcctacgacagtgccgggctccacttccgcgggcccaaggtcaagaccaacttccccgtcgccttcgcgcacgcccaccaccacgccccgcc

SEQ ID NO: 3321 - DNA, 649 bp, Artificial; identical to SEQ ID NO: 1028
  Synthetic

SEQ ID NO: 3322 - DNA, 439 bp, Artificial
  Synthetic
ccctcgaccacgcgtccgaaaacattcttctttcgccattaaactcttcatctgccattacctcgccgcgtctcaaaacttgaactttaatccacacatataatcttacttcagttctagtagatcaatagctgcaacatttttggttcttcttccaatagtcaaatatcagatctagcatatatttttgtgttgaacttgaagttatcagtgatgtcgtttacggggacacaacagaaatgcaaggcatgtgaaaagacagtttacccagttgagcttttgtcagcagatgggattagttatcacaaatcttgctttaaatgcacccattgtaaaggaactctcaagctgagcagttactcctcaatggagggtgttctgtattgcaagccccattttgagcagctctacaaagagtctggcaacttcaacaagaact

SEQ ID NO: 3323 - DNA, 195 bp, Artificial
  Synthetic
tcaggtacgttttggagaagtgcaaagcctgcgacaagacagtctattttgttgaccagctcactgccgatgggattttctatcacaaggcttgtttccgctgccatcactgtaacaggaccttgcagctgagcgattattcttcctttgagggaactccctactgcaagccccattttgaacaactgttcaaat

SEQ ID NO: 3324 - DNA, 356 bp, Artificial
  Synthetic
tggtatcaacgcagagtggccattacggccggggataaatgcaaagcttgtgataagacagtttattttgttgatttattgtctgctgatggagctacttttcataagtcttgcttcaaatgtagccattgcaaaggcactcttgtgatgagcaattattcctcaatggatggagtcctctactgcaagccacatttcgaacaactttttaaggaatctggaaattttagcaaaaactttcagactgcttccagacctgagagggaaaattcgctgacaaaggctccgaccaaactctcagccttgttctctggaactcaagacaaatgtgctgcgtgcaacaaaactgtttaccc

SEQ ID NO: 3325 - DNA, 743 bp, Artificial
  Synthetic
ctctctctaaaattttgcaaagttgtcattttgttaacaagaggtggaagaaaaataagaagaagagataatttcatggatctgaaagaaactgagctgtgtttggggttgcctggtggtggagaaagagataaaatcaaagggaaaagagggttttctgaaactgttgatttcaaacttaattttcaaaccaatgattcttcttctgctatggatctcaaggagaaaatcaagactcctactactaaagaaattgctaattgtaacaaggattcagtcaagccacctgccaaggcacaagtggtgggttggccaccagtgagatcttttaggaaaaatgtaatggctcagaaaaacaacactgaagaaactgaaaagagtaatgcaactgctgctgcatttgtgaaggtttgcatggatggtgctccttatctacgtaaggtagatttgaagatgtacaaaagttaccagcaactttctgatgctttggccaagatgtttagctcctttactatgggaaattatggggcccaaggaatgatagattttatgaatgaaagcaagctgatggatcttctcaatagttctgaatatgtacccacctatgaagataaagatggagactggatgctcgtgggggatgtaccttgggagatgtttgttgattcatgcaagcgtttacgcataatgaaaggatcagaagctattggacttgcaccaagagctatggagaaatgcaagcg

SEQ ID NO: 3326 - DNA, 515 bp, Artificial
  Synthetic
attgtacagtcctatagttgggcacaagttgtgggttggccaccagtgagatcattcagaaagaatgtactaaccgtccaaaagaacagcaccggcaacggcgaaagctccggcggcggcgcagcctttgtgaaagttagcgtggacggagctccatacttacgtaaagtggacttaaagatgtacaaaagctaccaacaactctctgatgcccttggcaaaatgttcagctctttcaccattggaaattgtgggactcatggatttaaggatttcatgaatgagagcaaattgatagacctcttaaatggctcagactatgtacctacttacgaagacaaggatggagactggatgcttgttggagatgtaccttgggagatgtttgttgattcatgcaaacgcttgaggataatgaaaggatcagaggccattggactagcaccaagagcagtggagaaatgcaagaacagaagctgaaattgatgatccaattacttgttcattgtattttt

SEQ ID NO: 3327 - DNA, 673 bp, Artificial
  Synthetic
tgtggcaccaagagagctgctgatcctatttcacctccccgttctaatgtcagtcaggttgttggatggcctcctgtaagaacttataggatgaataccctagttaaccagacaaaatcaccaccctcagaagaattttgcgggacaattgagaaatgcagaagcaaacatattatcactaatgcgagtagcagcaagagcaacagttttgccaaggagaaagggctgctcatcaagacttccatgtttgtggaggtcaatatggatggagttgcaattggaaggaaggtagatctgaatgctcatagtagctatgagaacttggaacagactttagatgggatgttcttaaaacccagcacaacagtttgtgcaagaccgtcaaatgcacaagagctaagtgtcatgtcagaaacgtcatcttcaagattattagatggatcatcagaatttgtgctgacttatgaagacaaagaaggagactggatgcttgttggagatgttccatgggagatgtttattagctccgtcaagagactacgaatcatgaggacatctgacgccaatggacttggtacatctccaagtttcatggaaagaaatggaagacagaggactaagccatgataggtcagataaagaagccccccttattggaaggatgaagtacaga

SEQ ID NO: 3328 - DNA, 501 bp, Artificial
  Synthetic
ccgagagatggattatctgattgccgcctgatggatcttaaaaatggaacagaacttgtgctcacttatgaggacaaggatgaagattggatgcttgttggtgatgttccgtggcgaatgttcacagacagctgtaggaggctgaggattatgaaggggtcagatgcagtgggccttgctccaagagccactgacaagagcaaaaatcggaactgagcaaaagatgaacccaatatgaatatccgacccctacaatcacatcacttttacttgtaaggtcccattctctaaaccacaagggtaatggtctaagttgcgagaaggggattacttatacctatgtgtcaccctcttttttttttggttttatttgtaccaattatgttagattttaagcgtaagttgtgtaagttcctgtaagttgtctacttaaccttgcttgtagtttcttctgtaaattgttgtgctgtatgatgcaaactatttttgggattttacttg

SEQ ID NO: 3329 - DNA, 628 bp, Artificial
  Synthetic
cggaggtcagtgtcgcagcgacgaacgccgacgagctagctctctctctcgatcgatggccatggcggcggagagcatcgacgcggagctgcgcctcgggctgcccggcagcggcggcggtgacggcgtggcggcgaagaagcggcggtcggcgtcgtcgacggtgaagagcgaggcctccggcacggcctgctgcggcggcgccggcgcccgggacgtcgaagacggcgcctcgccggcgtccaaagtgcaggtggtggggtggccgccggtggggtcgtacaggaggagcacgttccagtcgtcgtcgtcgtcgacggcggcggcggcgaaggggaagggcggcggcgagacggatcaagggaggaagaataagggaggagggctgtacgtgaaggtgagcatggacggggcgccatacctccgcaaggtcgacctccggatgtacggcggctacagggagctcagggacgctctcgacgcgctcttcggctgcttctccgccgacgcctccgcctccgccgcccacttcgccgtcgcctatgaggacaaggacggcgacctcatgctcgccggcgacgtgccctgggacatgttcatctcttcttgcaagaagctgcggataatg

SEQ ID NO: 3330 - DNA, 676 bp, Artificial
  Synthetic
gttactactaatgctactgctgttaagaactggaggccggcaattcaagatccatcgaggaatggtgccactgttgctactttcactccattccagaggagaggagattcgtcaccgatgaatcacttctcgtgcttgaaccagggcgaagaaactccatcttcaagtggtccgatggttgggtggccaccagttcaatcctttaggaagaacacgttggttgcaccagcacaaactgtaaagccggccgcggagcacacggccccggatcaagtcagtaatggacaagcagcagcagcagcagtagcagcatcactgttcgtcaaggtgtacatggacggcctaccgatcggtcggaaagtggatctggatttcaacaacagctacgtcaagctctcctcggctctcaaggacatgtttagcggcttcgtgagcggtgccggccagccgctgtccaagcaaaaatcgtctggagatgtgcagaacctctttgatggatatgagacggagtacgtcctgacttacgaagacaaggatggggatttgatgctcgtcggcgatgttccgtggaggatgtttgcagctactgtgaagaggctacggatcatgaaagggtctgatgcgatcggtcttggcgttccaagggatgccgaggctatgacgcgatgaaagaaaa

SEQ ID NO: 3331 - DNA, 825 bp, Artificial
  Synthetic
cacacatctcactgacccctatctctctctctcttcaaacggtttagttccccaaaaaaatatcaaaagaactaaaagaaaaaccctagaagccgaagaatctcctactcgttgtggatcggatcacctaactaattactcgttgataatcattatatcgagaaatatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcgga

SEQ ID NO: 3332 - DNA, 808 bp, Artificial
  Synthetic
tttaataaaaatttcatcttcttttttcaaaaagagttttgcagacatgcatgagataattattacagtatgttctaattatctccttaattaattaaaatgcttataaacacagattgcttatgtaatctcatcgtctagtgtcttgaagacatgggaatatcagatcagatcaaatgtctctctggaccaaaaaaaaagtaaaaaaccaatgattaactcttatatataacaaaaaccagatgtacatttataaagctttgagactctctgtctgaaataaaagtttctaaaaagactcttcagtgcatcatcttctcttgcttactgcatccaaatgtcaaggcagatgaaatctcagagcttttaatcacacgcagtctcttcacagatgaaacaaacatttgccatggaacatccccaacaagcatcttgtccccttcattgtcttcataggttaaagtaaattctcctttcccatctaataatccaatgataggtttctcttctccttgaccatcagagatatctctttgagctgcgagtagacctctgaagagtttgtcaacgacaaaagagagctgttcgtagctgttgtaagcattgagatcaactttacgaccaataggaacaccatccatgttgatcttgacaaacattccttccttcttggtttcaacttgtttttcaccatcatcactcttgttgatttgacctccatgagaggattcgttacctagctttgaagagcttgcgctcgctagattctttctgaacgaacgaaccggaggccaacccaccactggac

SEQ ID NO: 3333 - DNA, 280 bp, Artificial
  Synthetic
gagaccaatggcatccgatcctttcatgagacgtacactcttgcatgtatcgacaaacattggtcaaggaacttcgccgacgatcatccaatcaccgtctttggcttcataagaggcaacatagtcccacctattcaccaaacccatcattttcctcttattcatgaagcctatcattccttcttctcctccatgtttgcccatggtaaaaaagctgcccatgttggacaaagcattagaaagctcatcggagcttttatacatcctcaaatcgattttc

SEQ ID NO: 3334 - DNA, 551 bp, Artificial
  Synthetic
gcagcatgaacctagaagagaaaccaaccatgacggcttcaagggcttcccctcaagccgaacatctctactacgtccggtgtagcatctgcaacaccatcctcgcggttgggataccattgaagagaatgcttgacacggtaacggtgaaatgcggccattgtggtaacctctcgtttctcaccacaactcctcctcttcaaggccatgttagcctcacccttcagatgcagagctttggtggaagtgactataagaagggaagctcttcttcttcctcttcctccacctccagcgaccagcccccatctccctcacctccctttgtcgtcaaacctcctgagaagaagcagaggctcccatctgcatacaaccgcttcatgagggatgagatccaacgcatcgtaagtgccaatccggagataccacaccgtgaagctatcagtgctgctgccaaaaattgggctaagtacatacccaactctcctacttccattacttccggagaccacaacatgatccatggcttgggattcggtgagaagaagtga

SEQ ID NO: 3335 - DNA, 554 bp, Artificial
  Synthetic
taaaggcgaccactaccatgttcaaaacttagaggaagctgatcaatagcaaaagaagacatcttactttcatctgcatccatgttccatatagattccaaggaactttcccatgttggagaagccagaggagggaaattcaagtaacagctttgctctgagtagtagttgtcttttaccggtttaataacgtttgctccagactgattaatctctctccatatgtcatccatggagtagtacccgtcttcgcattcttgattcattttcccgttggagcctccagtgtcttgactagtagtagtggtcatagatgatgagcaacagttcgaagatgaggaagtaggagacataggtcgcttcttctcttgagccttcttcctcatatgagtcctccagtagttctctatctcattatctgtgctccccggtaatttccgggcaatttttgaccacctgtttccccatttggcgtgaagctcaaggactaaacgctcttcttgtggagtcatcttaccacgtttgagaccaggatgcaggtaattaacccacct

SEQ ID NO: 3336 - DNA, 678 bp, Artificial
  Synthetic
agatttttgccttccacaaagaagctagacaattttgtggaggcaagaggggtttctttctcatatctttgagagatttactgtccaattccctcctctttgtggagagatttgatgggagagaactagaccagcttgggattcgtatagagaggacatatgggatctccaagattgaactttggcgatgtgtttgcttctccagaatgcagcaacgcggatggattggcggcggtgatcgcatcgtgttctccaatggcattccaccaagggatggacgaagcactgagcggctacaagcgaccactctttccaattttcgaggcatcggccgaagagactggagacgacgacttgtgcgacgactccacggctcagcacgtcgagaagaagcgaaggctgtcagtggagcaagtcaaggctctcgagaagaacttcgagatcgagaacaagcttgagcccgaccgcaagatccagctcgccaaagagcttggactgcagccaaggcaagtcgcggtctggttccagaaccggcgcgctcgatggaagaccaagcagctggagaaagactacgatctcctcaaggccgagtatgacgatttgaagtcgagctatgtggatctcgcgaaagaacgggacaagcttcaggcagaggttgctaggctgaggctatgcatg

SEQ ID NO: 3337 - DNA, 941 bp, Artificial
  Synthetic
gcagcatgatgaagagattaagtagttcagattcagtgggtggtctcatctctttatgtcctacaacttccacagatgagcagagtccgaggagatacggtgggagagagtttcagtcgatgcttgaaggatacgaggaagaagaagaagctatagtagaagaaagaggacacgtgggcttgtcggagaagaagagaaggttaagcattaaccaagttaaagctttggagaagaattttgagttagagaataagcttgagcctgagaggaaagttaagttagctcaagaacttggtcttcaacctcgtcaagttgctgtttggtttcaaaaccgtcgtgctcggtggaagacaaaacagcttgagaaagattacggtgttcttaaaacccagtacgattctctccgtcataactttgattccctccgccgtgacaatgaatctctccttcaagagattagtaaactgaaaacgaagcttaatggaggaggaggagaagaagaagaagaagagaacaacgcggcggtgacaacggagagtgatatttcggtcaaggaggaagaagtttcgttgccggagaagattacagaggcaccgtcgtctcctccacagtttcttgaacattctgatggtcttaattaccggagtttcacagatctacgtgatcttcttccattaaaggcggcggcttcttcattcgccgccgcagctggatcttcagacagtagcgattcaagcgctctgctgaatgaagaaagcagctctaatgtcactgtggcggctccggtgacggttccaggaggtaatttcttccagtttgtgaaaatggagcagacggaggatcatgaggactttctgagtggagaagaagcttgtgaattcttttccgatgaacaaccgccgtctctacactggtactccaccgttgatcattggaattga

SEQ ID NO: 3338 - DNA, 638 bp, Artificial
  Synthetic
gctggtttggcgacgtctagggttcttggcatctcgtccccggttgccacacactgccgcaaagatgaatcgagagaagctcatgaagatggctagtgctgtgcgcaccggtggaaagggcacagtgaggaggaagaaaaaggctgtacataagacaacgactactgacgataagcgtctccaaaacacgcttaagaggttgggggttaacaccatccccggaatcgaggaggttaacattttcaaggacgacattgttctccactttgtcagtcccaaagtgcaagcgtccatagctgctaacacctgggtcgtgagtggacccgtccagacaaagaagcttacggaattactgcccggcatcatcgaccagctcggctttacggggccggataacttggagaacctcaagaagattgcgcagcaattcaagcggcaagagagcggcggtgggggcggtggcggcgcagctccgctgagcacaatcgaagacgacgaggatgtccccgatctcgttcccggggagactttcgagaagcccgccgctaatcccgccgaggaggccgtggccactgcgtgattccgggcagagcatattcctgctgtgtacttgtagcctcctgggcatattctccttt

SEQ ID NO: 3339 - DNA, 564 bp, Artificial
  Synthetic
gccattacggccgggatccttctgctcttcatttttggggtgctgactgctgcctagggttttagttctctattcttcaccaagatgaatgtagaaaagctacggaaaatggccggttcggtcaggactggtggtaagggaaccatgcgaagaaagaagaaggccgttcacaagacaactacaactgatgacaagagacttcaaagcaccctaaaaagaataggggtgaatgctattcctgctattgaagaggttaacatttttaaggaggatgtagttatccaattcatgaaccccaaagttcaagcctctattgctgcaaacacttgggttgttagtggttcccctcagaccaagaagttgcaggatattcttcctcaaattattcaccagttgggccctgataatttggagaatttgaagaagctagcggagcagttccagaagcaggcgcctaccggtgcgcctgaaggtggtgctgcagcacaggaggacgatgatgatgaggtgccggaacctgtggctggccaaacctttgaagcagccgctgcagaggagggtcac

SEQ ID NO: 3340 - DNA, 668 bp, Artificial
  Synthetic
cccacgcgtccgggtttatacacagatgaatagggagaagttgatgaagatggctaataccgtccgcactggcggaaagggtactgtcagaagaaagaagaaggctgtgcacaagaccaatacaactgatgacaagaggcttcaaagcactcttaagagaattggagttaactccattcccgctattgaagaagttaacatctttaaggatgatgttgttattcagttcatcaaccctaaggttcaagcttcaattgctgcaaacacatgggttgttagcggttctcctcagaccaaaaaattgcaagatatccttcctcagatcatcagccaacttggaccagacaacatggacaacctgaagaagctagcagaacagttccagaaacaggcttctggtgaaggtaatgccgcctcagcaaccatacaagaagaggatgatgacgatgtcccagagcttgttggagagacattcgaaactgctgctgaagagaaagcaccagctgctgctgcttcttcttagagagaaaagagcgagaccacatccaaaaaaaaaccgcactttgatttttacatatctttataatatgtttgttcgctcgatcctttttgtagtttccgaccagaatcttgttttccatctaatgacttaaggtttttatccaatt

SEQ ID NO: 3341 - DNA, 599 bp, Artificial
  Synthetic
gaattcaggaagcgttagaagaaagaagaaggctgtacacaggaccacgaccacagatgataaaaggcttcaaagcactcttaaaagaataggtgttaatgccattccagccattgaggaggtcaatattttcaaggacgatgtagtcatccagtgccaaaaccctaaagttcaagcttcaatcgctgccaacacatgggttgttagtggttctcctcaaacaaagaaattgcaagatcttttaccaggaattattaaccaattgggacctgataacttggacaacttaaggaagcttgcagaacaattccagaagcagatgcctggtggtgcaggtaccattccaggaacaatccctgaggaggatgacgacgatatgccagagcttgtggccggagagacattcgaggccgcagccgacgaggaaaaagcagcttcctagatattgtaagggagagctaaaatactatatccctacaatttctgtttttgacattatctattgtcttgaaatttttagtgttctcaactgcctggtttttttttcttattaggcccttctctcctttctcttgggtagcaatcaaacatgttcatgg

SEQ ID NO: 3342 - DNA, 761 bp, Artificial
  Synthetic
gcagcatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagttgaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcaacaagatggaatgggagcaggaccaagtgtgaataattacatgttgggttggttaccttatgacaccaactctatttga

SEQ ID NO: 3343 - DNA, 476 bp, Artificial
  Synthetic
gcagcatgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttggaattgaaagcacaatcgaacggtataatcgttgttacaactgctctctaagcaataataagcctgaagagactacacagagttggtgtcaggaggtgacaaagcttaaatccaaatacgaatctcttgttcgtactaacaggaatttgcttggagaagatcttggagaaatgggtgtgaaggaactgcaagcgctcgagaagcagctcgaagccgctcttaccgcgactcgacagcgcaagacacaagttatgatggaagaaatggaagaccttaggaaaaaggagagg

SEQ ID NO: 3344 - DNA, 761 bp, Artificial
  Synthetic
gcagcatgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttgatcggtaccagaaatgcagctatggatccattgaagtcaacaacaaacctgccaaagaacttgagaacagctacagagaatatctgaagcttaagggtagatatgagaaccttcaacgtcaacagagaaatcttcttggggaggatttaggacctttgaattcaaaggagttagagcagcttgagcgtcaactggacggctctctcaagcaagttcggtccatcaagacacagtacatgcttgaccagctctcggatcttcaaaataaagagcaaatgttgcttgaaaccaatagagctttggcaatgaagctggatgatatgattggtgtgagaagtcatcatatgggaggaggaggaggatgggaaggtggtgaacagaatgttacctacgcgcatcatcaagctcagtctcagggactataccagcctcttgaatgcaatccaactctgcaaatggggtatgataatccggtatgctcagagcaaataactgcgacaacccaagctcaggcgcagcagggaaacggttacattccaggatggatgctctga

SEQ ID NO: 3345 - DNA, 758 bp, Artificial
  Synthetic
gcagcatgggaagaggaagagtagagctcaagaggatagagaacaaaatcaacagacaagtgacgtttgctaaacgtagaaatggtttgctgaaaaaagcttatgagctttctgttctctgcgatgctgaagtctctctcatcgtcttctccaaccgtggcaagctctacgagttctgcagcacctccaacatgctcaagacactggaaaggtatcagaagtgtagctatggctccattgaagtcaacaacaaacctgctaaagagcttgagaacagctacagagagtacttgaagctgaaaggtagatatgaaaatctgcaacgtcagcagagaaatcttcttggagaggatcttggacctctgaattcaaaggagctagagcagcttgagcgtcaactagacggctctctgaagcaagttcgctgcatcaagacacagtatatgcttgaccagctctctgatcttcaaggtaaggagcatatcttgcttgatgccaacagagctttgtcaatgaagctggaagatatgatcggcgtgagacatcaccatataggaggaggatgggaaggtggtgatcaacagaatattgcctatggacatcctcaggctcattctcagggactataccaatctcttgaatgtgatcccactttgcaaattggatatagccatccagtgtgctcagagcaaatggctgtgacggtgcaaggtcagtcccaacaaggaaacggctacatccctggctggatgctgtga

SEQ ID NO: 3346 - DNA, 559 bp, Artificial
  Synthetic
gcagcatgactgatcaaggattggaagggagtaatccagttgatcttagcaagcatccttcagggattgttcctactcttcaaaacattgtctccacggtgaacttagactgcaagctagatcttaaagccatagctttgcaggctcggaatgctgaatataatcccaagcgttttgctgcggtgataatgaggatcagagaaccgaagactacagcattaatattcgcctcagggaaaatggtctgtactggagctaagagcgaggacttttcgaagatggctgctagaaagtatgctaggattgtgcagaaattgggattccctgcaaaattcaaggatttcaagattcagaatattgtaggttcttgtgatgtcaaattccctataagacttgaaggtcttgcttactctcacgctgctttctcaagttatgagcccgagctcttcccagggctgatttataggatgaaagtcccaaaaatcgtccttctaatctttgtctctgggaagatcgtaataacaggagccaagatgagagatgagacctacaaagcctt

SEQ ID NO: 3347 - DNA, 351 bp, Artificial
  Synthetic
gcagcacgaggaagccagaggtagccattgcagctagtactcaccaagtaaagaagatgaagaagggactttggtctcctgaggaagactcaaagctgatgcaatacatgttaagcaatggacaaggatgttggagtgatgttgcgaaaaacgcaggacttcaaagatgtggcaaaagctgccgtcttcgttggatcaactatcttcgtcctgacctcaagcgtggcgctttctctcctcaagaagaggatctcatcattcgctttcattccatcctcggcaacaggtggtctcagattgcagcacgattgcctgatcggaccgataacgagatccagaatgtctggaact

SEQ ID NO: 3348 - DNA, 455 bp, Artificial
  Synthetic
gcagcatgaacaaaggagcttggactaaagaagaagatcagcttcttgttgattacatccgtaaacacggtgaaggttgctggcgatctctccctcgcgccgctggattacaaagatgtggtaagagttgtagattgagatggatgaattatctaagaccagatctcaaaagaggcaattttactgaagaagaagatgaactcatcatcaagctccatagcttgctcggtaacaaatggtctttaatagctgggagattaccaggaagaacagataacgagatcaagaactattggaacactcatatcaagaggaagcttctcagccgtgggattgatccaaactctcaccgtctgatcaacgaatccgtcgtgtctccgtcgtctcttcaaaacgatgtcgttgagactatacatcttgatttctctggaccggttaaaccggaaccggtgcgt

SEQ ID NO: 3349 - DNA, 618 bp, Artificial
  Synthetic
accttattctttgttcttaaaaccttatctctttgctctgcagttctatagttctactgttaatctgttctaaagcagggttcaggaaatagcacaggtattaattactgaagctgttatattgtctgtgattagtgcatatagctagggaaggcaaggaaataatgaaattaggaccttggactcctgaagaggatatggccttgcagcggcttgttgcgaagcatggcccccgcaattggtcgctcattagtaaaggagtccctgtgcgctctggtaagtcctgtcgcttgcggtggtgtaaccagttgagcccggaggttcagcaccgcccttttagccccgaggaggacgctgtcatactggagtcgcaccggaggcatggcaataagtgggccaccatcgcccgccttcttcccggcaggaccgacaatgccatcaagaaccactggaactccgccttgcgcaagcatggcgaagcctgccttgctggtgccggcggcgcggtgtcccccttgtccagctcggacgggcggaagcgcagctgtagcagcattagcaacgaggaggcatcgtcatcatgggtcaaagaaagtcttgaaatagacgaaggagaag

SEQ ID NO: 3350 - DNA, 632 bp, Artificial
  Synthetic
caactgttctccgccacaaaatcaagaaagacagtggcggggactcaaaaaaccactagttttctgctacctctaaaaacttgacaatggcatttgcaggaacaacacagaaatgtatggcatgaaaagacagtgtatctagttgataaattaactgcagacaatagagtctatcataaagcttgtttcagatgccatcattgcaagggtactctcaagcttagcaactacaattcatttgagggagttctctattgtagacctcactttgatcagctctttaaaagaactggaagtctggacaaaagctttgaagggacacccaaaattgtgaagccagagaaagatgagaaaccacatgctgctaaagtctcaagcatgtttgttggaacaagggagaaatgttttggctgcaagaatactgtctatccaacagaaaaggtatcagtgaatggaacaccatatcacaaaagctgcttcaaatgtagccatggtggatgcacaattagcccatccaactatattgcgcacgaggggcgcctttactgcaaacatcaccatattcaactaatcaaggagaaaggaaacttaagccagctcgagggtgatcatgacaagaatacagttagaac

SEQ ID NO: 3351 - DNA, 716 bp, Artificial
  Synthetic
gcaaggcgaaggcgatcgattcgatcgatcgatctgtcgaggcaggggcccggcagcagctgttctacgatgtcgtccttctctttcgccggcacgcagcaaaaatgtaaggcatgcgacaagactgtctacttggtagaccagctcactgccgatggtgtcgtctatcacaaagcgtgctttcgatgccatcactgcaaagggacactaaagcttagcaattatgcttcgctggaaggggtcttgtattgcaagccccatttcgatcagctcttcaagcttactggaagtttcgataagagctttgagacaggactattgcacagacaacctagcgaagaagcgagtaagacgccatcgaagacatcgctcttgttctctgggactcaagaaaaatgtgttgcttgtgggaaaactgtgtaccccatagaaaaggtgactgtcgagggtacaccgtatcacaaatcttgtttcaagtgttctcacggcggctgtacgatatcgccatcgaattatcaagctcacgaaggccagctctactgcagacatcactacactcagctcgtcaaggagaaaggagacttcagcaatctgtccaagacaccggggaaggcagcagcgaaatagaaattggattttgggtgtaagggagtctactacgatcttcaaaggtttggtgatgagaaaacgttgcctgaggtgaatggaggatttga

SEQ ID NO: 3352 - DNA, 672 bp, Artificial
  Synthetic
tcatccttatcttaacaccattctctcttagcgtctttctccaaaaaccaaaaaccaagtgctctctgctgcagaaaatcaacaaaaggaaggggaagatccacaaaagaccatttttgttttctgtaaaacttgctcatattagccatggcatttgcaggaaccacacagaaatgcatggcatgtgacaaaactgtttatctggttgacaaattaactgcagataatagaatctatcacaaagcttgtttcagatgccatcactgcaagggcactctcaatcttggcaactacaattcctttgagggagttctatactgtagaccacactttgatcagctcttcaaacaaactggcagtttggataaaagctttgaaggtacaccaaaaattgtgaaaccacagaaacccattgacagtgagaaaccacaggtagctaaagtgacaagcatgtttggtggaacaagagagaaatgttttggctgcaagaaaactgtctacccaacagaaaaggtatcagattaatggtacgccataccacaagagctgcttcaaatgtagccacggaggctgtgtaatcagcccttccaactatatcgcacatgaggggcgcctctactgtaaacatcaccatattcaacttatcaaggagaaaggcaacttgagcaagct

SEQ ID NO: 3353 - DNA, 521 bp, Artificial
  Synthetic
gcagcatggcgttcgcaggaacaacccagaaatgcatggcatgtgacaaaacagtttatcttgtcgacaagttaaccgccgataaccgggtctaccacaaagcttgtttccgatgtcaccattgcaaaggaactctcaagcttagcaattacaactcctttgaaggagttctctactgcagaccacatttcgatcaaaacttcaagagaactggaagtcttgagaaaagcttcgaagggacaccaaagattgggaaacctgataggcctttggagggagagagacctgctggaaccaaagtttcgaatatgtttggtggaacacgagagaaatgcgttggttgcgacaaaaccgtgtatccaattgagaaggtatcggtgaatggaacattgtaccacaagagctgcttcaagtgtacacatggaggctgcacgataagcccttcgaattacatagctcacgagggtaagctatattgcaagcatcatcatattcagctgatcaaggagaaaggaaacttg

SEQ ID NO: 3354 - DNA, 346 bp, Artificial
  Synthetic
ttatcttgtcgacaagttaaccgccgataaccgggtctaccacaaagcttgtttccgatgtcaccattgcaaaggaactctcaagcttagcaattacaactcctttgaaggagttctctactgcagaccacatttcgatcaaaacttcaagagaactggaagtcttgagaaaagcttcgaagggacaccaaagattgggaaacctgataggcctttggagggagagagacctgctggaaccaaagtttcgaatatgtttggtggaacacgagagaaatgcgttggttgcgacaaaaccgtgtatccaattgagaaggtatcggtgaatggaacattgtaccacaag

SEQ ID NO: 3355 - DNA, 688 bp, Artificial
  Synthetic
ttatcatccatcggcagtgaaatcaaaagggctccaacttccaaacaagagattggtggaatcattggattcgtcagcgaaatgaaccaccggttcgtgtacagcctgaaccggagtcacgccaacgtctacatggttatgaccaatcaacaaagcatcagaccaaacaccattagtgtctaaagagagaagctcttcaccaggaaatggaggcaagccattataaccacattcctccacaatgtgttccaccggattaatataatgatcatgatgaccatcattgatgtccatactccatgaagggtccatggaagtgccggtaggattatctaccaaaaaatccgtagtggctaagtcgcaattttcttgtagtatagattcgtcaggctttggattcaagaaattggcgtaaacaagagcaagatcgatgcttggtgaaccaccaccggggttgccagaattagcggttaggctagttttagtattgttaccagaagatgatttggggcggcgggattttcgacagccaccgcctacaggaacattgcggagggaaccacctttggtccaatatctgcggcagcctttgcagaagtagcgaggctgagtgaggctatagttgttgtagtaacagaactttgtgttagaggatccacatcttggacaactcggcgtgatctccgcg

SEQ ID NO: 3356 - DNA, 152 bp, Artificial
  Synthetic
gcagcatggggaaagggaacatagttatacgaaggatcgataaatctacaaatatacaaatgactttctccaaaaaaaggactggaatgcttaaaaaaactaaaaaatcatcgatccttagatatgcaaaatttggtgttatcatatgctct

SEQ ID NO: 3357 - DNA, 460 bp, Artificial
  Synthetic
tcccgggtcgacccacgcgtccgaacaagatcaatagacaagtgacattctcgaaaagaagagctggtcttttgaagaaagctcatgagatctctgttctctgtgatgctgaagttgctcttgttgtcttctcccataaggggaaactcttcgaatactccactgattcttgtatggagaagatacttgaacgctatgagaggtactcttacgccgaaagacagcttattgcacctgagtccgacgtcaatacaaactggtcgatggagtataacaggcttaaggctaagattgagcttttggagagaaaccagaggcattatcttggggaagacttgcaagcaatgagccctaaagagcttcagaatctggagcagcagcttgacactgctcttaagcacatccgcactagaaaaaaccaacttatgtacgagtccatcaatgagctccaaaaaaagga

SEQ ID NO: 3358 - DNA, 501 bp, Artificial
  Synthetic
gcagcatggggagagggaagatagttatacgaaggatcgataactctacaagtagacaagtgactttctccaagagaaggagtggtttgcttaagaaagctaaagagttatcgatcctttgtgatgcagaagttggtgttatcatattctctagcaccggaaagctctacgactacgcaagcaattcaagtatgaaaacaatcattgagcggtacaacagagtaaaagaggagcagcatcaacttctgaatcatgcctcagagataaagttttggcaaagagaggttgcaagtttgcagcagcagctccaatatctacaagaatgccacaggaaactagtgggagaggaactttctggaatgaatgctaacgacctacaaaaccttgaagaccagctagtaacaagtctaaaaggtgttcgtctcacaaaggatcaacttatgacaaatgaaatcagagaacttaatcgtaagggacaaatcatccaaaaagagaatcacg

SEQ ID NO: 3359 - DNA, 638 bp, Artificial
  Synthetic
ggaggtgagagtagtactgcatttgcattaagatggaagaagagtggaataagaagaagaagaagagagggaagatggagataaggaggattgaggagaaaacgagtcggcaagtgacgttcagcaagaggcgaaatgggctgctcaagaaggcgttcgagctttcggttctttgcgatgctcaaatcgcccttctcattttctcgcccactggaaaactctatgaattcgcttcccccagtatcactgagacaatggatcgttataaaacatgtacaacaagtcatagcaacgatggggcaataaggcatccccaatattggatgcatgaaacagaaaaacttaaggaacaactttcctacctacaaaattggcagagtcaacttttgggtgaaaatttgaacgacctaaatatgatggatttacaaaaccttgagcaacagctagatcacggattaaaagatgtcagatacaaaaaggtgaatattctacttcaacaaaatcaagatctcaagagaaagattacagagctagagagcgaggttaccggccaaggggccaaggccgctaggaatgatgggaatatatatgtcgatatgcgtaggacttagttgttcctttttttatattaaacttga

SEQ ID NO: 3360 - DNA, 608 bp, Artificial
  Synthetic
tcttaataattggaatttgtgagagttttccgaaaggttttgaagtcgccggaaaatagcaatattttccattgaagccaatcagatgggtcgaggaaagatagagataaagaggatagagaacaacacaaacaggcaggtgacattttgcaagagaagaaatggactcctcaaaaaggcctatgaactttcagtactatgtgaagctgagattgctcttattgttttctccagccgtggccgcgtctatgagtactctaataacaacattaaggcaactattgatcggtacaagaaggctacttcagaaacctctaacgcttgcaccactcaagagctcaatgctcagttttaccaacaggaatcgaaaaagctgcgccaacagatacagatgatccagaattcaaacaggcatttggttggtgaaggcttaagctctttgaacgtaagggagctgaagcagttggagaatagacttgaacgaggcattactagaattaggtcaaaaaagcatgagatgatactagcagaaactgagaatttgcagaagagggaaattcaacttgaacaagaaaatgcattcctcagatcaaagatagctgaaaatg

SEQ ID NO: 3361 - DNA, 299 bp, Artificial
  Synthetic
catcgatccatcagtagctagctggcgtagctagctagctagctgcattgtccggcgagagagataactgctgcagggggcggccatggggaggggcaagatcgagatcaagcggatcgagaacgcgaccaacaggcaggtgacctactcgaagcgccgcacggggatcatgaagaaggccagggagctcaccgtgctctgcgacgcccaggtcgccatcatcatgttctcctccaccggcaagtaccacgagttctgtagcccttccaccgacatcaaggggatctttgaccgctacc

SEQ ID NO: 3362 - DNA, 342 bp, Artificial
  Synthetic
gcagcatgtcttgtaataatggaatgtcttttttcccttcaaatttcatgatccaaacctcttacgaagatgatcatcctcatcaatctccatctcttgctcctcttcttccttcttgctctctacctcaagatctccatggatttgcttcgtttctaggtaagagatctccaatggaagggtgttgtgatttagaaacagggaacaatatgaatggagaagaggattattcagatgatgggtcacaaatgggagagaagaagaggagattgaacatggaacaagtgaagacactaaagaataactttgagcttggaaacaaacttgaaccagagaggaaaa

SEQ ID NO: 3363 - DNA, 609 bp, Artificial
  Synthetic
ttcttgtcattaattaactgcagcatgcaggatctgacgtcagcagcagcgtattatcatcagtcgatgatgatgacgacggcgaaacagaaccaaccagagttaccagaacaagaacagctaaagtgtcctcgctgtgactcacctaacactaaattctgttactacaacaattacaatctgtcacagccccgtcacttttgcaaaaactgtcgtcgttactggactaaaggcggtgctcttcgtaacatccccgtcggtggtggaactcggaaaagcaacaaacgatccggttcttctccgtctagtaatctcaagaaccaaaccgtcgctgagaaacctgatcatcatgggtccgggtcagaagaaaaagaagagagagtttcgggtcaagaaatgaatccgacccggatgttatacgggttaccagttggagatccgaatggtgcgagttttagttcgttgttggcgtcgaatatgcagatgggtgggcttgtttacgagtccgggtcgcgttggttaccaggtatggatttgggtttgggttcggtacggaggagtgatgacacgtggactgacttagctatgaacagaatggagaagaattga

SEQ ID NO: 3364 - DNA, 608 bp, Artificial
  Synthetic
gcagcatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggaaggtgttttgtactgtaagcctcattttgagcagctctttaaggagagtggtagtttcaacaagaactttcagtcacctgcaaaatcggctgacaaatcaactcctgagctgacaaggacgcctagccgagttgctggcaggttctctggtacacaagagaaatgcgccacttgtagtaaaactgtgtatcctattgaaaaggtaacagtcgagagccagacatatcacaagtcctgcttcaagtgctcacatggaggttgcccaatttcaccttccaactacgcagctcttgaaggaatcctgtactgcaagcaccatttcgctcagctcttcaaggagaagggaagttacaaccacttaatcaaatccgcttccatcaaacgctctgcagccgcagcagtcgccgccggtgtaccagcagcctccgttcctgaatcttaataa

SEQ ID NO: 3365 - DNA, 276 bp, Artificial; identical to SEQ ID NO: 154
  Synthetic

SEQ ID NO: 3366 - DNA, 523 bp, Artificial
  Synthetic
cgcagcacacatccatccatccatccatctatccagagagcacagcaacggcgcatatatagtacccctctaccaaagcacaacaaccagaatctcctgagctcgatctagctactagcttgatctatccgatcaatcgactggcccgcgaggatcgatcgagactcgaaagggagggattttgatccggatcggtcgacgatggacatggcgcacgagagggacgcgagcagcgaggaggaggtgatgggcggcgacctgcgtcgcgggccgtggacggtggaggaggacctcctggtcgtcaactacatcgccgcgcacggcgagggccgctggaactcgctcgcccgatcagcagggctgaaacgcacaggcaagagctggcggctcctgtggctgaactacctccgccccgacctccggcgaggcaacatcacgccgcaggagcagctggtcatcctggagctgcactcgcggtggggaaaccgctggtccaagatcgcgcagcacctcccgggacgca

SEQ ID NO: 3367 - DNA, 139 bp, Artificial; identical to SEQ ID NO: 991
  Synthetic

SEQ ID NO: 3368 - DNA, 283 bp, Artificial
  Synthetic
ttataaaaacaatacactatcaacgtaattgtcaatactgctccaaatctctctcgctgaatcaatctgatcactatgaccatgaccatgaccacttcctcctcccatgtacatctgccacgggaatccccacaaaaccctgtttggatcaattgtcgacatctgatccataccgcctccaccatttccaaacgcataccccgtgttctccatctgatggatcgtggtcccatacacgccatccatggccattggatactgacagcttccgaaccctatatgt

SEQ ID NO: 3369 - DNA, 537 bp, Artificial
  Synthetic
ttcctctgtcatcatctgttgccagcaacgtattctttcccatctggctagccagaacctggttctcttctctcagcaatttctccttttctttaagggactcgatatactccatcatcagttctgccttcctagctctacttacggacagagcagtctcaagttgttcctccagagaaattagagaatctacacttacattatcgacatttggttcttcaagcttgctttggactgtttctagtaactccttgtgtggaagataattctgaattttttcttcaagatctaaggctctaagttcatcagcatgttgtatttcataacgatcaatgatcttggaaatgtcgtcaccggaggaagagtcatagagttttccggaggcagatacgacgacaacagcgacggaggattcacagagaatcgaaagttgtcgagctttgtcgatgagaccattgcgtcgtttggagaaagtgacttgtcgactgcttttgttctcgattcgcttgatctcgatttttcttcttcccatgctgc

SEQ ID NO: 3370 - DNA, 514 bp, Artificial
  Synthetic
gcagcatgggaagaagaaaaatcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatg

SEQ ID NO: 3371 - DNA, 631 bp, Artificial
  Synthetic
gagggactgaccgtctacttcccctacgagtttatctaccgggagcagtatgcatacatggtggagctcaagcacgcgctggacgcccgcggccactgcctgctggagatgcccaccggcaccggtaagacgatcacgctgctctccctcatcaccagctaccagctcgccaatccctccatcgccaagctcatctactgcacccgcaccgtgcacgagatggagaaggtgctggacgagctccgccgcctccaccgctaccaggagcaggagatcggcagcagccgggccaagatgctggcgctgggcctcagctcccggaagaacctctgcgtccaccccgtcgtcagcagcgagacgtccagggagagtgtggacgccggctgccgaaagttgacggcgtcgtgggtgagagccgccgccgagaccaaccccgacattgagacgtgctccttctaccagggctacgagaagcaaggcagcgaccagccactgcctgcgggtgtctacactctccacgacctccgggtttacggcaggcagaaaggatggtgtccatacttcatggccagacgcatgatccagtttgcgaatgtggtggtgtacaactaccagtatttgctggatccca

SEQ ID NO: 3372 - DNA, 580 bp, Artificial
  Synthetic
ttgaattctcaatacctacataaacatcaatctatattgaaccacaacaaaaagaggctaaatcaagaacaagtcaagaggttagaggaaagttttgattcaactaagaagcttgagccagagcaaaaaatccaacttgctaaagagttaggtgttcctccgcgacaaattgctatctggtaccagaacagacgagctagatggaagaaccagagcctcgagctggactacaatgctcttcagcttcagcttgacactgcattagctgagaagaggaagattgagaaagaaaacgaacgtcttcgaggcgagttgaagaaggtaaacgggatgttagttgcttgtaaaaaagcacaaggacatgaagaaacacaaggatttgttcctttaaatgcaactaatcccatttctagtggttgtgaggaaggagtagtgagttcaaactaccaagaagatgtgagttgtttattgataaaaaataatagtgactctaatttgcaatttgatgagctttatgcttgcttgatgggtgcagaagaaggatcaaattgtcgtttaagttggcaaaatggaaaagatc

SEQ ID NO: 3373 - DNA, 535 bp, Artificial
  Synthetic
atggaagaagggatgaagaaggggccatggagtggtagcgaatacacggtgctggtggagtatgtgaaggagaacggggagggggattgggacaaggtgtacttgaagacggggttgcctaggtctgggaagagttgccgcctccgatggtctaaccacctccgccctttcctcaagaagggacctttcacccttcttgagcagcaagctgttcttgctttccatgcctgcctcggtaaccagtgggctaagatggcccaactgatgcctggtcggacagacaatgaaatcaaagatttctggaacactcattgccagcgcctctcccgtcagtgaacttctacacagaatgttgtgctttcttctccaaatttgacaggtttctcagctttttttaaaataagcaagaagacagcgtaaattaaaataaattagtacgtgtatttcggacattcaagtagagtgttattggtcatgttgtattaggaaaagtagacctctgtaaattctactatgtttgagattcttagccacg

SEQ ID NO: 3374 - DNA, 379 bp, Artificial
  Synthetic
cccacgcgtccgacaactactactcagagcaaagctgttacttgaatttccctcctctggcttctccaacatgggaaagttccttggaatctatatggaacatggatgcagatgaaagtaagatgtcttcttttgctattgatcagtttcctctaagttttgaacatggtagtggtcgcctttagtctaggatttgattcatttggaatgtttatatgtgcagcatatatatgttatcaaacgacgactgtagtagtttcctatgacttacatcaaaaatcaccacccactgtactaatctcataagtagtcatcatcttatgcctttgtttagtttgtagagtgagtgaaaagatgtgtaatacaagtcagaactcta

SEQ ID NO: 3375 - DNA, 174 bp, Artificial
  Synthetic
cccacgcgtccggagaggtaaaaggttctattgcccagagaacgagagtttgagaacgagagagagagatgacacttgcgcaagaagaataccgtcatggaccgtggacagaacaggaggacatcctcttggtcaactctgtccacttgttcggagatcgaagatgggattttg

SEQ ID NO: 3376 - DNA, 632 bp, Artificial
  Synthetic
tcaatcgatgaccaaagacataatcttttcctgaagatttggctgaatcggttgcactctatatccaaactgcccatcatgatctctcatcatcattcctcttgcgttgcttgctatagccatctcctgttgttgcagctggaaagtgagttgccgttgctcctccgccatcatcttctcatttctcctctttgatataaggatctccatctggtggtctcggactttgtcgaggccatgttcaatggcgtgctcgacagccatcagatttttcaagttgagagactgtatatcttctcccttcaaatgcctgagctccagttgtaagctatcattctctttcttgatcctatcaatctcattgctaaggttctcatgcttagcatcccatagtttcttgccagataacttctggtattggtccaacatagcaccaagatccatggaaggacaacagtaatcaatcatcttaccattacttgcaaagattatgagggcaacttgtgcatcacaaagaactgtgatctctttagccttcttcaccaatccattcctcctctttgagaacgtcaccactctgttgtttgcgtcctctatcctctttatctcgatctttcctctacccatgctgc

SEQ ID NO: 3377 - DNA, 440 bp, Artificial
  Synthetic
gcagcatggctgataggatcaaaggtccatggagtcctgaataagacgagcagcttcgtaagcttgttgttaaatacggtccaataaactggacagtgattagcacatctattcccgggagatcggggaaatcgtgtcgattacggtggtgcaaccagctttcgccgcaagtagaccatcggtcgtatgcggctgaggaataccagatgatcgcacctgctcactctcacatcggctataactgggggagattgggtcgtcttctctatggtcgtacgtccacttccgtgactactcaatggaactcgacgctcgcaaggaaatggcttgaatcctctgatctttatagagctggtacgccttgaccaccaactatatcatgcattgattactgtcagacagcgaaaggaacgattgctgactaaccaacttgaagaatc

SEQ ID NO: 3378 - DNA, 320 bp, Artificial
  Synthetic
cccacgcgtccgctctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcg

SEQ ID NO: 3379 - DNA, 652 bp, Artificial; identical to SEQ ID NO: 155
  Synthetic

SEQ ID NO: 3380 - DNA, 653 bp, Artificial
  Synthetic
gcagcatgatagcttcagagagtaccaagagctgggaagctagcgcagtcagacaagagaatgaagaagagaagaagaaaccggttaaagattccggtaagcatccggtttatcggggtgtccgaaagaggaactggggaaaatgggtgtccgagatacgtgaacctaggaaaaaatcccgaatatggctaggaacgtttccttccccggagatggcggcgcgtgcacacgacgtagccgctcttagcatcaaaggagcctccgctatactcaatttccctgacctagccggctctttcccacgccctagctcgcttagccctcgagacatccaggtcgcggctctcaaagccgcacacatggagacctcacagtctttttcttcttcttcttctttaacgttttcatcttcacagtcttcttcttcgctagagtctctcgtgtcttcctccgcgaccggctccgaggagctaggggagattgtagagctcccaagtttgggatcgagctatgatggtttgactcagctaggtaacgagtttatattctctgactccgcagacttatggccttatccaccgcaatggtcagaaggtgattaccaaatgattcctgcctcgttatcacaagattgggatcttcaaggactgtat

SEQ ID NO: 3381 - DNA, 824 bp, Artificial
  Synthetic
gcagcatgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagtagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcaccataa

SEQ ID NO: 3382 - DNA, 488 bp, Artificial
  Synthetic
gcagcatggaatcgtcgtcgtcgggaacaacttcgtcgacgattcaaacgtcgtcaggatcggaggagagtctcatggagcagaggaaacgtaaacggatgctctcaaaccgtgaatctgcaaggagatcaagaatgaagaaacaaaagctcctagacgatctaacggctcaggttaatcatctgaaaaaagagaacacggagatcgtgacaagtgtcagcatcacaacgcaacactacctaaccgttgaagcagagaactctgttctcagagctcagcttgatgaacttaaccacaggctccaatctctcaacgacatcatcgagttcctcgacagtagcaacaacaacaacaacaacaacatgggcatgtgttcgaaccctctggttggtttggagtgtgatgatttcttcgtgaatcagatgaacatgtcttatattatgaaccagcctctcatggcgtcttctgatgctttaatgtattaataa

SEQ ID NO: 3383 - DNA, 650 bp, Artificial
  Synthetic
gcagcatggagatgatgagctcttcttcttctactactcaagttgtatcattcagagacatggggatgtatgaaccatttcaacagttatctggttgggagagtcctttcaaatcagatatcaacaatattactagtaatcagaataacaatcagagttcttcaacaacacttgaggttgatgctagaccagaagcagatgataacaatagagtgaattatacttctgtgtataataactctcttgaagcagaaccgtcgagtaataatgatcaggacgaagaccggatcaatgataagatgaaacggcgtttggctcagaaccgagaagctgctcgcaaaagtcgtttgagaaagaaggcccatgttcaacagttagaagaaagccggttgaagttgtcacagctcgagcaggaacttgtaagagctaggcagcagggattatgcgtacgcaattcttcagatactagttatctaggaccagctgggaatatgaactcaggtattgctgcatttgagatggaatacacacactggctagaagagcaaaacaggagagttagtgagattcgaacagcgctccaagctcatataggtgacattgagctcaaaatgttggtagatagttgcttgaaccactacgcaaatctc

SEQ ID NO: 3384 - DNA, 571 bp, Artificial
  Synthetic
gatactattttggaggaaactctcatttaggaggagaacaaaaccttcctgttaatatggccaacatgagctcagatgctgcagttttcgacatggagtacgcgaggtggctagaggaacaccatcgactaatgtgcgagcttcgaaacgcagtgcaagaacattttccagaaaacgagcttcgaatctatgtcgacaattgtgtaacacactacgatgagataatgaatctcaagagcatgcttacaaaatctgatgtctttcatcttgtttctggtatgtggaagactccagctgaacggtgcttcatgtggatgggagggtttcggccatctgagctcctcaaaattatcctgagtcagattgagccattaacagaacaacaacttatggggatttgtgggttacaacaatcaacacaagaagcagaggatgcactctctcaaggacttgaagctcttaatcactctctctcagacaccattgcctctgatgcattgtcttgccctcagaacatggccaactacatgggccaaatggctcttgccatgaacaaactctccactcttga

SEQ ID NO: 3385 - DNA, 600 bp, Artificial
  Synthetic
cggacgcgtgggcgccgaggcatgcgtcggacagcttcgagcaggaggcgtccaagcctcgagacaagatccagaggcggctcgcgcagaacagagaagcagctcgcaagagccggctacggaaaaaggcttacatccagaacctggagacgagccggatgaagctggcgcatctggagcaggagatcacccgagcaaggcaacagagcgcgtacatcaaccgcagcagcaacccagccaccctaccagcgcccatcgattcaggtgtggtgacgttcgaggtggagtacgcgcagtgggtggaggagcaggggaggcagacggcggagctgagggcggcgctgcaggcggcggcggaggggccggagctccgggcggtggtggaggcggcgctggcgcactacgacaggctgttcgcggcgaagcgtgaggcggcgaggcgcgacgtgttcttcgtgatgtccggcgtgtggcgcaccggcgccgagcggttcttcctctggatcgccggattccgcccctccgaggtgatcagggtgctcgcgccgcagctggagccgatgacggagcggcaggccgccgacgtgcaggggctccagc

SEQ ID NO: 3386 - DNA, 590 bp, Artificial
  Synthetic
gtcggggtcagttctagggtttagcacggggccgcgacttgcgaggacggtggccggattcgcgatggagcaagtggcgctggatgacgcgaagctcaaatcttctgtccaatccttccgcggcggcaagcgcgatcgagaagtcgtcacggcgggcggttttgatgtggaaggcatctcgatcggcggtcatgagacctgtgtgatcgtcccatccatgaagatcgcgttcgatattgggcgatgtccccagcgggcgatctcccaggatttcctcttcatatcccactctcatatggaccacatcggaggaattgcaatgtatgttgctactcggggtctctactcgatgaagccacccacaattttcgtgccttcgtcgatcaaaaccacggtggagaagctcttcgatgtttatagagagctcgatcaggcagagctagcaatgaagctggttggacttgacatcggcgaagagtatgatctcgggaaaggatacatcgtcaagcctttcaagacataccacgtaattcccagtcagggttatctcatctatgctgtgaagaacaagctcaagccagaatacatcg

SEQ ID NO: 3387 - DNA, 298 bp, Artificial
  Synthetic
ctttaagacattccatgtcatccaaagccaggggtatgtagtgtattcaactaaatataaactcaagaaggaatatattggcctatctggaaatgaaattaagaacttgaaggtttcaggtgttgagattacagacagcataataactcctgaagttgcttttacgggagatacaacgtccgattttgtagttgatgaaactaatgctgatgctctcaaggcaaaggttctcgtcatggagagcacatttcttgatgattcggtatcggtagagcatgcgagagattatggacatatc

SEQ ID NO: 3388 - DNA, 528 bp, Artificial
  Synthetic
aggggagggcgcgctctgaagcagccatggtgaatgttccgaagaccaagaagagctttgccaaggcaaggatgtaggaagcatacgcttcacaaggtcactcagtacaaaaaggggaaggatagcttgtatgtgcaaggaaagaggcgttatgaccgaaaacagtcgggatatggaggtcaaactaagcctgtcttccataagaaggcaaagaccactaagaagattgtccttaagctgcaatgtcagtcttgcaagcgcgtgattcaacatcccatcaagagatgcaagcactttgaaattggaggtgacaagaagggaaaggggacttccctgttctaaatctcatcatttttctatcagttttggcttgggatccctgatcttattgtgttggagctcttccttattccatataagagctaattcttagtctttctgagttcctactgtatgaacttattataatccaatgcacaattatggctactcttactattatatgaacttattgtcatccgatgcacg

SEQ ID NO: 3389 - DNA, 324 bp, Artificial
  Synthetic
cggcagtggaagtacgacggcacgagcttcaccgaagagcgaaaatggtgaacattccgaaaactaagaacacttactgcaagaacaaggagtgcaagaagcataccttgcacaaggtgacgcagtataagaaaggtaaagatagccttgctgcccaaggaaagcgtcgttatgatcgtaaacaatctggttatggaggtcagaccaagcccgtcttccacaagaaggctaagacaactaagaagattgtgctgaggcttcaatgccaaagctgcaagcatttctcgcaacgcccgattaagaggtgcaagcactttgagatcg

SEQ ID NO: 3390 - DNA, 504 bp, Artificial
  Synthetic
aagcaaaggcggtttctactgcagctccttccttgcctgaagtcagcctccgaccatggtgaacgttccaaaaactaagaagacgtactgcaagtcaaaggagtgcaaaaagcacactctgcataaagttacacagtacaagaaaggaaaagatagcctagcagctcaaggcaagcgtcggtatgatcgcaagcagtctggttatggtgggcagacgaaacccgttttccacaagaaggccaaaactaccaagaagattgtgctaaggttgcaatgccagggttgcaaacatgtgtcccagcacccaatcaagagatgcaagcactttgaaattggtggagataagaaaggaaagggaacttctctcttttaagtggcgcattcacggagatgaaattgtttatttttgtgtcgtggtggacttttttatcaagtgtagctcaacaatgtttcttttgcatattgaacaatgtatgtctatggtataatacttatatttcgagt

SEQ ID NO: 3391 - DNA, 562 bp, Artificial
  Synthetic
gaaacctatggtaagggcgtaggcattgacagacgtctggttagaggtagctgttcgacttgcagtcatggtgaacgttccaaaaacaaagaaaagcttttgccagggcaaggactgcaagaagcataccttgcacaaagttactcagtacaagaagggcaaggacagtctctacgtgcaaggtaagaggcgttatgaccggaagcaatctggatatggaggtcaaaccaagccagtctttcacaagaaggctaaaactaccaaaaagattgtactgaagcttcaatgccagggttgcaagcgtgtaactcagcatcctatcaagaggtgcaagcattttgaaattggtggtgacaagaagggaaagggaacatctctgttctgagctgttgcattgcttttgtcttcttttttagtcttgatctttatctcgatgtagtccaattaaagcttaatttaaataccccaacggatcctatctggttctgtagttgcttcagatatcagattaatgacaatgtagtttatttgagaattaatatcaactcttaccattattacg

SEQ ID NO: 3392 - DNA, 563 bp, Artificial
  Synthetic
taatcctcgactcgcgacaatggtgaacgtacctaagacaaagaagacctactgcaaatccaaggagtgcaaaaagcacaccttgcataaggtcacacaatacaagaaaggaaaagatagtcttgctgcccaggggaagcgtcgttatgatcgtaagcagtcaggttatggtggacagacaaagcccgtcttccacaaaaaggcaaaaactacaaagaagattgtcttaaggttgcaatgccaggggtgcaagcatgtctctcagcacccaatcaagaggtgcaagcattttgagattggtggggacaagaaaggaaagggaacctctcttttctagattgcctgtgatgcaaaatttgatagttttctgttatacgtttttagatatctttttttgttggtgtagttcaagagcttttgttttcttagattcaagttaatattatgctgtgttaattacattttgattaggagatcaaagctgtacttttcaagtttctatttagtatgattcttgttcccttattgatgttcaagcatttggaagttacttgtgctgcttt

SEQ ID NO: 3393 - DNA, 619 bp, Artificial
  Synthetic
catttctgtctcactcttcgccggcgacaatggtgaacgttcctaagacaaagaagacctactgtaagtcaaaggagtgtaagaaacacactttgcataaggtcacacaatacaagaagggcaaagatagcttagctgctcaaggaaagcgtcgttatgatcgcaagcagtctggatacgggggtcaaacaaagcccgtcttccacaaaaaggcaaaaacgacaaaaaagattgtgttgagattgcaatgccaggggtgcaaacatgtttcgcagcacccaatcaagaggtgcaagcattttgagattggcggggacaagaaaggaaagggaacctctcttttctagattgcctgtgaagcggaatgtaacagatctttcacccccttctgttctgttacactgttcagatactttggtaatatttgatgtagtgcaggagtttctgttattgaatcatgtgatcaattttgtgatgtcttagagaatctgataaggagagaaaatgaatattttaagtttttggtttagtatcttgttgcctaaatctattgcaagaaagttatgctgctctacctcacttggctgcatcaatttgtatgttgggattatattatagg

SEQ ID NO: 3394 - DNA, 659 bp, Artificial
  Synthetic
gtaacgacaccgcacaccgtcgtcaaaatggtcaacattcccaagacccgtaacacctactgcaagggcaaggagtgccgcaagcacacccagcacaaggtcactcagtacaaggccggcaaggcttccctgttcgcccagggtaagagacgttatgaccggaagcagagcggttatggtggtcagaccaagcccgtcttccacaagaaggccaagaccaccaagaaggtcgtcctgcggttggagtgcgtcaagtgcaagaccaagttgcagctggccctgaagcgatgcaagcacttcgagctgggtggtgacaagaagacaaagggtgctgctctggtgttctaaatgcgttgttctccggtattatcaattcttatgcttctcctggcggcatacgggcatcatggaacttggcgaagggggtactggtccttgtttagaggacagcggctcataggaaacgaataaaaagatttcttcatggaccgcattcacgcgttttttactgggatatgctttacagtgttatggtggaaaagccaacctgggacaatattccaattcacgatggcctggtgtctctgtgctaggcaactttagttcatggaggaggctcagactagctaacatgaaaagaagccgaatttcaccctttt

SEQ ID NO: 3395 - DNA, 535 bp, Artificial
  Synthetic
cccccgagggttttcggcaccgagctcgcgccgccgccatcgcacccaccgaaggagggagaggaacccaaagctcggcgccatggtgaacgtgccaaaaactaagaagacttactgtaagaacaaggaatgcaggaagcacaccctacacaaggttacccagtacaagaaaggaaaggatagcctttctgctcaggggaagcgtcgttatgactgcaagcagtcaggatatggtgggcagacaaagcctgtttttcacaagaaggccaagacaacaaagaagatcgttctgaagctgcagtgccagagctgcaagcactactctcagcacccgatcaagaggtgcaagcactttgaaatcggtggagacaagaagggcaagggaacttcactcttctaagatgctgatattgccctgttccccaattctctgccaggagttagcattaagaatgttcttgtcttgcctttctagtacaagttatatatcctcttgttttcagtcaggtctttttgatacataactacactacta

SEQ ID NO: 3396 - DNA, 638 bp, Artificial
  Synthetic
cccccccggccgccactcgccgcagcgtgtcggccagacaaggcagcgcctccgaaaccctagctccccgccttcccctccgcggccgccaaaatggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggcaaaaaccaccaagaagattgtgctgaagctgcaatgccaaagctgcaagcattactcccagcaccccatcaagaggtgcaagcatttcgagattggtggagacaagaagggcaagggaacatctcttttctaaactacctactggatactgaagttgtgggtctattgtgcttcatacttcaatgttattaggaacttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggc

SEQ ID NO: 3397 - DNA, 633 bp, Artificial
  Synthetic
gaggggagggtgagctctcttctgaagcagccatggtgaatgttccgaagaccaagaagagcttttgccaaggcaaggattgtaggaagcatacgcttcacaaggtcactcagtacaaaaaggggaaggatagcttgtatgtgcaaggaaagaggcgttacgaccgaaaacagtcgggatatggaggtcaaactaagcctgtcttccataagaaggcaaagaccactaagaagattgtccttaagctgcaatgtcagtcttgcaagcgcgtgattcaacatcccatcaagagatgcaagcactttgaaattggaggtgacaagaagggaaaggggacttccctgttctaaatctcatcatttttctatcagttttggcttgggatccctgatcttattgtgttggagctcttccgtattccatataagagctaattcttagtctttctgagctcctactgtatgaacttattataatccaatgcacaattatggctactcttactatatgaacttattatcatccgatgcacaattatgactactcttactatatgaacttataatccgatgcacaattatggccaatttttaaaagcctcttatttgcgaaaacaactgttgaccaaccttg

SEQ ID NO: 3398 - DNA, 624 bp, Artificial
  Synthetic
agagaacgtttcaagttttgctgcatatggttggacatttattaaacgtcagcgtcggaaaaggctctgttgtgttcagagtggttatagagactggagcagatggtgggaatgacaaagtttggggaacaagaagagcaaacgtgacagatgaatatgtgactataaaatttgaaattgaggttagtcttgaaggcactcaatcagatagttcaatctccaccattcactttggtggaagtaggcataatagcaaggaggtaacggagggcttgagtttcagcatgtgcaaaaagcttgtccagatgatgcagggaaatatatggatgtcttcgaacgcccagggccacgcacaagggatgactcttatcctcaggtttcaaaaacagtcgtcttttaggaaacgcatgtttgaatatagaaatcctttggagcaaccaatttccagcacaatgttcagaggcctaaatgtactcctcactgacgatgatgatgtaaatagactggtaacaagaaagctgctcgaaaaacttggttgccaagtaactgctgtttcaactggttttcaatgcctaagtgccctaggcccttcattaacaacctttcaagttgtcattttggatc

SEQ ID NO: 3399 - DNA, 617 bp, Artificial
  Synthetic
  misc_feature (243)..(243): The residue at this position can be any nucleotide.
  misc_feature (286)..(286): The residue at this position can be any nucleotide.
ggaagacccggatctttattgaaactatacttcctaaaatggggattacggccacggtcattgacccagccgatgtcggagctctggagttggctctaaatcagaagaaagtgaatcttttctttaccgagtctccaacaaatccattcctcagatgtgtagacattgagatggtttcaaagctttgtcatgaaaaaggagccctgttttgcatagatgggacttttgcaactcctcttaatncaaaaggccttgcccttggggctgacctcgttctgcactctgnaacaaaattccttggtgggcataatgatgttctcgctggttgcattagtggtcctgtaaagttagtttcagaaatacgtaacctgcatcacatcctgggtggtgctctcaatccgaatgccgcatatctaattatccgaggcatgaagacgctgcatcttcgtgtacagcaacaaaactctactgcattgaggacggccgagattttagaggctcatcccaagctgagacatgtctattatccaggcctgcacagtcatccagaatatcacattgcaaagaaacaaatgacaggttttggtggcgtggtcagttttgaggttgatggagat

SEQ ID NO: 3400 - DNA, 682 bp, Artificial
  Synthetic
atcaaagctttgccatgaaaatggagcgttggtttgcatcgatgggacatttgcaactcctcttaaccaaaaggcccttgctctaggggctgacctcgttgtgcactctgcaacaaaatatattggtggccacaatgatgttcttgctggttgcattagtggacctgaaaagttagtttcagtagttcgtaacttgcatcatatcctgtgtggtgctatcaatccgaatgctgcgtatttgatcatcagaggtatgaagacgctgcatcttcgtgtacagcaacagaactcaactgcacaaaggatagccgaaattttagaggctcatcccaaggtgagatgtgtctattatccaggcttgccgagtcatccagaacatcagctggcaaagatacaaatggctggttttggtggtgtggtcagctttgaggttgatggggatctgctgactactgcaaaattcattgatgctctgaaaattccttatattgctccatcatttggaggctgcgagagcattgtggatcaaccagcaataatgtcttactgggatcttagccagtcagacagagcaaagtatgggatcttggacaacttggttcgattcagctttggagtggaagactttgaggatttgaaagctgatattcttcaggctctggaggccatataagaccgtctt

SEQ ID NO: 3401 - DNA, 495 bp, Artificial
  Synthetic
gctatgctcagcgcgcttgttccagcaggtgggcacgttgtgaccaccactgattgttaccgcaagacgagaatttacatggagactgaactacctaagaggggaattacgatgaccgttattagacctgctgacatggatgctctccaaaatgcactggataataataatgtatccctattcttcaccgagactcctactaatccatttctgagatgcatcgacattgatcttgtctcaaaaatgtgccatagcaagggagcattgctttgtattgatagtacctttgcatccccaatcaatcagaaggcactaactctaggtgctgacttagttatccattcagcaacaaagtacattgctgggcacaatgatgttattggaggctgcatcagtggcagagatgagctagtttccaaagtccgcatctatcaccatgtagttggtggtgttctaaatccgaatgctgcctacttgattcttcgaggcatgaag

SEQ ID NO: 3402 - DNA, 613 bp, Artificial
  Synthetic
  misc_feature (264)..(264): The residue at this position can be any nucleotide.
ggctacttcctcattccctctctccagcttctttccttttcttttcttgcaagcgtagttcatcatggctgctacacttgccttttccctcttcgtctctgcctggcattgttcttaatgccttccttgcttggactcctaagcatagtagccactgcttttgcccaaagtggatggaactctgctcatgccaccttctatggtggaagtgatgcctccggaaccatgggaggtgcttgtggctatggtaatctgtatagccanggctatgggaccaacactgctgccttgagcactgccctcttcaatgcagggatgtcatgcggggcgtgctttgagatgaggggtgctgatgaccctcagtggtgcctccctggttctatcattgttactgccaccaatttctgcccccctaataacgctttgcctaataatgctggaggctggtgcaatcctcccctccaacatttcgacatggcccaacctggcttcctgcaaattgccaagtacaaggcaggcattgtgccagtgcaatacagaagagttccctgtgagaagaagggcggcgtacacttcactgtgaatgggcattcctacttcaacctagtcctgc

SEQ ID NO: 3403 - DNA, 457 bp, Artificial
  Synthetic
tttctgtccaccaaactacgcaaagcccaacgacaatggtggatggtgcaatcctccacgttctcactttgatcttgccatgcctatgttcctcaagattgccgagtaccgtgctggcattgttcccgttacttatcgccggataccatgccgaaagcgaggaggaatgagattcacaatcaatggcttccgttacttcaacttggtattgatcacaaacgtggcgggggcaggagacataataaaggtgtggctgaaagggccaaagactaactggatacccctgagtcgcaattggggtcaaaattggcaatcaaacgctctcttgacagctcaatccctctctttcacagtcaaagccagcgaccatcgctcttctacttcatggaatattgtcccttctcattggcaatttggccagactttcactggaaagaatttcaaagtctaatatcat

SEQ ID NO: 3404 - DNA, 627 bp, Artificial
  Synthetic
atggcatctttcaactgcagatggatattgagtttcttccgcattgcgacaatggcgctttttcaccaagcaatagcctacggctactattccacccctaagtttaacgccctgccatggaagcttgcttatgccacgttctacggagacgagactgcttctgagacaatgggtggagcttgtggatatgggaatttgttcaattctggctatggaacagctacagcagcattgagcacggtgttatttagcaatggatattcatgtgggcaatgcttccaaataaaatgtgtgaactctaagttttgctacaaaggatttaccaccgttacagccacaaatctctgcccacccaattgggcccaagactccaaccatggtggctggtgcaacccgccacgtcaacactttgacatggctaaacctgctttcatgaaaattgctcaatggaaagctggcattgtccctgttatgtaccgcagggtaccttgcatcaagaaaggcgggatccagttcgcgttccaaggaaacggctactggttattagtatacgtgatgaatgtcgctggagggggagatgtggcaactatatgggtgaagggaagcaaaacagggtggatgaaaatg

SEQ ID NO: 3405 - DNA, 610 bp, Artificial
  Synthetic
tttccttttccttttccctcttctctctctgtttacttgttcacacactgaatcactatagtgtgtgagaaaatggctgtaactaagatactctgcattgctactactcttttctgttttctcaccgccgtcaatgcaaaaatccccggcgcttacaccagtggcccctggcaaggcgcccatgccactttctatggtggctccgacgcctctggcactatgggtggagcttgtggatatgggaatctgtacagccaagggtacggagtgaacaatgcagcactgagtacagtcctgttcaacaatggactaagctgtggagcttgctttgaaattaagtgtgttgacgatggaaaatggtgccttcccggtaacccatcgattttcgtcacggctactaacttttgcccaccaaatttcgctttgccgaacgacgacggtgggtggtgcaacccgccacgtcctcattttgacttagccatgcctatgtttctcaaaattggtcagtaccgtgccggaattgtcccagtcacttaccgccgagtaccatgccggaaagcaggagggatccgattcacaataaacgggttccgttacttcaatttactat

SEQ ID NO: 3406 - DNA, 678 bp, Artificial
  Synthetic
taacaatgcagggggttggtgtaatcctccccttcaccattttgacctctctcagcctattttccacacattgctcagtacaaagctggaattgtccctgttgcttacagaagggtaccctgcagaagaaggggaggaattaggttcacaatcaatggacactcatatttcaaccttgtactcgtaacaaatgttggtggtggtggtgatgttcatgctgtagctgtaaaaggaacaagaactggttggcaaccaatgtcaagaaactggggacaaaactggcaaaacaacaactaccttaatggtcaaacactctcatttaaggtcattacaggtgatggccgcagtttgatttcctacaatgttgcaccagctcattggtcttttggacaaacttatactggagctcaattccactgaaaaaactttggctgctcaagaatttaatattttagataaatggggttttaagtttgtagtatattagtagtatactagtattaatgttatgtatactaattttgtcactagtattagtattgtgactgttttagtatagaatgggtgtactcaaatagagtatataggaggactatgtctatttgggaggttttagtggcctctagggttaaaaaatgaaaagggcatattttaaaattgtcctttttttcattttta

SEQ ID NO: 3407 - DNA, 662 bp, Artificial
  Synthetic
tttcagttaaggtgtgtcaatgctcgacagtactgcttgcctggcacaattactgtcacagcaacaaatttttgcccaccaggtggttggtgtgaccctcccaatcaccattttgatctgtctcagcctgtctacttgcgcattgctcaatatagatctggcattgttcctgttgcctaccgaagggtaccttgtagaagaaggggaggaattagatttacaatcaatggtcactcttacttcaacttagtacttgtgaccaatgttggcggagcaggagatgtacgatcattgtacatcaagggatcaagaactcagtggcaaccaatgtcaagaaattggggccaaaattggcagaataacgcttacctcaatggccaaagcttatctttcaaagtcaccacaagtgatggtcgcactgtagtttcttataatgcagctcctcgttcctggtcttttggccagacttttactggaggccagttccgttaatatcaaattttttcaagtatagtgcttactatatatttaatttaaatattattccaagagttggccttaatggcttttactcaccataatttaagaaaaaaaaaatggcactttttgcttggccattcaattgtggaagaaaaggaattgattcggcctacttttttttg

SEQ ID NO: 3408 - DNA, 609 bp, Artificial
  Synthetic
aaaggttcctcattaatggctaatctaccaacattctccattatctcacttctcttcttctttttaagcttttgctttcatgcaacttttgctgattatggtggctggcaaaatgctcatgccactttctatggcggtggtgatgcctctggcactatggggggtgcttgtggatatggaaatttatatagccaagggtatggaaccaacactgcagcactaagtacagcactattcaacaatggtttaacatgtggggcttgttacgagcttacttgcaacaacaatggtcaatcatgcctccaagggagcattactgtgactgcaacaaacttctgccctccaaatccatccctccctaacaacaatggtggttggtgcaatccccctctccaacacttcgatttagctcagcctgctttcttgcaaattgccaaatacagagctggaatcgttcctgtttctttccgaagggtgccctgcaggagaaaggggggtataaggtttacaataaatggacactcattcttcaacttggttttggtgactaatgttgggggtgctggtgatgttcaatcagtatcaattaaagggtctaacagtggatgg

SEQ ID NO: 3409 - DNA, 677 bp, Artificial
  Synthetic
gcgaccagcttgacacagtgagttcttcccacgctgtgtgaccctaggagggcgacgaggccgggagtgtcgataccgatggatttgaacttttcaagaacgacggagatactctcgttgtggtcgggaagatatgactcgagcatatccgtcctgcttttaagtccatctctccttcctgtcttcaaaggaatataaggtcctcctactgcttcgatgccttctcttgcggacaagacgagaatgtcagaacatgagacaacaccaggacactccctctcgagagcttccttgatctcctcgatgtacctaaagtttctaagtccgaagctcctgtcgtgttctttctctcctagctctcttcttgtcgaatccagcaaaagcgacgcatcacatgactcaacggcgcagtcatggaagatgttacggagccaagagaaagcggtgttcttgtggcgtttgtagaggagtttgacttgttcacggacgatgtcttcggcctgaggacacgtgtccttgtagaagttcatcatcaaacctggctcagcctctgttactgcttcagatgttgcagagagtgcccaaaggcaaagtatcgccaccatcatcacacctttgcctcccattttttttctctatctttcttctctcactcggacgcgtgggtcgacccggga

SEQ ID NO: 3410 - DNA, 633 bp, Artificial
  Synthetic
atgaccagtaagtatgtgtggctactaaatggcttccatgtctcagcagcagcttcttgtcggtctttttctacttctcattgcggcattgtgttcttcatcttcctctgcttcttcgcttcacagctatgctcagtcttgtccgagagccgagcaaatcattgccgacactgtgagggaagcggctgacagagatccaaccacccccgccggcattatccgcttgttcttccacgactgcttcgttgagggatgtgatggatctctgctgttggaatcgacacccaccaatggcagggacgtggagatgtttgcactcgggaacaacaactctgcgcgtggtttcgagatcattgagttggcgaagacccggctggaggctgcctgcccggggaccgtgagctgcgcggacacgctcgccattgctgccagagacgccacaactcgctttggaggacctttctatactgtgcctacgggtcgcttcgacggacgggtctcgagcaggacgttggccgacgcacgactgccgggtccctccttcacttttgttgagctgagagacaacttttgggagaaacgcttgtcggtccatgatctcgtcgtcctctctggtggacacaccattggtcg

SEQ ID NO: 3411 - DNA, 1168 bp, Artificial
  Synthetic
cccacgcgtccgcaagtaacaaaaatggctatctcaaagcttattcctactcttgtgctctttgttttgttctcttttgatgttagtgttgctcatccaggtctaggatttggatggggaagtaatagtcccattggaggatctttttactcaaatctttacccacaattttaccagttctcttgtccacaagctgatgagattgttatgacggtgctcgaaaaagccatagctaaagaaccaagaatggcagcatctttactcagacttcacttccacgactgcttcgttcagggctgtgatgcatcaatcttgttggatgatagtgcaaccataagaagtgaaaagaatgctggaccaaacaagaactccgttagagggtttcaagtaatcgacgagatcaaagccaaacttgagcaagcttgtcctcaaactgtctcctgcgccgacattctagctctagctgctcgtggctcaactatactgagtggtggaccatcatgggagcttccactagggaggagagactcgaggaccgctagccttaatggcgcaaacacgaacattcctgcacctaactcaactattcaaaatctcttaaccatgttccaacgtaaaggtttgaacgaaaaagaccttgtttccctatcaggaggacatacgattggagtagcgaggtgcccaacgttttaacaaagactataccatcaaaacggtaataacccacccgacgagacgctaaagaggtcttactactatggtctcaggtcaatttgtccccccacaggcggtgacaacaatatttcacctttagacttagcctctcctgcaagatttgacaacacatacttcaagctccttttatggggcaaaggcttattgacatcaaatgaagtgcttttccctggcaatgtaggcaagactggtgccttagtgaaagcttatgccgaaaacgaaagactttttttcccacaattcgcaaagtcgatggttaacatgggaaacattcagcctcttactggttttaatggtgagatcaggaaaagttgtcatgtgattaactaaaaaaactgtgtgtttttgcattattattgtattaaggggtgattaaaaataagtcgtgttatgtttttcgatatgttagtgatttaattaacgtctttgaccg

SEQ ID NO: 3412 - DNA, 682 bp, Artificial
  Synthetic
gaccagtccaacatccagtcttttttcttctttttctttttattccttcattgttacagagaacaaattagaaagctgtctgaaacaccagaaatatatggagaaactacaaatgtatgttaaccaaacactatgtttatacaaatacaacaaacttttctttcttggtttcttgtgtttgttaacactctttccaacttcatcttcaaacctttccttcgatttttatgcactgtcttgccctacagctgaattcatggtgaaaaatacagtgagatcagcttcctctatggacccaacactccctggaaaacttcttcgtctccttttccatgactgttttgttgagggttgtgatgcatctatacttttagaaggaaatggaacagagagaagtgatccagcaaacaagtcacttggaggattctcagtaatagaatctgcaaaaagagtattggaaatcttttgccctcgaactgtttcttgtgccgatattattgcattggctgctagagatgctgttgaattcgcaggagggccaaatgttcaaattccaactgggagaagagatgggaaaattagtttggcttcaaacgtgagaccaaatatagtggacacaagtttctcaatagatcaaatgattgatatattttctgcaaagggattgtctttggatgatctt

SEQ ID NO: 3413 - DNA, 1141 bp, Artificial
  Synthetic
aagaagtaatttatttcttagtttctcaatatcactaatggcttctcttggacttggtttaatccttgtaataatgttctttctatctatattccaagcattttcagcttccacttcccatattggtggtgactatgctaatctttatccacaattctaccaattcacatgtcctcaagctaatgatattgtcatgtctgttttagaagaggccattgctaaagattcaagaatggctgcttctctacttagacttcacttccatgactgctttgtccagggatgtgatgcatccatattattggatgggaataaagaattcaaaagtgaaaaggatgcttcaccaaacaagaattctgctaagggatttgaagtgattgatgagattaaagctaaactggaacatgtttgtcctcacacggtctcctgtgctgatattctagcccttgttgctcgtgactctgtcctcctgagcggtggaccattttgggaagtgccactaggaagaaaggactcaaagatagcagacttcaacagagcaagtatcgacatccctggaccaaactcaacaatccaaaacctcataaatcttttcaacaaacaaggcctaaaggaagaagaccttgtttctctttctggagggcacaccataggggtggcaagatgtgtgtcatttaggcaaaggctatacaatcaaaatggtgacaatttgccagatgcaactctagaaagagattactactatgatttgaaatcaatttgtccaacaaagggtggagacaataacatttctcctctagatgttgcttcccctgtcaaatttgataattcatatttcaagcacttgttaaatggcaaaggtcttttgaactcagatgaagtacttttcactggaaatgtacaaaagactacagaattggtgaagaattatgctgaaaatgagggacttttcttccaacaatttgcaaagtctatggtgaaaatggggaatattaatactctgaatgaattgaagggtgaaattaggaagaattgtcgcatagttaactaaaataaattagtactactctgtatttatgaataattgcatgatcatgtttagttcctgagttttcttttgaataaagctttggttagatgg

SEQ ID NO: 3414 - DNA, 738 bp, Artificial
  Synthetic
aagaagctagcttttggtttcttagattatattccatagacatttcattgatcatggcttttcgtgtgagtcatctgagccttgcactaagccttgtggcacttgcacttgcaggtgttgctatttatagaaacacttatgaagccattaatttgggacttcaaatgctctctccagattttgatttgcgggagtcagcagtcagcattttaaccctaaataatgttgatcagcaaaattcacacaagttgagccagcaatctccagaatcatgcgccttctcagctgttcgcggagttgtagacagtgctattgacacagaaagacgcatgggagcttctcttattcgtctccatttccacgactgctttgttgatggttgcgatggaggtattcttctagatgatattgctggatcattccaaggagaacagacctcaccacccaacaacaactcagccagaggttttgaagtcatagcacaagctaaacaaagtgtaaaagatacttgtcccaacgtatctgtttcttgtgcagacatcttagccattgctgctcgtgattctgttgttaaacttggaggacaaacctataacattacactggggagaagagatgcaacaaccgccaacttcactggtgctttaactcaacttccagctccattcgacaaccttaccctccaaataacgaagttcagtgacaaaaactttactgtccgggaaatggtggcgctag

SEQ ID NO: 3415 - DNA, 569 bp, Artificial
  Synthetic
ggcagcggcagtattcgtgattgcagtgttgctgtctctgcatggcagtgctttcggccagctgagctcgaccttttacagctcctcttgcccgaacctcatcaacatcgtgagaaacggcgtccggcaggcagttcaagcagaggctcgaattgctgcctcgttcgttcgactccattttcacgactgttttgttaatggatgtgatgcttctatcctgctggatggctcaagtctggagcaaaacgcattcccaaacgtcaactctgccaggggttttgacgttgtggattccatcaagagctccgtcgagagctcgtgtccgggcgcggtttcttgtgccgacttgctagcactcatagctcgagaatccgtcgtcgcgctcaatggaccttcgtggactgtagtgttcggaagaagagacagcttatcagcgagccaggctgcagcaaatgccaatcttcctccaccgactttcaacgcctccgcactcatcgctaactttcagaaccagtgactttcagcgacagacatggtagctctctcgggtgctcacactattggacagg

SEQ ID NO: 3416 - DNA, 512 bp, Artificial
  Synthetic
cttgagtaatcttgaaaaaaaacctaaaaagtagacaatcatgtcttttttaagatttgttggtacaattcttttcttggtcgcaacttttggagcatcaaatgctcagttaagtgcaacattttatgataccacttgccctaatgttacaagtattgtacgtggtgttatggatcaaaggcaacgtactgatgctcgagctggtgccaaaattattcgtcttcatttccatgattgctttgttaatggttgtgatggatcaattttgttagacacagatgggactcaaactgagaaagatgcaattcctaatgttggtgcaggaggatttgatattgttgatgatattaaaactgcattagagaatgtatgccctggtgttgtatcttgtgcagatattttagcccttgcatctgaaataggagttgccttggctggaggtccgtcgtggcaagtactatttggcagaagagatagcttaacagcaaaccgatctggagctgagagtgata

SEQ ID NO: 3417 - DNA, 692 bp, Artificial
  Synthetic
ggcttcaatttccctttcttgttttgcttcttcactcgtgctgatcatttccgcgggactttcggtccactttcatcaaacagaagctcaaggtacgcaaccaattgtgaagggtctttcatggactttctatgactccatttgccccaatgctgaatccatcatcagaagccgcctccggcaggttttccggcaggatattggccaggctgccggccttcttcgccttcacttccatgactgttttgtccagggttgtgacggatcagtactattagatggttcagcgagcggaccaagtgagaaagatgcacctcccaacttgactttaagacagcaggcatttaggattattgaagaccttcgacgccgtgtgcatcgagagtgcggtagggtggtctcttgcgcagatatcacagccattgctgctcgcgattctgttttcttatctggtggccctgattatgatctacctttaggtagaagggatggactcaactttgcaacaagaaatgaaaccctagccaaccttccacctccttcattcaacacaagtgccattctaacttcacttgccaccaaaaacttcaccccaactgatgttgttgcactttctggtggccacaccattggcattggtcattgcacttctttcaccgagagactttaccctaaccaagatccatccatgg

SEQ ID NO: 3418 - DNA, 710 bp, Artificial
  Synthetic
ggttccaaagttttctttttctttgctatcatcttcttttcagcgtgtctctgcttttgcggaggacaattctggccttgtaatggactactacaaggacacttgccctcaagctgaagatattatcagagaacaagtgaagcttctctacaaacgccacaagaatactgcattttcttggctcagaaatatcttccatgactgctttgttgagtcatgtgatgcttcgttgttgctggactcaacaagaaggatgctgtccgagaaggagacagacaggagttttggtatgagaaatttcagatacattgagactattaaggaagctgttgaaagggagtgtccaggtgttgtttcttgtgctgatattcttgttttgtctggtagagatggcattgttgctctaggagggccatatgtcccactcaaaactggaagaagagatggaagaaagagcagagcagacattcttgagcaacacctccctgaccacaatgagagcatgagtgttgttcttgagaggtttgccaatgttggtatcaacactcctggagttgttgccttgctaggggctcacagtgtgggaagaacacactgtgtgaagttggttcaccgtttgtatccagaagtagaccctcaactcaacccagaccatgttcctcacatgctcaagaaatgccctgacccaatcccagacccaaaggctgtac

SEQ ID NO: 3419 - DNA, 586 bp, Artificial
  Synthetic
cccacgcgtccggaggacgtcgtgctgggcgagatgaggatgatcctcgaggaggatcccacgctcgcgccgtctctgctccggatgcactaccacgactgcttcgtccaggggtgtgacggatcgatcatgctgaggtcgaggagcgggaagggggagagggacgcgacgcccaaccggagcatgcggggctacgacgccatcaatcggatcaaggcgaggctggagaccgtctgcccgctcaccgtctcctgcgccgacatcatcgccatggcggcgagagacgccgtctacctgagcaaggggccgtggtacgacgtggagaccgggaggagggacggcgacgtgagcgtggccgagtacgccgagaacgacctggcgccgccggactccaacatcgtcgacgtcaagaccttcttcagcgtcaagtctctcaacgccaaggacatcgccgtgctcttcggatgccacagcatcgggacgtcgcactgcggggcgttccagaagcggctgtacaacttcaccggaaggatggaccaggacccgtcgctggacgccggctacgcggcgaagctcaagaagctct

SEQ ID NO: 3420 - DNA, 632 bp, Artificial
  Synthetic
cccacgcgtccggctcaaacacacacacggcactccatttttaacaagtgttttctctctgacaagccagctgcacttaagcattgctagagcgctaagctacctgcagcgtagtgtagtgtagtgtactgccatggcagtgcgcgtgcttcttcctcctcctcgccggtggttcttgctttcttctctgctgctggtggtggcggcggctgttcccgtcgtccatggatacggcggcggcggtgggctgacggtcgggttctacaaggagtcgtgcccggaggcggagaagatagtgcgcaaggtggtggcggcggctgtccatgacgacccgaccaccaccgcgccgctgctcaggcttcacttccacgattgtttcgtcagggggtgtgaaggatcggtgctgatcaactcgaccaagaagaacacggcggagaaggacgccaagccgaatcacacgctggacgcgtacgacgtcatcgacgcaatcaaggagaagctggagcacaagtgccccgctaccgtctcctgcgccgacatcctcgccattgctgccagagacgccgtctccttggcaacaaaggcggtgaggcaaggacggtggagcaaggacggcaacttgtacgaggtgg

SEQ ID NO: 3421 - DNA, 558 bp, Artificial
  Synthetic
attactaagcaaaaaatcatagtacaagctgctattgagccttaaaaaaatggattccaagagcttcaacctttcagcttttgcacttttagcttgcctgattttatctttttcagtatcatctcttgcctatgggaaaaaaacaacatggccaccacttaaagttggtttctatagatatagctgtccctctgcggaagcaattgtgaaaaatgttgtatacaaagccgtatcgcgtaatccaggcattgctgctggccttatcaggctccattttcatgactgcttcgtcagggggtgtgatgcatcagtactattggatggaccaaactcagagaaggaaggtgttcctaataagaacagtttacgtggttttgaggttgttgatgaagcaaaagcacaacttgaggctgcatgccctggaactgtgtcttgtgctgacattcttgcctttgctgctcgggacagttcctataaagttgggaaaataaactatgatgtcgaagctggacgtcgcgatgggcgtgtttccattgactctgaaacattaaccaacct

SEQ ID NO: 3422 - DNA, 645 bp, Artificial
  Synthetic
tactcctaagaggttacgtaagaagccactttgatgcatttagctgtttgtgtattaacgcgtatgaaaatgtgaaccgaataaactatttttgacatggccactaggtgttagttgacgatgcatatggccagcgtcagaacccccttctcctccacctctatatatatttcttgattgactttgaccagcttcatcactagatactagggaatacccagaatacctgtacaaactatatatcttcaatttgtagaaaactctgtcagaaacatccttctgttctgtgaaaatgataccgccattaatatttctctcttgtgtttttcatttagtttcagctcaacttcgagttggcttttacaattctacctgtccacaagctgaaactattgttcgacaagctgtgcaaaagcagttcaatatcgaccgttccatcactgcagctctgcttcgcatgcattttcatgactgctttgtgagaggttgtgatgcatccatactcataaagtcaacgaagtctaagcaatcagaaagaagtgctggaccaaatcaaacagtacgaggtttcgagcttatagataatgttaagaaaagcatagaaacatcatgtccatcaactgtttcatgcgctgacataataac

SEQ ID NO: 3423 - DNA, 797 bp, Artificial
  Synthetic
caacaagcattctcttctaccttagcctactagctagctttgttgtctactctgatcgaggttggtggtgatcatggcgtcgtcgagggtgatcctagcgctgctgctcgcggcggcggcggtgatggcgtcgtcggcgcagctggacgagaaattctacagcaattcgtgccccagcgtggaggccgtcgtccggaaggagatggtgcgcgcgctcggcgccgcgcccagcctcgccggcccgctcctcaggatgcacttccacgactgcttcgtcaggggttgcgacggctcggtgctgctcgactcggccgggaacagcacggcggagaaggacgcgacgccgaaccagacgctgcgcgggttcggcttcgtcgagagggtgaaggccgccgtggagaaggcatgcccgggcaccgtctcctgcgccgacgtgctcgcgctcatggccagggacgccgtgtggctgagcaagggcccgttctgggcggtgcctctcggccgccgcgacggcagggtgtccatcgccaacgagaccgaccaactgccgcctcccaccgccaacttcaccgagctcacccagatgttcgccgccaagaacctcgacctcaaggacctcgtcgtcctctccgctgggcacacgatcgggacgtcgcactgcttctccttcactgacaggctgtacaacttcaccggcctggacaacgcccacgacatcgacccgacgctggagctgcagtacatggcgaggctgaggagcaagtgcacgagcctccaagacaacacgacgctggtgg

SEQ ID NO: 3424 - DNA, 724 bp, Artificial
  Synthetic
ccacgcgtcgcgagaagcatagctcgcttccacgcaagattaaaagctgcccctcttgctgctgcagactgcagtcctgcaagatcagcgcctgaagcaagaagcgaagaatcaaacgagagcctagcagcgtagcagatcgatcgatcgatcgatattatggaggcgcgaggaagcagaggaatgcggctgtggctcctgtccgtggcggtgatggccatggcgatggcgacgaggtcgcaggcgcagctgcaggtcgggtactacgacacgctgtgcccggcggcggagatcatcgtgcaggaggaggtcagcaaggcggtgtccgggaaccccggcatggccgccggcctcgtccgtctccacttccacgactgcttcgtcagggggtgcgacgcgtcggtgctgatcgactcgacggccggcaacgtggcggagaaggacgccaagcccaacctcactctccgcggcttcggggcggtgcagcgggtcaaggacaagctcaacgccgcctgcccggccaccgtctcctgcgccgacgtcctcgccctcatggcccgtgacgccgtcgtcctcgccaacgggccctcctggcccgtctcgctcggccgccgcgacggccgcctctccatcgccaacgacaccaaccagctgccgccccccaccgccaacttcacccagctctcccagatgttcgccgccaaaggcctcgacgccaaggacc

SEQ ID NO: 3425 - DNA, 650 bp, Artificial
  Synthetic
gagtacgacgagagctaagtaaacttagctatatcgatcgaccatggcgtccaggactagtgctactgccggcatgctgctgctcgccgccgcggctgcgctggtgtgcagctcggcggcggcgaggatgccgccgttggcgaaggggttgtcgttgggctactacgacgcgagttgcccgcaggcggaggccgtcgtgttcgagttcctgcaggacgccatcgccaaggacgtcggcctcgccgcggcgctgatccggctccacttccacgactgcttcgtccagggctgcgacgcctccatcctgctcgacagcacacccaccgagaagagcgagaagttggcgccgccgaacaagaccctccgcaagtcggcgttcgacgccatcgacgatctccgcgacctgctcgacagggaatgcggcgacaccgtcgtgtcctgctccgacatcgtcaccctcgccgcccgcgactccgtcctcctcgccggtggcccgtggtacgatgttcccctcggccgccacgacggctccagtttcgcgtctgaggacgccgtcctgagcgcgctcccgtcgccggactccaacgtcaccacgctcctcgaagcgctgggcaagctcaagctcgacgcccacgacctcgtcgccctct

SEQ ID NO: 3426 - DNA, 643 bp, Artificial
  Synthetic
gagaagtagaaacaaacagagagcaattctcttctcctacctagcaacctagtgcagtgcagtgcagtgcagcgaaggtttacttggcgacttccatgggttgcctgttgatgctctgcttggtttctcccctcctcctcgccacctctgtccacggcaacccgtggtatgggtatgggtatggcttgttcccgcagttctacgaccactcgtgccccaaggcgaaggagatcgtgcagtccatcgtagcacaggcggtggccagggagaccaggatggcggcatccttggtcaggctgcattttcatgactgctttgtcaaggggtgtgacgcgtctgtgctcctggacaacagcaccaccatcatcagtgagaaggggtcaaaccctaacatgaactccctcaggggtttcgaggtcgtcgacgagatcaaggccgccctcgaagcagcttgccccggcaccgtctcctgcgccgacatactcgccctcgctgcacgcgattccactgtcctcgttggtggcccgtactgggatgtgccacttggccggagggactcactgggtgccagcatccagggctccaacaacgacatcccagctcccaacaacagcctccccaccatcatcaccaagttcaagcg

SEQ ID NO: 3427 - DNA, 561 bp, Artificial
  Synthetic
atggatgtgacggctcgatcctgcttgacgacacgtcgacgttcaccggcgagaagagcgccggcccgaacgccaactcggcccgcgggttcgaggtgatcgacgccatcaagacgcaggtggaggcctcctgcaaggccaccgtctcctgcgccgacatcctcgccctcgccgcccgcgacggcgtcaacctgctgggtgggccaacgtggagcgtggcgctggggcggaaggactcgcgcacggcgagccagagcgcggcgaacagcaacctgccggggcccgggtcgagcctcgccacgctcatcagcatgttcggcaaccagggcctctcggcgcgcgacatgacggcgctgtcgggcgcccacaccatcggccgcgcccagtgccagttcttccgcagccgcatctacaccgagcgcaacatcaacgcctccttcgcgtcgctccggcagcagacgtgcccgcgctccggcggcgacgccaacctcgcgccgttcgacgtgcagacgcccgacgccttcgacaacgcctactaccagaacctcgtgtcgcagcgcg

SEQ ID NO: 3428 - DNA, 879 bp, Artificial
  Synthetic
atcgatctttgttagctagagtgttgagcaatggcgtccaagctgggtatggttgtgctactgatctcgggcctctttgctgcccgttgcgcggccgtggtgaccaccggcgaacccgtcgtcgccggcctctcctgggggttctatgacacgtcgtgcccgtcggtggagggcatcgtgaggtggcacgtcaccgaggccctccgccgcgacatcggcatcgccgccggcctcgtccgcatcttcttccacgactgcttcccgcaggggtgcgacgcgtcggtcctcctgacgggttcccaaagcgagctgggtgagatacccaaccagacgctgcggccgtcggcgctgaagctcatcgaggacatccgcgccgccgtacactccgcctgcggcgccaaggtgtcctgcgccgacatcaccacgctcgccacgcgtgacgccatcgtcgcctccggcgggccctacttcgacgtgcctctggggcggcgcgacgggctggcaccggcgtcgagcgacaaggtgggcctcctgccggcgcccttcttcgacgtgcccacgctcatccaggcgttcaaggaccgaaacctggacaagacggacctggtggcgctgtccggcgcgcacaccatcggactaggccactgcggcagcttcaacgaccgcttcgatggctccaagcccatcatggaccctgtgctggtgaagaagctgcaggccaagtgcgccaaggacgtgccggtgaactcggtcacgcaggagctggacgtccgcacgcccaacgccttcgacaacaagtactacttcgacctcatcgccaagcaggggatcttcaagtccgaccagggcctcatcgaggacgcgcagaccaaccgcacc

SEQ ID NO: 3429 - DNA, 584 bp, Artificial
  Synthetic
gttctgttggggagaagggactccaccactgcaagcgaggccttggcaaataccgacctccctgccccttcctctagcctcgcagaacttatcggcaatttctccagaaagggactcgacgcaaccgacatggttgctctctcaggagcacacacgatcgggcaggcgcagtgccagaacttcagggacaggatctacaacgagaccaacatcgattccgccttcgcgacgcaacgccaggccaactgcccacggccgacgggcagcggcgacagcaacctggcggcgctggacacgacgacgcccaacgccttcgacaacgcctactacagcaacctgctgtcgaacaaggggctcctgcactccgaccaggtgctcttcaacggcggcagcgcggacaacacggtcaggaacttcgcgtccaacgcggcggcgttcagcatccgccttcacgacggccatggtgaagatggggaacatctcgccgctgaccgggacgcaggggcagatcaggctcagctgctccaaggtgaactcctaattaaggagtactatgacgggatgcgttcgttgctggaagcaaa

SEQ ID NO: 3430 - DNA, 439 bp, Artificial
  Synthetic
gtttgtaatattagcgctgctcttttgtttgattctttctctttctgtatttgctgaggcttcgtcgaagaacaaacataagcccaaaccaaaaaaatcaacgtttggtgttggattctataaaagatcatgtccagctgctgaggccattattagaaaagctgtattcaaagcggttctgaagaatcctggcactgccgctggcattattcgcatgcatttccacgattgctttatcaggggttgtgatggttcagtgctgctggattcagtaagaggaaaggaaacggctgagaaagatagtcccattaacaacctaagccttcgagggtttgaggttattgatgaagcaaaagcacggctggaaaaactatgtccgcgcacagtttcgtgcgcggacatactcgcctatgctgcaagagatagtgccttgttcgcg

SEQ ID NO: 3431 - DNA, 600 bp, Artificial
  Synthetic
gaaagagagagatctttcaaatcaaagttgcaaaaaatcttataattataatgtctaaatttggctatttgggcaattttctagtgttctgtattctacaaggaatagttggttctagccatgctcagttacagctcaacttttatgcaaagagctgtccaaaagctgagaagataattcaagattatgtccaaaagcacatcccaaatactccatctcttgcagctgccttactcagactgcagttccacgattgttttgtcaggggttgtgatgcatccgtgcttttgaatttcacttcgagcacgaaaaagcagactgaaaaaggggctatccctaatcaaacactgagaggcttctcattcattgatgatgtgaagaaaatagttgaagctgaatgccctggagttgtctcttgtgcagatattgttgcattagtttctagagactctgttgtggtcactggaggcccttactggaatgttccaaccggtagaagagatggaaaaatatctaatgcgtccgaggccttggcaaacatccctcctccaactagtaacttttccagtctacagacatcttttgctggcaaaggtcttg

SEQ ID NO: 3432 - DNA, 517 bp, Artificial
  Synthetic
attcccgggtcgacccacgcgtccgcatcttcttcaggctcatctttcatctctattccatcccaaacatcttctctagtagcgcatttggtatgaaatgtagactcagaacacctcttacaagaatatcccccacaactccaatccattttcttacgacaaacaccacatactgaatcaataataccaagaagagaagtgcgagaaatgcgatgatcatggcggttgatattgatgacccatggaaatccagagcaattgttatgggaagtgaaattgcattgaagacagacatatgggcttcgatctccatggaggccgcaagtggtgcaagtaaaagagatcaattttggcataagggttagttcatggttgtgggtgttttggtcgtgaagatttagtggtggtggaagagaaacacatcgcaaatccaaagtaaagttacaagcggaacagtgataaaacatttcgtcaaaaatctttttcccacataaactacaattcccatcagtataag

SEQ ID NO: 3433 - DNA, 681 bp, Artificial
  Synthetic
tcgaccacgcgtcgttctcttcagattcactcttctctctctctttttctccatatattatgggtttcccagctaacagcgaaaagccattcaagttcttgatctatggccgcaccggctggattggtggcgtactcggcaagctctgtgaagctcaaggtatagactacgtatacgggtcgggtcggttagaaaaccggagctctttggaatccgacatatccaccatcaaaccgacccatgtattcaacgcagctggagtcactggccggcctaacgttgattggtgcgaatcccataaggtggagaccatcagaactaatgtggtcggcactctcacgcttgctgatgtttgtagagagaagggcttgatccttatcaactatgctactggatgtatatttgaatacgatgcgggtcatccgttagggtcgggtatcgggttcaaggaagaggatactcctaatttcactggatctttctattccaagactaaagctatggtggaggaattgctgaagaactatgacaacgtctgtactttacgagtcaggatgcccatctccgctgacttgacaaacccgcgaaacttcatcaccaagatcactcgatacgataaggttgtcgatatcccaaactcaatgacaatcttggatgaacttctcccaatatcactcgaga

SEQ ID NO: 3434 - DNA, 322 bp, Artificial
  Synthetic
cccacgcgtccgctctttcgtaaaaatggcgagttttgaggaaagctctgatttggaagctatacagagccatctcttagaagacttgttggtttgtgatggtttcatgggagattttgacttcgatgcttcttttgtctcaggactttggtgtatagaaccacacgttcctaaacaagaacctgattctccagttcttgatccggattctttcgtcaacgagttcttgcaagtggaaggggaatcatcatcatcatcatcaccagagctgaattcatcgtcatcaacatatgagactgatcagagtgtgaaaaaggcagag

SEQ ID NO: 3435 - DNA, 959 bp, Artificial
  Synthetic
aataataaacgaatttttttattaacggtcttcttttttgaagaatcatataatccaacaaagaaaaatcaaaattataaaaccaataaatgatcgccacgtgccacttcaacaacctcgcacttcaccgtcaaccccttatccattccaccaccggcggccaccgttctcctcttcttcggagctccgttctcgttagaagaaggaaaagaagatctcttggacttaatccgaaccgggtcgggttctcctgaattaactctcaacggaaaattcaacaaagcgcgggaaccacgcatcctgaaagcagctctgtcgtaagccaacgccgcgtcctccgccgtctcaaacgtccctaaccaaaccctagctccgttcttcgccgggtctctaatctccgccgcaaatttcccccacggcctttgtctcactcctctataatgctttcccttcgccgccgtcaccgccgccgaaacaggactcgtcttctccttcttgaccggaacagaatccaccgccgcgaaactctccggagtctcgatcttaacactcgggaaagagctacgatcttcgtcggaagacgaagaagacggctcccaaccgccgtgaaaggcgtcgttgaggataccgtaaactaacatatcctcagaatcgttttctttcaacggcaaatctccccagctctcggtgaagcaaggatacagtttgctaaagctagggtttcgtccgtacaccggtttaatgctctgaccggttacacaagattgagtaaccgaactcgctgtcgactcactgagtatcggctccgattctcctagtaagtgtcgtcgtatggactcaagaaaagcataatcagattgagaatccgccgtcatcgacataacagaaagagaattattaagaatgtttttttgttgtttggtttggttcttgttgagatttcaaaacggacgcgtggg

SEQ ID NO: 3436 - DNA, 812 bp, Artificial
  Synthetic
cccacgcgtccgctttctctctttcgtaaaaatggcgagttttgaggaaagctctgatttggaagctatacagagccatctcttagaagacttgttggtttgtgatggtttcatgggagattttgacttcgatgcttcttttgtctcaggactttggtgtatagaaccacacgttcctaaacaagaacctgattctccagttcttgatccggattctttcgtcaacgagttcttgcaagtggaaggggaatcatcatcatcatcatcaccagagctgaattcatcgtcatcaacatatgagactgatcagagtgtgaaaaaggcagagaggttcgaagaagaagtagatgctagacattaccgaggagtgaggcgaaggccgtgggggaaatttgcagcagagattcgagatccagcaaagaaaggatcaagaatctggctaggaacatttgagagtgatgttgatgctgcaagagcctatgactgtgcagctttcaagctccggggaagaaaagccgtgctcaacttccctcttgacgccgggaaatatgaagctccagcgaattcaggaaggaaaaggaagagaagtgatgtgcatgaagagcttcaaagaactcagagcaattcatcttcatcttcctgtgatgcattttagcatattaagagtgtgagcagtttccttaagttgtataaagtaattgtacagaggaaacgaattgtgtaggtttagtgtgcttgcaagttgcaacaaatgtgtatggatgttctgtttcttcatgtccctaagatttagaaacatcttcttatttcca

SEQ ID NO: 3437 - DNA, 912 bp, Artificial
  Synthetic
cccacgcgtccgaagcatactcatcctctgatttcgctggattcagctgtacaattccgcacaaagaagctgcattgcaatgttgtgatgaagttgatccattggcaaagtctataggagctgtgaacactatactaaggagaaaaagtgacggaaagttgttgggttacaacacagattgtattggttccatttctgctattgaggatggcctacgaagttcaggtgatccaagcagtgtaccttcttcttcttcgccattggccagtaaaacagtggtggttattggtgctggtggagcaggcaaggctcttgcttatggtgcaaaagaaaagggggccaaagttgtaattgctaatcgaacttacgaacgagcactagaactcgcagaagcaataggaggcaaagcgttatctctgacagatttagataactatcacccagaagatggcatggttttggcaaacacaacatctatgggtatgcaaccaaatgttgaggagactccaatttctaaggatgcattgaagcactatgcactggtctttgatgcggtatacactccgagaatcaccagactgttgagggaagcagaagaaagtggagccataactgtctcagggtcagagatgtttgtcaggcaggcttacgagcagtttgagatcttcaccggtttacccgctccaaaggaactctactggcaaataatgtcaaagtactgagacatagcttaagtgtgtgtgtgtgtacttccatgaaaagtcgtcgattcaataaagctttagattgccatttgtatgttccgagaatgtccttttttgaggccataagccgaatgactggttctctctttgtatttatatatatgtataaactattaagcctaacattaatcttttttaagtttctttg

SEQ ID NO: 3438 - DNA, 618 bp, Artificial
  Synthetic
acttacaacacagcaaaagaagcttacttacttattcacatactcactaactcacagttagtatcattattgagaggtccagacttcgcacagagacaccatgtgtggaggatctatcttattctcctacttaaggcagcagcaagccctgtctcagactcagatccagcatcagcttcccaaatgggatgagggggataataacattccccttcctgttaaggaagaggaggaggagaatctgcttccctctttcactgtagctgagacacctgcccctcttccccgtaagcggaagaatctgtaccgtggtatccggcagcgcccctggggtaagtgggcggctgaaatccgcgaaccccgtaaaggtgtccgcgtatggctaggtaccttccatactgacgaagatgctgaccgcgcttatgacaccgatgcccgtcgaatccgaggcgacaaggccaagctcaatttccctgttcctaaatcgcagccctcttcatcaacttctgcgcccaattctgctaccgatacccaaagcaagaggcaccgcaccaataccaaagcctctcgatgtgaacagctgttctctttctcccctgatcagaaagaatcatggct

SEQ ID NO: 3439 - DNA, 567 bp, Artificial
  Synthetic
cccacgcgtccgcttagctaggaccgaccgatccgatgtgcggcggtgcaatcatctacgactacatcccggcgcgccgccggttgtgcgcctccgacttctggcccgacgccgacgactccgacccccacacccccgctcccgagaaaccgccgcgcgcgaagagggagcggaagaaccagtaccgcgggatcaggcagcggccgtgggggaagtgggcggcggagatccgcgacccggtgaagggggtgcgcgtctggctcggcacctacccgaccgccgaggccgccgcgcgggcctacgaccgcgccgcgcgccgcatcaggggcgccaaggcgaaggtcaacttccccaacgacttcggcgccgcccccgcgccggccgcggcggcggcgaaggccgtccctcgcgtcgcgcccacgccggccgtgctcccgccgcccaagatggaggcggtgtccgagggcgccggcgcctgctcctccgacgaggtcaaggagctgtccgaggagctgctcgcgtacgagaactacatgagcttcctcggcatcccctacatggagggcg

SEQ ID NO: 3440 - DNA, 117 bp, Artificial
  Synthetic
gcagcatgtacggacagtgcaatatagaatccgactacgctttgtaggagtcgataacacgtcacttgctacgaggaggacgacagaacgagctgcgactcaatgagtcaacaccga

SEQ ID NO: 3441 - DNA, 359 bp, Artificial
  Synthetic
gcggcatggattccagagagatccaccaccaacaacagcaacaacaacaacaacaacagcagcagcagcaacaacagcaacatctacaacaacagcaacaaccaccgccagggatgttaatgagtcaccacaattcctacaatcgaaaccctaacgccgccgccgctgtctcaatgggtcacaacacctccacatctcaagctatgcatcaaagattaccttgtgttgggtctatgccaccgcatcaccctcaagaacatcagtatcatcatcctcagcctcagcaacagatagatcagaagactctcgaatctctcggatttgatggatcgcctccttctgttgccgccactcaacaa

SEQ ID NO: 3442 - DNA, 636 bp, Artificial
  Synthetic
gcagcaggagagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctgacttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaaga

SEQ ID NO: 3443 - DNA, 320 bp, Artificial
  Synthetic
cccacgcgtccgcaaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaa

SEQ ID NO: 3444 - DNA, 681 bp, Artificial
  Synthetic
cttcactcctatcccatatctcttcctctctctccttcttttctccatcttttcttttttttaataaagatggatataaaaccatgcaactctcaagatgttgaagtgaggaaaggaccttggactatggaagaggatttaattctcattaactacattgctaatcatggtgaaggtgtttggaattccttagcaaaatctgctggtctcaaacgaaccggaaagagctgtcgactccggtggctaaattatctccggcctgatgtccggaggggaaatattacacctgaagaacaacttttgataatggaactgcatgctaagtggggaaacaggtggtcaaaaattgcaaagcatttgccaggaagaacagataacgagataaaaaattattggaggacaagaattcagaagcacataaagcaagcagaaaacatgaatggacaagcagctaattctgagcaaaatgatcatcaagaaggaagcagtagccatatgtcgtctgctggtccagcagagacttactctccaacttcatactctgctaatattgacacaacttttcaaggaccttttctcactgaaacaaatgacaacatttggagcatggaggatatctggtccatgcaattgcttaacggcgattaagtatgttggtgaatattttaatttgatttaatt

SEQ ID NO: 3445 - DNA, 650 bp, Artificial
  Synthetic
gcagcaatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgatacgacgaccacgaatcatggcctggacatggaggagacgatggtggaagctatttatacaccggaacagagcgaaggtgcgttttatatggatgaggagacaatgtttgggatgccgactttgttggataatatggctgaaggcatgcttttaccgccgccgtctgttcaatggaatcataattatgacggcgaaggagatggtgacgtgtcgctttggagttactataa

SEQ ID NO: 3446 - DNA, 656 bp, Artificial
  Synthetic
gcagcatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaa

SEQ ID NO: 3447 - DNA, 258 bp, Artificial
  Synthetic
cccacgcgtccgcaaatccttcttcctcttcaattctctgtttcctccaaaatggctacaccaaacgaagtatcagctcttttcctcatcaagaagtatctcctcgacgaattgtctccgttgcctactactgccaccaccaatcgatggatgaacgatttcacgtcatttcatcaaaccggtttcgagttttctgaatttgaaaccaaaccggaaataatcgatctcgtcactcccaaaccggagatttctgatttc

SEQ ID NO: 3448 - DNA, 527 bp, Artificial
  Synthetic
attaagagaaaatatttcttagaaaattggctcaaaatgggaaggtcaccatgttgtgagaaagctcatacaaacaaaggagcatggactaaagaagaagatgaaaggcttattgcttatattaaaactcacggtgaaggttgttggaggtctcttcctaaagctgctggccttctcagatgtggtaaaagttgtcgtcttcgttggattaattacttaagacctgatcttaaacgcggtaatttcactgaagaagaagatgaactcattatcaaactccatagccttcttggtaacaagtggtcacttatagcgggaagattacccggaagaacagacaacgagataaagaattattggaatacacatataagaaggaagcttttgagtaggggaattgatccaacaacacataggctaatgggtgaacctactggtacacaaaaaatgacaacaatttcttttgctgctgatgatcaagaacagaagattaagatcagccccgaattcgagacgatgaacaagga

SEQ ID NO: 3449 - DNA, 800 bp, Artificial
  Synthetic
gcagcatgatgtgtagtcgaggccattggagacctgcagaagacgagaagctaagagaactcgtcgaacaatttggtcctcataattggaacgccatagctcagaagctctctggtcgatctggtaaaactgactttatattaaagtcatttctttaatttcttacaaagcatatataaactagggtttaatatatttatataaaaatatatatgttggtttgattggatcttttggtttcaggtaagagttgtagattgagatggtttaatcaattggatcctaggattaaccgaaaccctttcacggaggaagaagaagaaaggcttttagcgtctcatcggatccatgggaacagatggtctgtgatcgctagattttttcccggtcgaactgataacgctgttaaaaaccattggcacgtcatcatggctcgtcgtggccgagaacggtccaagctccgtccacgaggccttggccatgatggcacggtggctgcgactgggatgattggtaattataaagactgcgataaggagagaagattggcaaccacaaccgctatcaattttccttatcaattctctcatattaatcattttcaagtcctcaaagagttcttgaccggaaagatcgggttcagaagtagtactactccaatacaagaaggagcaatagaccaaactaaacgaccgatggagttctacaattttcttcaagtaaacacggattcgaagatacacgaattgataggtaattcaagaaaagacgaagaagaagatgtcgatcaaaacaaccga

SEQ ID NO: 3450 - DNA, 391 bp, Artificial
  Synthetic
cccacgcgtccgcaaaaacctctgataagttttggttcttgatataaacaaaatgggaagatcaccgtgttgcgatcaagacaaaggcgtgaagaaaggaccgtggctgccagaagaagatgataagctcactgcttatataaacgagaatggttatgggaattggcggtcgcttcctaagctcgctggacttaaccgctgtggcaagagctgtcggctccggtggatgaattatctccggcctgatatccggagaggcaaattttccgatggagaagagagtactatcgttagactccatgccctccttggcaacaaatggtcgaaaattgcgggtcatcttccaggaagaacagataatgaaattaaaaactattggaacactcatatg

SEQ ID NO: 3451 - DNA, 752 bp, Artificial
  Synthetic
gcagcatgtgtggcggtgctattatttccgattatgcccctctcatcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaa

SEQ ID NO: 3452 - DNA, 334 bp, Artificial
  Synthetic
gcagcatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaatagatgtggaaagagtcgcgggctgaggtggcttaactatcttagaccaaacatcaaacatggtggcttctctgaggaagaagaaaacatcatgtgtagcctttaccttacaatcggtaccaggtggtctataatcgctgctcaattgccgtgacgaacagacaacgatataaaaaactattggaa

SEQ ID NO: 3453 - DNA, 319 bp, Artificial
  Synthetic
ggatggaggggggcgatgcgagcggcagcgcgggcggtgatcagctggacctggaggcgtacgcggcgctctactcggggcggaccaaggtgacgcgcctcttcttcatagctgaccacgccaagtcccagacgctggagctggaggctctgcgcatggcgcacaacgagatacgcaagtcggacaacacgctgctgtacaaggaggcggtggacaagattggtggccgcctgggcgccgcctatgctctcgaccaggaatgggtggatgtcgtcgatcgcaggtccttgcagcgccaggagaagctcgacatggagct

SEQ ID NO: 3454 - DNA, 319 bp, Artificial
  Synthetic
cccacgcgtccggcatcagaatgggttacaatgactttggagatttctattacgcatgtggtatgctcggagatgctttcaagaactatatccgaacacgcgactactgcactacgacaaagcacatcattcacatgtgtatgaatgcgattcttgtcagcatcgaaatgggtcagtttactcatgttacaagctatgtgaacaaggcagagcagaatcctgaaacccttgaacctatggttaatgcaaaactgcgatgtgcatctggattggctcatttggagttgaagaagtacaagctagctgctcgtaagttctt

SEQ ID NO: 3455 - DNA, 511 bp, Artificial
  Synthetic
aaaaaccctagctccgatcgaacgttcaagacattaatctccgatggaaccagacgaggatttacggcaaatagctgacgagatctacgccaacggcgatgagaactcgcagcgtcaccggccgattatcagcggcgagcagctggatattgagttgtacgccgccttatacagcggccgaacaaaaattatgaggcttctcttcattgctgatcgatgtggcaatgcttcaatgcaattggaggctttgagaatgtcctacgatgagattaagaaaggggagaacacgcaattgttccgtgaggttgtacagaagattgatggacgtttaggccctaaatatgggccggaccctgcttggtccgacgctgtggatcgtcgagctgagctgaggaaggagaagcttgagaacgaactcaacgcttataggacaaatctgatcaaagagagcattaggatgggatacaatgattttggagatttctactatgcacttggacagcttggagag

SEQ ID NO: 3456 - DNA, 659 bp, Artificial
  Synthetic
atgcagcaatgaactcattttctggcttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctattaa

SEQ ID NO: 3457 - DNA, 503 bp, Artificial
  Synthetic
gcagcatgtcaggatctgagacgggtttaatggcggcgaccagagaatcaatgcaatttacaatggctctccaccagcagcagcaacacagtcaagctctttacaagcagccgatgagatcagtatcaccaccgcagcagtaccaacccaactcagctggtgagaattctgtcttgaacatgaacttgcccggaggtgagtctggaggcatgactggaactggaagtgacccagtgaaaaagaggagaggtagaccgaggaaatatgggcctgatagtggtgaaatgtcacttggtttgaatcctggagctccttctttcactgtcagccaacctactagcggcggcgatggaggagagaagaagagaggaagatctcctggttcttctagcaaaaggctcaagcttcaagctttaggctcgactggaatcggattcacgcctcatgtacttaccgtgctggctggagaggatgtatcatccaagataatggcgttaactcat

SEQ ID NO: 3458 - DNA, 652 bp, Artificial
  Synthetic
gcagcatgtcaggatctgagacgggtttaatggcggcgaccagagaatcaatgcaatttacaatggctctccaccagcagcagcaacacagtcaagctcaacctcagcagtctcagaacaggccattgtcattcggtggagacgacggaactgctctttacaagcagccgatgagatcagtatcaccaccgcagcagtaccaacccaactcagctggtgagaattctgtcttgaacatgaacttgcccggaggtgagtctggaggcatgactggaactggaagtgagccagtgaaaaagaggagaggtagaccgaggaaatatgggcctgatagtggtgaaatgtcacttggtttgaatcctggagctccttctttcactgtcagccaacctagtagcggcggcgatggaggagagaagaagagaggaagacctcctggttcttctagcaaaaggctcaagcttcaagctttaggctcgactggaatcggatttacgcctcatgtacttaccgtgctggctggagaggatgtatcatccaagataatggcgttaactcataatggaccccgtgctgtgtgtgtcttgtctgcaaatggagccatctccaatgtgactctccgccagtctgccacatccggtggaactgttac

SEQ ID NO: 3459 - DNA, 632 bp, Artificial
  Synthetic
gcagcatgaaacctaacggcgtaacagttccgatttctgaccagcaagaacagcttccatgtcctcgttgtgactcatccaacactaagttctgttactacaacaactacaacttctctcagcctcgtcacttctgcaaagcttgtcgtcgttactggactcacggtggtactctccgtgacgttcctgtcggtggtggtactcgtaaaagcgcgaaacgttcccgcacttgctcgaactcttcttcctcctctgtttctggtgtcgtctctaactctaacggtgttccgttacaaacgacgcctgttctcttccctcagtcgtcaatctctaacggcgttactcacacagtaactgaaagcgacggaaagggaagtgctttatctctctgtggaagtttcacctccactctgttgaaccataacgctgctgcgacggctacgcatggatccggttcggttattggtatcggaggttttggaatcggactcgggtcgggttttgatgacgtcagctttggactcggaagagcgatgtggccgttttcaactgttggtactgcgacaacgacgaatgttgggagtaacggtggtcatcacgctgttccaatgccagccacgtggcagttcgag

SEQ ID NO: 3460 - DNA, 588 bp, Artificial
  Synthetic
gagagagagagaacccaaaaacacaatagtaatttgtaacttctctctctccgttacctttcttccgttcatcgccatcggacctataattggatcgaatcggctcaaaactgttttattaaatggatacatattgttcggactgcaaacggaacacggaggtagtattcgaccacgctggcggcgatacggtttgttctgagtgtgggctggtattggaatcccgttcaatcgatgagacatctgagtggcgtacttttgccgatgaatccggtgatcatgacccgaatcgtgttggtggacccgttaacccgttacttggcgatgcgggcctttcaactgttatttctaaagggcctaatggtagtaatggggatggttcgcttgctcggttgcagaatcggggcggtgatcctgatagagccattattatagcttttaaggccattgctactatggctgataggttgagccttgtttctactataagggatcgagcaagtgagatatataaaaggctggaagatcacgagtgtactagaggcaggaatcttgatcccttggtagctgcttgtatctacattgcat

SEQ ID NO: 3461 - DNA, 665 bp, Artificial
  Synthetic
gcagcatgtcggatgcgtattgtacggattgtaaaaaggagacggagttggttgtcgatcactcagccggagataccctttgctccgagtgtggtttggttttggaatctcactccattgatgagacctctgagtggcgtaccttcgctaatgaatcttccaacagcgatcccaatcgtgtcggtggtccaaccaacccgcttctcgctgatagtgctttaaccactgttatcgctaagcccaatggttcatctggtgatttcttgtcttcttctctcgggaggtggcagaatcgtaactccaattccgatcgtggtttgattcaagcttttaaaaccattgctaccatgtctgaaaggttgggacttgttgcaactatcaaggatcgggctaatgagttatataagaggctggaggatcagaagtcaagcaggggaagaaatcaggatgcactttatgcagcctgtctgtacattgcttgtcgccaagaggacaagccacgaactattaaggaaatatgcgttattgccaatggggcgacaaagaaggaaattggccgagcaaaagactacattgttaagacattgggactggagcctggtcagtctgtggatttaggaactatacacgctggtgatttcatgagaaggttctgctccaacctt

SEQ ID NO: 3462 - DNA, 628 bp, Artificial
  Synthetic
cccccaccaatttactcctttccattccaacgcgcagattgtagagagagaatcaactccacaaacaaacacataatccttctctctctacctcatcgattttgttccattttcaggttcaatcataatcgggtctcgggtctcaattaacccgaatgggtgacgcgtactgtccggactgcaaacggaacacggaggtggtgtttgaccacgccgccggggatacggtttgttcggagtgtgggcttgtgctggaatcccggtccattgatgagacttcggagtggcgtacgtttgctgatgattcaggtgatcatgacccgaaccgtgttggaggacccgttaacccgttgcttggtgatgtgggcctttctactgtaatttctaaagggcctaatgggagtaatggggatggttctcttgctcggttgcagaatcgaggtggcgatcctgatcgtgccctcgttatagcttttaaggccattgccaatatggctgaccggttgaaccatggttctaccataaaggaccgagcgagtgagatatacaaaaggctggaagaccagaagtgtacgagaggaaggaatctggacgccttggtggctgcttgtatctacattgcttgccg

SEQ ID NO: 3463 - DNA, 702 bp, Artificial
  Synthetic
ttctgagctgagctgagctagcatccatggccaccacagccctctcctcagccaacttggccatctcaaaggccaaatccagctacactgctgctgagaccaccaagctgcatagccatggcctttctagtagcgcctcgctcgcctccaagcggattccgtcggttgggtccagtgctcgccggccttcccgcgtcgctgccatcagaatggattccaccaaagataagccccgtgctggtgctaaggaggctgctaaggagtccctcctcaccccccgcttctacaccactgacttcgaggacatggagcgcatgttcaacatcgagatcaacgggaagctcaacgaggaggagttcgaggctctccttgcggagttcaaggctgactacaatcagacccacttcgtccggaacaatgagttcaaggaggccgccgccgctatccaggggcccatgcgccagatctttgtcgagttccttgagaggtcctgcaccgctgagttctccgggttcctcctctacaaggaactgggacggagattgaagaaaaccaaatcccattgttgcggaaattttcaccctgatgtcccgagatgaggctcgacatgccggtttcctgaacaaggggctctcagatttcaacttggctcttgatctgggcttcctcacaaaagcaaggaagtacaccttcttcaagcct

SEQ ID NO: 3464 - DNA, 358 bp, Artificial
  Synthetic
aattcggcacgagagaatgtcagccaccacaactccaccaacttcaaaaccaaccaagaaagctcagaaacaaggaattaaagagtcccttttgacaccaagattttacactactgattttgatgaaatggagacacttttcaacactgagattaacaagaatttgaatgaagctgagtttgaggctctcttgcaggaattcaagactgattataatcagactcactttgttaggaacaaggagtttaaagaagctgctgataaaattcagggacctcttagacaaatttttgttgaattcttggagaggtcttgcactgctgagttctctgggtttcttctctacaaggagcttgga

SEQ ID NO: 3465 - DNA, 1023 bp, Artificial
  Synthetic
gaattcaagctacacagactctgcaaaaatggctgcagagatggcattgataaaacccatctctaatttcactagaaccagccctaaatttatcacctcaaccagaaaatcattctccgttatcaaaatggcatctcagtccactgcatcaacaactaagtcagggaaaccaaagaaagcaatcaaagaaaccttactcgctcctaggttttacacaactgattttgatgaaatggaaactctttttaacactgagatgaacaaaaacttgaatgaagctgagtttgaagctctattgcaagagttcaaaactgattacaatcagactcatttcgttagaaacaaagagttcaaagaagctgctgataaattgcaaggtcctcttagacagatttttgttgagttcttggagagatcttgtactgctgagttctcagggtttcttctttacaaagaacttggaagaagacttaagaaaaccaatccagttgttgctgaaattttctcactcatgtccagggatgaagctaggcatgctggattcttaaacaagggactgtcagatttcaacttggcactggatcttggatttcttacgaaggctagaaaatatacattcttcaaacccaagttcattttctatgctacatatttatctgagaaaattgggtactggaggtacataaccatttataggcacttaaagaccaaccctgaataccaagtttatccaattttcaagtattttgagaactggtgccaagacgagaacagacatggagatttcttctccgcactgatgaaagctcaaccccagtttcttaacgattggaaagcaaagttgtggtctcggttcttctgcctatcggtgtacgtgaccatgtacttgaatgactgccagagaacagctttttacgaagggatcggacttaacactaaagaatttgatatgcacgtcataattgagacaaaccgtacagccgcaaggattttccctgcagttctagatgttgagaacccgga

SEQ ID NO: 3466 - DNA, 1304 bp, Artificial
  Synthetic
cccccggtagtttctgctgaagttatcgggaaaaaaaatggcaacagaaatggctttactaaaaccaattaccaaattcaacacctttaacaccaccaccacttcacggatgagcaaccacagactgccgttcacagtgagaatgtcagccaccacaactccaccaacttcgaaaccaaccaagaaagctcagaaacaaggaattaaagagtcccttttgacaccaagattttacacaactgattttgatgaaatggagacacttttcaacactgagattaacaagaatttgaatgaggccgagtttgaggctctcttgcaggaattcaagactgattataatcagactcactttgttaggaacaaggagtttaaagaagctgctgataaaattcagggacctcttaggcaaatttttgttgaattcttggaaaggtcttgcactgctgagttctctgggtttcttctctacaaggagcttggaaggaggctcaagaaaactaatcccgtcgttgcagagattttctccctcatgtccagggatgaagctcgccatgctgggtttttgaacaagggtttatctgatttcaatttggcattggacttgggatttttgacaaaagcaagaaaatacactttcttcaagccgaagttcatcttctatgcaacttacttgtctgagaaaattggatactggaggtacattaccatatacaggcatctcaaggccaatcctgagtacacatgttatccaattttcaagtactttgagaactggtgccaggacgagaaccgccacggtgatttcttctctgctttgatgaaagcacagcctcagttcctcaatgactggaaggcaaagttgtggtctcgcttcttctgcctttcggtttatgtcacaatgtacttgaatgactgccaaagaacagatttctatgaaggcattgggcttaacaccaaagaatttgacatgcatgtcatcattgagacaaaccgcacaacagcaaggattttccctgctgtcctagacgttgagaacccagaattcaagaggaagttggacaggatggtggagattaaccaaaaaatacttgctgttggggagagtgatgacattccactggtgaagaatttcaaaaggatccctctgattgcagctctggcttctgagttattggccgcgtatctcatgaaacccatcgaatcgggttcagttgattttgcagagtttgaaccacaactggtctactaatttccttttccctcgtgaccttgtgaaaaaacagaagtcgattcttctcaca

SEQ ID NO: 3467 - DNA, 502 bp, Artificial
  Synthetic
ctcgagcttgcggccgctacacgacggacttcgaggaaatggaacagcttttcaacacggagatcaacaagaaccttaacgaagcagagttcgaggctctgcttcaagagttcaagaccgattacaaccagacacatttcgtgaggaacaaggagtttaaagaagctgcagacaaattgcaaggacctctccgacagatcttcgttgagttccttgagcggtcttgtactgctgagttctctggtttccttctctacaaggagcttggtcgaagactcaagaaaacaaaccctgttgtggctgagatcttctctcttatgtctagagatgaagcaagacatgccgggttcttgaacaagggattgtctgatttcaacttggctcttgatttgggtttcctgacaaaggcaaggaaatacactttcttcaagccaaaattcatcttctacgcgacttacttatccgagaaaatcgggtactggagatacatcacaatctacag

SEQ ID NO: 3468 - DNA, 721 bp, Artificial
  Synthetic
ccacgcgtccgctcgctaagaacaagcagctacattctctcgagcgcgattcgcggcgtcaacaggggggcatggcggcggcaatgtcggcagccagcgtcggcaatgtgaaggtgagtggatttggcggccgatggcgagggttccagtcgaaccgcggcggcagcgtggtgttctccaggaagatcgtggccagcgccgtcgccgccacgaaagacgccccgaggaagggcgccaaggaggcggtgaaggacacgctgctgacgccgcggttctacacgacggacttcgacgagatggagcagctcttcaatgcggagatcaacaagaagctcaacatggcggaatttgaggcgctgctcgcggaattcaaggccgactacaaccagacacacttcgtaaggaatccagagtttaaggccgcggccgacaagatcactggaccgatgaggaagatcttcgtggagtttctggagaggtcgtgcactgccgagttctccgggttcttactctacaaggagctgggaagaaggctcaagaaaaccaatcccgtggttgcggagatttttacgttgatgtctcgagacgaagcacggcatgcagggttcctgaacaaaggtctatccgactttaacttggcgctggatcttggtttcctgaccaaggccaggaagtataccttcttcaagccgcagttcatcttctacgcgacttactctcg

SEQ ID NO: 3469 - DNA, 845 bp, Artificial
  Synthetic
cggacgcgtggggctctctatctcactctttgcttctgcaactcacagtcaatggcggctgaaatggcgttagtgaaacccatctccaagttctcttccccaaagctctcaaacccgagcaaattcctctccggccgacgtttctccaccgtgatcagaatgtcagcctcttcctcaccgcctcctccaaccaccgccacctcgaagtccaagaagggaacgaagaaagagattcaagagtcgcttcttactccgaggttctacacgacggacttcgaggaaatggaacagcttttcaacacggagatcaacaagaaccttaacgaagcagagttcgaggctctgcttcaagagttcaagaccgattacaaccagacacatttcgtgaggaacaaggagtttaaagaagctgcagacaaattgcaaggacctctccgacagatcttcgttgagttccttgagcggtcttgtactgctgagttctctggtttccttctctacaaggagcttggtcgaagactcaagaaaacaaaccctgttgtggctgagatcttctctcttatgtctagagatgaagcaagacatgccgggttcttgaacaagggattgtctgatttcaacttggctcttgatttgggtttcctgacaaaggcaaggaaatacactttcttcaagccaaaattcatcttctacgcgacttacttatccgagaaaatcgggtactggagatacatcacaatctacagacacctcaaggaaaaccctgagttccaatgttacccaatcttcaagtactttgagaactggtgtcaagacgagaaccgtcatggtgatttcttctctgc

SEQ ID NO: 3470 - DNA, 648 bp, Artificial
  Synthetic
gcagcatgcatagtttgaatgaaacagtaattcctgatgttgattacatgcagtctgatagagggcatatgcatgctgctgcctctgattccagtgatcgatcaaaggataagttggatcaaaagacccttcgtaggcttgctcaaaatcgtgaggcagcaagaaaaagcagattgaggaagaaggcgtatgttcagcagctggagaatagtcgattaaagctgactcaacttgagcaggagctgcaaagagcaagacagcagggagttttcatctcaagttcaggagaccaagctcattctactggtggcaatggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcagctaagaatgatgtcttccactcgttatctggaatgtggaaaacaccagctgagcgatgtttcttgtggcttggcgggttccgctcatccgaacttctcaagctccttgcgaatcagctagagcccatgacagaacgacaggtaatgggcatcaatagcttgc

SEQ ID NO: 3471 - DNA, 293 bp, Artificial
  Synthetic
cccacgcgtccgctcgatcgcgctagacaacagggattctatgtaggaaacggaatacatactaattctctcgggttttcggaaaccatgaatccagggattgctgcattcgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtgtgctggcaaagccgatgtcttcttcgtcat

SEQ ID NO: 3472 - DNA, 677 bp, Artificial
  Synthetic
gcagcatgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatgttttctatgtcatgtccggaatgtggaaaacttcagcagagcggttt

SEQ ID NO: 3473 - DNA, 663 bp, Artificial
  Synthetic
gcagcatgggaacgagcgaagacaagatgccatttaagactaccaaaccaacatcttcggctcaggaagttcctcccacaccgtatccagattggcaaaattcaatgcaggcttattatggcggaggaggtactccaaatccttttttcccatccccagttggatctcctagtcctcacccctatatgtggggtgctcaacaccatatgatgccgccttatggcaccccagttccgtacccagcaatgtatcccccgggggcagtctatgctcatcctagcatgcccatgcctcctaattctggtcctaccaacaaggagcctgcgaaggaccaagcttctggcaagaagtcaaaggggaactcgaaaaaaaaggctgaaggaggtgataaagcgctctctggttcagggaacgatggtgcctctcatagtgatgaaagtgtcacagcgggttcatctgatgaaaatgatgagaatgccaatcaacaggaacagggttcaattcgaaagccaagctttggacagatgcttgctgacgcaagttctcaaagtacgactggtgaaatccaaggttcggtgcccatgaagccggtagccccggggactaatctgaatatcgggatggacttatggtcttcccaagctggtgtaccagtgaaggatg

SEQ ID NO: 3474 - DNA, 742 bp, Artificial
  Synthetic
atattccccactatcaataccaataatttgaagaagaagaagaagaagagatagttggatattgttgggatggggagaggaaagatagagataaagagaatagagaactcaagtaacaggcaagtcacttactccaagagaagaaatggtatcgttaagaaagctaaagaaatcacagttctttgtgatgccaaggtttcccttatcatctatggtaatactggcaagatgcatgaatattgtagcccttctactacgatagctgatatgctggatggttaccaaaaagcttctgggaggaggctatgggatgctaagcatgagaacttgagcaatgaaattgatagaatcaagaaagagaatgacagtatgcaggttaacctcaggcaccttaaaggagaagatatcaattctctgaactacaaagaacttatggttatggaagaagccttacaaaatgggctctctagtatcagtgccaaacagtctgagatcttgaggatggtcaggaaaaatgaccaaattctggaggaggaacataagcaacttcaatatgctttgcaccaaaaggagatggcagccatgggcggaaacatgagagtaattcaagaagaagtgtaccatcaaagagacagagattacgagtaccagatgccctttgccctgcgagttcagccaatgcagccaaacctacacgaaagaatgtagcattaatattaattccactatctgcagtttaact

SEQ ID NO: 3475 - DNA, 523 bp, Artificial; identical to SEQ ID NO: 1122
  Synthetic

SEQ ID NO: 3476 - DNA, 559 bp, Artificial
  Synthetic
cccacgcgtccgtaccttttacaatttgtttatatattttacgtatctatctttgttccatggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatg

SEQ ID NO: 3477 - DNA, 647 bp, Artificial
  Synthetic
aaaaatggccaatagcagtaatagttctaagaaagatatggatcgtgttaaaggtccatggagccccgaagaagacgagcttctacagcagctagttcataaacatggaccacgaaattggtctcttattagcaaatccatacctggaagatccggtaaatcttgccggttaaggtggtgcaatcagttatctccacaagtagagcatagggcttttactcccgaagaagatgagaccattattcgtgcacatgctcggtttgggaataaatgggctactatagcccgacttcttaatggacgaaccgataacgccattaagaaccactggaactctaccttgaagaggaagtcctcctctcttagtgctgatgaaggtaacgaactggtggaccaaatctttcaaaatcagcagccgccgttaaagagatccgttagtgccggatccgccatgccggtgtcgggtttccatttcagtcccggtagcccgtcgggttcggacagtgattccagccttcatgtcacctcatcgtctcaatctcacttattcaagcctgtcgccagagccggcggtgtatttccgccgccgtctatagacacgtcatctccttccgatgatccgccgacttcccttagcctttcgcttc

SEQ ID NO: 3478 - DNA, 668 bp, Artificial
  Synthetic
gcagcatggggagacaaccatgctgtgacaaagtagggttgaagaaaggaccatggactgcagaagaggataggaagctcataaacttcatccttaccaatggacaatgttgttggagagctgttcctaagctttctggtcttcttaggtgtggcaagagttgcagacttcgttggactaactatcttagaccagaccttaagagaggtcttctctctgattacgaagagaagatggtcattgatctccattcccagcttggaaacaggtggtcaaagatagcttctcatttaccaggaagaacagacaacgaaatcaagaatcattggaacactcacatcaagaagaagttgaggaaaatggggattgatcctcttacacataaaccactctctatcgtcgaaaaagaagacggagaacccttaaagaagctacagaataatacagttccttttcaagaaacaatggagcgtcctttagagaacaacatcaagaacatatcaagacttgaagagtctttaggtgatgatcaattcatggagataaatcttgagtatggtgtcgaagatgtccctcttattgaaacagagtctttagaccttatctgcagcaattcaacaatgtcttcatccacgtccacatcttcgcattcttctaatgattcgagt

SEQ ID NO: 3479 - DNA, 675 bp, Artificial
  Synthetic
ggggtggtgtgtggctgatgcaggtttgcagcgcagcgggaagagctgccgtctccggtgggtgaactacctgcatccagagctgaagcgagggaggatgagccccgaggaggagaggatggtggtgcagctccacgccaagctcggcaacaggtggtctcgcatcgccaagagcattcctggccgcaccgacaacgagatcaagaactactggcgcacccacctgcgcaagctcaagctcaaacagcaaaagcagcagcagtccgacgaccaccacaacgacaacgacgacgacgacgaccgcaactcctcctcctcttcgtcctcctccaacagcaacagcaacctgcagcagcagccgcagccagaggatgagtcgtcggccagtggcagcctgcaggcccaacatcatgaggaccagcaccaactgttccttcatcctctctggaacgacgacatcatcgtcgacgtcgactgctggagcagcagcaccaacgtcgtcgctccgccgccgatgcccgcctcgccgctctgggatatcgatgacgccttcttctgctcggattattcgctacctctctggggatagtatatatcatccatcagccgccaagacgatgacgactacatcaactcgatcgatcgatgcctcctaatcatgtgggagtactcagc

SEQ ID NO: 3480 - DNA, 335 bp, Artificial
  Synthetic
ggtgacgtctccgtggtgcgacacgatggggctcaacaagggtccatggacgccggacgatgacacggtcctcatcgcccacatccagctccacggccacggcaactggcgcgccctgtccaagcaagccgggctgctgcgttgcggcaagagctgccggctccggtggatcaactacctgcggccggacatcaatcggggcaacttctccaaggaggaggaggacaccatcatccatctccacgatctgcttggcaacaggtggtccgcaattgccgccacgttgcccgggaggacggacaacgagatcaagaacgtgtggtacacccacctca

SEQ ID NO: 3481 - DNA, 608 bp, Artificial
  Synthetic
cccgatctcgccgcgcgcgctcagctcgtcgacaaggcagcgtgcacccaccaagatagcgggatgatccagtgagcgcgtggaggcggtgtttgattctagattgttctagaaccgaacgagcgagcttagctagctagctagctgctgctgcttcgatcgatcggtcgttgcctcatgcaggagttccagtccatcccggggctcgccgggcggctgttcggcggcgcggcggcggctgacatccggcgcgcgcaggcgcagcagggcccggcgtcgcggtgcggcgggataccgtcgccggaggcggtgaagtgcccgcggtgcgagtcgaccaacaccaagttctgctactacaacaactacaacctctcgcagccgcgccacttctgcaagagctgccgccggtactggaccaagggcggcgtcctccgcaacgtccccgtcggcggcggctgccgcaagaccaagcgtagcggcagctcgtccgctgcgtcctcggccccgtcgacgccgacggcggcaactgacaacgccaagaaccagcggcgcgcctcggcgtcgtccccacgatccagtagcggcggtagcggcaacacgagccccac

SEQ ID NO: 3482 - DNA, 644 bp, Artificial
  Synthetic
gcagcatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcaacagcagcacgttgctgctcccatgacacctgtgatg

SEQ ID NO: 3483 - DNA, 664 bp, Artificial
  Synthetic
gcagcatggcgagagggaagatccagatcaagaggatagagaaccagacaaacagacaagtgacgtattcaaagagaagaaatggtttattcaagaaagcacatgagctcacggttttgtgtgatgctagggtttcgattatcatgttctctagctccaacaagcttcatgagtatatcagccctaacaccacaacgaaggagatcgtagatctgtaccaaactatttctgatgtcgatgtttgggccactcaatatgagcgaatgcaagaaaccaagaggaaactgttggagacaaatagaaatctccggactcagatcaagcagaggctaggtgagtgtttggacgagcttgacattcaggagctgcgtcgtcttgaggatgaaatggaaaacactttcaaactcgttcgcgagcgcaagttcaaatctcttgggaatcagatcgagaccaccaagaaaaagaacaaaagtcaacaagacatacaaaagaatctcatacatgagctggaactaagagctgaagatcctcactatggactagtagacaatggaggagattacgactcagttcttggataccaaatcgaagggtcacgtgcttacgctcttcgtttccaccagaaccatcaccactattaccccaaccatggccttcatgcacc

SEQ ID NO: 3484 - DNA, 188 bp, Artificial
  Synthetic
gcagcatgggaagagggaaagttgagctgaagaggatagagaacaagatcaatagacaagttacttttgcaaagagaagaaatggtttgctcaagaaggcttatgagctttctgtcctttgtgatgctgagattgctcttctcattttctctaaccgtggcaagctctacgaattctgcagcagccct

SEQ ID NO: 3485 - DNA, 635 bp, Artificial
  Synthetic
tttctctctcttttatcttcctttatagctttactcctatcttcgtctctcctgcatttaactaaatttaagggagagatggtgagaggaaaaacagagatgaggcgtatagagaacgcaacaagcaggcaagtcactttctctaaacgcagaaatggtttgctaaagaaagcatttgaactttcagtactttgtgatgctgaggttggtttggttatattttctccaagaggaaagctctatgaatttgccacttctagcatgcaggagataatagagcgctataagagacattctaaagacaaggttcaacctgaaaaccaagcagtgggacacgatatgcagcatttgaagcatgagacagcaagtttgatgaagaagatagaacttcttgaaacatctaaaaggaaactcttgggagaatgtttagggtcctgtaccctagaagaattacagcaaatagaaaaacagttggagcgcagtgttagcgcgatccggtcgcgaaagatgcaagtctttagggaacaaatgcaaagattgaaagaaaaggagaaagcccttgcagttgaaaatgcaatgctgagggagaagtttggaggtcttcaacagagacaaacatcaagcggagagaagga

SEQ ID NO: 3486 - DNA, 667 bp, Artificial
  Synthetic
gcagcatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaagattcatctccaaaggtggaggatttctttggggcccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaa

SEQ ID NO: 3487 - DNA, 674 bp, Artificial
  Synthetic
gggagaggaaagatagagatcaaaagaatagagaactcaagcaacaggcaggtcacttactcaaaaagaagaaatgggattttgaaaaaagctaaggaaatcagtgttctttgtgatgctcgtgtttctgtcatcatttttgctagtactggcaagatgcatgagttctcctctacttcgttggttgatattttggatcaataccacaagcttactgggagaagattgtgggatgctaagtatgagaacatggacaatgaaatcaacaaagtcaagaaagacaatgacaacatgcaaattgaactcaggcacctaaagggggaagacataacatctttgaaccacagagatctcatgatgttggaagatgcccttgataatggactcactagtatccgtaacaagcagaatgagcttctgaggatgatgaggaaaaagactcaaagtatggaagaggagcaagaccaacttaattgccaattgcggcaactagagatagcaagcatgaataggaatatgggagaaataggggaagtgtttcagcaaagggagaatgaataccaaactcagatgccttttgccttccgagttcaaccaatgcagcctaatttgcaggagaggttctaattaaaaaccttcatttatttggccatgacttcagaccttttattatc

SEQ ID NO: 3488 - DNA, 776 bp, Artificial
  Synthetic
gcagcatgggaaggggtagggttcaattgaagaggatagagaacaagatcaatagacaagtgacattctcgaaaagaagagctggtcttttgaagaaagctcatgagatctctgttctctgtgatgctgaagttgctcttgttgtcttctcccataagggaaaactcttcgaatactccactgattcttgtatggagaagatacttgaacgctatgagaggtactcttacgccgaaagacagcttattgcacctgagtccgacgtcaatacaaactggtcgatggagtataacaggcttaaggctaagattgagcttttggagagaaaccagaggcattatcttggggaagacttgcaagcaatgagccctaaagagcttcagaatctggagcagcagcttgacactgctcttaagcacatccgcactagaaaaaaccaacttatgtacgagtccatcaatgagctccaaaaaaaggagaaggccatacaggagcaaaacagcatgctttctaaacagatcaaggagagggaaaaaattcttagggctcaacaggagcagtgggatcagcagaaccaaggccacaatatgcctccccctctgccaccgcagcagcaccaaatccagcatccttacatgctctctcatcagccatctccttttctcaacatgggtggtctgtatcaagaagatgatcctatggcaatgaggaggaatgatctcgaactgactcttgaacccgtttacaactgcaaccttggctgcttcgccgcatga

SEQ ID NO: 3489 - DNA, 560 bp, Artificial
  Synthetic
gcagcatgggaagaggaagagtagagctcaagaggatagagaacaaaatcaacagacaagtgacgtttgctaaacgtagaaatggtttgctgaaaaaagcttatgagctttctgttctctgcgatgctgaagtctctctcatcgtcttctccaaccgtggcaagctctacgagttctgcagcacctccaacatgctcaagacactggaaaggtatcagaagtgtagctatggctccattgaagtcaacaacaaacctgctaaagagcttgagaacagctacagagagtacttgaagctgaaaggtagatatgaaaatctgcaacgtcagcagagaaatcttcttggagaggatcttggacctctgaattcaaaggagctagagcagcttgagcgtcaactagacggctctctgaagcaagttcgctgcatcaagacacagtatatgcttgaccagctctctgatcttcaagctggaagatatgatcggcgtgagacatcaccatatacgaggaggatgggaaggtggtgatcaacagaatattgcctatggacatcctca

SEQ ID NO: 3490 - DNA, 665 bp, Artificial
  Synthetic
attgttggagaggtgtctaggacggcgccatagctccattgagcctcaatgctgcggcttcttggctcattgcttccacggcgccgctagggtctcgtccagtggcggcgggcaagtgatcgccttggatctggtggttctagagggattcgggcaatgtggagcagcaccgcggcaatctaggcagggtttgtggcggcgccaagaatgcgtgggatgaggagcgaggtgcggtgattctcgccccggacagcgcgagttggaggcggcaatggaaggtgtgaggagaggtccaaatccagagctttggcatgcctgcgccgggccgcttgtgtctcttccgtgtattgggacgaaagtggtgtactttccccaaggccatagcgaacaggtggctgcctcgacccagaaggaagcagatgcggacattcctagctaccccaatcttccgccacacctcttttgtcaacttcacaacatcactctccatgctgatatcgagacggatgaagtgtatgcgcagatgactctccagcctatgaatgcccaagaaaaggattcgttcatggccgacttgggcagacaaaaccggcagccctccgagtatttttgtaaaacgctaacagcgagtgacacaagtacacacggcggtttttctatccctc

SEQ ID NO: 3491 - DNA, 614 bp, Artificial
  Synthetic
gcagcatggcaaatcgcggaggtgaatatctgtacgatgagttatggaaattatgcgcgggacctcttgttgatgttcctcaagctcaagaaagagtttattgttttcctcaaggtcacatggaacaactcgaagcgtcaacgcaacaagtcgacttaaatacgatgaagcctctttttgttcttcctcctaagattctctgcaatgttatgaacgttagtcttcaggcggagaaagatacggatgaggtctatgctcagattactttgatccctgttggaactgaagttgatgaacctatgagtcctgatccctctcctcctgagttgcaaaggccgaaagttcactctttcagcaaggttttgacagcgtctgatacaagcacccatggtggcttttctgttctaaggaaacatgccacggaatgtcttcctccgctggatatgactcagcaaaccccgacccaggagttagtagccgaagatgtgcacggttatcagtggaaattcaagcatatttttagaggccaaccacggaggcatctattgacgacagggtggagcacctttgttacatcaaagagattggttgctggggacacctttgtattcctg

SEQ ID NO: 3492 - DNA, 609 bp, Artificial
  Synthetic
gttgtactaaaaggactaaagttttcatttttgggttgccctttcttggcttttttggtttaactagtaaaaagtaggttcttgataggagttagtttgatttgctgtaatgagggtatcttcagctgggttcactcctcaaccagaggaagcaggggagaagaaatgcttgaactcagagctgtggcacgcttgtgccgggccactagtttcgcttccgcctgtaggaagcagagttgtgtattttcctcaagggcatagtgaacaggttgctgcctcgacaaacaaggaagtagatgctcatatccctaactatcctggtttaccaccgcagctaatttgtcagcttcacaacctgacaatgcatgcagatgttgaaaccgatgaagtatatgctcaaatgacgttgcagccactaagtgcacaagagcaaaaggatgtgtgcctgctaccagcagaacttggcatcccgagtaaacaaccaaccaactatttctgcaaaaccttgacggcaagtgacaccagtactcacggtggattctctgtcccccgacgtgcagcagaaaaagtttttccccctcttgattactctcagcagccgccctgtca

SEQ ID NO: 3493 - DNA, 583 bp, Artificial
  Synthetic
aaagacgctgaagaagaactttgccaacaagggtcttaacgctaaagaccttgtggttctctcagggggtcacaccattggaatctctagttgcgctctcgtcaacagtcgtctctacaacttcacaggaaagggcgattctgacccatccatgaaccctagctacgtgagggaattgaagagaaagtgcccgcctacagatttcagaacctcactgaacatggacccaggcagtgcgttgacattcgacactcactacttcaaggtcgtggctcagaagaaagggctcttcacatctgactctacgcttctcgatgacattgagaccaaaaactacgttcagactcaggccattctccctcctgtgttttcttctttcaataaagatttctccgattccatggtcaaacttggtttcgtccaaattcttaccggcaaaaatggtgagatcaggaagagatgcgccttccctaactaatttggatcgatcagaccgggtttcggatgattttgagtctacacgtttttctctgcttattttctttctttttcttttttctttcacggaagtttgagctttggt

SEQ ID NO: 3494 - DNA, 764 bp, Artificial
  Synthetic
cccacgcgtccgcattcctgtaaacacaaaaacttgtaatttccaacgaaatggcgcggttcagtctggttgtagtcgtgactcttagtcttgccatctctatgttccctgacacaaccactgctcaactcaaaaccaatttctacggaaactcatgtccgaatgttgaacaaatcgtgaaaaaagtcgtccaagaaaaaatcaaacagaccttcgtcaccatcccagctactctccgcctcttcttccacgattgcttcgtcaatggatgtgatgcgtcggtcatgattcaatcaacgcctaccaacaaagccgagaaggatcatccagacaatatttctttggccggagatggatttgacgttgtgatcaaagccaagaaagctcttgacgctatcccaagttgcaaaaacaaagtctcttgtgctgatattcttgctttagccacccgtgatgttgttgtcgccgccaaaggtccgtcgtacgcagtggaactcggaaggtttgatggtttggtgtcgactgcggctagcgttaacggaaacttgcccggaccaaataacaaagttacagaacttaacaagctttttgccaaaaacaaacttacccaagaggacatgatcgctctttcagcggctcacacacttggattcgcccattgtggcaaagtgttcaacagaatctacaacttcaacctcacacacgccgttgacccaactctaaacaaagcctacgctaaagaacttcagttggcttgtcccaag

SEQ ID NO: 3495 - DNA, 668 bp, Artificial
  Synthetic
cccacgcgtccgagcgttcaaagccaattgcctcagcccgagtttaacctaaaccagctcaacggcatgtttagccgtcacggcctctctcaaaccgatatgattgccctctcaggagcacacactataggatttgcacattgtggaaaaatgtcaaagagaatatacaattttagccctacaacacgtatcgacccgagtataaaccgtggatacgtggttcagcttaagcaaatgtgcccgatcggtgtcgacgtaagaatcgcaatcaacatggatccgaccagtccacgtactttcgataatgcttatttcaagaatctccaacaaggaaagggtttgttcacgtcagatcaaatcttgttcacagatcaacggtcaagatctacagttaattcgtttgccaatagtgaaggagcttttagacaagctttcatcacagcgatcacgaagttaggtcgggttggtgttttgactggtaatgctggtgagattcgaagggattgttcacgtgtcaattagtgtgatttgaggttttctttcttttattccttaaagaggatttttttttttaataataaaatttaatttcttgttgtcaaaataaggagttcataagtgtgaaacatggaaacttaaattaataagatgggtttatttcgttgaca

SEQ ID NO: 3496 - DNA, 643 bp, Artificial
  Synthetic
caaggccatgctgtttgtaaacttcaacagtgacctaattgagacttttaaatccaagtatcatgaatttgctgagcagtacaaaggcaatgatattagtttcttaattggtgatgttgaggccagtcaaggtgccttccagtactttggactcaaagaagatcaggtacctctaatcatcatacagacaaatgatggggagaaatatctcaaaccaaatgttgagcctgatcatattgcttcatgggttaaggattttaaggatggcaaggtgaagcctttcaaaaaatcagagcctatcccagaggttaacagcgaacctgttaaagttgtggttgctgacactctccaggagatggttttcaactctgcgaagaatgtactccttgagttttatgccccttggtgcggacactgcaagcagttggcccctatccttgatgaagtggctgtctcatttgaaagcgatgctgatgttatgattgctaaaattgatgctactgctaatgatattccccagggaacttttaatgtccaaggttatccgactctttatttcaagacagcaagtggaaaaatctcgcagtatgaaggtgacaggaccaaggaagacattattgacttcatccacaagaatcgggat

SEQ ID NO: 3497 - DNA, 375 bp, Artificial
  Synthetic
tttagcctccgagagattcagaaatattatattaaccaagaaggtaatcacaacagcttatgtgatatgcatcaacaatagaacattaaagatgaattcaacaattccaaaactgaagagaagagaattgtcgacaaagttaagaactgataacagaatacaaagcttaaaaattggtcgagtaacatagatgtcctcacatgactgcaccaagtcctatcacttgaacatagccataattccaaaacagagaagaataaaacataaaagcttaagccttgggggctactttctccttagccttttggagtttcaacactttcttcacaatcttttgctcttcgacaaggaatgcccgaatgatcctttccctga

SEQ ID NO: 3498 - DNA, 749 bp, Artificial
  Synthetic
ttttttttggtttatctgtccacttttttattcaaataaaagaaaagcagattacattggatgattttatacagtcggttctttaacaaagaaagatgattgatgctaatatacacaattacataatcttatacttgaattatacagtagtttggaagaaagaattatacagtagaaaaatattaccgtgaaaaaagtaaaaagtaaaagtaaaaccatcattattagttggtactctccacttcatctctaaaccaatctgaagtaccccaatcaaacggcgtggacttttcctccggtaagaaccggttccgacaaatcgggcacgttatcttattacagtcaacgatccaacggtctaaacaacgatgatgaaacacgtgtccacacttcggtagctgtctaatcttatcgtcggatacaaaatcggataagcaaaccgtgcagcaatcttccggatcggtcaagagatcggagaaacgaaccaccgggattaactcgttggcaagagttgctgacgtggagagagcgagtcgggtcgggtcgggtcgagaggtctcgttgtggtcaagaaaacttggtagaccgatgtaaggacaaagagcatcgaccatgtctctaaagaaaccgatgacgtaaagtatctttaatatgtaacctggaatctgaagctcggtgatgaaatcttcaggaagacccatgatttagagaaagatagagaagagagctagattgagcggacgcgtggg

SEQ ID NO: 3499 - DNA, 334 bp, Artificial
  Synthetic
cccacgcgtccgctctcgtctctatctttctctcacactcatgggtcttcctacagatttcaaagagcttcagattccaggttacgtactaaaaacactttacgtcatcggtttctttagagacatggtcgatgctctttgtccttacatcggtctaccaagttttcttgaccacaacgagacctctcgacccgacccgacccgactcgctctctccacgtcagcaactcttgccaacgagttaatcccggtggttcgtttctccgatctcttgaccgatccggaagattgctgcacggtttgcttatccgattttgtatccgacgataagatt

SEQ ID NO: 3500 - DNA, 806 bp, Artificial
  Synthetic
tttttttttatcgaatgataataatatttaaaatttccttattgatacgaaacatatatccctcgacaatacatatatagcggtctttattatttttatgtagaccgatcgatattgacctcaaaatcattacataatatcaaacgcgatcaatggccgaaacaagcatgtttctggaatcaggctgcccaatgagctcattgccacagtcgacaaattggtagtcaacaatgagatggccttgttgatagccaaaaccatcggtgtctatttgattgaacattgctacatccaaatccaagcctccgttgctgcattggtccactattctcacagttactgcagcatttgttcttgggttcttcacccttaaacacttgccgcaagaagcttgaccacgaggtcctgccggcccgcagaaggcggtccagccatacttgctccgccatgcgtacggcttatcagcatcccacgtggagcaataagcactcacggctctcaaatcccaattattctgcgccggattatagaaatggtaggtggcgcgtacgttcgacgcgctctcccctggtccgctaggcccacttccccaacaattgctctgacagttgttggtcggagaacagtagtccgcggtggtaccacagtaaccgtactgactgcagcagatgttaccgggacaagttcgaccaccgccttgacgaccgcattgttgtccggccaccgtagccactgtgtatgataaaagtatgatggttatgctaagtctgatcttcatgatccccaagtctttgcggacgcgtggg

SEQ ID NO: 3501 - DNA, 377 bp, Artificial
  Synthetic
gcagtggctcaaccttgacgtgtcaatctctcgttggttactcaagcaagaacgcaacaacgttgcgcaatatccaaaccctttttgccgtcaagaacctccgctcgatcctcggagctaacaatctcccactcaacacctcacgtgaccaacgcgtgaacccgaatcaagtcgtacgtgtcccaatccattgctcttgctccaatggaaccggtgtctcgaaccgggacatcgaatacaccatcaagaaagacgacatactctctttcgtcgcaactgagattttcggtggtctcgttacgtacgagaagatcagtgaggttaacaaaatccctgacccgaacaaaatcgaaatcggtcaaaagttttggatccct

SEQ ID NO: 3502 - DNA, 350 bp, Artificial
  Synthetic
ctgataaacctctcgacgttcctcttttagcttgtagctcttctgtgaggaaggactcgttggatgctcctctgcttctgtctaacaactcatacgtcttcactgcaaacaattgcgtcaagtgtacttgtgacgctttgaagaattggactttaagctgtcaatcatcatctgagattaagccttcgaactggcaaacctgcccaccattttcacaatgtgatggagctttgcttaacgcctcttgcagacaacctcgtgattgcgtctatgctggttactccaaccaaaccatcttcaccacagcttccccagcttgtccagattctgctggtcctgataactatgca

SEQ ID NO: 3503 - DNA, 489 bp, Artificial
  Synthetic
gccattacggccggggatcttggaagtttaaaggaaaagggagaaagagaaatctttctgtcttaagagtaattagcaatggcttcctcagttctttcctcagcagcagttgccacccgcagcaatgttgctcaagctaacatggttgcacctttcacaggtcttaagtctgctgcctcattccctgtttcaagaaagcaaaaccttgacatcacttccattgccagcaacggcggaagagtgcaatgcatgcaggtgtggccaccaattaacatgaagaagtatgagactctctcataccttcccgatttgagccaggagcaattgctctccgaaattgagtaccttttgaaaaatggatgggttccttgcttggaattcgagactgagaaaggatttgtctaccgtgaacaccacaagtcaccaggatactatgatggcagatactggaccatgtggaagctacctatgttcggatgcactgatgcc

SEQ ID NO: 3504 - DNA, 377 bp, Artificial
  Synthetic
ggctgcaggaattcggcacgaggaaaatggagaaagagaaatctttctgtcttaagagtaattagcaatggcttcctcagttctttcctcagcagcagttgccacccgcagcaatgttgctcaagctaacatggttgcacctttcacaggtcttaagtctgctgcctcattccctgtttcaagaaagcaaaaccttgacatcacttccattgccagcaacggcggaagagtgcaatgcatgcaggtgtggccaccaattaacatgaagaagtatgagactctctcataccttcccgatttgagccaggagcaattgctctccgaaattgagtaccttttgaaaaatggatgggttccttgcttggaattcgagactg

SEQ ID NO: 3505 - DNA, 560 bp, Artificial
  Synthetic
gccattacggccgggggattcaaggaattggaagatttcttgcccattgcgaaaagtccagctgaagagtgtgtaatgggggtggtgggcaaagcaggggattgggcatttaaggcgttctcagcggggctgggcgttgccaccattttctttgcagcttctttctccctcaacgtctaccgtggtctctcttggcataatcgccaatcgagaattgagaaggaaggatctaaagtcctgcagcaggaagaatgacggttttagacgtgctacacttttacctaacgttgcaagccgagatcataatataagttctgaatctttttacgttaaaataacttgaggacgagtatgatttacacattctgtcattgttattcatttactgttggtggccacataattgtgggagttgtaattctaagtagctatttaattgtagcagctgctgaccgttaaaatggagttggaacaagaacaacaacaacaacaacccagtatggtcctacaagtggggtctggctaggagataatttgaaaatgtccccttcgttattact

SEQ ID NO: 3506 - DNA, 720 bp, Artificial
  Synthetic
acgaaatcctttctgtagctgaacgaacacatatttgaaggtagcaattttggaaaaaagcattatggcactagtttctggaggaagatcatcgttgaatccaaatgcgcccctctttgttccttcgtttgtgcgccaagtggaggatttttcaccagaatggtggaatttggtgacaacttcaacatggttccatgactattggatgagccagaaccagggagaggaatatggtaatgatcaatatggagctggtaatgatatcgctgatttgcttcctgagaatattgatctcaatgtggatgaggatatcttgaacatggaagctcagtttgaggagtttctccaatcatccaaaagcgggcaacaaggaattaagtcacctctctatggtgtcaatggaatgccacaatatggattgcccaatgtttctgatccggtgataagaactatgagttcaccaatgtactatgagaagccagccaagatcgtgagctctaggaacagcttccgcagcatccaacagcctcgctgaatgtgattagcttagcaaaagctcttggtttgcattcagaaagtcagttcttagtactcttgacaagcagtagttaagaaagtctcgagttttagttttcatgtaacctttttgtacagagcaaggtaggcagcactcttgtatctagccttgttcatagtctgatatcctttcttttgcttaac

SEQ ID NO: 3507 - DNA, 988 bp, Artificial
  Synthetic
atcaatagctgaaggcctgaagcagatcaaagttcctaacaagctgattgacaacgcaacaatatggcgaccaacaaggttgagatggagaaaagtgagggaaatttgaaacatctagggtttgtaagggtgttggctataaacactgcggttttggtgtcaaatctgtacgaatacacgaagcagaactcggggcctctgagatcgactgtgggtactgtagagaacgcggtaactaccgtggtaaggcctgtttacgagaggcttaaaggtgttcctgatgaagtccttgttttcctagaccagaaggtggacgatggagcagcaaaatttgatgagcatgctcctcccttggccaagaaggttgtcagcaaagcccagtctgtatttcagaaggcatcagaagtagcacaagacttgttcaaggaagtacaagttgctggtcctcgtgcagctatcaatcatgctggtgcattgtccaagcaattggctgctagtcaagtggcagttctctggtatcatataaatcattgtgcgccgttgcatggaatcgcacagatggctgcacctactgctgctcactggtcagagaagtataatcaactagttgctgacttgaagaagaaaggttatattgttgtcaactacattcctttgataccagttgaagaaatctcaaaggcatataaacaggttgagtctgctgcgcatgagaaagacgatgctcctaattccagttcaagtaaatccgaatgattatcttagtatatctgtctacccaatgtttagttgtgcttgtaagactttagtttgggattgggaggtttgggggtatccattgtatagatcgctcgatgccacttctgtagcatcttaaatgttaaggttttgtgctttgtattcttctaaatgagttgttgattctgtaatggtgtgagtgcctatgcaatgtcctgtccatgcataatgaagtttgaattctgctaag

SEQ ID NO: 3508 - DNA, 785 bp, Artificial
  Synthetic
  misc_feature (716)..(716): The residue at this position can be any nucleotide.
ccccgaagataagaattcatacgtgtacgaaatcctttctgtggctgaacgaacacatatatttgaaggtagcaattttgggaaacagcattatggcattagtttctggaggaagatcatcgttgaatccgaatgcgtccctcttcgttccttcgtttgtgcgccaagtggaggatttttcaccagaatggtggaatttggtgacaacttcaacatggttccatgactattggatgagccagaaccagggagaggaatatggtaatgatcaatatggagctggtaacaatatcgctgatttgcttcccgagaatattgatcttaatgtggatgaggatatcttgaacatggaagctcagtttgaggaatttctccaatcatcccaaagcgggcaacaaggagttaagtcatctctctatggtgtcaatggaatgccgcaatatggtttgcccaatgtttctgatgcgctgattaatactatgagttcaccaagatcccccgttgcgccaccaatgtactatgagaagccagccaagatcgtgagcccaaggaacagcttccgcatcatccaacagcctcgctgaacgctattggcttagcaagagctcttggtttgcattcagaaagtcagttcttagtttgcagctactcttgacaagcagtagttaagaaagtctcgagttttagtttgttaagaaagtgtcgagttttagttntcatgtcaccttttgtatagagcaaggtaggcagcactcttgtatctagccttgttcatagtctgatac

SEQ ID NO: 3509 - DNA, 753 bp, Artificial
  Synthetic
atcgttcctgtagttgaaagtagatattttctcggacttcgaagacatcttcaggtaacaatttggagaaaggagaatggcgttagtttcaggaggaaggtcgacactgaatccgaatgcacctcttttcatcccgtcttatgtgcgtcaagtggaggatttttcacccgaatggtggaatttggtgacaacttcgacatggttccatgattattggacgagccagcatcaaggagaggaatatggcgatgatgcttttggttttgctgggaatgatgttgctgacttgcttcctgaaaatatcgatcttgatgttgatgaagatattttgaacatggaagctcagtttgaagaattcctccaatcatctgaaagtgaacaacaaggaatcaagtcatcgctctatggtgtcaatggtttacccaagggttcggaggcactcgtacggacactgagcatgccaaaggggccaaaatctcccattgagccaccaaagtactatgagaaaccagcaaagattgttagcccaaagaacagccttcgccgcatccagcagcctcgctaaatgtagtttagcttaagcaaaagctcttggtttgtagtttgggaatgtcagtccttaatttcgagcttttagtcttcttcacaaagcatcagttgagagtctgaggagtgtttagtttctggtagccttttgtatagagcaaggtaggtggcaccttctgtatctagccttgttcatagttgtagtat

SEQ ID NO: 3510 - DNA, 705 bp, Artificial
  Synthetic
gaagcaaagcgtgtatcaacgctcctttctcgtctctctctctctctctcttctcttccgggctgctcctctttttctctctctctctttctccctctcttctcgcgacggaaggaaggcggaatactcctttctctttctctttctctctctcataccgaggtatttagggtttccacaggcggagagaagagagagagagagagagcgtctttcttcctctaccgctgctactactactgctacgaccatgtcggggatcgccaatgctaacctaccgcggcggatcatcaaggaaactcaacggttattgagcgagccagcccctggcataagtgcatcaccttctgaggataacttacggtatttcaatgttatgattcttgggccaactcaatctccctatgaaggcggggttttcaaattggaattgtttctacccgaagaatacccaatggcggctccaaaggtccgattcctgacaaaaatttatcatccgaatattgacaagctggggcgcatctgcctcgacattttgaaagacaagtggagccctgcactccaaattcggacagtccttctaagtattcaggcccttttgagtgcaccgaatcctgacgatccactttctgagaacattgcgaagcattggaagactaacgaggcagaagctatgcaaacagcaaaggagtggaccaggatgta

SEQ ID NO: 3511 - DNA, 644 bp, Artificial
  Synthetic
cccacgcgtccggtcatcttcggcagacaggcaacgagcaccgaatctccccgcggataaggcttctttttttccgtctacaaaacgtcacctgtgcaacaactgaaagctctctggcttctccgattcggcggtccaggcctctctttccacctcttccaacgtttctttcaaccctctccctttgatcaggcatttcaggataccgcttctcgtcctcaccggcgatctccgacgagccaagatgttgaacatatggtctatggtatttggaaaatgcgccagcttctatgccccgccacagagagttcctaacacaaattgcagaaaaaaaagcaaaaggaggctgaaaatgccgaaggtcaggctgctggagggaagaggaagaaggtgacggcggcacagctacgagtacaaaaagatttgtcagaactatctctcggcgcaacgatgaagactgacttccctgaccccgacaatatcctcaactttatcctgtcgatcgagccggacgagggcatgtaccgaggcggaaaattcacattcgactttgccatcaaccagaacttcacgcacgagcctcctaaggtgctgtgcagggagaagatatatcatcccaacattgatctcgagggcaaggtctg

SEQ ID NO: 3512 - DNA, 615 bp, Artificial
  Synthetic
ggcaacgagcaccgaatctccccgcggataaggcttctttttttccgtctacaaaacgtcacctgtgcaacaactgaaagctctctggcttctccgattcggcggtccaggcctctctttccacctcttccaacgtttctttcaaccctctccctttgatcaggcatttcaggataccgcttctcgtcctcaccggcgatctccgacgagccaagatgttgaacatatggtctatgaaaaaaaagcaaaaggaggctgaaaatgccgaaggtcaggctgctggagggaagaggaagaaggtgacggcggcacagctacgagtacaaaaagatttgtcagaactatctctcggcgcaacgatgaagactgacttccctgaccccgacaatatcctcaactttatcctgtcgatcgagccggacgagggcatgtaccgaggcggaaaatttcacattcgactttgccatcaaccagaacttcccgcacgagcctcctaaggtgctgtgcagggagaagatatatcatcccaacattgatctcgagggcaacgtctgccttaacattctgcgggaggactggaagccggtgttgaacttgaatgctgtcattgtgggg

SEQ ID NO: 3513 - DNA, 635 bp, Artificial
  Synthetic
agtcaggtttcgaactctttccttctcctcctcctcctcccgttccctgcgccgaggaggaagaagaaagagccaggccaactcagagaggaggaaagaggaaagaggaaagaggaaagaagaagaaggaccatcccccgcgcgctatccacgcttgtgcagaactatttgacgctaacatgatcaagctatttagtgtcaagcaaaaacaaaaagaagctgctgaaagtgcaaatgggaggcctcaagtcaggaaacaaagtgctggggaattgcgtgtacagaaagatatcagcgagttgaatttgcccaaaacaacttccatatccttccccaacgggaaaaatgatatgctgaattttgaaataagcatttacccagatgaaggctactatcgtggtggaacttttttcttcactttcaatatttccccattgtatcctcatgaagccccaaaagtgaaatgcaagaccaaggtatatcatccaaatatagatttggaaggcaatgtctgtctaaacattctccgggaagattggaaaccagtcttgagcatcaactcaataatatacggccttcaatatcttcttctggatccaaacccagatgatcctctgaacaaggaggcagccgag

SEQ ID NO: 3514 - DNA, 708 bp, Artificial
  Synthetic
ttcatatatatatatatagagggaggaaggcttcgtgttggaccttccttttttgttttcctttttgccgccatcgccgtctttccttccttccttcgatcgatccatccctcctcctcttcgcgatcaagcttctcctcctcccccccccccccaatggcctccaaacggatcctcaaagagctcaaggacctacagaaggacccccccacctcgtgtagcgccggccctgttgcggaagacatgttccattggcaggcaacgatcatgggacccgttgatagcccttacgccggaggtgtgttcatgttgacaatccactttcccccagactaccctttcaaacctcccaaggttgctttcaagacaaaagtatttcatccaaacatcaatagcaatgggagtatttgcttggatattttgaaagagcaatggagcccagctttgacaatctccaaggttttgctttcgatttgttctcttctcactgacccaaaccccgatgatcctctggttcctgagatagcacacatgtacaagatagacagagccaagtacgaatctactgcaaggaattgggcacagaagtatgctatgggctaatagttattataatggacgtcccattgcaatggtagacaggccgagggattgattacactttcctgttcttgttttcaaaccatggggggttggatgtatcttgtg

SEQ ID NO: 3515 - DNA, 866 bp, Artificial
  Synthetic
attcgataagagagaagaaaagaacccatttgctggctcttacgctaacctgagatcacacaaatcctcttttttcttcagcttttttgtgccttctcacttaagcagggaccatgattaagttgtttaaagtaaaagaaaagcagagagagcaagctgagaatgcaaatggaaagccaccagtcaagaaacaaagtgcaggagagttgcgtcttcacaaagatataagtgagctaaatctacccaaaacatgtagcatatcatttcccaatggaaaagatgacctcatgaactttgaagtcactattcggcctgatgaaggatattatatgggtggcacatttacgttctctttcagtatttccccaatgtatcctcatgaagccccaaaggtgaagtgcaagacaaaggtttaccaccctaatattgacttagaaggaaatgtgtgtctcaacattcttcgagaagactggaaacctgtgctcaacattaacaccattatctatggtctatatcatctgttcacggagccgaatcacgaggatcccctcaatcatgacgcagctgctgtattaagagacaacccaaagttgttcgagtccaacgttagaagggcaatgcatggaggctatgttgggcaaacgttctttcctcgctgtatgtaacatctttacttctgaatcaactgatttaagaagctgatggtggaagtttgagaactctgggactgtgtaaagtttgggtgcaaaatcatttcaggtggtctttctgcaaacagaatatgggttcaaatgtcttaaaatatatgtaactcggaccagaaaaaatcttgtatgctaagtgtaaactttgcaatttgttttgga

SEQ ID NO: 3516 - DNA, 681 bp, Artificial
  Synthetic
tgtttttagtgagacaaagagtgtgaaactctcttacaatttctactttctctctctagaaaaaaagagacccttagcgtaaattttctgcgatcaaaaaaagaattcgattcaattcaatggccaacagcaatcttcctcgaagaattattaaggaaactcaacgtcttctcagcgaacccgcgccgggaataagtgcgtctccttcggaagaaaatatgcgatacttcaatgtcatgattcttggtccaacacaatctccttatgaaggaggtgttttcaaactggaactctttttgcctgaagagtacccaatggctgctccgaaggttcgatttctcaccaaaatataccaccccaacattgataagcttggtaggatatgccttgatattctcaaggacaagtggagtcctgctcttcagattcgtactgttcttttgagcattcaagcacttctgagtgcaccaaatccagatgatccactatctgagaacattgcgaagcattggaagtcgaatgaggctgaagctgttgaaacggctaaagaatggacccgcctgtatgcgagcggtgcctgaaacgaaacgactaagtgattttgaaaaaaaaaaagatgtggaatgtaatttatccactgtctaatcaggggagttgggaggactgaaagctaaatgcttc

SEQ ID NO: 3517 - DNA, 645 bp, Artificial
  Synthetic
cgccgatctccatctggcgagcagagcaggggaggggaagggaaggtatcctgaaagatgcttaatcttatcaaaataaaggataaaaagaaagagcaggcagcaagtgctgctggaaaggctcctgtgaagaagcaatctgctggagagctccgtcttcacaaagatattagtgagctaaacctacccaagagcacatcaatttcttttcccaatggcaaggatgatctgatgaattttgagatcatcgtccgacctgatgaaggatattacctaggtggcactttcgtctttacttttcaagtctctccctcttatcctcatgaacctccaaaggtgaagtgcaagaccaaggtataccatccaaatattgatttggaaggaaatgtatgcctgaacattttgcgtgaagattggaagcctgttctcaacatcaacactgttatttatggccttaaccttctttttacgcaaccaaacgatgaggatccgttgaaccatgaagcagcagctgtcctccgtgacaacccaaagctgtttgaagctaatgttaaaagggcaatggccggaggctatgtgggtcaacactatttcccaagatgtgcatgatatggtgctgggtgccacaaacattagtaagttaag

SEQ ID NO: 3518 - DNA, 561 bp, Artificial
  Synthetic
gggagagaactttttttatttaaaattagctgaaaaggaatatgtagaaactaaagtaagcaccgttacagttcaattagcacatgcttcacaagcaatcacatgattttagataggtatatatctgttaacaagcacagaaaagagggaaaaacaaacattttgcgtacagatggccagaattgaataagaatgcagagaatcgcagacgcagcacatcttcaaacaaggaacggttttcaaagaaatacaggcatccgactttggattcaaagctcactattaaacggttgaatgcggaggctaggtgtatgacaaaagctaaacggcttggcgttactactccagtgctgtatgctgttgaccctgttacacatactctcacctttgaatatattgaaggtccttctgtgaaagatatattccttggctttggattagttggtgttgacgatgaacggatgaccgatattggcacacagattggtaatgctattggcaaactacacgatggtggcctagtccatggcgatttgacaacatcaaattatgttaatgagg

SEQ ID NO: 3519 - DNA, 746 bp, Artificial
  Synthetic
gagaattggttgttactcctgttgaaaatactggattttgtccagaggacgccaccatagtagggaacacctgcttatatggagcgacaggtggtcaagtatttgtcagaggtaaagcaggggagcgttttgctgtaaggaattctcttgctcaagctgttgtagaaggcactggggaccactgttgtgagtacatgacaggagggtgtgttgtggtgcttggaaaggttggtagaaatgtagctgctggtatgactgggggtttggcatacattcttgatgaggatgatacccttatatctaaggtaaacaaggagattgttaagatccagagagtggttgctccagtgggtcaaatgcagctaaagagcctaatcgaagcccatgtggaaaaaacgggcagcacgaaaggcgcaactattctcaaggagtgggacaaatatttgccactattttggcaattggttccacccagtgaagaagacactccggaggccagtgctgaatacgagcaagctgctgctgggcaggtcactttgcagtctgcagagataccattgaagtaaatctcacatgagcacagcaatgaccatgattctaagcaggagacagtttgtacaggaaagaatgatattgtctccacggaaggactcggtgaagtctgagagatcagaactcttaaaggtgcaagcaactatctttgttgaacaaaaggctgatctttgtgatgcttcagcagctgtaca

SEQ ID NO: 3520 - DNA, 197 bp, Artificial
  Synthetic
gggcggacgcgtgggattgccgttgctactatttgcttagccgaagaacttggaaattcgggtacaacgttttagacctgttactagttcttgcccctcatttttttctttgaggcggttttcatgcccgtgcttaataagttgtaacttgtatcatgacattgacaatttcgtgaatgtgtaaattaaagtcatcc

SEQ ID NO: 3521 - DNA, 427 bp, Artificial
  Synthetic
gctgcgagggaattgcagctgaagagcttaattgaagcacatgtggaaaaaaccggaagcagcaaaggcgcggggattctgaatgagtgggaaaaggatctacctctcttctggcaactgggtccaccgagtgggggagacactcctgaagcttctggtggttacgtaagaacatccaccggggaaggcacatttcaatcgggttagagatcattcaagagcagggtggggcagttgaaacacaaggattggtatacatcaatgggggaggactatggagagcagattaatggaaaatcattatcattcacatgtagatcaaatgggggggacaatattcttattggcttgggatctttacaacaataccatgggtgctataactggacaggaaattcagtaaaataactggtttcaactggcaaaa

SEQ ID NO: 3522 - DNA, 450 bp, Artificial
  Synthetic
gccattacggccggggacaaaaaaaattgaagctcgaaatagctcatcaaaatgttttggaaaactaatctttttatttgtgtttctttggctattttgctaatagtaatactccaactagctgatgcaagggagatgtctaaggcggctgctccaattacccaaggaatggattcaaacaacattagtgatcaagcgggttatgctcgggttttacgttgtttggcttgcagatgttgtgtcggttaaattttatatattttttacgatcaaatattatacaatgtttttgtatgtgctaaaagtaataatactccaaaataaggcacaacattgtggtagtattagtttgtgttgttatacatgtcttgtccggttgtctttcaactttgtggtactgtaattttaattctggtcaataaatagtactactaattagtgtttatggtt

SEQ ID NO: 3523 - DNA, 562 bp, Artificial
  Synthetic
gaaagagagtgagagagctcgagcaatggcggcagtgttggagagctcggccttctgcggctcggccctggcagcagcaccaccagctcggggcctccccgcattgagcagcagcaggctcaccgtgagagccagcggcggcaagaagatctcgacgaaaacacctctaggaccttctggggacctcagttttaagtctggacgcgatgcttctggccgtggcaccacgggaaagggcgtgtatcaattcacaaagaaatacggagctaacgtggatggatacagtccgatctatactccggacgaatggtcgccttcgggagatgtttacacgggtggccagactgggcttttgctctgggcagtaacgctgggaggtatactactggccggtgtgttcctcgtatacagtactagtgctctcgcaagctaaatcgtgtaaacgttatattgtcaaaaagcgagcaaaaaggattatttccatacattgtccatagcttggacacgacttcaatgtagataaaggttgtattcatatttacaaatatatcgtattctcgtc

SEQ ID NO: 3524 - DNA, 614 bp, Artificial
  Synthetic
acgcgtcgctttcgtccgaccccgaaggtatcccagctatggcgttcgctctcgagaggtctgctctcctcggcaattccgtcgtcggtttgccttccctgcccaagcttagtatagcctcccccccttccaccgtcaaaatctttgccagcggagcaaagaagattaagaccaaggcaccactcggtccttccggagatacctcttaccgtaatggagctgatgcttctggatccaagggcaagggtaagggagtgtaccagtttgtcaacaagtatggagccaatgtcgatggttacagcccaattttcacccctgatgagtggtcacccaatggagatacctacgtcggcggtaccactggattggctatctgggctgtgaccctcggaggccttctcctcgctggtgtcttccttgtttatagtaccagtgccctttcacagtagattgttgttgaaaagacagacaatcctcatttacaatttatcttatgattatatgtaaaccattgaacatacttcgctgctatcaatgaatgagagctatcatctctccatttcattattgtaattgtcggtcattcgaatcggaacatttgatctattttagaa

SEQ ID NO: 3525 - DNA, 662 bp, Artificial
  Synthetic
ttgtcattaattaaggccattacggccggggaaaacaatacagtttggattttctttctttgtatttttcaaagcaaaggcaatggaagggaagactatgttcaagttatctcatgtagttgctttcttgctccttgcatcgctttttcaacctcttacggcaagagatctagtattcgaagtaagtgacggaatagaagtcttgcaattcccaatggcaaaagaaaaccaagtggaaacacttgatgatccctctctctcaataatttgcccaggaaagcaatcatggcctgaacttgtgggaaagccagcggcgactgctaagagaataattgagaaagaaaatcccatagccaaagttcagtttttgttccctggtatggttaggccacttaattatgtttgtggtcgagtttttgttgttgttaactggaaactcattgttcgagatactcccagcatgggttaattaaatagttctatgggactattatggaagattcagaataagttgccccaagaattaataaatagagtactggtgttctatagtgtactcttcatgtactgtactatttcaatataataaataaaataagtgtggctttttaaatttgtattataaatatcttgcctcattctcttttatgttgtaatttttt

SEQ ID NO: 3526 - DNA, 603 bp, Artificial
  Synthetic
gccattacggccggggatagtacaatttggagtttccttctttgtatttttcaaagcaaaggcaatggaggggaagacaatggtcaagttatctcatgtatttgcttttttgctccttgcatcacttttgcaatctcttacggcacgagatctggtattcgaagtgaatgatggaatagaagtcttgaaatttccaatggcaaaagaaaaccaagtggaaacacttgatgatgcctctctatcattaatttgccaagggaagcaaaaatggcctgaagttgtgggaatgccaggaaggactgctaagaaaataattgagaaagaaaatcccttagtcaaagttcattttttgttccctgatatgcttcaaccattggatttagattgtagtcgagtttttgttcttgttaactggaaattcatcgttcaaattactccctcagtgggttaataaaatagttctatgggactattatggaagattcagaataagttgccccaagaattaataaatagagtactggtgttctatagtgtactctttatgtactctactatttcgatataataaataaaataagtgtggcctttttaatttgtatt

SEQ ID NO: 3527 - DNA, 609 bp, Artificial
  Synthetic
gccattacggccggggaatacagtttggattttctttctttgtatttttcaaagcaaaggcaatggaagggaagactatgttcaagttatctcatgtagttgctttcttgctccttgcatcgctttttcaacctcttacggcaagagatctagtattcgaagtaagtgacggaatagaagtcttgcaattcccaatggcaaaagaaaaccaagtggaaacacttgatgatccctctctctcaataatttgcccaggaaagcaatcatggcctgaacttgtgggaaagccagcggcgactgctaagagaataattgagaaagaaaatcccatagccaaagttcagtttttgttccctggtatggttaggccacttaattatgtttgtggtcgagtttttgttgttgttaactggaaactcattgttcgagatactcccagcatgggttaattaaatagttctatgggactattatggaagattcagaataagttgccccaagaattaataaatagagtactggtgttctatagtgtactcttcatgtactgtactatttcaatataataaataaaataagtgtggctttttaaatttgtattattaaaaa

SEQ ID NO: 3528 - DNA, 616 bp, Artificial
  Synthetic
tctctcttccccaccttggttgaatattctccatcgacggggagagacaacaacaggcatggcctcactactgaagcaactgcaaggcaaagcatgcgtggcctcccagttcgtgtcgaaacacggatcgtcctactacaaatccctgatggagagcaacaagcagtacatcgcctccgagcccaccgttgagaagtgtcaggaactttccaaacaactcttttacacccgtcttgccagcttgcccgctcgatatgaacacttttggaaagagctggatctcgtgaagcagaaaatcaagaacaggcaagacttgaaggtggaggaggttgggattgctacattattttcattggagtgctatgcatggtattgtgttggagaaattgccggaagaggtttcactctcacaggctattatccttgacctttttcaagcttccatttaaaagtctaatagggaaccaaggagagagctgtttcagacaaaccttcctaataatgtcacctgtgtgaatttacatgactgcaatttttgcaattatccgactgagtcatggtcctttgtctccttttcagtctttttaaagatatttgttatatcatggcagttatg

SEQ ID NO: 3529 - DNA, 672 bp, Artificial
  Synthetic
tgaagtagcccatcacaagaagcattgaattttgttgcgcgcttgacattgcttaagtggctctttaacaaaggcatcatggcggcatggcgctaagggaactatggcttcaaaactacctatagtgaaagcaaaggctgttgaagtttcaaaattcttgaccaagcatggatgtgcatactacaagcagacgttggaacagaacaagcaatatattcaagagccacctactgtggagaaatgccagcatttggcaaaacaagtattctacactcgcttagctagtattccttgccgctatcaagcattctggaaggaacttgatgtcaagcacttgtggaagcacaaacaggagctgaaaatcgaggatgctggcattgctgctctttttggccttgaatgttttgcttggttttgtgctggggagatcataggacgagggttcacgattactggttattatgtctgaatgtctccaagtattaggttcgaaaggaatgacttatgtcactgttgatgaaaggtcattgtcaatctctactttgagcgggataacacgtatcagcgagatacagattttcaattttcatgtttagcaagtacacaatgtatgcagaggatgaggtcttctgctaaagatttcaaaggctgagttaggagtaatatacgtgc

SEQ ID NO: 3530 - DNA, 502 bp, Artificial
  Synthetic
gaattcgaaggactctttcttccttttcttcttcctcatctccaactctaaaccctaaatttcaacactacaggttttgtgattgattgttgttagagatggcatcgaagtttgttcaattgcaaagtaaggcatgtcaagcgacaaagtttgtgaggacacatggttcagcttattacaagcagaagttggagcagaacaagaagtttgttcaagagccagctactgttgaaaagtgtaatgaattgtccaaacaattgttctatactcgtcttgcaagtattcctggtcgtactgagtcattctggaaggaagttggtgctgtcaagcaactatggaagaataggcaagagctgaaggttgaggacgctggtattgctgctctctttggtctggagtgctttgcttggttctgtgctggtgagattgcaggaagaggatttaccttcactggttaccatgtctgataaacacaatgtaccacccaatgcttcaacaagga

SEQ ID NO: 3531 - DNA, 561 bp, Artificial
  Synthetic
ctctatcagaaagctagggtcactgctatgggcgactgaagcaaaacatcgcccatagtattactgcaaattgttgacgaaaggactttcttggtattgatggcatccaagattcagcaactgcaatctaaggcatgtcaagcttcacagtttcttgctaagcatggtactggctactacaaacagatgctggagcagaacaaacagtatattgtggagccacccagtgttgagaaatgcaatgaattgtccaagcagttgctctacactcgtcttgccagcatccctgcccgttatgagtcattttggaaggaagtcgattccgtcaagcacatctggaggaatagaaaggaattgaaggttgaagatgcaggtattgctgctttgttcggcttggagtgctttgcatggtattgtgctggtgagatagtaggaagaggatttacattcactggttactatgtctgagatatcagttcccaaaaatttgtttgcggaaattgacaattgtaagatctcttttttattaggatgatttgagtaacagggaattcatataag

SEQ ID NO: 3532 - DNA, 586 bp, Artificial
  Synthetic
gattctccatcgacggggagagacaacaacaggcatggcctcactactgaagcaactgcaaggcaaagcatgcgtggcctcccagttcgtgtcgaaacacggatcgtcctactacaaatccctgatggagagcaacaagcagtacatcgcctccgagcccaccgttgagaagtgtcaggaactttccaaacaactcttttacacccgtcttgccagcttgcccgctcgatatgaacacttttggaaagagctggatctcgtgaagcagaaaatcaagaacaggcaagacttgaaggtggaggaggttgggattgctacattattttcattggagtgctatgcatggtattgtgttggagaaattgccggaagaggtttcactctcacaggctattatccttgacctttttcaagcttccatttaaaagtctaatagggaaccaaggagagagctgtttcagacaaaccttcctaataatgtcacctgtgtgaatttacatgactgcaatttttgcaattatccgactgagtcatggtcctttgtctccttttcagtctttttaaagatatttgttatatcatggca

SEQ ID NO: 3533 - DNA, 324 bp, Artificial
  Synthetic
atcgactcatctctcagctcaccggtgctgcattatcaaaactgcaggaaggatttggttgtgaagatggcatcgaagttgatacaagttcaatcaaaggcatgtgaggcttcaaagtttgtggctaagcatggaacttcctactacagacagctgttggagaagaacaagcagtatatccaggaacctgccactgttgagaagtgccaagagttgtctaagcagttgctctacacccgtcttgctagcattcccggacgctatgaaaccttctggaaggaagtagactacgcaaagaacctatggaagaacagatccggtctg

SEQ ID NO: 3534 - DNA, 88 bp, Artificial
  Synthetic
aaagtttgtatgaaactggattcagaagtaactggatcataacattttgaagattttgtattacaaatttacacgtattgctactcat

SEQ ID NO: 3535 - DNA, 578 bp, Artificial
  Synthetic
gctcgagaattgcggccgcgaaagaatgaagctatattccccacaagaccgatgtgggtttacggatcgatatgggatgcatcggactgggccacagaaaatggaaggatcaaagccgactatcgataccaaccatttgtggctaagtacaaaaactttaagctagcgggatgcacagcggatagctctagctcatgcagaccgccatcgcctgcacccatgcgcaaccgcgggttgagccggcagcagatggcggcattgacatgggcacagaggaacttcttggtctataactattgccatgatccgaaaagagaccatacccaaacaccagaatgttaaaacaaacaaacaaaagaaaggttataataattttattttgcattatcaaacatacatgaataattggaggtcttgtgacgggtccacactggaaactatattgaagcagttgagcgtccggtcctctatgatttgagattaaaaagaaaaggttttgtttttcaatactttgtaatgtttccatttggtatctttcttataattgtaatattgtgtgatcacatatattaatatct

SEQ ID NO: 3536 - DNA, 675 bp, Artificial
  Synthetic
tgcagtcaagaatactttcttatctcttccttctacaatggcaactgctacaatgtctctctcttccccttcttttgccggaaaggcaataaaactctcaccatcttcctctgaaattactggaaatggaaaagtcaccatgaggaagactgttaccaaggctaagcctgtctcctctggcagcccatggtacggtcctgatcgtgtcaagtatttgggcccattttctggtgagtccccaagttatttgactggtgaatttcctggtgattacggttgggatactgctggactttcagctgatccggaaacctttgccaaaaaccgtgagctagaggttattcactgcagatgggctatgcttggagctcttggttgcgtctttcctgagctcttggcccgtaacggtgtcaagttcggcgaagctgtatggttcaaagctggatcgcagattttcagtgagggtggacttgactacttgggcaacccaagcttggtccacgcgcaaagcatcttggctatttgggcttgccaagttgtgttgatgggagccgtcgagggttatcgtattgctggtggacctcttggtgaggttgttgacccactttatcctggtggtagttttgacccattgggtcttgcagatgacccggaagcttttgctgagcttaaagt

SEQ ID NO: 3537 - DNA, 622 bp, Artificial
  Synthetic
acatttggagctaagaagaggtagagaaaatggtggtaagattgcggttgtcgaggttcggatgcaaaaacaaacctttttacagagtaatggcggcggatagcagatctccccgagatggcaagcacttggaagtcctcggttactacaatcctctcccaggacaagatggtggcaaacggatgggtcttaattttgaccgggtgaaatattggttatcggttggtgcacagccgtcagaaccggttgaacgtcttcttttccgagctggcgtattacctcctccacctatgctagctatgggacaaaaaggcggtccacgggacactcgtccagttcatcctatgactggacgtgtcgtggcaccggaaagtgtcaaaattgctgatccaaaagttagtgctaaagttgatggagatgacaaagcttagaacccgactagttatattttatacgacttcaacttgaatagctaatgtttgttccaatagtgatctgttgatatgtgataattacagaactaatatctgtttgttgctcttgattgctgggaaacttgatatccaaggacatatcatcgttaaagatgctgttgtcagtggtctctataaactatgtgatc

SEQ ID NO: 3538 - DNA, 86 bp, Artificial
  Synthetic
cgcgcactactcaaccttaatggccgactcaacaatggctctctcctcccctgccttccccggcaaggccgacaagctttcccccg

SEQ ID NO: 3539 - DNA, 571 bp, Artificial
  Synthetic
tcctttcctttcattgtagttaacgaaaagattacgattttggcaacatcagctatccagcaatcctccttcgccggccaaacggctctcaagccctccaacgaactcctccgcaaggttggtgtatccggtggtggccgtgtgaccatgcgtcgtaccgtcaagtctactcctcaaagcatctggtacggaccagaccgtcccaagtacttaggaccattctcggagaatacaccgtcctacctaaccggagaataccccggagactacggctgggacaccgctggactctcggctgacccggagacattcgctaagaaccgtgagcttgaagtaatccacagcagatgggctatgttgggtgctctcggatgcacattccctgagattctctccaagaacggtgttaaattcggagaagccgtgtggttcaaggcaggttctcagattttctcagaaggaggtcttgattacctcggaaaccctaacttgatccacgcgcaaagcatcttagccatctgggctgttcaagttgtgctcatggggttcattgaaggctacagaatcggag

SEQ ID NO: 3540 - DNA, 1040 bp, Artificial
  Synthetic
tttaaaagataattgtgagaaatagatgataacccaaaggtttagcaatctcgagagtaaaaaaaaagaaaactcaaaaccaaagattataatggcttcctcaaccatggctttgtcctcccctgccttcgccggaaaggctgtgaagcctgccgcatcagatgtcctcggaagcggccgtgtgaccatgaggaagactgtcgccaagccaaagggtccatcaggcagcccatggtacggatctgaccgagtcaagtacttgggtccattctccggcgagcccccgagctaccttaccggtgagttccccggtgactacggatgggacaccgctggtctatccgccgacccagagaccttcgccaggaaccgtgagctagaagttatccacagcagatgggccatgctcggagccctaggctgcgttttccctgagctattggctaggaacggagtgaagttcggagaagcggtttggttcaaggccggttcacagatcttcagcgacggaggattggactacttgggcaacccgagcttggtccacgctcagagcatcttagccatttgggctactcaagttatcctcatgggagctgttgagggctacagagtcgccggagatggtccattgggagaagcagaggacttgctttacccaggtgggagcttcgacccattgggcctcgctactgaccccgaggctttcgcggagttgaaggtgaaggagctcaagaacggaaggttggctatgttctctatgtttggattcttcgttcaggccattgtcaccggaaagggaccgttggagaacctcgcggaccacttggctgatccagtcaacaacaatgcatgggccttcgctaccaacttcgtccccggaaagtgagtttaatttgtgatcgagttgtgtgtatccggtttgttgcatcttggaaatgtgatgcagatttcatatcttgtaaattactttgtatgtgtgtgaaatatttaagaagctttatgataaaaaaaaaaaccaaaaaaggcggacgcgtggg

SEQ ID NO: 3541 - DNA, 902 bp, Artificial
  Synthetic
cccacgcgtccgcatttttccatcttcctcatcaccttcccaagaagaagaacaccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttgaagtcaaattaaaaggataagtggtatcgattatatatttgattaacccattgattggtgttaattgctcttttttttcttacgatgaacatacattgttcagtttcttttgattgtctgtgttttgatcaaaaaa

SEQ ID NO: 3542 - DNA, 476 bp, Artificial
  Synthetic
gcgcgtcttggttgtaaacaccgacccttctatcgtgtagttgtcgccgatgaaaaatcgcgcagggacggtaaacaaatcgaggtgttaggcttttatgatccactccaaggcaaagaagatgcggatagagtgagcctcaaattcgacagaatcaagtactggttatctgttggagctcaaccaacagacacagtggaaagcatgcttttcagggccggtttgataccaccaaagcctatggtagtggtcggttcaaaaaatgggcagaagtctacgagccaacatgtttcacccattacaggtgaaatcttgaactaagagtgttgatgcgttgagcaagaaagagccttttgtgtctgtgtgaaaggagtttatgtaatgttgtttaagacttttctgtttatgtgaaaggagttaatgtaatgttgtttaagacttttgctttctatgtgaaagcagtttaatgttatgtt

SEQ ID NO: 3543 - DNA, 731 bp, Artificial
  Synthetic
cggcatttcaaaccatcaaacaatcacttttctttttcatacaccatggctgcttcttcaatggctctttcttccccttcttttgctggacaggcagtgaaactctccccatctgcctcagaaatcactggaaatggaagggtctccatgagaaagactgtcaccaaacctgttgcatctagcagcccatggtacggcccagaccgtgttaagtacttgggcccattctccggtgaggccccaagctacttgaccggtgaattcccaggtgattacggatgggatactgctggactttcagcagatccagaaacctttgccaagaaccgtgaactcgaagtgatccactgcaggtgggctatgcttggagctcttggatgtgtcttccctgagctcttggctcgtaatggtgtcaagtttggcgaagctgtctggttcaaggctggatcccaaatctttagtgagggtggacttgactacttgggcaacccaagcttggtccatgcacaaagcatcttggccatctgggcttgccaagttatcttgatgggagctgttgagggttaccgcgttgctggtgggcctcttggtgaagttgtcgacccactctaccctggtggcagctttgacccattaggccttgctgatgacccagaggcatttgctgagctcaaagtaaaggagatcaagaatggtagacttgccatgttctctatgttcggattctttgt

SEQ ID NO: 3544 - DNA, 842 bp, Artificial
  Synthetic
tttctttatcacttcagccatcagaaaactcttcattctccttattaagccatggctgcttctacaatggctctttcctcttcttttgccgggaaggcactaaaactctcgccatcttcctctgaaatcaccggaaatgggaaagttaccatgaggaagactgctagcaagcccaagcctgtctcttctggcagtccatggtatggccctgaccgtgtcaagtacttgggtccattctctggtgagtccccaagctacttgactggtgagttccctggtgactacgggtgggacactgctggactttcagctgatccagaaacttttgccaagaaccgtgagttggaggtgatccactgcagatgggccatgcttggagctcttggatgtgtcttccccgagctcttggcccgtaacggtgtcaagtttggtgaggctgtatggttcaaggctggatcccaaatattcagcgagggtggacttgactacttgggcaacccaagtttggtccatgctcaaagcatcttggccatttgggcttgtcaagttgtgttgatgggagccgttgagggttaccgtgttgctggtgggcctcttggggaggttgttgatccactctaccccggtggcagcttcgacccattgggcctcgctgaagacccagaggcttttgctgagctcaaggtaaaggagatcaaaaatggtagacttgccatgttctccatgtttggattctttgttcaggctatcgtaactggaaagggcccattggagaaccttgccgatcaccttgcagacccagttaataacaacgcttgggcctacgcaacaaactttgtccc

SEQ ID NO: 3545 - DNA, 564 bp, Artificial
  Synthetic
ccgtgtagtagctgcattcaagagtttctcatctactttctataatggcagctgctacaatggctctctcttcctcttcatttgccggaaaggcggtaaaactctcaccatcttcctctaaaatcactggaaatggaaaagttaccatgaggaagacggttaccaaggccaagcctgtttctgctggtagcccgtggtatggtcctgaccgtgtcaagtacttgggaccattctctggtgagtctcccagctatttgactggtgagtttcctggtgactatggatgggacactgctggactttcagccgatcctgaaactttcgccaaaaaccgtgagctagaggttatccactgcagatgggcgatgcttggagctcttggttgcgtcttccccgagctcttggcacgtagcggtgtcaaattcggtgaagctgtatggttcaaggctggatcccaaattttcagcgagggtggacttgactacttgggcaacccaagtttggttcacgcacaaagcatcttagccatatgggcttgccaagttgtgttgatgggagctgttg

SEQ ID NO: 3546 - DNA, 567 bp, Artificial
  Synthetic
tctttctctccttgtttgtaaaggatgggagtggtgaagcttcggctggcccgattcgggcgaaagaatatgcccttctaccgcattcatgctgccgacagcagagctccccgcgacggaaaattcctcgaaaaaatcggatggtacaacccccttcctggtaaagatgggcacaagcgaattgggataaattttgatagagcaaagtactggttagcagttggagcacaaccatcagatgtggtaaagaggttgttctttattgccggtatcttgcctaaaccacctgttcctcccatgccaaagaagccccatcgtcaacaagtaaaggagtctccttcgaaagagcattagtagggagaacaaggcacatttgtcaacattcaaaggtcaaggcaaggagggtggcaaagtgaacagaaatggattccaaggtgctgcagtatgtaatgtagcattacattatattgcatttgtaaccaggcattccagaagtgtggattttaacaaaagtagccttctatttgataatatgctcaagtctgaatggggatacatttaaatagt

SEQ ID NO: 3547 - DNA, 601 bp, Artificial
  Synthetic
cttctttctgtgtagtagctgcattcaagagtttttcatcttctttctataatggcagcttctacaatggctctctcttcctcttcatttgccggaaaggcggtaaaactctcatcatcttcctctgaaatcattggaaatgggaaagttatcatgaggaaggcggttaccaaggctaagccagtctcttcaggcagcccatggtacggtcctgaccgtgtcaagtacttaggaccattctccggtgagtctccgagctacttgactggtgaatttcctggtgactatggatgggacactgctggactttcagctgatccagaaacttttgccaagaaccgagagttggaggtgattcactgtagatgggctatgcttggagctcttggttgcgtcttccctgagctcttggcacgtaatggtgtcaagttcggtgaagctgtatggttcaaggctggatcccaaattttcagcgagggtggacttgactacttgggtaacccaagtttggtccacgcacaaagcatcttagccatctgggcttgccaagttgtgttgatgggagccgttgagggttaccgtgttgctggtggacctcttg

SEQ ID NO: 3548 - DNA, 819 bp, Artificial
  Synthetic
aggactttggtcctacctagttatttatatacagttgctgcaaggccattaaactcaagccataaatcaaatattctttctgtgtagtagctgcattttcaagagcatttcactttatttctgcaacaatggcagcttctacaatggctctctcttcctcttcttttgccggaaaggcgctgaaactctcaccatcttcctctgagatcaccggaaatggaaaagttaccatgaggaagacagttaccaaggcgaagccagtctcttctggcagcccatggtatggtcctgatcgcgtcaagtatttgggcccattctccggtgagtccccaagttacttgactggtgagttccctggtgattatgggtgggacactgctggactttcagctgatcccgaaacttttgcaaagaatcgtgagctagaggtgatccactgtagatgggccatgcttggagctcttggttgtgtcttccccgagctcttggcccgtaatggtgtcaaattcggtgaggctgtatggttcaaggctggatctcaaatttttagcgagggtggacttgactacttgggcaacccaagtttggtccatgcacaaagtatcttggccatctgggcttgccaagtcgtgttgatgggagctgttgagggttatcgtgttgctggtgggcctcttggtgaggttgttgacccactctatcctggtggtagctttgacccattaggtcttgctgatgatccagaggcttttgctgagctcaaggtgaaggagatcaagaacggtagacttgccatgttctcaatgtttggattcttcg

SEQ ID NO: 3549 - DNA, 377 bp, Artificial
  Synthetic
aattcggcacgagcttcaatctccttattaaacaatggctgcttctacaatggctctctcctcttcttttgccggaaaggcagtaaaactctcaccatcttcccctgaaatcaccggaaatggaaaagttaccatgaggaagactgctagcaaggccaagcctgcctcttctggtagcccatggtacggtcctgaccgcgtcaagtacttgggccctttctctggtgagtctccaagctacttgactggtgagtttcctggtgactacggatgggacactgccggactttcagctgatccagaaacttttgccaagaaccgtgagttggaggtgatccactgcagatgggccatgcttggagctcttggatgtgtct

SEQ ID NO: 3550 - DNA, 864 bp, Artificial
  Synthetic
gaattcaagagaagctctaaaatctgtctcaaccaataagaaagcaatttaagatctcttattaaaaaactcaccattttgagtactctatttaagcaacccaactgcaacaaccacaaacatcatctccttgcaattcttatagcacttcaattttctcatccatccatatatcagttagccatggcagcttctacaatggctctatcttcacctgcattggctggcaaggcacttgttccttccagctctgaagttttcggtgaaggcagaatctccatgagaaaaaccgttgcaaagccaaaaaccgtttcatctagcccatggtacggacctgaccgtgttaagtacttgggaccattctctggtgaatctccatcgtacttaaccggtgaatttgccggtgattacggttgggacaccgccggtctttctgctgacccagaaaccttcgccaagaaccgtgagctggaggtcattcactgcagatgggctatgttgggagctcttggatgtgtcttccccgaattgttgtctcgcaatggtgttaaatttggtgaagccgtttggttcaaggctggttcacaaattttcagtgaaggtggattggactacttgggtaactcaagcttggttcatgctcagagcatccttgccatttgggcaacacaagttatcttgatgggtgctgttgaaggttacagagttggaggaggaccattaggtgaggtggaggacccactttaccctggtggaagcttcgacccattaggcttagctgatgatccagaagcttttgctgagttgaaggtgaaggaaattaagaacgggagattggctatgttctccatgtttggattcttt

SEQ ID NO: 3551 - DNA, 451 bp, Artificial
  Synthetic
ccccccgaaaacccttgctcccacaggagtgaacacgacgcgacccgagccggagaaggggaagggaaggcggcggcggcggcggcggaggaggaggaggcgcgaggggaggcgagcatggtggtgcggatccggctggcgcggttcggctgccggaaccggccgttctaccgggtgatggccgccgacagccgctccccgcgcgacggcaagcacctcgaggtcctcggctactacaacccgctccccgggaaggatggtggcaagaggatggggctgaaattcgacagggtcaagtactggctgtctgttggtgctcagccatcagatcctgtgcagcgcatcctttttcgagctgggcttctgcctccacctccaatgctagctatggctcgaaagggtggacctcgtgataggcgcccaattcatccgatgactgggcgccccttgg

SEQ ID NO: 3552 - DNA, 508 bp, Artificial
  Synthetic
ctcgagcttgcggccgcctcgcgcgtcttggttgtaaacaccgacccttctatcgtgtagttgtcgccgatgaaaaatcgcgcagggacggtaaacaaatcgaggtgttaggcttttatgatccactccaaggcaaagaagatgcggatagagtgagcctcaaattcgacagaatcaagtactggttatctgttggagctcaaccaacagacacagtggaaagcatgcttttcagggccggtttgataccaccaaagcctatggtagtggtcggttcgaaaaatgggcagaagtctacgagccaacatgtttcacccattacaggtgaaatcttgaactaagagtgttgatgcgttgagcaagaaagagccttttgtgtctgtgtgaaaggagtttatgtaatgttgtttaagacttttctgtttatgtgaaaggagttaatgtaatgttgtttaagacttttgctttctatgtgaaagcagtttaatgttatgttggttaagacgcg

SEQ ID NO: 3553 - DNA, 649 bp, Artificial
  Synthetic
cccgctaaaaccctcgcctttttctgagactcagagcggcggcgagcgccggccggtcgacggcggaggaattggtgtggagagggcggggagatggtggtccggatcaggctggcgcggttcggctgccggaacaggcccttctaccggctcatggccgccgacagccgctccccgcgcgacggcaagcacctcgaggtcctcggctactacgacccgctccccgggaaggatggtggcaagagaatggggttaaaattcgaccgggtgaagtattggctatcagttggagcacagccatcggatcctgtggagcgcatcctctaccgtgctggaattctacctccacctccaatgctagctatggcccacaagggtgggcctcgcgacagacgtcctattgatcccatgactgggcgccccttagaccttgagggtgtcacagttgttgatgattctcatactcccaagagtggtgatggagcacctaacgaggagacagcatagatgaggcatgatgatatatctgttttagcatattgtgtggttttgcaagattaaaaagtactgtttgtggcctttctgatgggtgtttgagcctgtgactagtatgttgtgacctttcttgctgaccggctttattgatcta

SEQ ID NO: 3554 - DNA, 615 bp, Artificial
  Synthetic
agggcggcggaggaggagggacggatgcggctccgctgacgctcgagctgctgcccaagggcggggccaagcgcgggttcgcggacgccatcgttgggggtcccgccggccagcggcgggaggcggccgggggcaaggcggcggcggcggcggcggcggcggaggccgaggaggaggaggagaagaagaaggcgcaggcgccggcggcgaaggcacaggtggtaggatggccaccaatccgcagctacaggaagaacaccatggcgatgagccagcctgctctgaaaggcaaagacgacggcgaggcgaagcaggctccggcatccggttgcctctatgtcaaggtgagcatggatggtgctccttacctcaggaaggtggacctcaagatgtacaagaactacaaggagctctctttggctctggagaagatgttcagctgctttaccgtcggtcatggtgaatcaaatgggaagtcagggagagatggattatctgattgccgcctgatggatcttaaaaatggaacagaacttgtgctcacttatgaggacaaggatgaagattggatgcttgttggtgatgttccgtggcgaatgttcacagacagctgta

SEQ ID NO: 3555 - DNA, 443 bp, Artificial
  Synthetic
cccacgcgtccgaacaacaaatcttaaacgttttactttgtgctgcactactcaacctcaatggccgcctcaacaatggctctctcctcccctgccttcgccggtaaggccgtcaagctttcccccgcggcatctgaagtccttggaagcggccgtgtgacaatgaggaagactgttgccaagccaaagggcccatcaggcagcccatggtacggatctgaccgtgtcaagtacttgggtccattctctggcgaatcaccgagctaccttaccggagagttccccggagactacggatgggacaccgccggactttcagctgaccccgagacattcgcaaggaaccgtgaactataagttatccacagcaggtgggccatgctcggagccctaggctgcgtcttccctgagcttttggctagaaacggagtcaagttcggaga

SEQ ID NO: 3556 - DNA, 767 bp, Artificial
  Synthetic
gccattacggccggggacagctaacttctctattacttcagccatcaaaaaacacttatttttccttattaaaccatggctgcttctacaatggctctctcttccacttcttttgccggaaaggcagtaaaactctcaccatcttcctctgaaatcaccggaaatgggaaagttatcatgaggaagactgctagcaagcccaagcctgtctcttctggcagcccatggtacggtcctgaccgtgtcaaatatttgggtccattctccggtgaatctccaagttacttaactggtgagtttcctggtgactatggatgggataccgctggactttcagctgatccagaaacttttgccaagaatcgtgagttggaggtaatccactgcagatgggctatgcttggagctcttggttgtgtcttccctgagctcttggctcgtaacggtgtcaagttcggtgaagctgtatggttcaaggctggatcccagattttcagcgagggtggtcttgactacttgggcaacccaagtttggtccatgctcaaagcatcttggctatttgggcttgccaagttattttgatgggagctgttgaaggttaccgtgttgccggtggacctcttggcgaggttgttgatccactttaccctggtggcagtttcgacccgttaggccttgctgaagacccagaagcttttgctgagctaaaggtaaaggagatcaagaacggcagacttgccatgttttccatgtttggattctttgt

SEQ ID NO: 3557 - DNA, 225 bp, Artificial
  Synthetic
gccattacggccggggatggagctgcaagattggaaagaggcattgaagtattgcagattaactatcccgggttatgagagagtttatccagaatgtcatcctttgctcggactgcaatattacacttggggaaaacttgaatggtggcttggtgagactgaggaagcttatagggcactagccaaggcagcagagatactgcgaattactcatggaacaaacac

SEQ ID NO: 3558 - DNA, 526 bp, Artificial
  Synthetic
agcgatggcaccaggtaagcagcgccgcgacgacaccaagagcaaggcggccaaggcggccttgtcggccaagagcgtcaagaatccggccccgaagatgcggcggaggaagatcagaacctccgtcacattccaccggcccaagaccctgaagcaggcgaggtccccaaagtatccccgcctgagcgcccccaaccgcgagaagctggaccactacaaggtgctcaagtacccgctcaccaccgagtcggccatgaagaagatcgaggacaacaacaccctcgtcttcatcgtcgacatccgggccgacaagaagaagatcaagaatgccatcaagatgatgtacgacgtccagaccaagaaggtcaatactctcatcaggcccgacggtttgaagaaggcgtacgtgaggctcaccccggacattgacgctttggatgtggcgaacaagattggcatcatctagaagagcaagcttaaaatcgggtttgtgtatcgctttaatgcaaagtttatggtttttttc

SEQ ID NO: 3559 - DNA, 720 bp, Artificial
  Synthetic
agcagcttctctcagggtttcacactgtacttaaccaaatggctccagctaaagctgatccgtccaaaaaatctgatcccaaggcacaggcagctaaggttgccaaggccgtcaagtcaggatcaaccttcaagaagaagtcacaaaagataaggacaaaagttacattccaccgacccaagactttgaagaaagatagaaaccccaagtaccctcgtatcagtgcacctggaaggaacaaacttgatcagtatgggattctaaagtatcccctcaccaccgaatctgcgatgaagaagattgaggacaacaacacccttgttttcatcgtggacatcaaggctgataaaaagaagattaaggatgccgtgaagaagatgtatgacatccagacaaagaaagtcaataccttgattaggcctgatgggacgaagaaagcatatgtgaggttgactcctgactacgatgcattggacgttgccaacaaaattggaatcatctaaactagttacctgtttagaattttacgagaatttaaaatcttggatttgggtttttagatacacttgaatggaagtgccttctatttttcattttcattttgtgttttagagacatgttttgttctgtataagagaaatcaactttaagctgcagttttctttctcgaaattctctgaatcctaacctgtcttcccaaaaccttaagagtcggagggg

SEQ ID NO: 3560 - DNA, 365 bp, Artificial
  Synthetic
cgcagttgatgtcaccaagaaagccgaccctaaggctaaggctttgaaagctgcgaaagcagtgaaatctggccaaatcgttaaaaagcctgcgaagaagatcaggacaaaggttactttccacaggccaaagacattgaccgttcctagaaagcctaagtacccaaagatcagtgctactccaaggaacaaattggatcattaccagatcctcaagtaccctctcactactgaatctgccatgaaaaagattgaagacaacaacaccttagtcttcattgttgacatccgtgctgacaagaaaaagatcaaagatgctgtcaagaagatgtatgacattcagaccaagaaagtcaacaccctca

SEQ ID NO: 3561 - DNA, 452 bp, Artificial
  Synthetic
aaaaatggcttcaagttccatagctcttttcttggctctcaatcttctctttttcacaacaatctccgcctgtggtagctgtactccgtgcggcggaggttgcccctctcccaagccaaagccaactcctaaaccaaccccaagccctagctctggctcgagcaagtgccctaaagacaccctcaagctcggtgtctgcgctaatgtgctcaacggcctcctggacttgacccttggcaagccaccggtcgagccatgctgcagcctcatccaaggactcgctgatgttgaggcagccgtttgtctctgcaccgctcttaaggctaacattcttggaatcaacttgaacctcccaatatctttaagtctactccttaatgtttgcagcaaacaacttcctcctggcttccaatgctaaaaaccatattgatatataatttaaatacacttat

SEQ ID NO: 3562 - DNA, 333 bp, Artificial
  Synthetic
ctcacaacctagctagctagtaaacagtattttctatataccaaaaatggcttcaagttccatagctcttttcttggctctcaatcttctctttttcacaacaatctccgcctgtggtagctgtactccgtgcggcggaggttgcccctctcccaagccaaagccaactcctaaaccaaccccaagccctagctctggctcgagcaagtgccctaaagacaccctcaagctcggtgtctgcgctaatgtgctcaacggcctcctggacttgacccttggcaagccaccggtcgagccatgctgcagcctcatccaaggactcgctgatgttga

SEQ ID NO: 3563 - DNA, 647 bp, Artificial
  Synthetic
gaggcaagggcagtgaaagttttggcgatggctcctccgaccaaaggtgcagttgcaaagacggattccaagggccaggctgtgaaggcggccaaagcactcaagtcaaatgtccatttgaagaagaaaaccaggaaggtgaggacttcggtgaccttccacaggcccaagaccttgaagagggtgcgcacccccaagtacccccgcctcagtgccccccaccgcaacaagctcgaccactacgaagtcctcaagtaccccttgaccactgaatctgccatgaagaagatcgaggacaacaacacccttgtcttcattgttgatctccgtgccaacaagaaacagatcaaggattccgtcaagaagatgtatgacatccagacaaagaaggttaacaccctcatcacgcctaaaggattgaaaaaagcatatgtaaggttgacggcagactatgatggcttggacgttgcaaacaagattggtattatttaatcaaggtattggactagaacccagggcgaatttttttctgtagtcttttagtcaaaagacctcgcgtgtactgggcttaactctacctgtggagggaagctatcaagtgaatttttggtaaagaagaggtctttcatttaagttgcaaaagctga

SEQ ID NO: 3564 - DNA, 541 bp, Artificial
  Synthetic
gataagtcgacaactcctcaaccgcacaggcgcctctccgtgcaaattcgacaccaagccgatacaatggcccccgctaacaagaaagctgccgccaagggctccaagcaggccaacgccgctgccaaggccgccctcaagggtactcactcctccaagaaccgcaaggtccgcctgaccacctctttccaccgccccaagactctggtcctgtcccgcgctccccggtacccccggaagggcatcaaacacgtcccccgtcttgatgagcacaagatcatcatccaccctctcaacactgagagtggcatgaagaagatggaggagaacaacaccctggtcttcatcgtcgacgtcaagggcaacaagggccagatcaagctgggcctcaagaagctctacgacattgacaccgtcaagatcaacaccctgatccggcctgacgggtccaagaagggctacgcccgcctgacccccgatgtcgatgccctcgacattggcgccaacaagctgtccctggtttaagctggataatttgttg

SEQ ID NO: 3565 - DNA, 597 bp, Artificial
  Synthetic
ttttctcaggtaagccaccctgttgggtttttagcactgtcctcagctatggctccagctaaagttgatttggccaaaaagaaagacaccaaagcccaggctgtcaaggctgccaaggctgttaagtcaggatcatcctttaagaagaagtcaacaaagataaggacaaaagttactttccatcgacctaagacattgaagaaggataggaatcctaagtaccctcgcattagtgcacctggaaggaacaaacttgatcaatacgggatcctaaaatatcctcttaccactgagtctgcaatgaagaagatcgaggacaacaatacccttgtcttcattgttgatatcaaagctgacaaaaagaagataaaggatgcagtgaagaaaatgtatgacatccagacaaagaaagtcaataccttgatcaggcccgatggaacaaagaaggcttatgtgaggttgacacctgactatgatgctttggatgtggccaacaaaattggaatcatctaagttgattacctagttttttaattttaatgtcaaacctgaaattttgcaaatgagctctttagaaacttttgaacaggaagtgcg

SEQ ID NO: 3566 - DNA, 532 bp, Artificial
  Synthetic
cgggagttctctgaggtttgcagtgtaggggcttagaactgtctcccatggctccagctaaagcagatgtggcaaagaaaggtgatcccaaagcccaagccgtcaaggctgccaaggctgtgaaatcaggatcaacctttaagaagaagtcaacaaagatacgaaccaaagtcacatttcatcggtccaagacattgaagaaggatagaaatcccaagtatccccggattagtgcacctggaaggaacaaacttgatcactacgggattcttaaatatcctctcaccactgagtctgcaatgaagaagatcgaggacaataatacacttgtttttattgttgacatcaaggctgacaaaaagaagattaaggatgcggtgaagaaaatgtatgatatccagacaaagaaagtcaataccttgatcaggcctgatggaacgaagaaggcatatgtgaggttgacaccagactatgatgctttggatgtggcgaacaaaattggaatcatctaaatgtattaaatggtttggat

SEQ ID NO: 3567 - DNA, 743 bp, Artificial
  Synthetic
atccagagcaatggcgttgcaaacgcagccggtagcaaatgcgtcacctcttcatgttcttcggtccgtatgcgtcctcctcctggccgcgtcggcgacggtggcggcgcggcgccacggcccggcggcgcccatcgccgggcagagcatgtacctggcgccgagctgccgcgcgcacacggcgtcgctgacggacttcggcggcgtgggcgacggcacgacgtcgaacacgacgccgtcccggagaggtaagttcaagaggcagccctgtgaagctccaatggctcctaaagctgctcctgccaagaagggtgatgccaaggcccaagccttgaaggcagccaaggctgttaagtctgggacagccaagaagacgaccaagaagatccgcacatccgtgacatttcaccgccccaagaccttgaagaagtctagggaccccaagtacccaagagtcagtacccctgggaggaacaagcttgatcagtaccagatccttaagtatccccttaccactgaatccgcaatgaagaagatcgaagacaacaacactctggtcttcattgttgaccttaaggctgacaagaagaagatcaaggctgctgtcaagaagatgtacgacatccaggcaaagaaagtgaacactctgatcaggcctgatgggaagaagaaggcttacgtgaagctgacaccagactacgatgctctcgacgtggccaacaagattggcatcatctaagtta

SEQ ID NO: 3568 - DNA, 637 bp, Artificial
  Synthetic
caagaggcagccctgtgaagctccaatggctcctaaagctgctcctgccaagaagggtgatgccaaggcccaagccttgaaggcagccaaggctgttaagtctgggacagccaagaagacgaccaagaagatccgcacatccgtgacatttcaccgccccaagaccttgaagaagtctagggaccccaagtacccaagagtcagtacccctgggaggaacaagcttgatcagtaccagatccttaagtatccccttaccactgaatccgcaatgaagaagatcgaagacaacaacactctggtcttcattgttgaccttaaggctgacaagaagaagatcaaggctgctgtcaagaagatgtacgacatccaggcaaagaaagtgaacactctgatcaggcctgatgggaagaagaaggcttacgtgaagctgacaccagactacgatgctctcgacgtggccaacaagattggcatcatctaagttagggtgctgcagtagtcttttgtgtcctggtctctatgtgattggagttttgtagctattacttagcgaatgcctcagtggctaagttatcactattttgctgcacacttccatgaatttgatataatgcaagtgacttatcgtgagcta

SEQ ID NO: 3569 - DNA, 621 bp, Artificial
  Synthetic
gctccgccgccgccaaccccaccgcggcgagctccgccttccgccggccgcgatggctcccaaggccgctgtaaagaaggctgatggaaagactcaacaagccttgaaggttgccaaggcagtgaagtctgggtcaatcaagagaaagtcaaagaagatccgcacttcggtgacatttcacagaccaaagaccctgaagaaggcgagagaccctaagtacccaagagtcagtgcacctggcaggaacaagcttgatcagtaccaaatcctcaagtacccccttacgaccgaatctgccatgaagaagattgaagacaacaacacccttgtcttcatcgtcgacctcaaggcagacaagaagaagatcaaggcagctgtcaagaagatgtatgacatccaggcaaagaaagttaacactctgatcaggcctgacggcaagaagaaggcttacgtgaagctcactccagactatgatgctcttgatgtggccaacaaaattggcatcatttaagttagggcgctttttttcatcatgttgaacgtaagattttggttggctagttcttaatgttgaacagaaccttataacttgcaaaagaacatcttgagttttgttgagcg

SEQ ID NO: 3570 - DNA, 582 bp, Artificial
  Synthetic
ccccccctccactactacgaatcgccagccgccacaccgagctccgccgccgccaaccccaccgcggcgagctccgccttccgccggccgcgatggctcccaaggccgctgtaaagaaggctgatggaaagactcaacaagccttgaaggttgccaaggcagtgaagtctgggtcaatcaagagaaagtcaaagaagatccgcacttcggtgacatttcacagaccaaagaccctgaagaaggcgagagaccctaagtacccaagagtcagtgcacctggcaggaacaagcttgatcagtaccaaatcctcaagtacccccttacgaccgaatctgccatgaagaagattgaagacaacaacacccttgtcttcatcgtcgacctcaaggcagacaagaagaagatcaaggcagctgtcaagaagatgtatgacatccaggcaaagaaagttaacactctgatcaggcctgacggcaagaagaaggcttacgtgaagctcactccagactatgatgctcttgatgtggccaacaaaattggcatcatttaagttagggcgctttttttcatcatgttgaacg

SEQ ID NO: 3571 - DNA, 702 bp, Artificial
  Synthetic
aggtcttctttggatccagcaagggaagaaggtaggaaggtaagtgtcaaaggttcagccggactccagcgatggctcctccgacaaaaggtgcagcggcgaagacagactcgaaggggcagaccactaaggctgccaaggctgctaaggcactgaagtccaatgtccatctgaagaagaagacacggaaggtgagaacttccgtcaccttccacaggcctaagaccctgaaaaggactagaacccccaagtaccctcgtgcgagtgccccacaccgcaacaggctggaccattacgaggtccttaagtaccccttgaccacggagtctgccatgaagaagattgaagacaacaacactctggtcttcattgtggacctccgtgccaacaagaagtccatcaaggatgccgtcaagaagatgtacgacatccagaccaagaaagtcaacaccctcatcacgccgaaaggattgaagaaagcttatgtaaggttgacagctgattatgacggtttggacgtggctaacaagattggtattatttaaattagatttgattagaatagagttggttatatgtctttctcaaggcttctggttaaactaaattgagtctgtacccagacttaactccctttggaggaaagtatcaagtgaatttttggcaatattattattagagtgctcttatgtttttaggtgc

SEQ ID NO: 3572 - DNA, 842 bp, Artificial
  Synthetic
cttgtcctttttggggataaaaacaggttagcccagatttgtatggagataacaacacaagactctttacctactggactagtgatgcttatcaagccacaggctgctacaatctgctatgttcaggatttattcaaatcaataatgaaatagcaatgggggccaccatttcccctctttccagctatcatggttcacaatatgatataagcattcttgtctggaaggatccaaaagagggaaactggtggatgcaatttgggaatgactatgtattgggatattggccaggctttttattttcatatttaacagacagtgcttcaatgattgaatggggtggggaagtggtgaattcagaatcagatggacttcacaccacaactcaaatggggagtggccattttccagatgaaggttttgggaaatcaagctatttcaggaatatacaagtagttgatggttcaaataatttgagagctcctcaagatcttgggatttatactgaggataacaattgctatgatgttcaactaggaaagaataatgactgggggaactacttttactatggtggacctggtagaaattctaattgtccatgaccaagattctaaatgttttttacttaattctttcactcttttaatgtagtaaaactggtaatgtagacattgagtcctttgtatggtcattgttttactctttgtaaaacttttgtttttaggggctaagttagtgcgcaacaaaatgtgtatcattgttggtctttgtgtgaaaagtttttcacctttctttttagacctccagtctctaaataaaaatattgttggggacaaaat

SEQ ID NO: 3573 - DNA, 282 bp, Artificial
  Synthetic
ggcattaccggcgccgggactgcatgctgtgcacacgcgggatatgctgatcgagcaatacctatccaaattcactaaccacagatctaatcaaactgatagctatcagcagggctctaaacagcttaaaaggcggatccaatgctaaatcaatagttcttctgtagcttaattttatttgatgataactgagtatcatttggggttagtagattgttgtattctccccttaaaatatgcgataacaattttggttttaatatatgggatatgcaattttag

SEQ ID NO: 3574 - DNA, 710 bp, Artificial
  Synthetic
gagtcgacagcgatcacaaaagggcgattttcatctcagctgttcaatcgatttcaggcagcttgcgcacacctttactattactcttgtgtacttgctgcctccgatacaagtaaccagtaacttgagctatgggaaagaggaagtcaaagtcaaagccacctccaaagaagaggatggacaaacttgatactgttttcagctgtcctttctgtagtcatggcaccagcgtggaatgtcgcattgatatgaaaaacttgattggcgaggcgaattgcaggatctgccaagagagcttcagcaccacagtcactgcactaacagagcctattgatatatacagtgaatggattgacgagtgtgaacgagtcaacaactatgaagaagatgatgtttcctacaagttagatcctaacgaatgatctgcttcaagattgtgcagcttgttgagtagccagaaatgatttaaagctaccttaagcttgacttcaattttggcaattattcgtcacactgcctaagaagaacctaaacttatccaggcctctggagtccaataagtagctccatttaagaggctttctatgtccaaatagtttgaaacagagtcagttgctatcttgtttatgttatgcccctgcaattatagcttgcttatatgagactggcttaatgatgtgaacctaatgttaagtaggtttatttctccc

SEQ ID NO: 3575 - DNA, 709 bp, Artificial
  Synthetic
  misc_feature (504)..(504): The residue at this position can be any nucleotide.
aagatattaacaactgtgtgctcagataatcccgttgagaatcaatcagtcgggttccaaaaaatggagtccgaactccaaaaattaccacctaaaactacccaaacaacacaacccgaatccgtggacgaaagttcccttaccaaagacgatcgtccacttctcaaacccgacccgactagccctcaactccaagttcaatcccagtcttctagttctaaccctaacatcgaagaattagacaagaaatacgccccatatgtgaggcatgacgtgtatggagtaatgggccggggcgagttgccctggaccgagaaggttcttttgggtattgcgctcgtgacggttgtacctatgagagttgttggggcaatgactatattggttgtgtattacttgatttgtaaggtttgtacagcgttttcggcaccgaatcgagaggaagaggaagagcaagaggattatgcgcatattggtgggtggagaagggttgtgatgatgcanagtgggatgttcctttcgagagtaatgcttttcgtttttggattctattggattagcgaaacttattgccccattgatctcaatagcaactcaaataatgagcatggatcaaacgatcaggctgaagaacttgaaagaccaggggctattgtgtcaaatcacatttcgtacttggatatcttgtatcacatgtcttcctcatttc

SEQ ID NO: 3576 - DNA, 539 bp, Artificial
  Synthetic
atttcttgagtttgtgttgatacagatttgagattgctttcgcaagattgctttcttgtgaaagggtgaaggagaattattatgtttggttacttgtgtttaaaggtaccaatggataagacgaaaaggaaaacctgcaccaagggagatagctcccgttgttgtatctaatcatgtctcttacatagaacctatcttctttttctatgagttatttcctaccattgttgcttccgagtcccatgattccatgcctttcgtcggaaccattatcagagctatgcaggtgatatatgttaatagattctcccccacttcgaggaagcatgctgttagtgaaataaagagaaaagcttcttgcaatcaatttccccgagtgcttttatttcctgaagggactacaaccaacggaagagctattatttcctttcaacttggtgcatttatccctggctatcctatccagcctgttattgtgcggtatccccacatacactttgaccaatcatgggggaatgtttcccttggaatgctgatgt

SEQ ID NO: 3577 - DNA, 307 bp, Artificial
  Synthetic
gaggccattacggccgggaagcctaaaggtggattaaaggaggcattgaaagttgaccctaataaagtaagacgactaagtgtaagtgaacaggctttcgaaaaggctgccgaatctcatgggatggaaattgtgaggttcacgcaaagaaacattttaagggtgtatcctaaaggtactaggtttaactcatccaactacaagccactaattggttggatgcatggagctcagatggttgcatttaacatgcagggatacggtagagcgctatggttgatgcatgggatgttcgggtcaaatggag

SEQ ID NO: 3578 - DNA, 420 bp, Artificial; identical to SEQ ID NO: 1138
  Synthetic

SEQ ID NO: 3579 - DNA, 431 bp, Artificial
  Synthetic
ttcacgctggtggcgagaaagttcctcaaggtgcaagtccggccgtatatccccgacttcaagaaggcgtttgagcacttttgcatccatgccgggggtagggccgtgttggatgatctgcagaagaatatggagctcacggactggcatatggagccgtcgaggatgacgctgttcaagtgggggaacacttcgtccagctcgctgtggtacgagcttgcatactgtgaggccaagggacgcatcaagaagggggacaggatctggcagattgctttcggatctgggttcaagtgcaacagtgcggtgtggagggcgtgcatggcggtggacggaaaggaagtaaacaatgcgtggtcggagtttgtaaacacgggtgatgtttgagatcactgcaatatattaatgccatgaatttatgcttagtttct

SEQ ID NO: 3580 - DNA, 358 bp, Artificial
  Synthetic
caggagcttcaatctttcggggatgggctgcagcgcgggcctgatctcagttgatctagcccgcgacttgctccaagttcatcccaattcaaatgcaatcatcgtcagcacggagatcataacgcctaattactatcaaggcaacgagagagccatgttgttacccaattgtctcttccgcatgggtgcggcagccatacacatgtcaaaccgccggtctgaccggtggcgagccaaatacaagctttcccacctcgtccggacacaccgtggcgctgacgacaagtctttctactgtgtctacgaacaggaagacaaagaaggacacgttggcatcaacttgtccaaagatctcatg

SEQ ID NO: 3581 - DNA, 369 bp, Artificial
  Synthetic
aagagcttcaaaagaatctaggcttgagtgaagagaatatggaggcttctaggatgacacttcacaggtttggaaacacttctagcagtggaatctggtatgagttggcttacatggaggccaaggaaagtgttcgtagaggcgatagggtttggcagatcgctttcggttctggttttaagtgtaacagtgtggtgtggaaggcaatgaggaaggtgaagaagccaaccaggaacaatccttgggtggattgcatcaaccgttaccctgtgcctctctaaattatcattcttctaaattaaatcaagtaagatctctaattactccaaccaaaagatacagtttggttggatgataggagttatttac

SEQ ID NO: 3582 - DNA, 490 bp, Artificial
  Synthetic
acccacgcgtccgagctatgcattatgttccaccgagaatttcaatggctgctgctagagaagaagctgaacaagtcatgtttggtgctttagataaccttttcgctaacactaatgtgaaaccaaaggatattggaatccttgttgtgaattgtagtctctttaatccaactccttcgttatctgcaatgattgtgaacaagtataagcttagaggtaacattagaagctacaatctaggcggtatgggttgcagcgcgggagttatcgctgtggatcttgctaaagacatgttgttggtacataggaacacttatgcgggtgttgtttctactgagaacattactcagaattggtattttggtaacaagaaatcgatgttgataccgaactgcttgtttcgagttggtggctctgcggttttgctatcgaacaagtcgagggacaagagacggtctaagtacaggcttgtacatgtagtcaggactca

SEQ ID NO: 3583 - DNA, 380 bp, Artificial
  Synthetic
cccagcgtccgacgcagaagaaaccggcaaaatcggagtgtccctctctaaaaacctaatggcgatagctggagaagctctcaagacaaacatcacaactctcggaccactagttctaccaatgtccgaacaacttctctttttcgcgactcttgtggcccgaaaagtcttcaaagtcaagaaaataaagccttacattcctgatttcaagctagctttcgagcatttctgtatccacgcgggaggtagagccgtgctcgacgagattgagaagaacttggatttacccgaatggcacatggagccatcgaggatgacgttgaaccggtttggtaacacttcgagtagctcactttggtatgagcttgcgtatagtgaag

SEQ ID NO: 3584 - DNA, 376 bp, Artificial
  Synthetic
aataatcaagaggcgtcacattaagagtacaagagcttaaccagaaaagaaaaaaaataaacaaggcagagtctagtaagactaggactaaccaaacaaatggtttttcattaaatcaaaagtcgagcttaaccggatatcggtcgatgcagggttcccacggactactaaccgaaggcttgacattgtttaaagccacccaaactgcactgttacacttaaacccacttccaaaagcaatctgccaaacccggtttcctttcttcatcctacctttagcctctatgtaagccagttcataccaaatcgagctcgaaaaagtgtttccaaatctgggcagggtcattctggatgcctcgacatgagtctgcaaaag

SEQ ID NO: 3585 - DNA, 562 bp, Artificial
  Synthetic
tagcgataaatatcgtgcaaagtattttcaagaatgagaagaacaaggttgcacttatggtaacatctgagtccttgagtccaaattggtacacagggaataatagatctatgattcttgctaattgtttgtttagatcaggagggagtgcaattctcttgacaaacaaagtggctttaaaaaataaggccatgttcaagttgaaatgcctagttagaatacaccatggtgcaaaagatgaagcttatgatagttgcatacaaaaagaagatgatcaaggtcacataggtttccaccttgataaaacattaccaaaggccgcgacaaaggcactagtcgataatttgaaaacaattgcacccttaattcttccagtgagagaattacttagatttgcaattgtgtcacttgttagaaaaatgaattggggttcaacaaaatgaggagctaagccagtaatcaatttcaaaacacgtgtggatcatatttgcctacatacaggaggaaaagcactaattgatggagttgggacaaatttgaatctaagtgagtatgatttaga

SEQ ID NO: 3586 - DNA, 564 bp, Artificial
  Synthetic
tggtatgaacgcagagtggccattacggccgggtaccaatcttgtgttttttataggactgactgcccttgaactgttgatttaacttacctccccgaagcagtgactcaggtaccgccaaatccttgtatggcagaagcaagaaaagaagctgaagctgttacgtttggagccatcgacgagcttcttgctaaaacctctgttaaacctaaggatattggaattttagtagtgaattgcagcttgtttaacccgaccccctctttgtctgcgatgattgtcaaccattacaaacttcgggggaacattgttagttacaatctcggtggaatgggttgtagtgctggtttgatctcgattgatcttgcgaaagatcttcttcaagttcatcccaacacttatgccttggttcttagcatggaaaacatcactttgaattggtattttggtaatgagaagtccatgctccttccaaattgcttattccggatgggaggtgctgctgtgttgctctcaaacaaaagatccgatcgaagaagatcaaagtatcagctggtccatact

SEQ ID NO: 3587 - DNA, 1195 bp, Artificial
  Synthetic
gcgtccggacttatataccagtagataaatggattccatcaaatttttctcttagtagtaatcaacatcaagctaaattggttattgttggtgccatagacgatctgttggcaaaaacaggagtgaaaatcagagagatcgggattgttgttgttaattctagtatgtttaatccaacaccttctctttctgctatgattgtcaaccattataagcttggagttaatgtgattacttataatcttggtggcatgggttgcagtgctggacttatttctgtggacctagctaatcggcttttacaggggaaagcaaacacctatgcacttatagtaagcacggaagtagtctcaacggccttctatacagggaaagacaaatcaaagctaataccaaatatgattttccggatgggtgcttctgctgttctcctttcgaaccgtttctcggatcgttggcgctcaaaatatcaactgatgcatgttgtccgcacccataaaggtgcagatgacagagcattcggttgcgtctaccaagatgaggaagaggatggaaaaaaaggcatgtcattgtcaaaagacttaatggcagtagctggtgaggccttaaaaacaaatattactactttgggccctctagtcctcccaatgtccgagcagctcctatttttcgtctctttaatcgcgagaaatgttcttaaaaggaaaataaagccatatatccccgatttcaagatggcattcgagcatttctgcattcatgcaggggggagggccgtgttggacgagcttcagaagaatcttgatctcacagaggaacttatggaaccttcaagaatgactctttataggttcggaaacacttcaagtagttcagtgtggtataatttggcctactctgaggccaaagggaggataaagaagggtgacagagcatggcaaataggttttggctcaggattcaaatgtaacagtgctgtttggcgcgcgctaaagaccgttgatgcagccattgaaaagaacgcgtggacggatgagattgaggatttccctgttcaaatcccgtattgatgatcagtactgaaaccataaaacacattcaaaatcactctagtatatttgtatatgggattgtgcacctaattttgaacaagcgaggaatctggaattaataaatttaagtaagatggggggca

SEQ ID NO: 3588 - DNA, 585 bp, Artificial
  Synthetic
cccacgcgtccgggtgctccgcgggcgcgccaagatggagctcggctgcctcgtgcgcgccaacatcgccgccaacgacgacgcccacgcctgcgcgctgcagcgggaggacgacgacggcaccgtcgggatcagcctcagcaaggcgctccccaaggccgccgtccgcgccttcgccgccaacctccgccgcctcgccccgcgcatcctccccatcaccgagctcgcccgcttcgccgcccagctgctcatcaccaagaagctcctccgccgccgcgccaccgccgccaccgccaccaagcacaccggcggcgacgggcccaggatcaacttcaagacgggcgtggaccacttctgcctccaccccggcggcacggccgtgatcgaggccgtgaagcgcagcctgggcctcgacgacgacgacgtggagccggcgaggatgacgctgcaccggtgggggaacacgtcggcgagcagcctgtggtacgtgctgtcgtacatggaggcgaaggggaggctgaggcggggcgacaaggtgctgatggtgacgttcgggtcggggttcaagtgcaacagctgcgtgtg

SEQ ID NO: 3589 - DNA, 492 bp, Artificial
  Synthetic
ggggaacccggcgggacatgatgctgcccaactgcctgttccggatgggcgcggcggcgatcctgctgtcgaacaggaggagggaggcgaggagggccaagtacaggctgatgcacgtggtccgcacgcacaagggcgccgacgaccgcgcgtaccggtgcgtgtacgaggaggaggacgagcaggggcactcggggatctcgctgtccaaggagctgatggccatcgccggcgacgcgctcaagtcgaacatcaccaccatcggcccgctggtgctgcccatgtcggagcagctgctcttcttcttccgcctcgtcggccgcaagctcatcaacaagaagtggaagccgtacatcccggacttcaagctggcgttcgagcacttctggatccacgccgggggacgcgccgtgatcgacgaactgcagaaaaacctggacctgtccgcgcaacacgtggaggcgtcccgcatgacgctgcaccggttcggca

SEQ ID NO: 3590 - DNA, 298 bp, Artificial
  Synthetic
ccttgggcacctcgacggggaagctgtcgatctcccccgcccacgggttgcgctcgtcggcgtcgggctcgacggtgcggagcgccctccacacggcgctgttgcacttgaacccggagccgaacgcgatctgccacgccgtctgtccgcggcggacgcggcccttggcctcggcgtacgcgagctcgtaccagagcgagctgctcgacgtgttgccccaccggtagagcgtcatccgcgacggctccatgtgccaggcgccgaggccgaggttcttctcgatggtgtcgagcacggc

SEQ ID NO: 3591 - DNA, 250 bp, Artificial
  Synthetic
cccacgcgtccggggaataagaaggctatgttgattccgaattgtttgtttcgtgttggtggttcggcgattttgttgtcgaacaaggggaaagatcgtagacggtctaagtataagcttgttcataccgttaggactcataaaggagctgttgagaaggctttcaactgtgtttaccaagagcaagatgataatgggaagaccggggtttcgttgtcgaaagatcttatggctatagctggggaagctc

SEQ ID NO: 3592 - DNA, 636 bp, Artificial
  Synthetic
cccacgcgtccggttaactgcagcttgttttctccaactccatctttatcagctatggttgtgaacaaatacaagttgagaagtaacataaaaagttacaatctttctggtatgggatgtagtgctggtttaatctccattgatttggctagagaccttcttcaagtgcttccaaattcatctgctttagttgtaagtactgaaattataacacctaattattaccaaggttcagaaagagcaatgcttttgcctaattgtttgtttagaatgggaggtgctgctatacttttgtcaaacaagagaaaagacagcagtagagctaagtacagattaatgcatgtggttagaacacataaaggtgctgatgataaagcttatagatgtgtgtttgagcaagaagatccacaaggaaaagttggcattaatctttctaaagatcttatggttatagcaggagaagctttgaaatccaatattactacaattggtcctttagttctccctgcctcagaacaacttcttttcctttttactcttattgggaggaaaatatttaaccctaaatggaaagcttatattcctgatttcaagcaagcttttgaacacttttgcatacatgctggtggaagagct

SEQ ID NO: 3593 - DNA, 556 bp, Artificial
  Synthetic
aaaacaatcagcattacataataatgagtgaatttctaggataaatcatgaatacgaaatagtacacatgaatatcaactgacagatattcagcaaattaccccctcaactctaaattaatgaccctaaactcaatatccaagaaacatcaaaatgagaagaacacttacttgatggatcctcattacaattgaaagcaagtagaattccctatcccagcttctcaatagaaattacatcagctaaagactagctttcaaatcacaaaaggaaacgactgaacagcacatgccaacagataaagaataattccccaaaaattttgggaacactaagctaaatgaaggattgttagatttttgcaacccttgggacatcgacagggaactggtcgatctcatccatccacgggttcttctccttggctggattaattgaccgtaaagctttccaaactgcactgttacatttgaaacctgaaccaaatgctatctgccaagttcggtctcccctcttgatccttcccttagcttccgagtaggccaattcataccaa

SEQ ID NO: 3594 - DNA, 533 bp, Artificial
  Synthetic
gagatgaaaaagaagaagagaaattaagttgcatgatggagttggaaaagcaagggaaaatagtaccatggtgttcacaacttgaagttctaacacatccgtcattaggatgtttcgtgtcgcattgtggatggaattcgactctggaaagcttatcgacgggtgtgcctgtagtggcatttcctcattggacggatcaagggacaaatgctaaattaattgaagatgtttggaagataggtgtaaggttgaaaaagaatgaagatggtgtggttgagagtgaagagattaaaaggtgcatagaaatggtaatgaatggtggagaaaaaggagaagaaatgagaagaaatgctcaaaaatggaaagaattggcaagggaagctgtaaaagaaggtggatcttcatatatgaatctaaaagcttttgttcaagaagttggcaaaggttgttgacatctatctaattaagcaattgttttcctatttgtaatttgcttcttttttcctaataaagtttagagttcaacttctaaa

SEQ ID NO: 3595 - DNA, 648 bp, Artificial
  Synthetic
attcgaccacagtcaccacagatcttcttccttcccgagacgccaggaaacgccgggagaaagcatgggttctctgggagcagcaggtaagccgcacgccgtgtgcatgccgtacccggcgcaggggcacatcaccccgatgctgaacgtggcgaagctgctccacgcccgcggcttcgacgtcacgttcgtgaacaccgagtacaaccacgcccgcctcgtccgcacccgcggcgaggccgcggtggcgggcgcgccgggcttccggttcgccaccatccccgacggcctgccgccgtcggacgacgacgacgtcacgcaggacatcccgtcgctgtgccgctccaccaaggagacctgccttgcccccttccgccgcctcctcgcccagctgaatgaccccgccacgggccacccgcccgtcacctgcgtcgtctccgacgtcgtcatgggtttctccatggctgccgccaaggagctcggcctcccctacgtccagctctggacagccagctccatcagctatctcggataccgtcactaccgcctcctcatggaacgtggccttgccccactcaaagatgtcgatcagctgacgaatggataccttgacacgccggtggaagacgtgccggggctgaggaacat

SEQ ID NO: 3596 - DNA, 372 bp, Artificial
  Synthetic
gtcgagccacgcgtccgggcctggctggaggcgaaaccaccgcgcaccgtggcgtacgtgtccttcggcagcgtggcgacgccgagcccggcgcagatggccgaggtggcggagggtttgtacaacaccggcaagcccttcctctgggtggtgagggcatcggaaacctccaagataccggaaggcttcgccgccaaggcggggaagcaagggagagggctcatcgtgacgtggtgcccgcagctggaggtgctggcacacccagctgtggggtgcttcgtgacgcaatgcgggtggaactcaacgacagaggggttgagtgccggtgtaccaatggtgggggtaccgcagtggtcagaccacacaatgaat

SEQ ID NO: 3597 - DNA, 397 bp, Artificial
  Synthetic
cccacgcgtccgaaaatacaaatcgactttcatattttctctgcataagagagaaagaaaatgggatctcatgtcgcacaaaaacaacacgtagtttgcgttccttatccggctcaaggccacatcaacccaatgatgaaagtggctaaactcctttacgccaaaggcttccatattaccttcgtcaacaccgtctacaaccacaaccgtctcctccggtcccgtgggcctaacgccgttgacgggcttccttctttccggtttgagtccatccctgacggtctacccgagactgacgtggacgtcactcaggacatccctactctttgcgagtccacaatgaagcactgtctcgctccattcaaggagcttctccggcagatcaacgcaagggatg

SEQ ID NO: 3598 - DNA, 649 bp, Artificial
  Synthetic
gggtgctagccctcctcatcgacctcttccgtcggcccgccgtcccagccgggatccttctgacgccgccgcccgacctcgccgccgccgacgacgacgacgtcgacggcggaagctcagctgaccgtgccgagacgctccggtggctcgacgagcagccgaccaagtcggtcatctacgtggcgctggggagcgaggcgccggtgacggcaaagaacctgcaggagctcgcactggggctggagctcgctggcgtgcgcttcctgtgggcgctccggaaaccggcggcgggaacgctgagccacgcctccgccgccgacgccgacgagctcctccccgacgggttcgaggagcggacgcgcgggcgcggcgtggtgtggacggggtgggtgccgcaggtggaggtgctcgcgcacgccgcggtgggcgcgttcctgacgcactgcggctggggctccaccatcgagagcctcgtgttcggccacccgctggtgatgctgccgttcgtcgtcgaccagggcctcgtcgcgcgggcgatggcggagaggggcgtcggcgtggaggtcgccagggaggacgacgacgagggctcgttcggccggcacgacgtcgccgcggcggtgcggcgcgtcatggtggaggatgaacg

SEQ ID NO: 3599 - DNA, 670 bp, Artificial
  Synthetic
gaaagagatgcttcctcttgcctaccgaacacccaacgcatttaccacgaatctggcagttgcagcgaagcgaacgaaaactgccgcatgccttcttatcaacacgatcgaagagctggaccagaaactcgtggacgtgcgcaggtccgagttttccagctacttagcagtcggacctctggtgtcccaagcgctactacaagaacaggatactgcagtcagttccacaagtgacgattctctgagctggttggacaagcacgctcaccgttcgattctctatattgcctacggaagcgttgtgtccctgaaagttagcgacgcccagaagatagcggaagctgtgaaagcaagtcgtcagccggttttgtgggcagtaagacggaagttcgcaggcgacgtacctgagaacttctacgaaagcttgcaagaaagagctgggacgcaagctttgatcgtggaatgggctccgcaagtggctgtgttgcgccaccctgcagttggggccttctggacgcactgtggatggaattcggctctggaagccttgtgcacgggagtaccgatgctttgctggccctgcgaagccgatcaaaacgtcaatgcaaacacgatagtgaccaattggagaactgggatgatggcgagtaatggaccacaagatgacgcg

SEQ ID NO: 3600 - DNA, 640 bp, Artificial
  Synthetic
  misc_feature (540)..(540): The residue at this position can be any nucleotide.
ggcagttcgaggagatgtcggcaggactcgaagagctccggaagccattcctttgggccattcgtccgaagtcggtgaacaacttggaaaccgaggctttcgaagccttcaaggcgaaagtgagcagcttcggactggttgtgacctgggctcctcagctggaaattctccgccatccttcaactggcgggtttctaagtcactgcggctggaactcgaccatggagagcatctgcggcggcgttccgatgatctgctggccctgcgtcgcggagcagaatctaaactgcaaactggtggtggaagattggaagatgggactgagattctcaaatgtagccacacgaaaactcgtctccagggaagagtttgtggaggtggtggcgacactgatggacggacacagcggggttgtgatgaggaaaaatgcaaagaagctccaggaagcagcacacaaaacagtctccaagggtggttcctcgtataagaatcttggaaatttcgtggacgccatgaagagcatcccttcttagttctttnttattctcgattcattcttgattcaactactatccgaatttatatttttttaaacacttcgataagttggtccaggaatagtttgttttctcgtatgatg

SEQ ID NO: 3601 - DNA, 243 bp, Artificial
  Synthetic
cccacgcgtccgatttggcagatgagagttacttaaccaaggaacacttggacacaaaaatagactggataccatcgatgaagaacctaagactaaaagacatccctagcttcatccgaacgactaatcctgacgacatcatgctcaactttatcatccgtgaggctgaccgagccaaacgcgcttcagctatcattctcaacacgtttgatgatctcgaacacgacgttatccaatctatga

SEQ ID NO: 3602 - DNA, 651 bp, Artificial
  Synthetic
gaagaataacttcatcccgtacatcgatggtgttccacagctgcgagcgagagagcttccgctcgggctccatgacggttgccccgacaacttgaaagaggtcatgaagaggaacctcagctcttcctgggtggtgatgaacactttcgacgagatggaaaaagaagccatcgctgcagcccacaagtacgtcgagcacaagctagtagtggttggtcccctgctcccgagcacttgctctcctttcgggaacgacgcgagtcgaccaatcctcaagtggctggacaccaagagtagtgcctcagtgctatacatctcatttggaacagtggcgggaatagcatcgatgaagccgatcgaggagctggccaaaggcctggaggttagcggcgtggactttgtatgggtgtttagaagcaacctcgtcgaggacaagcaaggtgagcagcagttcatggaagagttccgggacagaacacaagcttccggaagaggactgatcgttccctgggcaccgcagctccaggtgctgcagcacgacgcggtcggggggttcctctcgcactgcggctggaactcagtcctggagagcatctggagcggagttccaatgctgggatggccatgcatcgcagagcagaatctaaacta

SEQ ID NO: 3603 - DNA, 691 bp, Artificial
  Synthetic
cgcgtcgcggacgcgtgggtcgatggaatcgagaggcctgcgatcgattctctcaggggcagcggcgtggaggtcagctccatcgggcccttgcatctcctgtcggagaaactcggggcgattgatccgcgaggaggagacgatcgccgaagaatcgagagcgacggaatcgtccagtggctggacaagaggcccgattccagcgtcatctacatcgcatttggcactacgatggcgatggcagatgggcaattcgaggagctggcggaggctctggaggaatcgcggcagagtttcgtgtgggcgacgagggatctgtcactgcttccacccggattccaaggcagaatgtcggagctggatcaagggctggtggtgtcctgggcacctcagctggagattctggggcaccgatctaccggtggatttctgacacactgtggctggaattccgtgctagaatccatgtcatttggaatgcccatggtgacaaggcctatcactggagaccaagttctcacggcaaagtttgtggtcgacgagtggggtattggttttggtgtgaaggggattgagattgggctggaggtggcccgcaaggatgacctccagaagtcaatcagggctcttatggaagctgatccagaaaccagcaaggtatggaaaaatgcgaggcgcatcaaggaaatgg

SEQ ID NO: 3604 - DNA, 329 bp, Artificial
  Synthetic
cccacgcgtccgtgctgaaggtggagaacagaccactctagaagctgatgtggtcctcgtctcagctggtagaactccgttcacatctggacttgatctagagaaaatcggagttgagacagacaaaggcgggagaattctggtgaacgagagattctcgacaaatgtttcaggcgtttatgcaattggagatgtgattccaggaccaatgctggctcacaaagccgaagaagatggtgttgcatgtgttgagtttatagcaggcaaacacgggcatgtggattacgacaaagtccctggggttgtctacacgtaccctgaagttgcgt

SEQ ID NO: 3605 - DNA, 872 bp, Artificial
  Synthetic
cccacgcgtccgggctaatgttgatacaacaattctcaggaagtgctgctgtaatctcttatgcaagtaccatttttagaaaagctggtttttcggtggccattggaacgacgatgctaggtatcttcgtgattccaaaagccatgattggcctcattcttgtcgataaatggggcagacgtcctctcctgatgacttcagcgtttgggatgagcatgacttgcatgctacttggggtcgccttcacattacagaaaatgcaattgctttcggaactaactccaatattatcgtttatatgcgtaatgatgtatattgcaacttatgcaataggcttgggaggtctaccttgggtaattatgtcggagatatttccaataaatataaaagtaactgcaggaagtatagttacgttagtctcattttcaagtagttcaatcgtcacttacgctttcaactttctgttcgaatggagcactcaaggaacgtttttcatattcgcgggtatcggtggagcagcgttgctttttatatggttgctcgttccagaaacgaaaggattatcactcgaagaaatacaagtttcacttattcatcagcccgatgaaagaaatcaaacttaatttgaattattttattttattataaaaatgatcaaattcagtttatggtgttatatttgtttatttacaaacaaggatttttttttttcattatgtaattactactttatttttctgggtaattagccccatttttatgatgtatatttacgagatgtaaaacttggcctacgtacatgtgtattttatctctaaaattgcaaatgtaatatttttcggacatatattaaagaagagattgatttcaaa

SEQ ID NO: 3606 - DNA, 656 bp, Artificial; identical to SEQ ID NO: 1012
  Synthetic

SEQ ID NO: 3607 - DNA, 605 bp, Artificial
  Synthetic
  misc_feature (432)..(432): The residue at this position can be any nucleotide.
aaatctttctctctttctctctaattctttactgactacttcttttagttcagttgctaaaacacaaggtaaggatatggcgcttgaagctttgaactctccaagaaccccaaccccaccatcatttcagtatgaaaacaccactctcaactaccttgaatcttggacaaagggtaagagatcaaaaagacaacgtagtattatggaacaacagcctactgaagaagaatacttagctttctgtcttcttatgcttgcacgtagcggtaattctactacttcaacgaaacagatatcaccttcctcagagtccaagaatttatacaagtgttcagtgtgtggtaagtcttttggatcttatcaagctctaggtggacataaagctagtcaccgtaaacagctcattaacggagacgtcaatgaaaactccgncaccaccttcactaccaccgctgttgccacgtcagctaacggccttggtgggaagattcacgagtgttctgtttgccacaagagtttcccaactggacaagctttgggtggtcacaaaaggcgtcactatgagggaaaggtgacgtcatcggacggtgtgggttccacgagta

SEQ ID NO: 3608 - DNA, 466 bp, Artificial
  Synthetic
gggtgaagcagagttcctctgtggggcgtggttttcacctgctgcgaggtccttgatctcaagaatcctcgatcctaatcctcagacaaggattcacatgtgcggtatccggaacaacgaatggttcaagaggaactacatgcctgtgagactggcagacgacgaagacgggacactggacgacatcgaagctgtttttgatgactctgaagaccagttcgtgaaggaacagatagacatgcaggaaggcccttcgatgatgaacgccttcgaacttattactctctcacaaggcctcaatctgtccgctcttttcgacagaagacaagaccttgttaagcgtcagacacggtttatctccaaatgtccggcccgggaattgctagcaagaatggaggataccgcaaactcgatggacttcaaagtgtacaagcgtggataccagatgagatttgaggggctaact

SEQ ID NO: 3609 - DNA, 527 bp, Artificial
  Synthetic
aaagctgacatctggtcttgtggggtgatcttatttgtcttgttggctggttatcttccgttccatgactcaaatcttatgaatatgtataggaagataagtagggcggaatacaaatgccctaattggttccctttagaagtgcgtaaacttctttctagtatcctcgacccaaaccctcatacaaggatttcgatagccaaaattaaggaaagctcctggtttaagaaagggttggaatccagacatgtgagaaccaaactagtacagaaccaaaatgttaatgcagatggcgatgctgtttgcagttcgagtttggagaacagcatctcttcctctgacacaaagctagagttggcaaaacctatgaatctaaatgcatttgatatcatctctctttcaagtggttttgacttgtctggtctatttataagaaatgatcaaaaggaggaactgcaattcacatcagtgaagcctgccgcggtcatcatatctaagcttgaggaagttggcaagaatctgaacct

SEQ ID NO: 3610 - DNA, 657 bp, Artificial
  Synthetic
tgtataacaaaatatctgctgctgaatttacttgcccaccttggatctcttttgctgccatgaagttaattactcgcatcttggatccaaatcctacaacgcgtattaccgcccctgaaattttggaggatgagtggtttaagaaagattatagaccacctgttttcgacgagatagaagatgcaaacctggatgatgttgaagctgttttcaaagactctgaagaatatcatgtaacagagaaaaaagaagagaagccaacttccatgaatgcattcgagttgatttctatgtcacaaggacttaacctcggcaatctcttcgacgaacagggattcaagcgagaaacaaggttcacatctaaatgcccggccagcgagataatcagtaagatcgaagaagcagctaaacctctcggctttgatgttagcaaaaagaactacaagatgaggctccaaaatctgaaagccggaagaaaagggaaccttaatgtttccactgaggtatttcaagttgctccgtctcttcatatggttgaggtgcgcaaggcaaaaggtgacactttggaattccacaagttctacaagaatctttcaacctccttagatgaagttgtatggaaaactgaagagacatggaaaagaaaaagtgaagagc

SEQ ID NO: 3611 - DNA, 471 bp, Artificial
  Synthetic
atccacagacgcgcatcacattttccgaggtcattgagaacgagtggttcaagaaagggtatcgtccacctgtttttgaacaggcagatgttagtcttgatgatgtgaatgctatttttagtgaatctgctgactcttcgaatcttgttgtggatagacgggatgaacgtccttctgcaccactgactatgaatgcttttgagcttatttcaacttctcagggtctcaatctcagttctctgtttgaaaagcaaatggggctagtcaaaagggagacaagatttacatcgagatgtcctgcgaatgaaattgtctcaaaaattgaagaagctgctgtacctttgggcttcaatgtgaggaaaaataactacaagattaagcttcatggggagaagagtgggcgcaaaggtcatttatccgttgcaaccgagatttacgaggtggcaccttcactatacatggttgagcttc

SEQ ID NO: 3612 - DNA, 700 bp, Artificial
  Synthetic
gaattcagatgccaatctgatggagatgtacaggaagattggtagaggagaatttaaatttcctaattggttgggggcagatgtgcgcaggcttctgtcaaagatcttaattccaaacccatatgagagaatctcaatggcgaagatcatggaaagttcttggttcagaaaggggttgaatgccgaagtagaaaagccttcacggaaaaacaagggaccgagcctttcttctgtggatgttgatgcgttgtttagtcggaataatgataacagcagtaccagtagttcagaaacaaaaccgactaatttgaatgcatttgatattatatccctttcagcgggatttgatctgtcgggtttgtttgagaaaactgacaataagaagaaggaatcgaggtttatgtcaaggcagcctgccccaaccattatctctgccctggaggatgctgcccagcgcctgagattaaaggtgaaaaagaaagatggaggacacctgaaatttgaagggacaaaagaaggtagaaaaggagtactgtccattgatgcagagatattcgaggtaactccatcttttcattgggttgaaatgaagaaatcaagcggcgataccatggagtatcagaacatgtcggagcattgtttaagaccagcgctcaaggacatcatttgggtttggcaaggtgatcaacctcgtgctctg

SEQ ID NO: 3613 - DNA, 625 bp, Artificial
  Synthetic
ggaagagagagagagagagagagagagagagagatcaatggcaagcatagccttcgcagcctcctcagcctcggcctccccctccctcgaccacgctagatctcccctcatcctcccccctaaggtctctttcttctcatatgggatcaaaagcccagcctgcgatgctagcactgggtggtcctatactcaaaagggccgactttcaggcattcgggcttctgtttccacagaggctcctgcaaaggtagagaaggtatctcgcaagaatgatgagggcgtaattgtcaacactttcaagcccaagaatccctacaccggcctttgccttctcaacactaaaattgttggggatgatgcgcctggggagacgtggcacatggtcttcagcacggaagggatggtagagtacagagaagggcaatccattgggatcatcccacctggtgttgatgctaatggcaaacctcacaaactgaggctctactccattgctagcagtgccttgggtgattttggagacaagaagactgtctctctttgtgtaaagagggtggtatataccaatgaccagggcgaggaggtcaagggtgtatgctccaactacctttgtgatctgaagtcc

SEQ ID NO: 3614 - DNA, 526 bp, Artificial
  Synthetic
cggagacgaccgcagcgccgggtgcggaggtgactactaaggtggagaaggtgtcgaagaagcaggtggatggcgtggtgacgaacaagtacaggcccaaggagccgtacacggggcggtgcctcctgaacacgaggatcaccggcgacgacgcccccggtgagacgtggcacatggtgttcagcaccgacggcgagatcccctaccgcgaggggcagtccatcggcgtcatccccgacggcatcgacaagaacggcaagccccacaagctccgcctctactccatcgccagcagcgccatcggggacttcgccgactccaagacggtatcgctgtgcgtgaagaggctggtgtacaccaacgatcagggagagatcgtcaaaggagtctgctccaacttcctctgtgacctgaagcctggttcggacgtgaagatcacggggccagtggggaaggagatgctgatgcccaaggaccccaacgccaccatcatcatgctgggcaccggcaccggcatcgcgccctt

SEQ ID NO: 3615 - DNA, 553 bp, Artificial
  Synthetic
gttcgtctatattcaattgcatccaccagatatggggactcttttgatgggaagacggccagcttgtgtgtcagacgagctgtctactatgatcctgagacaggaaaagaagacccttccaaaaatggtgtttgcagcaactttctgtgcgactcaaagcctggtgacaaagtgaagatcacaggtccttctggtaagataatgcttctaccagaagataatccaaatgcgacacacatcatgattggaactggaactggtgtggctcccttccgaggctaccttcgtcgtatgttcatggaatcggttccaactaagtttaatggccttgcttggcttttccttggggttgcaaacactgacagccttctatatgacgatgagttcaccaagtatctcaatgactacccaggcaatttcagatatgaccgtgctcttagccgtgaacaaaagaacaataaagggggaaagatgtatgtccaggataaaattgaggaatacagtgatgagatcttcaaactgctggatgaaggggcccacatgtacttctgtg

SEQ ID NO: 3616 - DNA, 1510 bp, Artificial
  Synthetic
tagaatatacacttctcttatcttcacatctccaatccttcaaatctcctccacccaatcctttaatccactagctaccctctctaaaaagatcccaactccccttctccttattttccttattcaccattaccttattatcaattccctcctcttaatattttgttccatttcttgatatctcaaacatggctgctgcagtaagtgctgcagtttctcttccatcgtccaagtccacctcttttcccaccagaacctccatcatctcccctgaaaagatcaactttaacaaggtgcctttgtactacagaaatgtgtcagctggtagtagagtggtttcaatcagagcccaggtgaccacagaggctcctgctaaagttgagaagatttccaagaaacaagatgagggtgtggttgtgaacaagttcaggccaaaggaaccttacattggtagatgtctactcaacactaagatcacgggtgatgatgctcctggtgaaacttggcacatggtcttcagcactgagggagaggtcccatacagagaaggacaatccattggtgtgattgctgatggtgttgatgccaatgggaagcctcacaaactcagattgtactccattgctagcagtgcccttggtgacttcggcgactccaaaaccgtttctctgtgtgtcaaaaggcttatctacaccaatgacaaaggggaagaagttaaaggagtttgctcaaacttcttatgtgacttgaagcctggagcagaagtcaagattactggacctgttgggaaagaaatgctcatgcctaaggatccaaatgccaccattgttatgcttgcaactggaactggaattgctcctttccgttcattcttgtggaagatgttctttgagaaacatgaggattacaagttcaacggtttggcatggcttttcttgggtgttcccaccagcagctcgctactttacaaagaggagttcgagaaaatgaaggagaaggcccccgaaaactttagactggactttgcagtgagcagagagcaaacaaacgaaaaaggcgaaaagatgtacatccaaaccagaatggcacaatatgcagaagaactatggggtctgctacagaaagacaacaccttcgtctacatgtgtggactcaagggcatggagtctggaattgatgacattatgacttcacttgctgctagagatggtattgtatgggcggactacaagaagcaattgaagaaggcagagcaatggaatgtggaagtctactaaatatttttggttttctttgtataaatatgagccaactttatgcttctctacccttcatccatgtagataggtaaatttttccttttaaattaattttcattttttttttggattttccttttcttgaaatttcatcattaaatgaatcagtgtattgacattggccctgtaaaaggaattgacggcatgtatcaataacatatagctgaatcaacctcaattgctgtctgttg

SEQ ID NO: 3617 - DNA, 373 bp, Artificial
  Synthetic
gcagcaacttcctatgtgattcaaagcccggtgacaagattcaaatcaccggtccatctgggaaggtaatgctattacccgagagtgatccaaacgcgacacacataatgatagccacgggaacaggagtggctccatacagaggctacttacgtcgaatgttcatggaaaacgtcccaaacaagacatttagcggcttagcttggctcttcttaggcgtggccaacaccgatagccttctctatgacgaagagtttaccaagtacctaaaagaccatccagacaactttaggttcgacaaggcattgagcagagaggagaagaacaagaaaggtggaaagatgtacgtgcaggacaagattgaagaatatag

SEQ ID NO: 3618 - DNA, 1293 bp, Artificial
  Synthetic
ttttttttttttcatgtctaatgattgactttcttggtggagttacactgtgtccattaattgacacgattattcagttgcaaaaatggcgaaaaccacagaaagactattaactcaatacacttcaacatgccactgcttgttcttcctgagctgagtaagtttctgctcccagctttcgcctcgctcttcagcgactctcttaagcgtatcttgaatcccgggcatcattcctttaagtccgcaaaagtaaatatgagctccattgtccaaaagtttgaaaatttcatcgctgtattcttcaatcttgtcctgcacatacattttccctcctttcttgtttttctcttctctgctcagcgctttgtcgtacctgaaattttctggatagtccttgcggtacccggcaaattcttcatcataaagaaaactgtctgagttagccacaccaaggaagagccaagcaagtccgtcaaacttgaaattgggaacattctccataaacatacgccgtaggtatcctctgtacggagcaactccggttccagtagcaatcattatgtgagtagctttcgggtcatcttcaggtaaaagcattacctttccagatggaccggtgattttaactttatcgccgggtttggcattgcacaagaagttactgcatacaccagctttggaaggatcttcttttcctgtctccggatcatagtaaatagctcgacggacacatagactagctgttttgccatcaaaagaatctccataccgtgttgatgcaatcgaataaaggcgaacgttatgaggtgcaccaggtttcttgggattctcaccaggaggaatgactccatagctttgtccttcccagtaaggaacattaccatcatgatcaataacaatgtggcaagtctctccaggtgcttgtggaccaacaattctctcaaccgaaacaatagttgcagtataaggctccttaggcctaaacaagtttaagggagtctctttgggatcttcaagttctagaggagtaaccaagactttggatttgcttgattgctgaagtgacatgcatattgtggacctttttttcacacctaagcttctagatttcgaatctagtctcagcagaggaggaccccatgacttatcagtgaagcttatactttgaaccttaatcatagatcggctcgacccatcaattctagttggaagtgcaacggacatctgagaaggagtagttgagagagccatagcaatggagaaaagagacgataattctcccggacgcgtggg

SEQ ID NO: 3619 - DNA, 675 bp, Artificial
  Synthetic
tccgctgggaaggtaatgctattacccgagagtgatccaaacgcgccccccataatgatagccccgggaacaggagtggctccatacagaggctacttacgtcgaatgttcatggaaaacgtcccaaacaagacatttagcggcttagcttggctctttttaggcgtggccaacaccgatagccttctctatgacgaagagtttaccaagtacctaaaagaccatccagacaactttaggttcgacaaggcattgagcagagaggagaagaccaagaaaggtggaaagatgtacgtgcaggccaagattgaagaatatagtgatgagatcttcaagcttttggacaatggagctcatatttacttctgtgggcttaaaggaatgatgcctgggattcaagatacccttaaaagagttgcagaaaagagaggtgagagctgggacttgaagctttctcagctcaggaagaacaaccagtggcccgttgaagtctattgagctctttatttgtatttgctgtttttgatttttgatttaagaatcgtaataaatttgaatttggtgtttttctacttttcaaacatgatatgatgataatatctgaaatttgttggttttgagaagagaatattctcagagaataatcaatatatcatttatgtaaaaaaaaaaaac

SEQ ID NO: 3620 - DNA, 472 bp, Artificial
  Synthetic
acttaagggaccatatgcgacgagctgccgatgtgtgcttcgcccaacttttccgagagggaaacggaactacaggcattgttgatttcaccaattatgacgacatgaaatatgcgattacaaagcttgacgattcggaattccgtaatccattctcgcgatcgttcatccgcgtcaaggaagacaggtctcagggattcacacgaaacctttcgcgcattgtcagtcgaagccggagcaaaagtcgtacccgcacttacagccgtagcaaaatccgcagtcgaagtcggagccgtgggcgatctaagagtccaggatgcaggtccaagtcatgctcgaagtcggattcgaagtctcctgtggctcgatcgacgtctcggtcgtactcgccgcgctcaccggggtctcctgttgttaaggaatcaagccgaatgccgactccccgtcgctcccgctcagattctcctgcggc

SEQ ID NO: 3621 - DNA, 361 bp, Artificial
  Synthetic
aattcggcaccagatttttctttctccgtaatctctagtgttggatcctacaggcataatgggtcgtttaagtcggactatctatgtgggcaatcttcctggtgatattcgtgagagagaagtagaagatttgttttacaagtatgggcatatcgtggaaattgagttgaaagttcctcctagaccacctggttatgcatttgtagagtttgaagattctcgtgatgctgatgatgccatccgtgggcgcgatggctatgactttgatggacatcgattacgagttagttgtctccccacctccccatctttttggtgatgtgtggtatttttttgaagtcagattatgttcaccactatt

SEQ ID NO: 3622 - DNA, 446 bp, Artificial
  Synthetic
gcggaggagaaggcgctgcgtgcgtgcagcggcagcggtggtgctgtggagcgccggatttgtcgctgtgaatcgaggtagcacttagcaatgagtcgatccagtcggacaatttatgtcgggaaccttcccggtgatgttcgggagcgcgaaatcgaggacttgtttcacaagtatggacatattgtagacatcgacttgaagctgccaccgaggcctccagggtactgtttcatcgaagtcgaggacgctcgagatgccgaggacgccattcggggtcgtgatggctacaactttgatggataccgtctaacgtgttgaaattgctcacggtggccgcggacctccgtcctcggatcgatacagtagccatggtggtcggggaggaagcgtatccaggcgttcggaatacagagttatcatcacgggtttgccttcgtcggcgt

SEQ ID NO: 3623 - DNA, 590 bp, Artificial
  Synthetic
tttgcttgtgcgcaagcggcggataaggcgctgcgggggcagcggcaccggcggtgcctggagcgccggatttttcgcgtgaatcgagctaccactaagcaatgagtcgatccagtcggacaatttatgtcgggaaccttcccggtgatgttcgggagcgcgaaatcgaggacttgtttcacaagtatggacatattgtagacatagacttgaagctgccaccgaggcctccggggtactgtttcatcgaattcgaggacgctcgagatgccgaggacgccattcggggtcgtgatggctacaactttgatggataccgtctacgtgttgaaattgctcacggtggccgcggccctccgtcctcggatcgatacagtagccatggtggtcggggcggaagcgtttccaggcgttcggaatacagagttatcatcacgggcttgccttcgtcggcgtcttggcaggacttaaaggaccatatgcgacgagctggcgatgtttgcttcgcccaagttttccgagagggaaacggcattgttgacttcaccaattatgacgacatgaaatatgcgattaaaaagcttgacgat

SEQ ID NO: 3624 - DNA, 626 bp, Artificial
  Synthetic
cccacgcgtccggggtaagaagcggataagaagctgatcgccaatttcatcaaaccctaattgataatccagtgttgcagctaattcttccttcattgctgagaatgagtggccgtttttcacgcacgatttatgttggcaaccttccagcagatataaaggaatatgaagttgaagatctattctataagtacggtcgtatattggatattgagttgaagattccacctcgccctccttgcttttcttttgtggagtttgaaagttctcgagatgcagaagatgccatcaggggtagagatggttacaactttgatggctgtcgcctgagggttgagcttgctcatggaggaagagggccatcatcttcaagtgatcgccgaggcagctatggcagcagtggtggtggagggcgttatggtgtttctcggcattctgattaccgagttattgttcgaggtcttccatcttctgcttcttggcaagatttgaaggatcatatgcggaaagctggcgatgtgtgctttgctgaagtttctcgtgacagtgaaggtacctttggcatggttgactacacacattatgaagacatgaagtatgctataaggaaacttgatgatactgag

SEQ ID NO: 3625 - DNA, 318 bp, Artificial
  Synthetic
acggcttctacgctgtggattgtggcttagtctgctctggatcttccgagttttctttttcagggacaatgagtcgatcgagtaggacactttatgttggcaatcttccgggcgatattcgtgagcgtgaagtggaagatctgttttacaagtatggcccaatagcgcatattgagctgaaaattccaccaaggccccctggttatgcttttgttgagtttgaagaagttcgtgatgctgaagatgctattcgtggtcgtgatggctatgattttgatgggcaccgtctgagggttgagcttgcacatggtgggcgtg

SEQ ID NO: 3626 - DNA, 653 bp, Artificial
  Synthetic
aaaattttctcctcagctctctgttttcatccgtcatcaaatcttctgaggaataatgagtcgttcaagtaggacaatttatgttggtaatcttcctggtgatattcgtgagcgagaagttgaggatctgttctacaagtacggcccgatagctcatattgatctgaaagttccaccaagacccccgggttatgcttttgttgagtttgaagaggctcgcgatgctgatgatgctattcgtgggcgtgatggctatgattttgatgggcatcgcttgagggttgaacttgcacatggtgggcgtggtaactcatcagcaaatgatcgttatagtggcaatagtagcggtcgtaatcacaaatttggagctcccaaacgtaccgagtatcgagtattagttaccggattgccccattcagcatcctggcaggatcttaaggatcacatgcgtcgagctggggatgtttgtttctcacaagttttccgtgagggtggtggaaccactgggattgtggattatactaaccgcgacgacatgaaatatgctatcaaaaaacttgatgaatctgagttccggaatgctttttctcgttcgacgattctcgtatgacggggacatgtttcaaatacttggttatagcatgcttaatgcc

SEQ ID NO: 3627 - DNA, 631 bp, Artificial
  Synthetic
acgaacataaggccgacgcgtatcatttaacctcccgtcgacgtctatcattcaattctcgccgctttttgctcgcggtgaggatgtcgacaccggcgaggaagagactgatgagggattttaagcggttacagcaagatcccccggccggcatcagtggagctccgtatgacaacaatataatgctatggaatgcagtcattttcggccctgatgatactccctgggatggaggtacatttaagctgacacttcaattctcagaggactatccaaacaaaccaccaactgtgcggtttatttccagaatgttccacccaaatatttacgctgatggaagtatttgcttagacatcctgcaaaatcagtggagtcccatatatgatgtagctgctatactgacttcaatccagtgcagtctttgctctgtgatccaaatcctaactcgccagcaaattcagaagcagcacgcatgttcagtgagaacaagcgtgaatacaacaaggaggtgcgcgagattgttgaacagagctggacagcagactgacttctccctcactctcgtctgtgacagcagattatcctgtctcatactgaaattgttctcgtcttgtcactacattagtaacta

SEQ ID NO: 3628 - DNA, 558 bp, Artificial
  Synthetic
ggtgaagaagaagaaagagaagaagaagaaatgcaagaaaaggattgagatcggcaaaagacagaaggatttcgcattcctgggtttgttgtgtgaccgaaactggatggataagcctctttaaccccaacaagggcagcgtttaatcactttcaacaagtccggggggttggttgcatacaatccaacataagctttcactttcttccaaaggcgatcaatctcttgccacaatgtccacgccgtcaaggaagcgtttgatgcgtgatttcaagcggcttcaacatgacccccctgctggtattagtggtgctccgcaggacaacaatatcatgctttggaatgctgtcatatttgggccggacgacacaccttgggatggaggcactttcaaattgaccttgcaattctcggaagactaccccaataaacctccaacagttcgttttgtgtcaaggatgttccatccaaacatctatgcagatggaagtatctgcttggacattctgcaaaatcaatggagccccatatatgacgttgcagcgatacttacatcta

SEQ ID NO: 3629 - DNA, 496 bp, Artificial
  Synthetic
gagaagacggagagagagagagagaagggaagtccaggcgtctctatctttcttactctgcccttctcagcattcccactgccatgtccacccctgcacggaagcgcttgatgcgcgacttcaagcggcttcagcatgatccccctgctggcataagtggtgctcctcaggacaacaacattatgctttggaatgctgtcatctttgggccggatgacacaccatgggatggaggtacgttcaagctgacattacaattttctgaggactatccaaataagcctccgacggtccgttttgtgtcgaggatgttccacccaaacatttatgccgatggaagtatctgcctggatattctgcagaaccaatggagcccaatctatgatgtcgcagcaatacttacatccattcagtctttgctctgcgatccaaacccgaactctccggcaaatcccgaagcagcacgaatgtatagcgaaaaccggcgagactacaa

SEQ ID NO: 3630 - DNA, 584 bp, Artificial
  Synthetic
ggaatggcatcctctgctcagcttcgattgatgtccgatctgaaggccattagccatgagccacctgagggatgcagtgccagcccttatagcgatgcggacctttttgtttgggacgccacaatatttggtcccgaagatactccatgggaatgttgttcctgtgaccggatccatctttcgaaacttgaaaattagatcaatgaacctatctgtaactttgtgttctattgtatgcttgtgtttcttgtaggtggcattttctgcctccgtttggtctttggagagcattaccctgccaaaccacctcgtgtcaggtttacttccgagatatttcaccccaatgtgtacaatgatggcaccttatgcatggacattatacaagatgcttggtctccttgccacaacatctgtacaattctaacatctgttcagtcattgctaacagatccgaatcccgcaagcccagctaactcggaagctgcacatttatatcaaactgatattcaagcatataacaggcgagttcggcgttgtgtgaggaagtctttggaaagcacatagtatactttgctttgcttgtt

SEQ ID NO: 3631 - DNA, 361 bp, Artificial
  Synthetic
  misc_feature (234)..(234): The residue at this position can be any nucleotide.
agaatggctacttctgcgcagctccgcctcatgtcggacctcaaagccatcctcagcgagcctcccgagggatgcagcgcaagcccttacaatgatgataatctctttgtgtggaatgctactatctttggccctgaggacagcccttgggaaggtgggattttttctcttcgtttgatattcggagatcaatatcctgaaaagccacctcgtgttagatttactagcgagatnttccatccaaatggtgtacacaatggaaacttatgcatggatataattcaggatgcttggtctccctgccacaacatctgcactatattgacttcaatacagtctttattgacggatccaaatccag

SEQ ID NO: 3632 - DNA, 529 bp, Artificial
  Synthetic
ggccttataaccttagttacctatagtccattgacggttcgcaatcagaatggctacttctgcgcagctccgcctcatgtcggacctcaaagccatcctcagcgagcctcccgaggtgggattttttctcttcgtttgatattcggagatcaatatcctgaaaagccacctcgtgttagatttactagcgagattttccatccaaatgtgtacaacgatggaaccttatgcatggatataattcaggatgcttggtctccctgccacaacatctgcactatattgacttcaatacagtctttattgacggatccaaatccagagagccctgctaacccagaagctgcacacttatatcggaccgatattcaagcatataataggaggatcaagcagtgcgtaagaaagtctttggatagttaatgagtatggaatttcgactgaaagtaaacatgacgtaatttggctcttgctaggcattcacaggtctaaactaaactatggttaaagaagattgaataactcacta

SEQ ID NO: 3633 - DNA, 713 bp, Artificial
  Synthetic
tacgaaaccaacaaggaagagaatcaaattcttctattcccaataattctctattcagattcgatctcggtctctgagtgatggcttcgaaacggatcttgaaggagctcaaggatctccagaaggatccccctacctcttgcagcgccggccccgtcggagaggacatgttccattggcaggccacaattatgggtcccccagacagcccttataccggtggtgtattcctagttactatacattttcctcctgattatccattcaaacctcctaaggttgcttttagaacaaaagttttccatccaaatattaacagtaatggcagtatatgcctggacatattgaaggagcagtggagccctgcattaactatttccaaggttttgctttcaatttgctctcttttgacggacccaaatcccgatgaccccctggtgccggagattgctcacatgtacaagacagacagagctaaatacgaatcaactgccaggagttggacccagaaatatgccatgggttagaacattacctatacgggcccgagtccatgtaaaaagaattcatgtgcctgttctctctcctctctcaaccagcaaagtgtagaatagcattaaatgttgtcctctccaagaaaaagagatgctttgaatatttttatatggattctaacattttaagaaatctgggaactgtttatttatctggtt

SEQ ID NO: 3634 - DNA, 674 bp, Artificial
  Synthetic
ggcaactccttttcatttccccccccaccctccatcaactgaagtctatggcttcgggttctcaagctagtctcctccttcagaaacaactcaaagatctctgtaaaagaccagttgatggattttcagctggtttggttgatgaaagcgacttattcgaatggagtgtcaccattatcggacccccggatactttatatgaaggtggtttctttaatgctatcatgagctttcctcaaaattatcccaacagtcctccaactattaggtttacctcggaggtgtggcatcctaatgtttattctgatggaaaggtttgcatctcaatacttcacccacctggtgatgatccaaatgggtatgagcttgctagtgagcgttggtctcctgtccatacggttgagagcataattttgagcatcatatcaatgctttcaagtcctaatgatgagtctcctgctaatgtggaagccgctaaggaatggagagataatagagatgaattcaagaaaaaggtcagtcgttgtgtaagacggtctcaagaaatgacataaagacacgaatgccaaaatcggacttctttcatcagttgttgtttgatacaaatgtagaattgttgtcaaggtctgtcataccttttgtaatatttgcgagtacggtcattatttacattt

SEQ ID NO: 3635 - DNA, 758 bp, Artificial
  Synthetic
tgcgaactccaggggcacctcctccaacacaaagcaggagttgagcgcagaatcaaaccaaaaccctagctcaccgccttgtttcctccgtattggtggttacaatgtcgactccggctagaaagaggttgatgagagatttcaagaggttgcagcaggaccctcctgctggtattagtggtgcacctcaagacaacaacattatgctttggaatgccgtgatatttggtcctgatgacactccttgggatggtggtacgttcaagctgactcttcaattctctgaggattaccccaataagccaccaacagtgcggtttgtttctcgcatgtttcatcctaacatttatgcagatggaagtatatgtttggatattcttcaaaatcagtggagtccaatatatgatgttgcagctatacttacatccattcagtcattgctgtgcgatcccaaccccaattcacctgcaaattcggaagcagctcggatgttcagcgagaataaaagggattacaaccgcagagttagagaagttgtggagcagagctggactgcagactgattctaaggaagaaagatgtcattgctgaccgcaattcgggagcaccagggttcatctatgttacatttacggattgaaacctcttcttggaaattttattggaacacatttgttttggccctagtattatggcttggtgctgtttgccttaccgtttgctgcattgcattgacaagctcctgtaatatatgaatg

SEQ ID NO: 3636 - DNA, 662 bp, Artificial
  Synthetic
agaaatcaaatcgaccccttactcctctaaatccccacacccatctctctctctctctctctcctcaatcgaaggatccgacaataaaagttgattgtcttcaacatctgtctaccagcaaaaactacttgcgtgcagtcgccaactgatcctaggattatacttacatttggctatggcaactaatgaaaatctcccaccaaacgtgataaaacaattggcaaaggaattgaaaaatcttgatgaaactcctcctgaaggcatcaaagtaggtgtcaacgatgatgatttttcaaccatatatgctgatatcgaggggccagctgggactccttacgagaatggggttttccgcatgaagttgattttgacgcatgatttccctcattccccacccaaaggttattttctgaccaagatttttcatcccaacatcgcttccattggcgaaatttgtgtcaatgctctgaaaaaagattggaatcctagtttgggcctacgacatgttctcatggtggtaaggtgtttgctgatcgagccatttccagaatctgcgttaaatgagcaagctggtaaaatgctgcttgataattatgacgagtatgctagacatgcaaggctttataccagtattcatgctaaaccaaagactaagttaaaga

SEQ ID NO: 3637 - DNA, 702 bp, Artificial
  Synthetic
cccacgcgtccgctcctcctcttcctccctcccgatcccctggcccgcacgaaactcaaagcatccccggcgccgcagctccccggaggaggaagcccccgcgccccgccccgaccagatccgatggccaacagcaacctcccccggcgaatcatcaaggagacgcagcgactcctcagcgagccagcgccgggaatcagcgcgtctccgtcggaggagaacatgcgctacttcaacgtcatgatccttggcccggcacagtccccctatgaaggtggagtttttaagcttgaactctttttacccgaggaatatcctatggctgctccaaaggttaggttcctgaccaaaatataccaccccaacattgacaagcttggtaggatatgccttgacattctcaaggacaaatggagcccagcccttcagattcggacagttcttttgagtatccaggcactcctaagtgcaccaaaccctgatgatcctctctctgataacattgcaaagcactggaaagccaatgaagcagaagctgttgaaacagcaaaggagtggactcgcctgtatgccagcggtgcataaaacccaatgcctctcgtgatgtaataacccgtcatgctttagccttaatcaaatgccatttgcttgataagaacaaactggagatattggcagtggaagggagtttaaatgactacc

SEQ ID NO: 3638 - DNA, 724 bp, Artificial
  Synthetic
cccacgcgtccgcccacgcgtccgctcacctggcgcgccgaagcttctctcctctctctcaactccggcgagaggaggaggcggcggtggggcgttcgtcgggagagagaccagggccggggggctagggttcggccgttcagagaggcggcggctgaggaggaggaggaggaggaggagggggtgaggagagatgtcgacgccggcgaggaagcggctgatgcgggacttcaagcggctgcagcaggacccccccgccggaatcagcggcgcgccgcacgacaacaacatcatgctctggaacgccgtcatcttcgggccggatgatacgccgtgggacggaggcacgttcaagcttaccttgcagtttacagaagattatcccaacaagccgccgactgttcggtttgtttctaggatgttccacccaaatatttatgcagatggaagcatctgcttggatattctacagaaccagtggagccctatatatgatgttgctgccatattgacttcaattcagtctttgctgtgtgatccaaaccccaactctccagcaaactcagaagctgccagactgtttagtgagaacaagcgagagtacaaccgcaaggttcgtgagatcgtggagcagagctggacagctgactagggcatgcagcagggcaacgggtggtatccaccatgccagaaagatgcaataagcaaccgtgaaaaacctgtg

SEQ ID NO: 3639 - DNA, 610 bp, Artificial
  Synthetic
gcgagagagagcaggaaggcgatcgatcagctcccggcggcgctgtcggaatccggatcttggagccgctgccatggccagtaccatcgccaacagcaatctcccgcggcggatcatcaaggaaacgcagcgattactgaccgagccagccgaaggcatcaaagcttcgcctgccgaagataatttgcgatacttcaatgtgatgatccttggccccgcacagtcaccctatgaaggtggtgcttttaaactggagctttttcttccggaagaatatccaatggctgctccaaaggttcgcttcttgacgaaaatttaccatccaaacatcgacaagctgggccggatttgcttagacattctaaaagacaaatggagtcctgctctccagattcgaacagtgcttttgagtattcaagctcttttgagtgctcccaatcctgaggatcccctggacgagaacatcgcgaagcactggaagacagaccaaggaggagccatcgcgactgcaagagagtggactcaactctacgcgacccataattaaatcaaaatgcggaccattcgtcatcttggttcgtttagttttttctgctttggtcatatttgt

SEQ ID NO: 3640 - DNA, 679 bp, Artificial
  Synthetic
acgaccaccaattccaagcacacattcggacacccacactctctatcttgcgaacagcctgtcacgcgcgaaatcacttccccaacatcatcctggactacagtctccataacgacaccactcgcgcctcacatcccacgcatcactttccaacatgtccacagcagcgaggagacgcttgatgcgcgacttcaagcgcatgcagaccgaccctccagctggcgtctcagcctctccgatcgcagacaatgtgatgacatggaacgccgtgatcatcgggccctccgacacacccttcgaggatggcactttccgtcttgtcatgcacttcgaagaacagtaccccaacaagccaccgggcgtcaagttcatctcacaaatgttccacccaaacgtctatgccaccggagagctgtgtcttgacatcctgcagaaccgctggagtccgacatacgacgtggcggcaatcttgaccagcgtgcagagcttgctcaacgacccgaacaccagcagccctgcgaacgtggaagccagcaatctatacaaggacaaccgcaaagagtacactaagagggtacgggagacggtcgagaaaagctgggatgactgagcaaagcgcgcaacacgaaagtgagttatgaggcaatcactatcgaattcagactggcttgcatgagac

SEQ ID NO: 3641 - DNA, 320 bp, Artificial
  Synthetic
cccacgcgtccgagctcccggtataagtgcctctccatctgaggataatatgcggtatttcaacgttatgattcttggtcctacacaatcaccttatgaaggaggagttttcaagttggagctctttttgcctgaagaataccctatggcagctcccaaggttaggtttctcacaaagatataccatcctaacattgacaagcttggaagaatctgtcttgatattctcaaggacaaatggagccctgcactacaaatacgaacagtgctcttaaggtatatgagctgattacataagattatttcctgctaaaaactat

SEQ ID NO: 3642 - DNA, 748 bp, Artificial
  Synthetic
aggagaaggaatgtttttgtttgagattaaagaggtttcaaacaaagagatgataaaacataggaatctaacttatttcatggaagatccctatgtgaagaagtcctctctctttctctcttctctctattaaaaccgagtctttgagggatcaaaggacacaaactttcatcccattgcatatttctgagtccagcttctcgcagtagactcatactttgctctatcggttttgtacatgtgagcaatctctggaaccaatggatcatctgggtttgggtccgttaacaatgaacatatcgaaagcaaaaccttcgatatggtcagtgcaggactccattgttctttcaaaatgtcaaggcaaatgcttccgttgctgttgacattagggtggaacacttttgtcctgaatgcaacctttggtggtttgaaaggataatccggtgggaagtggatggttacgagaaacactccgcctgaataaggactatcggatggacccattattgtagcttgccaatgaaacatgtcttcagcaactgggccagcactgcaggaagttggaggatccttctggagatccttgagctctttcaagatccgtttcgaagccatttctcaaccaaaaaaaaactcctagatccaaaaaaccaaaccctcaagacagatcctccaaactcggttttgacgattcacttcctgcagatgattttgagaaagagacagagagagccttcggacgcgtggg

SEQ ID NO: 3643 - DNA, 457 bp, Artificial
  Synthetic
cccacgcgtccgggatattgaaagaattgaaggagttgcaaagagaccctcctgtatcatgcagtgcaggtccaacaggagaagatatgttccactggcaagctactataatgggtccgaatgaaagtccttactccggaggtgttttccttgtcaatattcatttccctcctgattatccttttaaacctcccaaggttgtattcagaaccaaagtgtttcacgcaaacatcaacagtaatggaaacatatgtttggacattctcaaagaccaatggagccctgcccttaccatttctaaggtttgaaattctatatatgtatttagttatttggcaatattttctataattccatatatcagatttggtatataaccaagaagctccaataggtaacacaaattactaacattttggtattataggtgcttctctctatatgctctcttctaaca

SEQ ID NO: 3644 - DNA, 441 bp, Artificial
  Synthetic
atgcttatattcaggtccgaaaattatttgcaatctcgttccaactcttctctctcccgcaaagtgaagtcggtctgaaattcgtaatggcttcaaagaggattcagaaggaactgaaggacttgcagaaagacccccctgcttcttgcagtgcaggtcctgttggtgaggatatgttccactggcaagctacaattatgggtccatctgacagcccattttctgggggtgttttccttgtgtctatccattcccccccagattatccattcaagcccccaaaggttgccttcaaaaccaaagtattccacccaaacatcaacagtaatggtagtattgtctggacatcctaagagaacaatggagccccgccctaactgtatccaaggtgctactttccatttgttccttgcttactgatccaaatccagatgatccttt

SEQ ID NO: 3645 - DNA, 339 bp, Artificial
  Synthetic
aatgcatgatttttttcgggaaatgttgcttgatgtggacaacatgccgtatgaggagctattggcacttgaggaacgcataggtgacgtgagcactggcctaagcgaagaggtcattttgaaagcaatgaaacaccacaaacatacatcttagtgtccttcttgtgttgagttgtatcagaacatagagccatgctgcatttgtcatgaagagtatgtataaggtgataatctatgaaccttgaaatgtggacatgaattccacaaggactgaatcaagcaatgggtcatgatcaagaatctctgccccatttgtaagaccgaagcattaaagacgcc

SEQ ID NO: 3646 - DNA, 622 bp, Artificial
  Synthetic
ggcatcgtccgtcaagttcaaggtcggcgttgatgttggggagacagctcgatggcgctgttggagttccatattcttggaggtctttggctgctgccagtgaaggtaggagcaggcttgtttccgagattcgcaatgtattggatcttatgcgcaggggagaggccttaagattcgaggatgtcatgatcctcgatcagtcggtcttctttggaatggcagatattcatgatcgccatcgggatatgcggcttgatgttgataacatgtcatatgaggaattacttgcactggaggagcgcattgggaacgtctgcactgggcttagcgaagaaaccattttgaatcgcctgaagcaacacaagtatgtatgcattaaaacagaagaacctgtggatgctgagccatgctgtgtttgtcaggaagaatataaggatggtgaggatcttgggaaactggattgtggccatgattttcataccgactgcattaaacagtggctcatgcagaagaatttgtgccccatttgcaaaacaacagggctgaaaacctgaggaaagcgttgaacatttttctcgtgtcaaagaagttggatgtgacggttgggctaacgaaggttggc

SEQ ID NO: 3647 - DNA, 589 bp, Artificial
  Synthetic
ccgccggatgcgcgggtaccgccattcccccgtcggcctcgaggaagagatcatgatgtttcagacaagagttctgttgggaggaatgagcatgtatgatcggtaccaggattggcgccttgatgttgataacatgacatacgaggagttgcttgagcttggagataaaataggttatgtcaacactggattgcgtgaggatgagatagttcgcaaccttaggaaggtcaaacacccagcctttgactcctcgttccggtattcaacagaaatggaaaagaaatgcagtatttgtcaagaagagtttgaagccaatgaagagatggggaggctggattgcggtcacagctaccatgtttactgcattaagcaatggctttctcagaagaacgtttgcccagtttgcaagactgccgttaccaagacttgaagtccggactccgggcaacgacgattgtatacctgggtcaaactttcaaaacatgtttgtttgtgctctgtacagtcaattacatatgttattgtataaacacatcatccattcttttgcatttgcagatagaaatgccatattgaggcatcctttatc

SEQ ID NO: 3648 - DNA, 470 bp, Artificial
  Synthetic
tcgattgtttgttttattcaggtgatctactctaataattggtcttcgaaaagtataatcctttttttttggctcgtcattctggctctttctttgacctgatgttcttcattttgcttctcctctcattcttgaactgaaaattcatgtattgtgacaattagttgaagaagaaggagtagcaaagtggggttgggatgtttgggtctggaatgaatttgataaccacaataattggttttgggatgagtgcaacttttatagtgtttgagtgtactagactgatttgtgggaggataagcaggaggcaatcaaggcaaatgtttgaaattgaatcatggattgatcttcaaatgattcactaatgtaaacctattctggcagccagagcatcgaatcaacgggcttgactctgttgtggttgctgcaattcccaccatgaaatttcaccgctaggctttcacctcctc

SEQ ID NO: 3649 - DNA, 384 bp, Artificial
  Synthetic
tttgcttcccccttcccactgcggctagggttttagctcactcttcaagatgaatgtagaaaagctgcgtaagatggccggttcggtcagaaccggtggaaagggtaccatgagaagaaagaagaaagccgttcacaaaacaactacaaccgatgacaaaagactacagagcaccttgaaaagaataggtgtcaatggcattcctggtattgaagaagtcaacattttcaaggaggatgttgttatccaattcattaatcccaaagttcaagcatctattggtggaaacacatgggttggtagtggttccccccagacaaagaaattggaggatatccttcctcaaattattcaccaattgggtcctggtaatttggagaattt

SEQ ID NO: 3650 - DNA, 622 bp, Artificial
  Synthetic
attttgctggagaatagtcggatgcaggaggcgaaaaaagattcgatctttggaggccttggctctggggcgcccgtcggagcggatcgcttcccgtttgatcctcgggagtattcgccggcgatgagctccgactccagggagctgctcgggatcgatcccccggagctcatcttccccttcgaattaaagaagcaaatctcgtgttctctgcacctaacaaacaagacagatgaatatgtcacgtttaaggttaagacaactagtccaaagaagtactgcgtccgtccaaataacggcattgtggctccccagtccacatccaatgttcttgtaacaatgcaagctcagcgggaggcgccaccggacatgcaatgcaaggacaaattccttgtgcagagtgccatagtgacacaagagctcacaccgaaggatatcaccggagacatgtttacgaaagaatcaggtaatgtggtggatgaggtgaagttaaaggttgtttatactcaacctcacccgacatctctcaatggcgggtctgaggaaggtctaggaagcttgagttatcaagaagcaacaaaaggatctagagaatcagaaacagtaacctctgagccattgg

SEQ ID NO: 3651 - DNA, 472 bp, Artificial
  Synthetic
gttctttatcacagagtagagaaaacaaaaatgacggaggcaatgattaggaaaaaagccggtatggctagtgtgaaagacatgccgttgttgcaagacggtccaccaccgggcggttttgcaccggttcgattcgctcgtcggatccctaacaccggtccaagtgctttggccattttcctcactgcttttggtgctttctcttggggtatgtaccaagtcggcgttggaaataagaagcgtagggtaataaaggaagaaaagtatgctgctcgaagggctatcttgcccatgcttcaagctgaagaggatgaaagattcgttaaagagtggaagaagtatcttgaagaagaggctagaatcatgaaggatgttcccggttggaaagttggtgaaagtgtttacaactctggaaaatggatgcctccagcaaccggagagcttcgtcctgatgtctggtaatatgttggca

SEQ ID NO: 3652 - DNA, 656 bp, Artificial
  Synthetic
ttttttttttgagggaaaaaaacagaaaatgttcctcagtaccgtaccagcaatacatgaactgtgtatgtatcaattctcttattatacgatggaaaaagagagacaagaaacatcaaggttctaaaatgcttaaacaaacattcattcatcatcatcaaaaggagccattgataatttaccagacatcaggacgaagctctccagtagctggaggcatccaacgaccagaattgtacacgttttcaccgactttccatccaggaacatccttcatcacatccgcctcgtattctagatacttcttccactcagacacaaacctttcatcttcttcagcttgaagaattggtagaatcgctctacgagcagcgtatttctcttccttcaacgccctgcggattttgttgccctgaccgacttggtacatcccccaagcaaaagcacctgaaacggtaaggaaaatagccatggcgcttggacccgtgttggagatccggcgagcatatcggaccggtgcgaatccacccggtggtggaccatcctgaagcaacggcatatccttcacactcgccattcctggcttcttccttatcatcgcctccgtcatcttcttcctcgatcgatcacaatcccaaatcgatcggacgcgtggg

SEQ ID NO: 3653 - DNA, 391 bp, Artificial
  Synthetic
tgtgtatgtatcaattctcttattatacgatggaaaaagagagacaagaaacatcaaggttctaaaatgcttaaacaaacattcattcatcatcatcaaaaggagccattgataatttaccagacatcaggacgaagctctccagtagctggaggcatccaacgaccagaattgtacacgttttcaccgactttccatccaggaacatccttcatcacatccgcctcgtattctaatacttcttccactcagacacaaacctttcatcttcttcagcttgaagaattggtagaatcgctctacgagcagcgtatttctcttccttcaacgccctgcggattttgttgccctgaccgacttggtacatcccccaagcaaaagcacctgaaac

SEQ ID NO: 3654 - DNA, 602 bp, Artificial
  Synthetic
acgcgtcgggtgtcaacaagcttctgcgcaccttgtctccttcgatcaccctcaaggtaggagataaaacatggcgatggcaatgggtatgaagcccggaaagcctggcctcgaggagcctcaagaagccctccatcgcatccgtatcaccctttcttccaagagtgtcaaaaacctcgaaaaagtgtgtgcggatttggttcgaggtgccaaagaaaaaaagttgaaggtcaaggggcctgttagaatgcccacaaaggtgttgcgccacaccaccaggaagtccccttgtggagaaggtaccaacacgtgggattgttttgagctgaggatacacaagagaatcattgatttgcacagctcttcagaagttgtgaagcagatcacctcgattacaatcgagcctggagtcgaggtggaagtgacaattgcagatgtctgagtgtagtcaattatttcttttcgaccgggaaaaggttattgacttggttgaagagggatgactggtctttcaattttaggttatgtttctccttacgaatatttgttaggatttttgacatttaatcctgtgttaacggagaattgagctggatagtatt

SEQ ID NO: 3655 - DNA, 982 bp, Artificial
  Synthetic
ggcgcatttttgcggttccaatagatacttcttgtaaagttccaatctcttatttcttgtttcagaatatacatgctttcgctcacatctcttaccacagtaagtacttgtagttaaggtaccacaacacacacaagagaaagtagccattctagacctaggaccagggttagattccacgtcacccgccaacttcagcaaatcaaaattcaacagctgtttgtagagctcggcataatccggaacatcatacggataagcggccgccacatcagcgatcgtcacctcgacctcgacaccaggctcgatggtgatggaggtgatctgcttcacaacatctggggagctgatgagatcgatcacccgcttgtggatgcggaactcgaaacgatcccatgtgtttgttccttcaccgcacggcgacttgcgggtggtgatgtggagcaccttggtggggatcctgacggggcccttgacgcgcagctgcttgtccttggcgcccttcaccagatcagcgcaaaccttctcgaggttcttgacgttcttggaggagagggtgatgcggatgcgattgagctgcagctcccgcgcctcctccatgccgagcttcccgcccttcatcgcgccgccggcgccgtacaccgcagccgccgccatgcttaattaatgcgaaggtaaatacagtagatttaaacatcaggacctagagttcaccactcgaagtcttttctcagcttcttatccacaaatttcccttcacaattaaacagcaacttaaacttattaaagtcaaagatatgataacataaagaaaccaaagcagaaatagcactataaggggatcgatatctatccactaaagccttatccaaagcatcaagcaccttaaagtctttgtaagatttgtaattgtcattgatagagatataaatctcactcaaaacttctacatctctcacatcagttctacctaattttgtga

SEQ ID NO: 3656 - DNA, 610 bp, Artificial
  Synthetic
gaagctgcggctacgtcttttacatcttcgtcgcatctccctcagcaaatcaaatcaaatcaaaatatggcgtatgcagcaatgaaggcaacaaaaccagggctagaggagccccaggagcagattcacaagattagaatcactctttcttccaaaaacgttaagaatcttgagaaagtgtgtgctgatctggttcgtggtgccaaggacaagaggctcagggtaaaaggacctgtgcgaatgcccactaaggttctcaacattaccactagaaagtctccctgtggagaaggcacaaatacatgggacaggtttgagctgcgggtgcacaaacgtgtgattgaccttttcagttccgcagatgttgtcaagcagatcacctcaatcaccattgaaccgggtgttgaggttgaggtcaccattgctgattcttagattcttctctgttttcattaggttgttgaatttttttcaagtactagtggtttgcagttgctttcttggccgtctaaattatgggcttaaggttttctttattccaattaaagttttgcagctaaaccagatactaatactatttgatattgggaagaggatttgtccgttaaaa

SEQ ID NO: 3657 - DNA, 591 bp, Artificial
  Synthetic
gggtgaagcggcagcagttttcagtctcagttgcataattctgagcttcttctctccactctctgaaagatggcagcatatgcagcaatgaagccgaccaagccaggtctagaggagccacaggagcagattcacaagattaggatcactctttcctccaaaaatgttaagaatctcgagaaagtgtgtgctgatttggttcgtggtgccaaggataagaggctcagggtgaagggacccgtgaggatgcccacaaaggtccttaacattaccactagaaagtctccttgtggtgaaggtacaaatacatgggacagattcgagctgcgtgtccacaagcgagtcattgaccttttcagctctgcagatgttgtcaaacaaatcacctcaatcaccattgaacctggtgttgaggttgaggtcactattgctgattcttagatcctttgtcttacctaggtagatgagttactctttatatgctgtcgtattttgccctccagactttatgtattacgagttttttggaattacaattttgctgttaaactaagacttttgataaaagtaaagtgtatggtttgtttattt

SEQ ID NO: 3658 - DNA, 606 bp, Artificial
  Synthetic
ttgcgggtgtcaacaagcttctgcgcaccttgtctccttcgatcaccctcaaggtaggagataaaacatggcgatggcaatgggtatgaagcccggaaagcctggcctcgaggagcctcaagaagccctccatcgcatccgtatcaccctttcttccaagagtgtcaaaaacctcgaaaaagtgtgtgcggatttggttcgaggtgccaaagaaaaaaagttgaaggtcaaggggcctgttagaatgcccacaaaggtgttgcgccacaccaccaggaagtccccttgtggagaaggtaccaacacgtgggattgttttgagctgaggatacacaagagaatcattgatttgcacagctcttcagaagttgtgaagcagatcacctcgattacaatcgagcctggagtcgaggtggaagtgacaattgcagatgtctgagtgtagtcaattatttctttttgaccgggaaaaggttattgacttggttgaagagggatgactggtctttcaattttaggttatgtttctccttacgaatatttgttaggatttttgacatttaatcctgtgttaacggagaattgagctggatagtattttggaat

SEQ ID NO: 3659 - DNA, 247 bp, Artificial
  Synthetic
gagggcagggagagagagagagagagagagagagagagataagatgtcaatggcaatggctatcaagcctggtaaggctgttctagaggagtctcaggaggctcttcaccgaatccgaattaccctgtcctccacaagtgtcaaaaacctcgagaaagtatgtgccgattcggttcgtggtgctaatgaaaaaaggttgaaagtaaaggggcctgtccgtatgcccaccaaggtcttgcgccacact

SEQ ID NO: 3660 - DNA, 706 bp, Artificial
  Synthetic
ccctaacgccacccgcgccgccatccccgagcaccaccaaccccaccccccgagcgagcggagcggagaacgcgaggcgaggcgaagcaaacatggcggcggctgcggtgtacggcgccggcggcgcgatgaagggcgggaagctcggcatggaggaggcgcgggagctgcagctcaatcgcatccgcatcaccctctcctccaagaacgtcaagaacctcgagaaggtttgcgctgatctggtgaagggcgccaaggacaagcagctgcgcgtcaagggccccgtcaggatccccaccaaggtgctccacatcaccacccgcaagtcgccgtgcggtgaaggaacaaacacatgggatcgtttcgagttccgcatccacaagcgggtgatcgatctcatcagctccccagatgttgtgaagcagatcacctccatcaccatcgagcctggtgtcgaggtcgaggtgacgatcgctgatgtgtaatgctgccaaactagcactaccttagacctacctgtcttgtttctctgctgcttagaatctcggttccgattgccatgcgtgtaacggacatccaactggtttagtgtatctgggtcttttatatgtgcgcggatgctatggatctttctcatgtaagaggtgtgtaactcgccagttttgcttcaaccacatgaaatttggtattggattcaatttttgtc

SEQ ID NO: 3661 - DNA, 377 bp, Artificial
  Synthetic
aaaatgtcattcaacaaggataaggccgacgctgaagctccccagcagctccgaaagatcagaatcactctgacttccaccaagatgaagtctcttgagaacgtctccgctgacatcatctctcgagctaagaactccaacgttggcgtcaagggccccgtccgactccccaccaaggttcttaacatcaccacccgaaagacccctaacggtgagggttccaagacctgggatcactttgagatgcgaatccacaagcgactcatcgatctccactcccctgctgaggttgtcaagaagatcacctctatcaacatcgagcctggtgtggatgttgaggtcaccattgccgcttaagcttgttgaccccaaaactt

SEQ ID NO: 3662 - DNA, 550 bp, Artificial
  Synthetic
ctttcccggcctcatcactttgccgatacgaagatcgtcccctttcaatccaattataacgatccgttcgagtcgtgaagccgttcaaaatgtcttaccagaagaacgacaaggatgttcaggagccggctaaaagccacaagatccgcatcaccctttcttctcgcaaggtccaggtcctcgagaaggtctgctccgagatcatcgaccgtgccaagaacaaggacctccgcgccaagggccctgtccgtctgcctaccaagtgcctgaccgtcactccccgcaagaccccttgcggtgagggttccaagacctgggaccgcttcgagatgcgcattcacaagcgtctcatcgacctccacgcccccactgaggtcgtcaagcagatcattgtcaacatcgacgctggtgtcgaggttgaggtcaccatcgctgcttaagcgaatctccaatttcgtaaagatgttggagtggccgagaccctgacgtcgagggagatgaaaacagccctcgcagcagataagcacaaaataaactggttcaagacata

SEQ ID NO: 3663 - DNA, 622 bp, Artificial
  Synthetic
tggtatcaacgcagagtggccattctgcattgtctacatgcatagtactgtccagaaggaggataacaaccccggattaaccatcttgaggtggatctacgaagagcttccttctgaccataaggacaggcttcaggttgtatactttgtgcatcctgggatacggtcaaggcttgttcttgcaacactaggcagatttttcctgagtggaggcttgtattggaaaataaagtatgtcagtcgcctgcaatatctttgggatgacataaagaaaggagagctccagattcctgaatttgttcaaaagcatgatgacattctagagcacaggccactgactgattatggaattgaaccagatcccctccacttatcgcagatgccacctacagcctactcgtttgggagacatgactcgggatggtcatctagagagtacatgtcttagaaaagctgctagattctgtacagcattgtacttatgttccaattctaagagtctttacttatgtactaaactttcttctgcttgtctctgctcacttttgtgttaccataaaccagtactgcataagtgatctttgtcagagaaagaaagggaaggaaacccctactctcttcg

SEQ ID NO: 3664 - DNA, 691 bp, Artificial
  Synthetic
gttttgcaagttatccgaaattcgataaccatgttttcagaagttgaacaagaacagcttattgagaaacttgaaatcttcaaaatccaaggcagagataaacgtggccggaaaaccttgcgcatcatcggcaaattctttcctgctaggaatctgagcgttgaagtggtgaagaagtatttagcggagaagatctttccagaacttgagaaacggccgtttgccgtggtgtatgttcacaccgatgtggaaaaaagcgagaactttcctggagtatcagctttacgatccttctacgatgcgattccggtgaaagtccgagataatctggaggctgtttattttcttcaccctggccttcaagctaggctcttccttgccacttttggtcgcttcatcttcagcggagggttgtatgggaaattgaggtatgtgaacagggtggattatctgtgggaacatgtaaggaggaatgagattgagatgccagaattcgtgcttgatcatgatgaagatcttgagtaccgtccgatgatggattatggtttggaaagtgatcatgcgagggtctatggtgcgcccgcagtggactctcctgtgtccatgtactccatgagatgcatctcataggcgaatcggacggcctttgcactctttttgttccatagattaaatatgtagaaaccttttg

SEQ ID NO: 3665 - DNA, 940 bp, Artificial
  Synthetic
agaaacgatgagttctcagatttcggagattgaacaagagcagctgatcgagaagcttgagatcttcaagatccatggcagagacaaacgtggccgtaagatccttcgtattatcggaaaattcttcccagctcgatttctgtcactggatgtgttgaagaagtatctagaggagaagatatttcctcgattaggtagaaaaccattcgccgtactctacgtccacaccggcgtacagagaagcgagaacttcccaggtatctcagctctacgagcgatctacgacgcaattccggtaaacgtcagagacaatcttcaggaggtttacttcctccatccaggtcttcaatcacgtctcttcctcgccacctgcggccgatttctattttccggcgggttgtacgggaagctgaggtacataagcagagttgattatctgtgggaacatgtgaggaggaatgagatagagatgccggagtttgtatacgatcacgatgatgatctggagtatcgtccgatgatggattacggtcaagaaagcgatcacgcgagggttttcgccggagccgccgtggattcatcagtctcaagtttctccatgaggtgtatctcatagcgtaaaaggctaaaactccacccactagatatcggatcgtatcttataaaccatataatatacgaatacgattaataatatatcaaaaagattggaaataggtgtgctttttgaaattagtgagcgttttttatggaaaagaaaagaaaagaaagcagttggcgtctggataaagggaaggaggagaatctttagattttttctttaatctgtttttcttttgtcttgattagttttttctttagtggtggtggttgtgagttagtgtgtaaaatgtatattgtcatatgtgaatttaataataagtccttttgtaagatgatc

SEQ ID NO: 3666 - DNA, 427 bp, Artificial
  Synthetic
cccacgcgtccgtcatcttcttcttcactcgcctcaatttttgttcccttcttcttctataattcaactgtgaatttcaccgacgaaacaaaaaagagagagagagagagagaaacgatgagttctcagatttcggagattgaacaagagcagctgatcgagaagcttgagatcttcaagatccatggcagagacaaacgtggccgtaagatccttcgtattatcggaaaattcttcccagctcgatttctgtcactggatgtgttgaagaagtatctagaggagaagatatttcctcgattaggtagaaaaccattcgccgtactctacgtccacaccggcgtacagagaagcgagaacttcccaggtatctcagctctacgagcgatctacgacgcaattccggtaaacgtcagagacaatcttc

SEQ ID NO: 3667 - DNA, 505 bp, Artificial
  Synthetic
cccacgcgtccgcgtttcctaagatcaagaagccttgtcccccaatttacaaaccaccggtggtgatccctaagaagccgtgtccaccaaagattgcacataaacccatctacaagccgccggttcccatctacaagcctccagtgcctatctacaagccaccagtggttatccccaagaaaccgtgtccaccaaagatacacaagcccatctacaagccacccgtgcctatctacaagcctccagtggtgatcccaaagaagacatttcctccacttcacaagccgatctacaagcacccggttcctatctacaaaccaatcttcaagccgccagtggtggtgattccaaagaaaccatgtccaccacttcccaagtttccacacttcccacctaaatacattccacaccctaagttcggaaaatggcctcctttcccttctcatccttgataaagatgcaaaatcctctgtctttcttaatttaagaaaagtgatcgagtgat

SEQ ID NO: 3668 - DNA, 396 bp, Artificial
  Synthetic
cccacgcgtccggagagagagagagagagagaaagaaagatccaacttccacaaagaaccatggaagctgagaaagaaacagaacaagaaggaaacttgacagtaatgaaacttccggtgttaccaactaaacccaacactcacagccactctatgtcatcaccaattcacagttccatatcagcttcagttccctttagctgggaagaagagcctggcaagcccaagcaacactctacttcttcttcctcctcttcctcttcctcaccattaacttcttattcttcatctccttttgaaactcacaagtccttagagctaccaccaaggcttcacttacttgaaaaagatggaggatcagtaaccaaacttcactcgcctataacagtctttgat

SEQ ID NO: 3669 - DNA, 385 bp, Artificial
  Synthetic
aagctgcacaaggccgtgtccccgtgttcctggatggaggtgtccgccgtggaacagatgtctttaaagctttggcacttggtgcatcaggggtgtttattgggcgaccagtcgttttctcattagctgctgaaggagaagctggtatcagaaaagtattgcagatgatgcgcgatgagtttgagctaactatggcattaagtggctgccgttcactgaaagagatcactcgtaaccacattgtggccgattgggatgctccacgagctgctcttcccgcgccaagtttataaaataaaaccttaggtgtcaaattgtttcaccatgacaacgtattagttccacatgttttcaatagcttacttatctttcacgggaacactca

SEQ ID NO: 3670 - DNA, 1011 bp, Artificial
  Synthetic
ggggagtatgctacagcaagagcagcgtcagcagcagggacaatcatgacattgtcatcttgggccacttccagtgtagaggaggttgcttcaacaggacctggcatccgtttcttccagctttatgtctacaaggacaggaatgttgttgctcagcttgtgagaagagctgaaagagcaggtttcaaggctatagccctcactgttgataccccaaggctgggacgtagagaagctgatattaagaacagatttgttttgccaccatttttgacgttgaaaaactttgaaggattggaccttggcaagatggaccaagcaagtgactctggattagcttcatatgttgctggtcaaattgatcgcactctgagttggaaggatgttcagtggctccagactatcacttcattgccaatcctggtaaagggtgtacttacggctgaggatgctaggcttgcagttcaggctggagcagctggtatcattgtgtcaaaccatggtgctcgccaactcgattatgtcccttcgacaatcatggctcttgaagaggttgtgaaagctgcacaaggccggattcctgtattcttggatggaggtgtccgccgtggaacagatgtcttcaaagctttggcacttggagcttcaggcattttcattggaaggccagtagttttctcattagctgctgaaggagaagctggaatcaaaaaagtgttgcaaatgttgcgcgatgagtttgagctaactatggcattgagtggctgccgctcactgaacgagattacccgcaaccatattgtcactgagtgggatgctccacgtgctgctcttccagccccaaggttgtgaaaatgtaccttaagtgtcaaattgtttcatcaaaacaaagtattgcttcactgtttcagaagcttatatttcggttttgaatacttgtttctgtttaatgagtttacgaatatgttaagcttttctcagtaatcgaaaactgataaattctaaaaaaaa

SEQ ID NO: 3671 - DNA, 619 bp, Artificial
  Synthetic
ccccccttgcctccagttgcaatgccatgcgcttttatcagctatatgtgtataagaataggaatgtttcagcaacattagtacggcgggccgagagttgtggattcaaggcacttcttttgacagttgacactcctatgctcggtcggcgtgaagcagatatccgaaacaaaatggttttcccacggagtggtaatctcgaaggtttaatgacaatagatgaccatgataccacaaacggttctcagctcgaacgattcgcacgagcgacgctggatccatcattatcatggaaggatatagagtggctcaagtccataaccagcatgccgatctttctcaagggcatcgtcaccgctgaggacgcgaggagagcagtggaggctggggtggccggcgtgatcgtctccaaccacggcgcgcggcagctggactacgcgccggcgaccatcgccgccctggaagaggtggtcagggcggtggccggcgccgtgccggtgctggtcgacggcggaatccggcgaggcactgacgtgttcaaggccctggcgctcggcgcacgggcggtcatggttgggaggccggtgttcttcgggctggcggcgaggggggaggcagg

SEQ ID NO: 3672 - DNA, 600 bp, Artificial
  Synthetic
acagatgaccactccgtgggaaaaccattgtgtttcggatatctgcttcacgccgatctttctcaagggcatcgtcaccgctgaggacgcgaggagagcagtggaggccggggtggccggcgtgatcgtctccaaccacggcgcgcggcagctggactacgcgccggcgaccatcgccgccctggaagaggtggtcagggcggtggccggcgccgtgccggtgctggtcgacggcggaatccggcgaggcactgacgtgttcaaggccctggcgctcggcgcacgggcggtcatggttgggaggccggtgttcttcgggctggcggcgaggggggaggcaggcgcgaggcacgtgatcgagatgctcaacggcgagctggaggtggccatggcgctctgcggctgccggagcgtcggcgagatcacccgcagccatgtcatgaccgagggtgacaggatcaggtccctgctctgatgaatcatttctcatctggccaatgcagcttcaggtctaaaaatacaagtgggctatgggccaacccgtaaaccgatttataggtaataaaatttgaccgacccgtgaatctatttatatgtaaa

SEQ ID NO: 3673 - DNA, 776 bp, Artificial
  Synthetic
tggcttcttacgtcgccgggcaaatcgatcgcaccctgagctggaaggatgtgaagtggctgcagaccatcaccacgctgccgatcctggtgaagggagtgatcactgcagaagacacgaggctcgccgtggagaacggcgcggccggcatcatcgtgtccaaccacggcgcccgccagctggactacgtcccggccaccatcagcgccctcgaggaggttgtgaaggcggctcgcgggcagctccccgtcttcctcgacggcggcgtccgccgcggcaccgacgtcttcaaggcgctcgccctcggcgccgccggcgtcttcatcgggaggccggtggtgttctcgctggcggcggcgggggaggccggagtccggaacgtgctgcagatgctccgcgacgagttcgagctcaccatggcgctcagcggctgcacctccctcgccgacatcacccgcaaccacgtcatcaccgaggccgacaagctcggcgtcatgccgtctcgcttgtaaacaacaacgacggcgaacttgtcgccgtcgatcgatcaccggccggccgccgcgacacgctttgccggccgacggatgatcggccgggaatgaagaagaaggtagtagctgccgaagaaaagattggaagatgcaaagttctataattttggatgatgctgcgtcatgtacttttgttaattgtcgagtgattgatcacctgtacctaattaaatggtttattggattattggcggtttatactaaacgaacaaattaatacct

SEQ ID NO: 3674 - DNA, 816 bp, Artificial
  Synthetic
gaattcaagtgccatgcaaaaaatggctcaccctgaaggagagtatgcaacagcaagggcagcatctgcagctaacaccattatgacattatcatcatgggctacttccagtgttgaagaagttgcttcaacaggaccagggattcgttttttccaactctatgtgtacaaggacagaaaagttgttgagcagttggttagaagagcggaacgagccggcttcaaggcaattgctctcactgttgacaccccaagacttgggcgtagggaagctgacattaagaacagattcactttaccaccatttttgactttgaagaattttgagggattggaccttggacagatggaaaagtcaagtgactctggacttgcgtcatacgttgctggtcaaattgatcgaactctaagctggaaggatgtgcaatggcttcagacaattacgaagatgccaattctagtgaagggtgttgttactgctgaggatactaggttagctatacaagcaggagcagcaggtatcatcgtgtccaaccatggagctcgtcagcttgactatgcaccagccaccatcagttgtcttgaggaggtcgtgaaagctgcacagggccgagtccccgtattccttgatggtggggttcgtcgtggaacagatgttttcaaagcattagctctaggagctgctggcatatttattggaagaccagttgtgttctcattggctgctgaaggtgaggctggtgtaaaaaaggtactccagatgcttcgcgatgaatttgagttgacaatggccctaagtggatgccgctcactcaa

SEQ ID NO: 3675 - DNA, 592 bp, Artificial
  Synthetic
attcgtttcttccagctttatgtttacaaagacaggagggtggtggagcagcttgttaggagagctgaaagggctggattcaaggcgattgcgcttacggtggatactccgcgacttggccgtagggaggctgacatcaagaacaggtttgttctgccaccatttttgacactgaagaactttgaaggcctggagctggggaaaatggaccaggctagcgattcaggactggcttcttacgtcgccgggcaaatcgatcgcaccctgagctggaaggatgtgaagtggctgcagaccatcaccacgctgccgatcctggtgaagggagtgatcactgcagaagacacgaggctcgccgtggagaacggcgcggccggcatcatcgtgtccaaccacggcgcccgccagctggactacgtcccggccaccatcagcgccctcgaggaggttgtgaaggcggctcgcgggcagctccccgtcttcctcgacggcggcgtccgccgcggcaccgacgtcttcaaggcgctcgccctcggcgccgccggcgtcttcatcgggaggccggtggtgttctcgctggcggtggcggggg

SEQ ID NO: 3676 - DNA, 704 bp, Artificial
  Synthetic
accctttcaatcctttaatttctcattttggcccaactcccaaaacccccaccgtcgcacccctccgttattccgctgcctccgccacaccagaaaccaccaccacgaccgccacagcattccacggcctttgctacgtcgtaggggacaacatcgacactgaccaaatcatccccgcagaatacctaaccctagtcccgtcaaacccagacgagtacaaaaaactcgggtcctacgcgctgtgcggactcccttcatcgtaccaaacccgtttcgtcgacccggatgaattcacatccaagtactccatcattataggcggcgacaacttcgggtgcgggtcgtcgcgggagcacgcgccggttgctttaggagctgcgggcgtggcggcggtggtggcggaatcgtacgcgaggatattctttaggaactcggttgcgactggcgaagtttatccgcttgaatcggaagtgaggatttgtgaggagtgtaagacgggtgatgtggtgactgttgaactaggagagagtaggttgattaatcatacgactgggaaagagtataaattgaagccaattggtgatgctggtcctgtcattgaagctggtggcatttttgcttatgcaagacaggctggaatgattccttcccgagatgcttagtttttcaaagtggtaattgattcggttcacatattttctctt

SEQ ID NO: 3677 - DNA, 577 bp, Artificial
  Synthetic
ccccacacactgaacaccatggcggcggcggcggcggctccggctctatccttggccgaggcggcgccggtgacagcagttctggcaccgtgtcccacgccctcgaggacgttccgccgccgcagctgggtcgcggctatctgccggcccgccctgaaatgccaccacagtcgtcccctgaccgccgtggtcgccgcggctgcggctgccgctgcggcgggggactcgacgtcggccggcgtattccacggcgagtgcttcgtcgtgggggataacatcgacaccgaccagatcatcccggccgagcacctgaccctggtcccgtccaagcccgacgagtaccgcaagctcggctcgttcgccttcgtcggcctccccaccgcggcctacccgacgccgttcgtcgcccccggcgaggagaccacccgctacgccgtcatcatcggcggcgccaacttcggctgcggctcctcccgcgagcacgcgcccgtcgccctgggcgccgccggcgcccgcgccgtcgtggccgagggctacgcgcgcatcttcttccgcaactccgtggccaccggtgagg

SEQ ID NO: 3678 - DNA, 203 bp, Artificial
  Synthetic
cccacgcgtccgtttatcctttggattctgatactagggtttgggatgagtgtacatctggtgatgtttcaactgttgacttgacggaaggagatagttttttgatcaatcataccactgggaaagagttcaaacttaagccgattggtgatgcttgaccagtgattgatgctggtggtatatttgcttatgctacgaaagct

SEQ ID NO: 3679 - DNA, 617 bp, Artificial
  Synthetic
tggaaaatccggtgcagttctgacgctctcgtgttaactctgctccgaaatgtctgcatatgataatgtggttggcgggaagttgaaactaaagggaaaggcattggatgtaaaagccgctggaataaagaaaaagaaaaggaaagaaaagaaggattatgatcaaatctcccaagttacaggaaaggagctttcaacagatggtggtagtggatctttagatgatcccaccaaggaagagagcacagatgccactaaatctgttggtgaagaaaatgctggtcgctgggatgataatctaacccctgcagagaggcgctacatagaacaaagggagaggattgacatgcataagatggccaagactgctaataaatcacatcgtgaccgaatcgaagatttcaatcagtacttggcaaacatgagcgagcactatgacattcccaaagtcggtcctggttaattaagaacaaatcagaaatttgctccatctctatatcttgtttatggttgttttgttttagcatatttaatagctacttttttgcaatttgtattatgtaatttagcagtttcctttgctagatggtgaaggggagccttggagtaatggtaaa

SEQ ID NO: 3680 - DNA, 622 bp, Artificial
  Synthetic
ccccaaccctcgcttctcggggacgcggagcggccagccggccaccttccactgcctcgagctcctctccttctccgggttggtgtggcgtggagatccatcctggccgacctctttcgctaggcgagatgtctgagtaccagaacgtcgttgggggtaggctcaagctgaaggggaaggcgctggatgtgaaggaagggggagtcaagaagaagaagaagaagaagcagcaccacgaggagtcatctgaagccgggcacggagagcttcaccaaggtggaagctctgaagtaccagctgaccctaatgatgaattgactgaagctgataagatgggagaagaagggaacctgcaaggcgactatgatcacctcaccccagctgagaggcgttacatggagcagaagcagaagattgacatgcataagctagccaaagtagccaacaagtcacacagggaccgcatccaggacttcaaccaatacctggcaaatcttagcgagcactacgacatcccaaaagttggccctggttaactttgcctattcagagcttcgcaggaatgcttcctatgctgtacccatccagccatctgttagcttgtgatgctcctacctgtatt

SEQ ID NO: 3681 - DNA, 613 bp, Artificial
  Synthetic
cccccgaaccctcgcttctcggggacgcggagcggccagccggccaccttccactgcctcgagctcctctccttctccgggttggtgtggcgtggagatccatcctggccgacctctttcgctaggcgagatgtctgagtaccagaacgtcgttgggggtaggctcaagctgaaggggaaggcgctggatgtgaaggaagggggagtcaataagaagaaaaagaagaagcagcaccgcgaggagtcatctgaagccgggcacggagagcttcaccaaggtggaagctctgaagtaccagctgaccctaatgatgaattgactgaagctgataagatgggagaagaaggaaacctgcaaggcgactatgatcacctcaccccagctgagaggcgttacatggagcagaagcagaagattgacatgcataagctagccaaagtagccaacaagtcacacagggaccgcatccaggacttcaaccaatacctggcaaatcttagcgagcactacgacatcccaaaagttggccctggttaactttgcctattcagagcttcgcaggaatgcttcctatgctgtacccatccagccatctgttagcttgtgatgctc

SEQ ID NO: 3682 - DNA, 713 bp, Artificial
  Synthetic
gaattcagaacaggatatcaaaagaagagaagatgctgttaccagagctggtgtcccctcagatgatagaaactggcctccgttttttccacttattcatcatgatatagctaatgaaatacctatccatgctcaaaggttgcagtatctggcttttgcaagttggttaggtatagtcttttgtcttgcattcaatgttattgctgtgactgtctgctggattagagggggaggtgttaaaatatttttccttgctattatctatgcacttcttggatgccctctttcatacgtgctgtggtacaggccactctatcgcgcgatgaggacagatagtgccctgaaatttagttggtttttcctgttttacctgatgcacattggtttctgcattgttgctgctattgcccctccgattgttttccaggggaaatcgtttacgggtattctttccgccatatcagtcttctctgaccatgtgctgcctgggatcttctatttggttgggtttggttttttttgcttggaaacacttctaagcttttgggtacttcagaaagtttacatgtatttcagaggtaataagtgaagatttcctaagctctagtcaatattccagttggtgttcatgttgcaaaaagctatcagtatattctttactttctcttcgagacaagttatctatttcttgtgattatgaatgtattttgggt

SEQ ID NO: 3683 - DNA, 917 bp, Artificial
  Synthetic
cggagcgcacgctagtggagcagctgctgcgggggttggccaccgcctccatcgccgtcgccgactcgccgccatcgtcgttgccgtcgtcgccgtcggcggagtaggcaggcggccatggcggggaagcacggccgcaacggcttcgaggacgacgacgtcaatcccttcgcgggaggaagtgttcctcctgccaacaattctcgactcccacctctctcccatgagccagctgatttttacaatgtggacattcctcttgactcgtctaaggatttgaagaaaaaggagaaagaactccaggcaatggaagctgaactaaacaaaagagaaagggaactgaaaaggaaggaagaggctgcagcccaagctggcattgtcattgaagataaaaattggccaccctttttccctctcattcaccataatatttcaaatgagatacctattcatctacaaagaatgcagtaccttgcattttcatcgtttttgggattggcagcctgcctattttggaatatcatagcaaccacaaccgcatgggtaaaaggggaaggtgttattatctggttgcttgctattatctacttcatatctggtgtacctggtgcttatgtgttatggtaccgccctctttataatgcaatgagaactgagagtgctttgaagtttgggtggttttttctgttttacctgattcatataatcttctgtgtgtgggcagctgtggctcctccttttcctttcaaaggaaaatctttggctgggattttgcctgccattgatgtcataggcaagagtgctatagtggggatattttactttgtcgggtttggattattctgccttgagtcactgctgagcattggtgtcattcagcaagtatacatgtacttccgtggaagtggaaaagccgc

SEQ ID NO: 3684 - DNA, 833 bp, Artificial
  Synthetic
gcggggaagtccaacaagcacacgacccggatctggtcgtggatttggcattccctgggccagcgccccaaatgcagcggcttttctagatcttgaaagcgattccttgatcgtctcctgccatggcgtcgcgctacgattcgaatccattcgacgaggaagatgtcaatcccttctcggaccctgctgttcgtgctcaaatgacggggaagccatcgtatctggggaacaatttctatgaatcgcaaccatacaatgttcctcaggtgaactcgatatctcctctagcaccggagcggacctcggttggagatgccaccgtggaaattcccctgggcaacatgaaggatctgaagaaacgggaaaaggagttgaaagacaaggaagagcaactccgaaagagagaagccgaagtgaaaaggcgagaggacgctgcatcaagagctggaatcgtgctcgaagacaagaactggccgcgctttctcccgatactgcaccatgacattgcgagcgacatcccgcagtacttgcagcgcatcatgtactacgcatatggaagctggctcggaattctcttatgtttgacgtggaattttgttgccgtcactggagcttggatccaaaagactgtcagcgcttcctatggtgtgcagatatggttcctcgctattatctacattcttgcgggctttccggggtccttcttcctctggtacagacctctgtaccgtgctatgaggtcagagagcgcgatcaagtttggatggtttttcatcgcgtatctgttccacatcctgttttgcatcttctgctgtgtcgctcctcccgtcgtg

SEQ ID NO: 3685 - DNA, 748 bp, Artificial
  Synthetic
tcttctatttttgctactattcagatctcatctttaaagcaaaactcagaattggttgaaatggcgggccgttatgatcgaaacccttttgatgaagaagaagaagttaatccttttgctggtggtggaggcagagggaaagcttcagggcaatcaaattttagtggaggtgcatttaatatcacatctggtagtgtgcctccagcaacaaactccaggctttcaccccttccaccagagccagctggcttctatgaccgcgatgcaccaattgatattcctcttgatagtgcttcggacttgaaaaagaaagaaaaagaattacaggctaaagagagtgaattgcgacgaagggaacaggaactaaaaaggagagaagatgctgcagcaagagctggcattgttatcgaggagaaaaattggcctccgttcttcccaattatccatcatgatattgcaaatgaaataccaattcatcttcaaaagctacaatatgttgcatttacaacattcttgggacttgttgcatgccttttgtggaacatcgtagctaccactacagcatggattaaagaaggagatgtaaagatctggttcctttccatcatttacttcatatcggcggttcctggagcctatttcatgtggtatcgtcctctgtatcgcgcttttagaactgagggtgccatgaagtttgcgtggtttttcttgttttacatggttcacattatattctgtatcttcgctg

SEQ ID NO: 3686 - DNA, 511 bp, Artificial
  Synthetic
ggtcgacccacgcgtccggtcttcttcttcttctgataactagatttttcaatcttctgaagctttaattttttcatagccatggctaatcgttatgatccaaatcctttcgctgaggaagaagaagtcaatcctttcgctaatgctagaggagttccacctgcgtcgaattcgagactttcgcctttgcctccagagcctgttggtttcgattatggtcgaaccgtagacattcctcttgacagagctggtacacaggatttgaagaagaaagagaaggaactccaagccaaagaagctgagctaaaacgacgagagcaggacctcaaacggaaagaagatgctgctgcacgagctggaatcgttatcgaagtgaaaaactggccgcctttcttcccgcttatccaccatgatattgcaaatgaaattccggttcatctccaaagactacagtatgttacctttgcaacgtatttggggttggttctttgtcttttctggaatatcatcg

SEQ ID NO: 3687 - DNA, 462 bp, Artificial
  Synthetic
gacccacgcgtccgaaaaagcctgcttgatagtatgactgacattgatccatcagtttatgccaacttcttttgggtctcttctcagtaccataaagtccgtcaagagttctctgagttctataaaaatgctcttctttacctcgcttatacgtctgtggactcactctcggaatcatttaagctggatttggcttttgatttgtcgctttcagctctacttggggagaatatctataactttggggaactgttagcccatccaattttgaaaagtctgcttggaacaaatgtggaatggctttaccacattctacaagcattcaaccacggagatttagttcagtaccaagaactctgtcgtgtgcacaatgcatcgttgagtgctcaaccagcactggttgagaatgagaagaaactattagagaagatcaacattctctgccttattgagatcattttc

SEQ ID NO: 3688 - DNA, 400 bp, Artificial
  Synthetic
ggacaatccatgtctcctgggtgcaaccaagagttcttggaattccccaaatcaagtcattgcgtgatcggctagacaattgggtggagaaagttcacactactttgctagcagtagaggctgaaactcctgatttagttgcatcataatcataatcaagcagagactctagcgaaactaaatctagtttcttgggttgtcattgtcccgatttacgtaacaaattcaatgatctcgatgtgtttttaagggaagcaggtgcttgttattgtatttcatttcgtcaggttcataatgacattcctagggaaaacagggagccatgttgtgaaatggctgtactttactgctttagatacttagatcttttatgcactagaatctaaaagaatccagtttc

SEQ ID NO: 3689 - DNA, 329 bp, Artificial
  Synthetic
agaaaaggtcggtagagagagaacgagaaggagaaggagagaggagagagaagatggcaggagtgtggcccgtaatgcaagattgggagccggtggttgttcggaagaagaccccaaactcatcctccatgaaggacgagaaggctgtcagcgctgctcgccgcgccggaggacccgtcgagaccatcagaaaacataacgctggatctaacagaggtcacatccagcactattagcctgaacacaatgaaactggacgatgagactgacgtgctgtcacatgataaagttccgtcagaaatgaaaaaagcgatcatgcaagcacgctt

SEQ ID NO: 3690 - DNA, 594 bp, Artificial
  Synthetic
tcttcttggtcctcctcttgtctcgtctcgatggccgggattggtccgatcaggcaggagggggagccggtggtggtgcggaagaaggcgcccaccgccgccgccaagaaggatgagaaggccgtcaacgccgcccgccgctccggcgccgagatcgagaccatgaagaagtataacgctggaacgaacaaggcggcgtcaagtggcacatccctcaacaccaagcggctggatgacgacaccgagagccttgcccatgagcgtgtctcaagtgacctgaagaaaaacctcatgcaagcaaggctggacaagaagatgacccaggcacagcttgcacagatgatcaatgagaagccccaggtgatccaggagtacgagtcaggtaaagctattccgaaccagcagatcatcgggaagcttgaaagggctcttggaacaaagctgcgcggcaagaaataatgttctactattaggccctgaagcatagtgttggagcaaccaaagccaaaatgtttgcgtaacctatgctgggtcttttgataccatgcaggatgtttctgttggtgcatgagtgaatactgaataactattatg

SEQ ID NO: 3691 - DNA, 600 bp, Artificial
  Synthetic
tttctctaaaagaagaaaagatggctggaatatcacaagattgggagccggtggtgattcgcaaaaaagtgccgaccgccgccgcaagaaaagacgagaaagcagtcaacgccgcccgtcgcaccggtgctgagatcgaaaccgtcagaaaagctactgcagggtcaaacaaggctgcatctagcagtacaacattgaacaccaggaagcttgatgaagataccgagaacttgtcacatcaaaaggtaccaactgaattgaagaaagccattatgcaagcacgacaagataagaagttaactcagtctcaacttgcccagttgataaacgagaaaccacaaatcattcaggagtacgagtctggaaaggcaattccaaaccaacagataatctctaaactggagagagctcttggtgctaaacttcgcggaaagaaataaaggttggaatagtgaaccttttggattagactgtctggttgtatcctaaaagtggtcatgtacatgagcttttttactttaaccactatggtacttgttgtatctggattcatgatgtggttttcgtggttgacttgggtgttttttcttgtgaaaaatg

SEQ ID NO: 3692 - DNA, 689 bp, Artificial
  Synthetic
gaggaagaagagcaagaggaagagcgaagaagatgagtgggcatatcgcgcaggattgggagccggtggtgatccggaagaaggccgtgactgccgggcagcgccgcgacgagaaggccgtgaacgaggcgcgccggtcaggagggccgatcgagacgatcaaaaagttcaatgcggggtccaacaaggcggcgacgagcacaccgggaatcaacactaagaagctggatgacgagacggaggagctcgcccacgaacgcgtttcaactgatctaaagaagaacatcatgactgctcgcgctgaaaaaaaaaatgacgcaggcacagcttgcacagctgattaacgagaagcctcaaatcatccaagagtacgaatccgggaaggccatccccaaccagcagatcatctccaagctcgagcgcgcgctggggacgaaactgagaggcaccaccaagaagtgagtaacttcccgtcgtttcttttctttctgtctgtgaaaggtcgtaactgtgcgaacaaaaactatgcttctacaaacaacgtttcgaggacaccctctgtaatgtaaatacaatgctctgctgctgtacaagcaatagctacagatacaaatcgatccggctgcaagcaactctactgcctgtccggaagaaagaatcgatcgaagctttcgaagcacgaagacttg

SEQ ID NO: 3693 - DNA, 533 bp, Artificial
  Synthetic
acgaagaaagaagccctagattttgtcaaaatttggtttctgaacaaaaaaccatggccggaattggaccgataactcaggattgggagccggtggtgatccgtaagaaacccgctaacgccgctgccaagcgcgacgagaaaactgtcaacgccgctcgtcgatccggcgccgatatcgagaccgtcagaaaattcaatgctggaaccaacaaggcggcatcaagcggcacatctctgaacacaaaaatgcttgatgatgacactgagaaccttactcatgaacgtgtgcctactgagctaaagaaagccattatgcaagccaggacagacaagaagctaacccagtcccaacttgctcaaatcatcaatgagaagccacaagtgattcaagagtatgagtctggcaaagctatacccaaccagcaaatcctttctaagctggagagagcgcttggagctaagcttcgtggaaagaagtgagccaagttctactgatgtagcaagtaacaagaatcaatgctttcgtctaat

SEQ ID NO: 3694 - DNA, 364 bp, Artificial
  Synthetic
gcagctaagcgcgacgagaagactgtcaacgccgctcgtcgaagcggcgccgatattgagaccgttcgaaaattcaatgctggatcgaacaaggctgcatcaagcggcacctccttgaacacaaagaagctagatgatgatactgagaacttatctcatgatcgtgtgcccactgaattgaagaaagccatcatgcaagctagaggggagaagaagctgactcagtcccaacttgcccatctgatcaatgagaagccacaagtgatccaagaatacgagtctgggaaagcaattccgaatcaacagatcctttcaaagctggagagggcacttggtgctaaactccgtggaaagaagtagaagt

SEQ ID NO: 3695 - DNA, 723 bp, Artificial
  Synthetic
cccacgcgtccgcatttcttgttattatccacgaacgaagaaaaacctagaaaacagttgaagaaagaaaatcacaagagaagccatggccggaattggaccgattactcaggattgggaaccagttgtgatccgcaagagagctcctaacgctgcagctaagcgcgacgagaagactgtcaacgccgctcgtcgaagcggcgccgatattgagaccgttcgaaaattcaatgctggatcgaacaaggctgcatcaagcggcacctccttgaacacaaagaagctagatgatgatactgagaacttatctcatgatcgtgtgcccactgaattgaagaaagccatcatgcaagctagaggggagaagaagctgactcagtcccaacttgcccatctgatcaatgagaagccacaagtgatccaagaatacgagtctgggaaagcaattccgaatcaacagatcctttcaaagctggagagggcacttggtgctaaactccgtggaaagaagtagaagtgtagaacaaagcttttaaaggtaacaacaaaagctgatcgcagtttctctccagtccacatgctttaccatatcctaaaaactatatttatgtatggtttggtttaatggcgtagtagtttgttgcgaggaatctttcatgatgtaagaaaaacaaagctgtttggaaccttttgtcattataaataatttcttctctttctttt

SEQ ID NO: 3696 - DNA, 670 bp, Artificial
  Synthetic
aagcgcaacaaaagcaagggtcaagagagatattttttcccgagaagaagaagaaaaaaaaggatgagtggaggaatagcacaagactgggagccggtggtgatccgcaagaaggcgcctaccgccgccgcacgcaaggatgagaaagccgtcaacgccgcccgtcgctccggtgctgagatcgaaaccatccgaaaatctgctgctggcacaaacaaagctgcctccagtagtacgaccttgaacaccaggaaacttgatgaagatactgagaatttggctcatcaaaaggtaccaactgaactgaagaaagccatcatgcaagctcgacaagataagaagctgacccaggctcaacttgcccagttgataaatgagaagcctcaaatcatccaggagtatgagtctggaaaggcgattccaaatcaacagataatctctaaactggagagagctcttggtgcgaaacttagaggaaagaaatgaagtgccttttgggtttctcaaatctccgttccagtcctaaaagtggtcatgtacatgaacatcttcctatgttagccctctttctgtaaccactttggtgcttgtgcctgtgtatggattgatggttgaggatttcctagctaaacgggtgttactaatatggaaaataaaggcgtttatgctt

SEQ ID NO: 3697 - DNA, 625 bp, Artificial
  Synthetic
gatgatttgagtcctcgtcgcgtcgcgtcgcgtcgtgtccacctgcgaatcctctagtcctcgcgagtcgcgacacgcggagctttggcacctgcagcgatggcgaccgaccaccgccgcttccccgtcttcctcgccgcggcgctgctcaccctcctcctcctcccggcctccgccgcggccaccgacgtcgagtactgcaggcaggggcgggattatcctgtgaaggtgagcggagtggagatcgtccctgaccccgtcgtcagcgggcagccggccaccttcaagatctccgcatccacggataaaagcatcactaaggggaagctcgtgatagatgtcaagtacttctttttccatgtccattcagaaagtcacaacctttgtgaggagacctcttgcccagtaactggtgaattcgtgcttgcgcacgaacagactttaccatcaatcaccccaccaggttcttacactctcaccatgaggctactagatgacggcaacaaggaactgacctgcatctcgtttgggttcagcatcgggttcatttcacctcttgctctcatctaaattcagctggagtcacagcaatgtacttgcagaactcccatagtcctaccacaac

SEQ ID NO: 3698 - DNA, 695 bp, Artificial; identical to SEQ ID NO: 139
  Synthetic

SEQ ID NO: 3699 - DNA, 670 bp, Artificial
  Synthetic
attgatagatagatagagagatagagagacagagagagagagaaagaaagaaagaaagaaggaaagaaaggccaagggcacaagttcaaaaccatcgatctcttctacaatagaatgagcaatctaagaaggatgtgctatctctttctggttttgatcagtaccttctttgcacttgtgaatgcaaaggttacatggcagtcctgctcgtcaagaatcgactacaaagtggatgtgcaaggtgtcagtgttattccggaccctgttgtgaagggagtcgatgcaacatttaaaattcctgccatcacaaaggatccaattaccggaggcacagtggtgatagatgtgtactactttgggattcatgtacactctgagaaagatgatttatgcagcaaaacagaatgcccggttgcacctggagagtttacacttacgaactcccaacctctacccaatttcacaccatctggatcttatcgtctcaacatgaatgtgtacgacaccgatggaagtctgctgacttgtgtcaaaatcagctttaaaatagtgggatcagtcaatcagcttgaatccagtgatttgaacaggttttccgaagatcgattcgtgcatgaagattgatacaaggctatgtcagtttcaaacaataaatgtaaatatgggatga

SEQ ID NO: 3700 - DNA, 638 bp, Artificial
  Synthetic
gatagatagatagagagatagagagacagagagagagagaaagaaagaaagaaagaaggaaagaaaggccaagggcacaagttcaaaaccatcgatctcttctacaatagaatgagcaatctaagaaggatgtgctatctctttctggttttgatcagtaccttctttgcacttgtgaatgcaaaggttacatggcagtcctgctcgtcaagaatcgactacaaagtggatgtgcaaggtgtcagtgttattccggaccctgttgtgaagggagtcgatgcaacatttaaaattcctgccatcacaaaggatccaattaccggaggcacagtggtgatagatgtgtactactttgggattcatgtacactctgagaaagatgatttatgcagcaaaacagaatgcccggttgcacctggagagtttacacttacgaactcccaacctctacccaatttcacaccatctggatcttatcgtctcaacatgaatgtgtacgacaccgatggaagtctgctgacttgtgtcaaaatcagctttaaaatagtgggatcagtcaatcagcttgaatccagtgatttgaacaggttttccgaagatcgattcgtgcatgaagattgatacaaggctatgtcagt

SEQ ID NO: 3701 - DNA, 709 bp, Artificial
  Synthetic
ccccccctgtacccggtgaaggtgagcggggtggagatcgtgcccgatccggtcgcccgcggcgagcccgcaaccttcaagatctccgcttccactgataaaactatcggtaaagggaagctggttattgatgtgaaatacttcttcttctatgtccactcggaaactcgtgagctctgtgatgtgacttcctgcccggcaagtggtgacttcttggtagctcatcagcaaaccctgccatcatacactccaccaggctcttacaccatcaccatgaagatgctgggtgataacgatgaggagctgagctgcatctcgttcgggttcagcatcggtttcgctgcatcacaagccaccatctgaatgcatccagaggcagaattcagaaatatcacaccatggatgtaattacaaaagcacctatgtatcttagatcatagaactcaaatacaatgcgcatctgccaacacattgtgttcaactaagacgttttatccagagttgaacatacaataaaaacatcactcactagtgtacctaactccgtttagctgttgaaatgtgttgcattgcatgttgaattgagcctggatgcatcttgatcttgagaaaaaattcctgaacttttgaggtgtgaagcttgtgcaagcaatctgggtggttggtgctgtacttaaccactagccacatgggaaaaccatgttatgtt

SEQ ID NO: 3702 - DNA, 706 bp, Artificial
  Synthetic
ggctctgttcgtatctggtctctccttcctaagtagcagtccaacaggtgataatgtggaatcggtggttataacgctttaataggagacttgcactttcaactattattattctctcccatctttatctgtatccgtcctttgctttgctccgatcaaatggcaatgattgccgtgaaactctttgttggtcttctgttattcctatgtcttctctctcctctcacttccgctgaatccaccgatttcgagtattgcaataaaaaggccaagtacgatgttaaggtcagtggaattgatataacgccctatccagtcagcggaggtaaaaagaccacattcagtatcagtgcatccacaggtcagaatctcaccggaggaaagctggtgattgatgttaactatttgttcttccatgtccaccacgaggccatcgacctatgtaaagagacatcgtgcccagcttccggtgattttgtgatttcccactcacaagagttgcctggatttactccacctggatcatacactcttacaatgaagatggtggatgacaaaaatcatcaactgtcctgcataagttttggcttcagcattgggtttatagccgagtcccaggcgttagcagcagatagctaggtggtccaaggacctagtaacaaataatggtttttcaatattgtaatcaagtgttctctccaaactt

SEQ ID NO: 3703 - DNA, 588 bp, Trichoderma harzianum
agacgggaaagccgctggaggttggtacttcctttgatatagtcgcttttttttttcgctgtaaatctttcggattacactatatcatcatgaagtttcacgcaactgcccttacacttgcatatttggcaaactatgcttcggcagcagtggcccagccgaggagtgaagcaaacgagtctgctactcccgaaggcaagacgttctccatctctcaagtatataacgaacagtacaaagcaaccaatgtccccgccacctacattgcagctctggcaaaatatagcccccagctcccagagcacatcaaacatgtgatcatggccaatccggatctgcaccgcagatttggctctcttcttgatgctggtaatcagacgggcactgccgttgccacaccatctccgggagccgattcggaatatgttattcccatcaagattggcacaccccctcaaaccgtgccaataaaccttgataccggttcatcagacctttgggtcttctcgacagacacgtatccgtcccaagtccaaggccaggcgatttacaaccccggtgcctcaaacaccagctcacgccagaacg

SEQ ID NO: 3704 - DNA, 229 bp, Trichoderma harzianum
gcatcatcaaagcgaacaagctcagttgatgcctcgagacagcggcagaaaccgacaacacgaaccccaaactcgaattcgagcgcaaaccagagcacaggaagagggcacatgtcgaacccaaacaactggcaggaggaggcgatgcggcgtctgcgccagatgcagacgcggggcgggtatcccggacgaggaggaccgcagatgcccagaggagcaaacggcgcct

SEQ ID NO: 3705 - DNA, 383 bp, Saccharomyces cereviseae
  misc_feature (195)..(195): The residue at this position can be any nucleotide.
  misc_feature (198)..(199): The residues at these positions can be any nucleotide.
  misc_feature (222)..(222): The residue at this position can be any nucleotide.
gaattccagctgaccaccatggcttctagagtggacgaaactacrgtcccctcatactactattacgtggatccggaaactacatatacgtaccaacaaccaaatcctctacaggacttgatatcggtgtatggcttggatgacatctccaggcaagtggcaagaacaaatttggacggcactaaagccgtgaantannaaaatcttacaagaaccagatancagatctttcaggtaaattctccaccataccgaccagagaaaatggtaaaggtggtcaaatagcacatattcttttccaaaataacccagacatgatgatacaaccacctcagcagggtcaaaacatgtcagagcgacaatggcgcggacagctgcgcaat

SEQ ID NO: 3706 - DNA, 434 bp, Saccharomyces cereviseae
gaatcccagctgaccaccatggtcaatagtaagaggcagcagagaagcaagaaagtatcgtcatcctccaaagtgccccccaccaaggggaggacatttactgggcgctgggcatgcatattcaagaaacgcagatgcgacgataatagaccaatctgttcactgtgtgccaaacatggagataattgtagttactatatcagacttatgtggttagtggagaacatctacaaagtacgcaagcattcactgatcagttcattacaggctcgcaaatcgaaatcgaaaccattgtgccagaaaatctcaaaatcaaggtttaaacaaatgacccattttatacaactatcacccccgacaagtgactgcgaagacagcgtgcacgatgcaagtaaggaaactacgcttcctaacggtaatacattcaccataat

SEQ ID NO: 3707 - DNA, 499 bp, Saccharomyces cereviseae
gaattccagctgaccaccatgaactgtatcactattgacgttttttttactgctttttcccatccctgcaagctaaaaaaaaagcaagctgactcttgtataaactgcaaggactcattgattaaaattagatttacattacatactaaaggaaaaggcaaactataccggctataccacattcgttcaaaaatgccctctaccacgctactgtttccgcagaaacatattatggccattccatgcaagatatacgcgttcttcagagagctcgtcatcggagttattatatccaagccagatctaagtcatcattattcttgtgaaaatgcgacaaaggaggaaggcaaaggtgcagcagatgaacaaaagactaccacaagtttgtttcccgaatcaaataatatagaccgctcttcaaatggtggatgctctgtgatcccttgctccatggatgtcagcgatttgaacacgccaatatcgatcacactatctcccg

SEQ ID NO: 3708 - DNA, 339 bp, Saccharomyces cereviseae
gaattccacctgaccaccatgaatcttagataagacgacttgggctacgataattctaaaaatatagaatcatatactggtagaatttttgacgtatatatacaaaaagattcgtattcacagtcggccttggatgatatgtttccagaagccgtagtttcaaccgccgcttgtgtgaaaaatgaagcggaggataacatcaatctcatagacacgcatcctcaattcgaactggtaaatactggactgggtgctaaatcggacgatttgaaatctccatcagcaaaggctacgttcactgacaagcagaggaagaatgaagtaccaactatatctgtg

SEQ ID NO: 3709 - DNA, 566 bp, Saccharomyces cereviseae
gaattccagctgaccaccatgtttacttcgaagcctgctttcaaaattaagaacaaagcatccaaatcatacagaaacacagcggtttcaaaaaagctgaaagaaaaacgtctagctgagcatgtgaggccaagctgcttcaatattattcgaccactcaagaaagatatccagattcctgttccttcctctcgatttttaaataaaatccaaattcacaggatagcgtctggaagtcaaaatactcagtttcgacagttcaataagacatctataaaatcttcaaagaaatatttaaactcatttatggcttttagagcatattacttacagtttggctccggtgtaaaacaaaatgtcttgtcttctctgctcgctgaagaatggcacgcggacaaaatgcggcacggaatatgggactacttcgcgcaacagtataattttataaaccctggtttcggttttgtagagtggttgacgaataattatgctgaagtacgtggtgacggatattgggaagatgtgtttgtacatttggccttatagcatggcaattcccggggatc

SEQ ID NO: 3710 - DNA, 593 bp, Saccharomyces cereviseae
gaattccagctgaccaccatgatgaatgaagacatatccatcattgatggccataatagttttttaacggaaaaaagcaccgtgctattaacccaagccaagagaacactagaagacgaaaaggaaatgattactcccccgagctcaactgtgagaaaaacaatgaaggaagtaaataagaggccgtcgcatcccctctcaccggatcactcgtccccaattgctccatctaaggccaagcgccaaagatcggacacatgcgctcggtccaatggtaacctaaccttggaagaaattcttcaatctttggaaagaagaagaataaatggtgaactcgccaagaaacctccatattcgtatgcaactttgatttgcttggccattttgcaatctcaggagggaaagctaacgctatcccagatatatcattggatccacgttcacttcccttattacaagcagaaagatgctagttggcaaaattcaataagacataacttgtctttaaatgatgcgttcatcaagactgaaaagtcctgcgatggtaagggtcatttctgggaggtcagaccgggtgccgaaacaaaattttt

SEQ ID NO: 3711 - DNA, 143 bp, Saccharomyces cereviseae
gtcagttgtgcgcttccaaacagaataaacatccacgccaaacagcccgcttgaagcaaatttggaattcgttgctgcttgtgagtgacatctgggtgcagatggactttcttgtgtgaaattttgggtttccaaatgtgccc

SEQ ID NO: 3712 - DNA, 469 bp, Saccharomyces cereviseae
ctacaggagctgtctaaccagagcactctgtaagtcgcgagctttgactactattttgcagtcatctgtacattttgccttgattattaattcgctgcataaatcatctatgtccaacgatgaatattttggtagggaggagatctcttcgagaatgtggtagcaagacgcttttccattcgatatggcgctgctaatgtgttcaattgcttcagattgggttcgaattgttttagtatgagaagcagccaccggaagcaccgaagctagagatttctgattcaacaggtggcttgttattaagtcgcatttgatctccttatttgaacatggtttggtcccgatacacttgcggttgccaatattattacactggctccctacagcaaggggaagcacgctggggaataaagtatcatcttctgtctcgtatggaagatacttttggtcaatttcacattgacatgct

SEQ ID NO: 3713 - DNA, 536 bp, Saccharomyces cereviseae
ccagctgaccaccatgggcaatatccttcggaaaggtcagcaaatatatttagcaggtgacatgaagaagcaaatgttgctaaataaagatggaacacctaagaggaaggtgggcagaccaggcagaaaaaggattgactctgaagctaagagtaggaggactgcccagaatagggcagctcaacgagcgttccgagataggaaagaagccaaaatgaagagtttgcaagagagggtagagttactagaacagaaagatgcgcagaataagactaccacggactttttactatgttctttaaaaagtttactgtcggaaattacaaaatatagagctaagaattctgatgatgaaagaatattagccttcctcgatgatctgcaagaacaacagaaaagggaaaacgaaaaaggaacaagtacagcagttagcaaggctgcaaaggaattgccatcgcctaattcagatgaaaacatgactgtgaacacaagtatagaagtacagccgcacactcaagagaatgagaaagttatgt

SEQ ID NO: 3714 - DNA, 550 bp, Saccharomyces cereviseae
gaattccagctgaccaccatgcacgttttctttcctttgcttttccgcccttcccctgttctgttcatcgcatgtgcatatatatatatagatatatatatacattgtacacggtgcacggtagtgaacataactatgagcacgaacatagtcccgaacctcgacccggacttgaatttaaacaaagaaatctgggacctgtactcgagcgcccagaaaatattgcccgattctaaccgtattttgaacctttcttggcgtttgcataaccgcacgtctttccatcgaattaaccgcataatgcaacattctaactctattatggacttctccgcctcgccctttgccagcggcgtgaacgccgctggcccaggcaacaacgacctcgatgacaccgatactgataaccagcaattcttcctttcagacatgaacctcaacggatcttctgtttttgaaaatgtgtttgacgacgatgacgatgatgatgacgtggagacgcactccattgtgcactcagacctgctcaacgacatggacagcgcttccc

SEQ ID NO: 3715 - DNA, 590 bp, Saccharomyces cereviseae
gaattccagctgaccaccatgtatgcaacatcgggatggactttccaaacatcttcgaacgtgacatggcattaaggaattccagctgaccaccatggatgcaacatcgaggatggagcagcctgatgtctttgtaagcaaactctaccacctgctgcaggggaacgcttactcgaacataatacaatggtcgactgatggcagcaagctcgtcatttggaatccggaccagttcaccaaagtcatcctagagcgattttttggtattcacacctttgcagcattcgttaagcaattgagcaaatataacttccagaaggcgggccgcccggactgcgtggagttttccaacattcactttcgaaaagataacattaatagcctctcactggttaaagctcatcagtctgccgccactcccaatgtcgccgccgtcaataatatgaataagcagtgtacttttcactgggaccctttcaaagtgaactccattctaagcaaggccatcggcaagccttccttcgagaaattagtgaaaaatgttgacaggcttcagggcaatcttgatgagcttaagtcgacaaacgcag

SEQ ID NO: 3716 - DNA, 387 bp, Saccharomyces cereviseae
aataaatgccatcatctcttcactgacagccccagatcagccaattaccgtatcattacaatattccaacgacaagaacatggcgacggaaatacaagcttatgctaaactctccggaccaaactggacctattatgtgaattatttggaagtttctattggtataaatactgatcccttaaacagtgcactacaggaaaattcagatggtgtaaaaaacacatatagattgaatattgatctcggacctgtcaaagtcgtttctataaagcacgccataataaaatacaacatgaatatcggcggttgggaattgcacatattgggccgtaacggcgctaaagtaaactttcaaaggactcataatggacccaacaatcctcccat

SEQ ID NO: 3717 - DNA, 404 bp, Saccharomyces cereviseae
gaattccagctgaccaccatgagcaacgaagttgacaggatggatgttgatgaagatgaatcgcaaaatattgcgcaaagctcaaaccaaagtgcgccagtggaaaccaaaaagaagagatttgaaattaagaaatggaccgcagtggcgttttggtcatgggatatagctgttgacaactgtgctatttgcaggaaccatataatggaaccatgcattgaatgccagccaaaggccatgacggacactgataatgaatgtgtagcagcctggggtgtctgtaatcacgctttccatttgcactgtattaataaatggatcaagacaagagacgcatgcccattagataaccaaccttggcagttagcaagatgcggtaggtgacatggcaattcccggggatc

SEQ ID NO: 3718 - DNA, 66 bp, Saccharomyces cereviseae
gaattccagctgaccaccatggcccgcaatagatgcgcttccttaacatggcaattcccggggatc

SEQ ID NO: 3719 - DNA, 584 bp, Saccharomyces cereviseae
gaattccagctgaccaccatgaagaacaataacgaaagtgaggctgagaaccaacgtctactggacgaattaatgaaccagacaaaagtcctccaggaaactttagatttttcgttagtgacacctactccacaccacaatgatgattacaagatacacggaagtgcctacccaggtggtgagactcctgcccaacagcatgaaaaactctcatacatcaatacgcacaactctaacgataataataacttaatgggcagtcaagcgaggtccaattcacaaactcctacagcttcgaccatatatgaggaagcagaatcgcaatcgtctacctggatgatatgtttagaacaagccaaggcggtagacctgtcactcaaaattccatatcttccatagggcagggtcccttgagatcatcttattctatggcttacgactcacctgtggatagagcaatgaatactccattacagcaacaagaaggcttaaaagctgagttaccacatgactttttatttcagcatggcaccgatgacacaatgtataacttaactgatgatttgagctcctctttatcttct

SEQ ID NO: 3720 - DNA, 668 bp, Saccharomyces cereviseae
gaattccagctgaccaccatgtcaccgtgttatggacaaaacagtgccatcgccaaggggtcttggaacagagaggttttacaagaggtgcaaccgatttatcattggcacgatttcgggcaaaacatgaaagaatattcggcatcacccttagagggggattccagcctgccttccagcctgccttccagcactgaggactgtttactactatcattagaaaacacaatcacagttatagccggaaatcagagacaggcttatgactctacgtcgtctactgaggaaggtacagcacctcaattacggccggatgaaatagcggacagtacacactgtatcacgtcattagttgatccggagttcagagatcttattaattatggacgtcaaaaaggagcaaatcctgtatttattgagagcaatacaacagaacaatcccattcacagtgtattctaggctatccccaaaaatcgcacgtggcacagctatatcacgaccccaaagtactcagcataatttccgaagggcaaacaaaaagaggaagttaccactgttctcattgttctgaaaagttcgcaacgttagttgagtttggcgcgcacttagacgaattcaaccttgaaagaccgtgtaagtgtcccatagagcaatgtccctggaaaat

SEQ ID NO: 3721 - DNA, 583 bp, Saccharomyces cereviseae
gaattccagctgaccaccatgaattacctgcgagatagatttcctccggataatgaccaaagacccttcagatgtgaaatttgttcacgaggtttccacagacttgaacataaaaaaaggcacggaagaacgcacactggcgagaagcctcacaaatgtaccgttcagggctgtccgaaaagcttcagccgaagcgatgaactaaaaagacatttgaggacacatactaaaggcgtccaaaggcgcagaataaaatccaagggctcgcgaaaaaccgttgtgaatactgctaccgccgcccctaccaccttcaatgaaaacactggtgtttcgctcacggggataggtcaatctaaagtgccacctattcttatctccgttgctcagaattgcgatgacgtgaatatacgaaatactggaaataataatggcattgtggagacacaggcacctgcaattttagtgcctgtgataaatattccaaatgaccctcatccgattccaagtagcctctccactacttctatcacctccattgcatcagtatatccctctacttctccattccagtacctgaaaagcg

SEQ ID NO: 3722 - DNA, 689 bp, Saccharomyces cereviseae
  misc_feature (232)..(232): The residue at this position can be any nucleotide.
gaattccagctgaccaccatggtcgtaattaacggggtcaaagtatgcctgtgaaacgtgtatcaggggtcacagggcggcgcagtgtactcacactgatggtccgctacagatgatcagacgcaagggaagaccatcgaccacatgtggccattgtaaagagctgagaagaaccaagaacttcaacccatccggtgggtgcatgtgtgcctctgcacgacggccagctgtngcagcaaggaagatgaaacacgatgtcgttgtgatgagggtgaaccttgtaaatgtcataccaagaggaaaagcagccggaaatcaaagggagggtcatgccacagaagggcaaatgatgaagcagcgcatgtcaatggtctcggtattgcagatctggacgttcttttgggcctaaatggtcgctcgtcggatgtagacatgacaaccacattgccgagtttgaagccacctctgcaaaacggagaaattaaggccgacagcattgacaatcttgatttggcttccctcgatccgcttgagcaaagccctagtatatctatggaacctgttagtatcaatgaaacaggaagcgcatatacaactacgaacacagcactaagcgatatcgacattccattctccatcaatgagttgaacgagctatacaacaagtatcttcgcataactcacattca

SEQ ID NO: 3723 - DNA, 574 bp, Saccharomyces cereviseae
  misc_feature (380)..(380): The residue at this position can be any nucleotide.
  misc_feature (456)..(456): The residue at this position can be any nucleotide.
gaattccagctgaccaccatggagttttctttccaaactttcccaaatacgaaaatcaacgactgcatcaaaagcccaagtgcaagatccattacccaagaagaatgacgaagagtattccttgttacccaaaaattacataagagacgaagatcctgcagtaaaaagattgaaggagctgaggcggcaggaactgttaaagaatggtgctttggctaaaaaaagtggtgtaaaacggaaacgtggcacctcatctggatctgagaaaaagaaaatagaaaggaatgacgatgatgaaggtggccttggaattaggtttaagaggtctattggagcaagtcatgcgccactcaagccagttgtaaggaagaaacctgaanctatcaaaaagatgtcatttgaagagctaatgaaacaagcggaaaataatgagaaacagcccccaaaagttaagtnatcggaacccgtaactaaggaacgcccacattttaacaagccaggtttcaaaagttcaaaaagaccacaaaagaaagcatcccctggcgcaacattgcgtggagtatcttctggaggc

SEQ ID NO: 3724 - DNA, 599 bp, Saccharomyces cereviseae
tcattaattaatctaaattttggtagcgccattgaaacatattttagcgataaaacaggtcataaccaagtcgtcgaaaaagctcccgtagctttggataacattctacgaaaccttaaacttggtgaatttataacatattttgtccttaacagaaaatcattgcaagtaaatgtacctcaccacttgctgttcacaaatcaaacggattacggagagttcgctgttgaaaaaggggaacatgataatatagctggcaaatttgagacccttttgaagaaaaaggaaattttaatcagaaaattactaaatattgaacagaaaaatgaccatattctagaaaattgctgcaattcggatgctgaaatgaaaaatatcggagagctagtctgctcaatgatcactctggtatcaggcatattagattcaattactaatatgaacgcagaaaactctgttgatttggattcaaagccccttccgaacgcctattttgctcaggacagtgaagaagaattaatgtcgccaacacaaagtattacgtcaaatcttgccagtgaagaaaatacacgttgcacaaccaaagacttgatgggaac

SEQ ID NO: 3725 - DNA, 576 bp, Saccharomyces cereviseae
cggaattccagctgaccaccatggaggatcaggatgctgcatttatcaaacaggctacagaagcaatagtggatgtatcattaaatatagataacatagatcctataataaaagagttattagaaagggtaaggaataggcaaaacaggttacaaaataaaaaaccagcactcataccggcagaaaatggtgttgatataaatagtcaaggcggtaacataaaggttaaaaaggaaaacgcattaccaaaaccaccgaagtccagcaaaagcaaaccccaagatcgtagaaatagtactggtgaaaaaagatttaaatgtgcgaaatgttcgttggaattttcaagatcatcagatttgagaaggcacgaaaagacacacttcgccatattgcctaacatttgtcctcaatgtggcaaaggttttgcaaggaaagatgcattgaaaagacattatgatacactgacatgtaggagaaacaggactaaattactaactgcgggtggtgagggtatcaatgaattactgaaaaaagtcaagcaatccaacatcgttcatcgtcaagataacaaccaca

SEQ ID NO: 3726 - DNA, 945 bp, Arabidopsis thaliana
ctgcaggtaccggtccggaattcccgggtcgacccacgcgtccgcatttttccatcttcctcatcaccttcccaagaagaagaacaccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttgaagtcaaattaaaaggataagtggtatcgattatatatttgattaacacattgattggtgttaattgctcttttttttcttacgatgaaatacattgttcagtttctttgatgtctgtgttttgatcaaaaaaaaaaaaaaaaaaaa

SEQ ID NO: 3727 - DNA, 955 bp, Nicotiana benthamiana
gcggccgcccttttttttttttttttttttttttttttaagattaaagagatatatttttatcattttcccataggacgagcggtgttcaaaagctaatcactccattaagcttaacatttttttccatttcttctctcttttggcttcaaaaataacaaacagaagttcatctaaggaagttctgttaaggttgttttcacagttttctaatagttttgagatttaagcttcatttcctgatgtatcccaattattattaatattcaatccagaaataaaaaagaacgacaccaacaatgtgtcaactgtgaaagaagaagaagaagaagaagatgaagaaaaagaatgacaccaacaatttgttaacaaagaagaagaagaagaagaagaagaagaagaagaagaaagaagaagaagaagaagaagaagaagaagaagaagaagaagaagaagaagaagaagaagaagaagaagtggtgaagaagaaaaagaagaagaagaagaaagagaaggagatgcaatattttgcaataattaagtaaacaccttgattagtactgcacgtagatggacgattgattagttgaattgaatcttgttgtgcataggaagcttctccgagtgaacaatcaccaaatgctagcatattaggatcaattcgtaaatctgggttaatatgctgaagttgtgcaacaacattaagtgtaattttttgccaccaagtttcctgtcgttcctcgaaatttttctgcatcctttgttgccttctctcttccatttcctttagtttttgctccattatattatcagtagtctttgaagagggtctagaatttctagatttttgtttcaagatagtctttgtaaccccacgaccatacaaatttacgcgacctgaatgttcaggtcccatgactgttgcaaatgggtcaattgattcggacgcgtgggtc

SEQ ID NO: 3728 - DNA, 1318 bp, Nicotiana benthamiana
ttttttttttttttttttttcagtagaactaccaattttttttttttaaaccttttaactacctttcacagtaaagtttatccagacaatacctctacagaaaaggagaaagcagacgcacaaacacagagaccttaaatacaacagttaaacaggatgacggggaaaaccaatgcaaagaaatgaatgaaaaaatgacagcccctgtgatgatatcgtcagcaacttgcaccggcatcgtcgcattgaagcagccttccaccaggaaaaggcagatgcagcatcaacaaattcttcaaccttgctggctcccctctggttcaaccttcttgtggtgaaacttcaccactatgcaggtaatattgtcagcactaccccgagtaaatgcagtctctgttagcttcctagcagctgcttctggttcttcttctgcttgtgcaagtgaaatagcatcctcatttggtaccacatcccaaagcccatcgctggcaagcacgagtagttctaattcctcatcaatctcttgatcctgaatctcaggttcggccacaacaaattgcttcaacatacggttgccaaaagcacgtgacattgctaatacaccaccaactctccaggtaccagcccacatcacaacacctccggcactttcaattctcttcctctcatcagttcgattgggcttatgatcctcagaaagagcaattgcttttccgcccttcgatattatagttcgcgaatctccaacattggcaacatagagatggttaccaactagaactgctgttgaagcagtggaaccatcatctcggaaggtatctttttcagaatctaagaagtccatgtctgtttgttgatatgtttcacttatggccaacttggtgtttgttgggaactctggatgtttcattagattctcaaagagatgtttcttcagaaactcagctgctcgggaaccccatggccatcaaatatcccaaataagcaaactgtttgtccatcaactttggaagttttaatgccataaaaatcctccatggttgctcttttccctctaaagcttgaataaccacaactcagtcttccatcttcactcttccatcctccgctagcgaaaccaccattattatcatccttctccggtgaaacatcaacgacaggtcctcctttagcagttgcaccagtatccaccatcatcgttctccttgctgtatatacacttgcgtagctattgcataacatctaaatttgaatttgccgcattaactgccggaacttgaactcagatacgagagagacgcctggccggacgcgtggg

SEQ ID NO: 3729 - DNA, 724 bp, Oryza sativa
ctgaagaggtacccagctaggctgtcagttctatcactgacctgcatctttgggctcctccagttcctggtcattgcagccttcactgaagaagacctgagcagatggaaggtgaactccggaagcgagctgttcacaatcctctacgctggtcttgtggcatctggcgtggcgtttgctctgcagatatggtgcatcgacaggggagggccgctgttcaccgccgtgttccagccggtccagaccgtcgccgtcgccgtcatggccgccatcattctcggagatcagctatactcaggagggatcatcggagcagttctgattgtgatcgggctgtacttcgtgctgtggggcaaaagcgaggagaagaagagcaagaacaatctgcaggaccagtcatcggtgcagggaggaggaggagacgacatcaggaggcatctgctcgggcaagaagatgcatctcgcaaagacgaagaagctgcagtcactgatgaactggcatgacgatcgatcgagctgaggggcgttcttcaccagtaatatgcatgatgatgttggagttggaaaatatatgttgatgtcagtgactgtacttttcttaactatgttaatcaaagaagaagatccaagcgtgccagtgtaattaaaaacagtactgctagctggtcctcactcaccagtgatatactatatataattgctacgaatcaaaaaaaaaaaaaag

SEQ ID NO: 3730 - DNA, 442 bp, Nicotiana benthamiana
ggccattacggccggggagcagtgaccaaattaagtcgaaaaaaaaaatggcaactcctgaagaaaacattgcacctgcagctccaccaccgccggcggcagaaccatcagcggtggaggctttagtgaccactattgaaacagcgaccaaacaggttgaaacaccgaaggaagtcaaggaggagaagaaaggaggagcacaggatctcaagttaacccttttgattccaggggctgtagtagctgttgttggagtagttcttgccattgtcaagaaggtgaaagagtcggctaattgaatgtagatcccttgtatcgtcaactttatatttctgtacattttttccccctttttgtaagacgagcctaaactctttgtcagctttgaagggaaataaataaatttcatatgcttttattataaaaaaaaaaaaaaaaaaaa

SEQ ID NO: 3731 - DNA, 600 bp, Nicotiana benthamiana
gtccacataagattcaggggattggtgctggtttcattcctggtgttttggaagttggtcttattgatgaagtaattcaagtttcaagtgaagaagccatagaaaccgccaagcttctggcattgaaggaaggtttgcttgtgggcatatcatctggtgcttctgctgctgcagcaatcaaacttgctaagcgccctgaaaatgctgggaagctcattgttgttgttttcccaagcttcggggagcgatatctttcctctgtgctctttgaatctgttagacgggaagcagagaacatgaccgtggagccttgaacattttgtccttcgattagcataccatagtctcaagaggattttccaatcaaagcagaatgttcttgtctgaacctttcccttcctgtttgatcaaactgctaaaaataaggccttttcttttctttagtggcctttcaagtatatcttagtgcttttataattttactgtttctacaacacttgtgacagtggacttgtaacaggaatttcaagagctgttgctgcttgttcgtcaaagttcctctaagccttttattttcttgaaaaaaaaaaaaaaaaaaaa

SEQ ID NO: 3732 - DNA, 1217 bp, Poppy
gtcgacgaattcaagtgaaggcagcccattcctacctctgaaccctgaaacaccattcttgtctgtgtctgaatttcactctaatctctgtataatcatggcgattacaacaccattatcacaatcaaatctctattcaacaaacaatacaatcatcaaaacaccaagactgattcatcaaattcaatccaattcaatttcattgaatttgaggaacccaagcttccaaaacgagttgtgggggaataggaattgttctctggttgttcagaggggggtagcggcatctgtgattacagcaactgctgctgctgagaaacagaagaagaggtatcctggtgaagggaaagggtttgtggaagaaatgagatttgtagctatgaaattacatacaaaagatcaagctaaagaaggtgagaaggaatctcaagcgcaacctttggggagatgggaaccttctattgaggggtatattcaatttcttgttgatagcaagtgtgtttatcatactcttgagagtattgttgataaagctgctgttccttcatatgctgagttcagaaatacaggattggaacgggcaggagcattggctaaagatctggagtggtttaaagagagaggccatgctattccagaaccctctaattctggcctatcttattcccagtaccttgaagacttatcagtgaaggatccacaagccttcctctgtcatttctacaatgtatactttgctcacactgcagggggtcggatgattggtaaaaaggtggctgagatggtactggaaaagaaggagctggaattttataaatgggacggtgatcttaaacaactgctgcagaatgtgagagataaactcaacatagttgctgaaagctggtctagggaagagaaaaatcactgtttggaggaaactgaaaaatcattcaagtactcaggggagctcttgcgattgatactaacgtaaagatattgcaaactatatcagttctgtatatatctttaaaacaactgaaccaagtactttgtcatcttttcagctcaagctactttaatcaccgtttcgtttgctttctgcagccatgtttatatttcctgcataataatctgttcttgttattattgaatggatattggtgtagacgtctggaaggatttcattgcttatttgcatctagatgcattcgaagttcaaaaaaaaaaaaaaaaaa

SEQ ID NO: 3733 - DNA, 1043 bp, Oryza sativa
tgaacggtggaacgcgtacttacccacaagttaggtgcatgccatggcaccattcatggcatgcgcctcgccaccggtactcgcgctggccctgctcgcgtcgtgcggtgcctttctcgccacctccatgctcccggcgcgtgcgacggcgagcagctgcttggacgtcggcgacatggtgatgatggacaggttccgcgcttggcagggagctcacaaccggtcgtacccgagcgcagaagaggcgctgcagcggttcgatgtgtaccgccgcaacgcggagttcatcgacgccgtcaacctgcgcggcgacctcacttaccagctcgccgagaacgagttcgcagacctcaccgaggaggagttcctggccacgtacaccgggtactacatcggcgatggccccgtggacgacttcgttttcacgacgggtgccggagacgtcgacgccagcttctcctaccgcgtggacgttccggccagtgtcgactggagggcccaaggcgccgttgtgcctcccaagtcccaaacttcaacatgcactaacagcttgatcactatgtggattttagtttcgagcacgacgacccaacatattcaaaataagtgatttcagatgctctgtataatgcagctctggcttcctcgaggccacaacaacagcctactgttgagcaatagcaattctaccaaaactatgggtacagcagataaggtataagttttcaagaactcacctgcgccggccacgactctcctcttgaaagcggtcaccgctggcctcccggtgccacatctccgggagcggcacgtcgtcggggtcgcttacatactcctcctcctccttgtcatcatccccggtccccgccgtctccacctcctccggcgtcagcggcaccaccgggggcttgccggcggcgtggaaggaaggccagcaagattaaaataagattaagtcactagaaaatcctttgagatgtactactactgcgaaaccaaaaatcggagctgaaaattaagatcaaaaaaaaaaaaaaaaaaaa

SEQ ID NO: 3734 - DNA, 410 bp, Saccharomyces cereviseae
ggaattccagctgaccaccatgcctaaagtttacagttaccaagaagttgccgaacacaatggcccagaaaatttctggattatcatcgatgacaaagtttacgatgtttctcaattcaaagatgaacatccaggtggtgatgaaattataatgggtttgggtggacaagatgctacagaaagctttgtcgatatcggtcattctgacgaagcattgagactactgaaaggtttatacattggtgacgttgacaagaccagtgagcgcgtttctgtggaaaaggtatctacctctgaaaaccaaagtaaaggtagtggtacattggttgtcatattggccattttaatgctaggtgttgcttattatttgttgaacgaataacatggcaattcccggggatcgcggccgc

SEQ ID NO: 3735 - DNA, 917 bp, Saccharomyces cereviseae
ggaattccagctgaccaccatgaacagagtttcgtttattaaaacgcctttcaacataggggcgaaatggagattagaagatgtctttttgctcattatcatgatacttcttaactacccagtgtattaccaacaaccgttcgaacgtcagttttacattaacgatctcactatatcgcatccttatgcgacaactgaacgtgtaaataacaacgtgttgtttgtttatagttttgtcgtgccatctttaaccatattgataattggttccattttggccgatagaagacatttgatttttattttgtacacatctctccttggtttatcactcgcttggttcagtacgagtttctttacaaacttcatcaagaattggattggaagactaagaccagattttctagatcgttgccaacctgttgaaggcttgccattggacactttatttactgcaaaagatgtgtgtacgactaagaatcacgaacgtctgttggatgggtttaggacaactccgtcaggtcattcaagtgaaagctttgcaggactgggttatttgtacttctggctatgtgggcaacttttgactgaatcaccgttgatgcctttatggagaaaaatggtggcctttctaccactgttaggagctgcactaattgctctatccagaactcaagattacagacatcatttcgtcgatgtaattttagggtctatgttgggttatataatggcacactttttctacagaagaatcttcccacccattgatgatcctcttccgttcaaaccattgatggacgattcagatgtcaccctggaggaagcagtcacccatcagaggatcccggatgaggaattacatcctttgtccgatgaaggtatgtaacatggcaattcccggagatcgcggccgc

SEQ ID NO: 3736 - DNA, 1097 bp, Saccharomyces cereviseae
ggaattccagctgaccaccatgaacgtaacatcgaatgcaactgcagccggttcctttccactagcatttggtctcaagacctcatttgggtttatgcactatgccaaggcccctgccattaatttacgccccaaggaatccttgctgccggaaatgagtgatggtgtgctggccttggttgcgccggttgttgcctactgggcgttgtctggtatattccatgtaatagacactttccatctggctgagaagtacagaattcatccgagcgaagaggttgccaagaggaacaaggcgtcgagaatgcatgctttccttgaagtgattctacaacatatcatacagaccattgttggccttatctttatgcacttcgagccgatctacatgactgggtttgaagaaaatgccatgtggaagcttcgtgcagaccttcctcggattattccagatgccgctatttattacggctatatgtacggaatgtccgctttgaagatctttgcaggctttttattcgttgatacatggcaatactttttgcatagattgatgcatatgaataagaccttatacaaatggttccactctgttcatcatgaactatacgtgccatatgcttacggtgctcttttcaacaatcctgttgagggcttcttgttagatactttgggaaccggtattgccatgacgttaactcatttgactcacagagagcaaatcattctttttacctttgccaccatgaagactgtcgatgaccactgtgggtatgctttgccacttgacccattccaatggcttttccctaataacgctgtctatcacgatatccaccaccagcaatttggtatcaagacgaactttgctcaaccatttttcactttctgggacaatttgttccaaactaactttaaagggtttgaagaatatcaaaagaagcaaagacgtgtcaccatcgacaagtacaaagagtttttgcaagagagagaattggaaaagaaggagaaactcaaaaacttcaaagctatgaatgctgctgaaaatgaagtaaagaaagagaaataacatggcaattcccggggatcgcggccgc

SEQ ID NO: 3737 - DNA, 556 bp, Trichoderma harzianum
cataaccacaactaagtcataaggaaacaatcacgattctgaatatctattcgcgttatatacaagctaaaatgaagccgttttatctgatttctattctatttaccagtttgggcactgctatcccagttatccctagggataataacggaatcctcgataatttcctagctattgtgaaagacgcgacaggaattgatcggacacccgtccacgggctcgtcggcactgtcctgaatggtggcaccaaatctatcttgattaactcgactgtcctgggtcttgcagaggcaatttttgatgaggtgaaatcccaattaggcattcaagatccgcggtcgcttgaagaaactattgcgtctttggaagaggcgggtaatgagacttttaaccaattctgccaactactcgacacgttccgcagagaggataaaggtcctgctggaggaaccattgactcgctaggcgtgggcaatatatcctcattagacttggcatcttctatcgacttgatcataaacttggtcggactacaatgtccaagtggtgcggccgc

SEQ ID NO: 3738 - DNA, 769 bp, Trichoderma harzianum
catccacgacagcttcgatagcttcgacaaagacgaaaatcatcatgaagctttcgctggggattgccgcagcatttgtgagctgcgctgcagcatcgcagcccgccgccgacgtttacgttctgccgaatcgcgaatccgcatcgccgccgtccattcccagcagcgttgcccgactcatcttgctgaagctggcggactccagttccttttccttggtccgcgatattcctgacgacgtcgatgtagaagaggtggtctcgttgatgaatcgatatggaggcgtcactactccattgttcgatgagctcgctcatgagcctaagcagctgttcattgcgcttcagggcttgacggacgagcagatgaaagagaccagagcgaaattacagcggcagccctcattcactatccccgatgtgcctcatatcgaccgtctgcaatgggcaacgggcactgaaccgcctccatccgagtttgtaaaaggaaaagggatcagctgctcttatgatgagatgaccaacccagtcgagtcccggtgctggaagggaaagagcttgctggctagttttgatatccaaaagaagcccgaatacttggacgacgtgatcgacagcttcccacggctgacctcgcttgctgagattggcgaagtgcaaacgactttcctcttcttcactggcgttggtaaattgtcgagccagaccaaagcacttcacaagcgccaggcggagcgggtgatttcccactttcataagactgcggccgc

SEQ ID NO: 3739 - DNA, 698 bp, Trichoderma harzianum
ctcgagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgcggccgcgtcgaggggtagtcaagatgcataataaataacggattgtgtccgtaataatgggggaaaaaaaaaaaaaaaaaaaa

SEQ ID NO: 3740 - DNA, 292 bp, Trichoderma harzianum
tatcactactccatctcagttcgtgttcttgtcattaattaaaagagatatctgggcttcaactctcaattcatatttacaataaaagtaataaagattgaaaccgccagcaactccragtcacaaccacatacatcatgcctgcgcaaactacatctccccacctggccaacctcgagcgcgacggcttcgtcgtcatcaaatccatcgtctccccctcgaagctcgaggccctccgcaccgccagccttaaagcagagcagctcgcccgcagcgkacaatggcctcacgt

SEQ ID NO: 3741 - DNA, 242 bp, Trichoderma harzianum
gaggtccagaatcttccaggttgacctctgtattggcggaagttaccatgggatgggctgctgttacacaatgattcaacttgtgagcctccttcgatcctttggacatctgaagtcacagatgagtcaattatgtgttgtatccctttcacaaggatcggaacttgggggagggctttgtcttgtttcggaatcatagttgagaggcaatcaacagcgttttgcataaaaaaaaaaaaaaa

SEQ ID NO: 3742 - DNA, 756 bp, Trichoderma harzianum
caaccaccactcagcaagcaatcatcaaaacagccactctcacttttctctcaaagtaaaacacttcaaaccgccaacatgcaggttacttctatgctcgctctcctctttaccgttgccactggcgctcttgcagctcccggccacggagctcctcctcctccccatgttcctccccctccccctcctcctcccaccaaccaaaacaccaacaccaacaacaattggcaatccaacagctgtggcaacggcgcttctccttactgctgcagtgctacagctgatggcctgggagagaactactggaagtgctctgatctcaatgatgtgtgcaacgacgtcattgtttgctgcaacaacaatagcaacaacaacaaccagcagggaaagcaaaacaacatcgacaccggcaaccagtcttgcagtgccttcggacaacagaaggtcatctacctctaagcttgcctgcagaagctcaaagtcggcaatggctctcttatttgcttgtatcttagtcttataaggcagttcatgtccaagtttgtcggctaagggctgcggtgacgggtttgagaaaatgggcagtggcatgtggaacggtgaaaaaatgcttcttttctatttggtttgtagcagggtggctcttctgaggcagtctttacaacccgctcactttccttaagcctatttaaaccgatatagttattacaaccaaaagccaaaaatcggttgccttaaaaaaaaaaaaaaaaaaaa

SEQ ID NO: 3743 - DNA, 1281 bp, Trichoderma harzianum
gtggatgattgataggtacattagcagagtggttttagttttggaggagttttactttttattctctttcatattccaattctgtacttgtctcggaagccatatttacaactctcaacaccacaatggcgggcttcaagaaactactccagactctaactgggaaaaagagcgacgatgccactcaacccgaagagcagcaacgccaaactcctcagcccaaaccttggtccggcatcgacaacacccaaccagcaggctcgaaccccatccgcggcttctccaccgaatatctcggcgagcaaaagtccagcaacacggccgtccgccgggacctcggcttcgcgggccacatcggcggccagtggttcggcgtgtacggtgacacgctgtggtgcagtcccggggtgacggacccggatttggagccggatccggaagggttccacggcatggtgcggaactcggtggcggtgttgacggatgatccgctggtagttcggtttgtgcatttgaatggggatgagccggtggcgcatccgttgcagtttacgccgtttgaggagcggtggggggagacgaatttgtttgggtttggggggacgagtcttgtggaggttgatggctatggggagggtgttggggcgctgtattatttgattaatgaacatgaaaactatcgtcacgctggcatcgcccgtgtcgaagttatagacggcgttcccactaccaccaagcgccttggagaacatggctggtggtgggactgctctacgacagcaaagtacggcgacattgctacctacagagacgtaaacagcgagtacatctatgcttggggccatccacccaagaccataacagagtggccggcaacggagtatatataccagacgcgagtcaaggccacagaagcatttgatctagacaagtatgaatactggtgggggagagcaaaggggtggcggagcgagatgttgaacgagcataatccggagacggcggtgatgtggggagctgggcaggggcaggttgtgtatagcgagtggttcaagtgttatatctatgttcatttgaatggcccaaaggtagcactgagaacggcggcgaaactggaagggccgtggagcgaagatcgagaagtttttgaagcagagccgattgatggcgggtttgtgtacgctggagttgcgtatccgtttttggatgagacgggcaagacgctgacgattgcgtatacgaataataaccatattcaggtaaaaaaaaaaaaaaaaaaaa

SEQ ID NO: 3744 - DNA, 955 bp, Trichoderma harzianum
aggcaaaatgtccacaatggaggctccagttgagaagaagattgaaaagacagcaaagccttatggcatgcgcaaaaatggaatgcaatggcatgctccgaagaaggcgtttcgcccgaccaaaggcctctcatcgtatgagcagaggactaaggagcgagctgcaatggctcagatgaaggcaaaggaaaaggagatgaaggaggagaaggaggaagagcgccagcgtcggattcaagccatcagggataagcgagcaaagaaggaagagagagaaagatacgagaagatggccgaaaagatgcaccgcaagcgagtggagagattgaagcgcaaggagaagcgaaacaagctcttgaactcttgagccgagaatccacgccgacgaaagacactgggatcagactgcatcggcaaaccccgtggtgcattctacatgttcgtactggcggtatgcagagttatcatacttgcaacggatgcgcactgtggcatccggactttgacggccaggaagcagcatgcacagcaagcagttggacggggggctgtagcgacaagctcttcaccgccatggactccagtcgctgctcgcagtagtctgaacttggtcttattttcgttctgcagcaaaacgggactactatctgtttgggtctgtttgtggatttgcctgcatcatatgcccggtacttcatgctagaatgatcgatattacttggtttcgccagactgtgggactttgctgggatttctttggagctgcgttggggcttggatacatatggacctgcatcttacatcttgcaacttcaagttacagcatggggcagtccttgcatgcttaggtatgggcggacgggtggtttttggaggtcttgcatttgcatggcgttggggagcacattgattaaatgaataaacaaatatttgagaaaaaaaaaaaaaaaaaaaa

SEQ ID NO: 3745 - DNA, 206 bp, Trichoderma harzianum
agaagtccaactaccaattcacccacaagatgctggaccaggagcccaagaagacgtccggtggtgaggtgcgcatcactgactccaagaacttcccaatctccaagaccgtggctgctgcccacgccgtcatcgagcccggcgcgatccgtgagatgcactggcaccccaacgccgacgagtggtccttcttcatcagcggccgc

SEQ ID NO: 3746 - DNA, 654 bp, Trichoderma harzianum
cggcagcaaaggctgctggaggcgttgtttccattgcaaagaaacaaaccctccagtccaccggcttgtgggagaccttccgcaaggccttcgccctcgaccccaatcgctccaacggcgtccccctgaacccttacttccgaaacccgacgcccggagccttggaccccctcagcttcgacgaccccgtcactcttcccgctggcgacattgccgacaacgcctactggaagcgtgatgtccgtcgcgcgtacccgcagctcagcgtcgttacgcagggcgacgccgtgtcgttgttgacggttggaagcgccgcacagcccaaggtcgagctgattggcgaggccggcgagaaggctctcgttgcggcgcagaaggagggcgagacgacgggcctggccaagttcctggagaaggcgcccaaggatgtggcaaaggacgtgttcgtcaatggattgcctccgctgccgagcggacaggccctggaggctggaggatgggatgtgcacaagtacgagctcaatgaggatcagacatatggtgaaggctatcctaccaggacgttcaaataagacgggcaatagggtcgacttgtgtaaatacagataagatgaagaaagattagaatttcccgaaaaaaaaaaaaaaaaaaaa

SEQ ID NO: 3747 - DNA, 873 bp, Trichoderma harzianum
gtggtctgactgtagaacaatctctctttgtcctgtagtctctttgacttataatctgctctatcctgctgttgcgtggaagcttcagagtcctccctttgtgtgtgcgcgtgagccgaaacaatcaccacaattgctgctcgcacgccccggaaacaacaaagagcccgctgatccgatccgccatctccggcatacaatgcgccgctgctcttcttcttcatcaatcagctctcagtggtcctctataagcgacgaccagctcaactccatcgtccacatcaacagcatcaccaccgccgccaccacagtcaccgccagcaactcgtctgttgtatcttcatctgcctctgttgcaccctcaatcatgccttcagtccacacaatgtctgagcgccgcccttccaccccccagtatgagcgcagtcgccagggaagcacatgctccgtactgagctgcggcggcatgagccctgatgcgaccaaggagctgtggaagaccatgttggagctccaagagcgatatggatgttacacctcagccagaatggatatggccgttggagcgggagacatggctctctctctaatgccaaatccatttattctcgatacgctaaacgactccgtcgtcgacctgcctgacgagggctgggagatgctcaatcgctgtctcagacagcccaggcattaaattcttggcctgatactacctgacactcgtacaaactactaccacccgcaatcgttatttcttcgaatgaagcgcggtagatgaggacgatatgatgggtatattcttcctggaaggcgtttttttttttttttttttttttttttccggaaaaaaaaaaaaaaaaaaaaaaaaaaaaa

SEQ ID NO: 3748 - DNA, 492 bp, Trichoderma harzianum
cccacgcgtccggaagcctgcatcgcccgccatggccattacgccgacccaattcgccaagaagacggcgcagtcgaccagctggtcggatgcgaagcgtcgagtcctttcttcgtaccgcgaatggatccgagctgcgcctgagatccagaccatgtacaatgtccctctccccatttctaccctccgaacacggatgcgacaagagttcgagcgacaccgatacacgaaccagctgtccatagttgacgtgcttctcttcaagtcccatgcagagtaccaggaaacaatgaacttctggaagcagcagactcacatcttgtcttatttcggcgaaaactttagaggtgacaagaggcttccgtccagcttcatggctggtttccttgagggtcgaaattagaaagacaatgcaagaaagtttgttttgtaaatatctctgtataaagattttgtgccgaaaccctccaataaaaaaaaaaaaaaaaaaaa

SEQ ID NO: 3749 - DNA, 756 bp, Trichoderma harzianum
cacattcacttcctgaggccgcatctcattcagcttttaccccaccatctcacagcccatcatctatctcatccaacctctcaccacaacagcacctacatctacaagagagaacacttccctcttgaaaaagtaaacctaaataaacacatcaaatcaaaatcctccatcatggccgacaaagaccgcatcacctgccacgtcctcgacaccaccgccggccgccccgcaaagggcatccgcgtccgcctcgaaggccccgtccccagctctcccaacgcccacactgccgtcaacaccttcgagtccctcaccaacgacgacggccgcatcaccgtctggctgccctactcctcagagtcctcggccggcgaggtgcccgtctacactctcgaggacgtcctgggcgctatcaaggggccttcccggtggacgctgcgtttcgacactgccggctactttggcgaggaaaaaaacattcttcccagaagccaccattgtgtttcgtgttgaagagggccagcattaccatgtgccgctgctgttgagtccgtacagctacaccacttaccggggaagctaaaggggggcatgggaggacaacgcggcttcacagccacagtcgtttcagtttcagagtcagagtcagagtcagtattcagagatacatatgacaacaatgatattgaaagcgtgctagtcgtggcaatgtcaacactgtcactctttttattacaaaaaaaaaaaaaaaaaaaa

SEQ ID NO: 3750 - DNA, 900 bp, Trichoderma harzianum
gacacacagacgcactcacacactcagcttaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggcaggtgatgaagcaatttgcgtcggagatcgagaagctctcggagagggtgctggacctgctgtgcgagaatctgggcctggagaagggttacctgaagaaggccttcgccgggtcgaacggcccaacgttcggcaccaaggtgagcagctacccgccgtgcccgcgccccgatctcgtcgacggcctccgcgcccacaccgacgccggtggcatcatcctgctgttccaggacgaccaggtgagcggcctccagctgctcaaggacggggagtgggtggacgtgccgcccatgcgccacgccatcgtcgccaacatcggcgaccagctggaggtgatcaccaacggcaggtacaagagcgtcatgcaccgcgtcctcacgcgccccgacggcaaccgcatgtccatcgcctccttctacaaccccggcgccgacgccgtcatcttcccggcgcccgcgctcgccgccgccgacgcggcggcggccgc

SEQ ID NO: 3751 - DNA, 701 bp, Trichoderma harzianum
caaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccggcgcgcccacgttcacgcacggcacgccgccgaaagccaccccaccgcccacgccgctgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacagggcaaggcattgctgatggtgaatgcacaacacgcgtggcagactggccgaaaattgatgatttactgatgggcgactttggacttgaaatggggcatgccggatgggttacttgacagtatttacaccatttctattcaacaataaatggaattctccaaaaaaaaaaaaaaaaaaaa

SEQ ID NO: 3752 - DNA, 647 bp, Trichoderma harzianum
aagggcattgaacctcgatacgagttcggctttggacttggttacacgacctttgcatattccaacatatccatcaactatattcagggggcaaacacgtatccatggccgggcggccctattgtcagcggcggacaaacggatctatgggatgcaatcgccaccgtcagcgtaaacatcaagaatacaggcagcgttgctggtgccgaagtggcgcagctctacattggtattccaggggctccggcgaagcagcttcgcggctttgaaaagccctttttgcagcctaatgagtcacagtcggtgacattccatctcacaagaagagatttgagcgtatggagcgtggagagacagaagtggcagttgcagcagggcaactacaagttctacgttgggagcagcagcagacgactgcccctgaatgggacgatggatttataagagaacctcagcaaggccagcggactttcagatgcagctcgagtatgccaaaatcgtatgctgcgtgatgaatggagctctgtatggggtacatcatgtgtagatacagctgcgagaaaggttgttgtttcctccttcaagcgagctgagaaggcagcaactaaccgtctattggatagatcgaaaaaaaaaaaaaaaaaaaa

SEQ ID NO: 3753 - DNA, 164 bp, Trichoderma harzianum
cccacgcgtccggccaataggtggcctgcaggctgtttctgatacaaatcctcgtaatgcacagacgtgaatagtgctggcacaagtcacattgctgctgccttgaagggttccatttacattttggtgcagctctaccaaccgaaaaaaaaaaaaaaaaaaaa

SEQ ID NO: 3754 - DNA, 1314 bp, Trichoderma harzianum
tccaattaggcattgacagcaaaccaattccctccataactgggcctcttcacacccgtactcagaatgaccgacagaatattccgcatctttaacccgggagaaccaaagggtgatcccgttgagaagaggcgcgctcagctgcgacgtgcccaacaatcttatcgagatcgcaaggacaagtacaccaaggcgctcgaggctgaactagcacggtctcggaagagcgaggcgggcttgacgttccagatcgagcagcttcgtgtcaaagttcagaaactggccagtctcttgtcccaaaatggcatctcacttcctccagattttgacaatgaggaacaacttcatgatgatgtaccgcgtatagattcatctccgctcacaacgcgtggacaaccacaaaccgctgaaggcttcctatcaagtacagattcaacctctcctgagtcggtgacggaccaaggagctatcttaaatagtggaaaccgcactctacggcagtacagttcgagaatcttttcccgacatcatgaaccgcaggttccagcgccgacgaggaccgtccaagatgagcccggtgacaggactcgccttgctgaacttgatcccacacaggtcggaatggaatttgtgctcgcactagaaaggccttgtctaaaccatcttcatggaaaccccaaaaagcccctagaaccacacggccatgccttgacactaacagtccagctacaggcctccttgtcacttcctccgatcgatccaaagaaccctgtacctccgtcataccacaacgctcccgcagccgtactcgatcgcctattgaatcttgccccaagtgtatcaccagacggcgacgtgacgccgatccaagcgtggcattttatccgtcgccaaccgcaattcggatatttcgaggtgcagcgcctcaacaggctggcggagaggttacgggaagcagcaaagtgtcacgggtttggtgctgctgttcagacgggcatctttgaatcggctgtacgggaaatcctccaccccttggctataacagcagcttgacatataccccagaaatggggctacctaacctaccttttcttcttcttacaattgttaaacattatttactcaagtatcccatacatgggtcactggcaatattacatggagaatgatctcaccagaacgaaacaatatatacaactgcatagaaccgtcattttaaacgtgttcctttttcaagattggtactcgagatgagaagttttaatagattttttaatatcattcttcaccattcaaaaaaaaaaaaaaaaaaaa

SEQ ID NO: 3755 - DNA, 1492 bp, Trichoderma harzianum
ctcttcctctgtctgctatctttcctcctatctcagtcacccatccatccttttcctcccatcttttcacacattattacaaaatgggcgccgccgacagaatttcccagattggaggccagatctccggcaaccctaccgccggtggtcgcgacaagatcctcgagaagcgccctgacgatgtcgtcgtcactgccgcctgccgtaccgccttcaccaagggcggcaagggtggcttcaaggacacccccgctggcgaccttctcgctggtgtcctaaaggccatcatcgaacgctccaagatcaaccctgcgctcgtcgaggacgtcgccgtcggcaacgtgcttgcgccgggtgccggtgccactgagttccgcgccgccgcttttgtcgccggcttcacagaggagacggccgtgcgtgcggtcaacagacagtgctcttctggcctgcaggcctgtgtcgatgtcgcgaaccagatccaggctggtatgattgatatcggtattggtgccggtgtggagagcatgaccctgaactatggccccaacgccgtgtccgaactctccgaagacttccagaaggtcaaggaggctgccaactgcaaggtccacatgggtgttctctccgaggccatggccgtggatctcggcatcacccgtgagacccaagatgccttcgccgccgcctcataccaaaaggccatcaaggcccagaaggagggtctcttcaaggacgagatcgtccccctcaaggtccgtgtccaggaccccaagacggaggagtggaaggaagttgtcgtcgaccgcgacgacggcgtccgtgacggcatcaccgccgagtccctgagcaagatccgccctgcctttgccaagaacggctccatccacgccggaaacgccagccaggtctccgacggcgccgccgccgtgctgctcatgcgccgctccaccgccgagaagctcggccagaccatcctcggcaagtacgtcgccggcgccatcgtcggcgtcgcgcccctgctcatgggtcagggtccctggaaggccatccccaaggccctgcaaaaggcaggcatctccaaggacgacgtcgacatcttcgagatcaacgaggcgtttgccagccagtgcctgtggtgcgccaaccagctgggcatcccccacgagaagatcaaccccaagggcggtgccattgcctttggccaccccctgggctgcactggtgctcggcaggtttcgacgctgctgtatgagcttaagaggacgggtaagaaggttggcaacacatccatgtgcattggcactggtatgggcatgagcgccgtctgggttgccgagtaaagtggatgatgattaataggtgcgggtatatatgggatgaatgtgtacgaatagaaaacgagtctcttgtttatgttctcgtaaaatgcagagaacaatctagcatagaaatattgaatacctgatgttaaaaaaaaaaaaaaaaaaaa

SEQ ID NO: 3756 - DNA, 671 bp, Arabidopsis thaliana
ctgcacatgatagcttcagagagtaccaagagctgggaagctagcgcagtcagacaagagaatgaagaagagaagaagaaaccggttaaagattccggtaagcatccggtttatcggggtgtccgaaagaggaactggggaaaatgggtgtccgagatacgtgaacctaggaaaaaatcccgaatatggctaggaacgtttccttccccggagatggcggcgcgtgcacacgacgtagccgctcttagcatcaaaggagcctccgctatactcaatttccctgacctagccggctctttcccacgccctagctcgcttagccctcgagacatccaggtcgcggctctcaaagccgcacacatggagacctcacagtctttttcttcttcttcttctttaacgttttcatcttcacagtcttcttcttcgctagagtctctcgtgtcttcctccgcgaccggctccgaggagctaggggagattgtagagctcccaagtttgggatcgagctatgatggtttgactcagctaggtaacgagtttatattctctgactccgcagacttatggccttatccaccgcaatggtcagaaggtgattaccaaatgattcctgcctcgttatcacaagattgggatcttcaaggactgtataattattaagcggccgc

SEQ ID NO: 3757 - DNA, 1062 bp, Trichoderma harzianum
cccacgcgtccggcaccaattcccaattcatctatataatcttctatatcccgatcgacaccacatcacatcccgccatggccgctccgacagaagcgcagctcgcgcatatccagctcctcgaacagctcgacatccactccatccacaagaacttccgcaaccccaactggaagcccaaccagcgccgaaacaagaacctcaaggccatcgtaggcgacgcgtcgaaacgagaagcctctgcccttgcgactccacaagacgtcagcggcgatgcgaccccagccgccgacgatggcctctcgaccagcggcacctcgacgccggccacaagcaccaatgggaacccgccgccgccgaatcttgcgcaggcttcgcgtagtttgtcgaagctcgtgctggaaaagacgttgaagccgcctgtgggaggggctggagctgtgtcggcaccaaacgcgacgtacacaaatattgagtcggcgccttcattagcacattcgaagcactactgcgatattacgggccttccggcgccttacttggatcccaagaccaggctgcggtatcacaacaaggaagtgtttgggttgatcagagcattgccccagagctctgcggagcagttcctggctgctcgtggcgcgcatacggtgctgaagtgagcgcgctggtggatgattatacgagtttgaatatcaatagcacatcaacggcttttttttcaggaaggggggaattcaccaagcacaaaggaagggtattttaaaatctatcgcaacggcgcactggggttgtttatattttacactggcttttatatgggagaaatcatgttggatccacaaagtcaagcctcaactatgcacctcccgcctttcggcaagaggatggcaattgacgctccggcttaatcggaatcgcgagcttgttctttgccctgaacgagtaccgaaaaacgtatggggggaacgtctcagttgccagagctgatatggcggtggctgtcagggcaagtggtagcaatgaataatagcaaacgttcaaaaaaaaaaaaaaaaaaaa

SEQ ID NO: 3758 - DNA, 574 bp, Trichoderma harzianum
tcatggtcggctccgcctccgagcgcgacggcatcgccaagcacggcgccaagctcgtcaccgccgtcgcttgtgctgatgtccccaagttcaccgtcgtcgttggtggcagctacggcgcgggcaactacggcatgtgcggccgtgcgtacagcccgcgattcctgtggatgtggcccaacgcccgcgtcggcgtcatgggcggcgagcagctcgcctccgtcatggagacggtcggcaagtcggtcgacccggagctcaaggagcgcattgagaaggagagcgaggctacttactcctcggcccgtctttgggacgacggcatcatccctccccagcacactcgccagtatctcggtctcggcctgagagccgccatgggaggccgcaacgaggtcaaggccggagacaccaaattcggcgtcttccgaatgtaagcaaacaaagaaaagacaagagaaagaaacaagaaaaaatgtatcaaaaaaagatgtaaaaagtaatatatactacacactcatgtaaacatgcaaacaaccccgtgtctttttgataaaaaaaaaaaaaaaaaaaa

SEQ ID NO: 3759 - DNA, 376 bp, Trichoderma harzianum
cacctcggtctctacgcaatcgcgactgcatcagaagcattcaattgctcgtcaacgtcaacatgtctctcgcacagtctatctacagcaccgtcttccgcaagaacttcaccatgcttgcggccgttttcggtgccggcttcgcttgggagatcggtttcaatgccaccatgaacaaaatctgggacagcaacaaccgaggccgccaatggaaggacatccgacacaagtacattgagggcggcgaggacgaggagtaagatcaacatgcaaattccggttgctacggctagaatgggtgtggcatgggactgcctggggaaaatgtacaaaaccaacgagaaatagaatgattcaaaaaaaaaaaaaaaaaaaa

SEQ ID NO: 3760 - DNA, 505 bp, Trichoderma harzianum
cccacgcgtccgcccacgcgtccgcgcaatcgaaaaaggattaatcgcaactccgagatcctgctgaatcacaatgagacctactcaggttcgtctgggcggcggcgcccctcaacccaagactggccactggctcggtgactggggctcctttggtggtgccaagcagaagggcattatcgactacggcctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatgttgaattatgggtgtccaggggacacagtgtatatcagcgtctagattaggagaaaacaatagaaacgtttgactctacgaaaaaaaaaaaaaaaaaaaa

SEQ ID NO: 3761 - DNA, 1345 bp, Trichoderma harzianum
tcgacccacgcgtccgcaaacatctcgactccctacagccaaaagcttctctcatgtccgactacgctcctcccacagggcctccgccgcccaaggcccccgaagttcccgctggctgggccgcccggtggaacgaccaatacaaagaatggttctacgtaaatatctacaccaaaaagtcccaatgggacaagcccaccagtcctgtcttccctgacggagacgccccgccttccgggcctcccccaggctatgacggccacaacgctccccgcacgtccgatgccaagacgaacccctatggcgatcagagcaacaactttggaggctcatcatcaaggcagacgcaggaagacgaggatgctcgcctggcagccaagatgcaggccgaagaaaatgcccgagctcgcagcgcttcttccaaccctcccggatacaacaactattccggaggcgctgccgattcgtaccgccagcagagcaccagcccgtaccctcccccgcaaagcagcccgtacggtacaccccagccgcagcagcaacagggcgaatcgagaggtcttctgggtaagctgaccagcaagatcgctggtaaatctcccggcggcttccccggtgcccccggcgctggcagctacgggggctacggccctcctcagcaacaatacggcgcccctccagctccatatggccaggctccttctccctacggaggagcgcctgctgcctatggcggcggatatgctcctggatacggtgctcctcctcctgccccttacggccagcctgcttatggctaccagcagccgcagcagcagcctgcgaagaagagcggaggtggtctcggtttggccggaggagctgccctcggtctagctggtggtgttgtgggtggtctattgatagatgacgcgattgatcactttgaagacgagggatatgaacgcggctatgaccaaggatatgacaatgggtttgacaacggatatgatgatggcggcggtgacttttaattagtggactaggcgaactagctgcatatttgttaatgttcatatatatatgtgatgcgtcgctggaggaaagaattaggagtggtaatttgtttgtttgccggattggtctgtttttagctattcacaagacaaagacttgatattgtcgtttttggctaggattaggaggatggcgttacggattaacgccaatcgcatgaagcatgaagctgatgatacaacataaaaaagccctgagatttttcaaaggtccctagagctctgccttgaaatcaaaaaggattataaagcatagatgtacaatctcccaaaaaaaaaaaaaaaaaaaa

SEQ ID NO: 3762 - DNA, 411 bp, Trichoderma harzianum
tcgacccacgcgtccgatgctgccgactcgagcgcttctcaagcgctccgtttggaaagggccaaacctcgtccccctctccatcgtcttccccaaggtccccaacgataaagtccctcccgttcgaacacaagcccgctcagcgaccatcctgcccaactttgtcggcctcaactttgagattcacaatggcaaggattaccaccaggtgacgattacagaggacatggtggggcacaagctgggagaatttgcgcccacgcggaaaccgaatatttgggacaggaaatagacagactgaagggaatggagaagagaggatgaacatgtacaattacttgtatcaacgccgtaatgccacgacttattgcatgctttgaatcattggcacaaaaaaaaaaaaaaaaaaaa

SEQ ID NO: 3763 - DNA, 220 bp, Trichoderma harzianum
gcaacaaggatatccgaaagttcttggacggtctgtacgtttccgagaagggcaacgttgttgaggaggcttaaatgtaccggacaaggatctctgtttcttttgcgtttctgggactccggagtggcgaaggttcatcattgcatgtcacgtagcaacggggctactcttttacaaaaaatacattaaaaagtaaagtgaaaaaaaaaaaaaaaaaaaa

SEQ ID NO: 3764 - DNA, 176 bp, Trichoderma harzianum
cggcgtctcctacaagaaatcgttcgtttccctctgtcattgcgagcctgttgagcaacacaacaaaaaggcgtcaacacacaaagatccaatcgccagatctaaagcctctgtgctactcagtccaacaattgcacaaagcgacacaacataccgaaaaaaaaaaaaaaaaaaaa

SEQ ID NO: 3765 - DNA, 538 bp, Trichoderma harzianum
taattgactactatgtgggcattcaataactcagtcacatgccaaagacctccccatccattgcatctccctcagtgaagaacaaagcagttagttgttggcactttgttcacccatcaacaaaaaatttcttgctccaggaattgaaagccctaaagggaaaaaaaaaattcaacagccgcgcatatagctcgtgactcgaccacaacgtgagctagtcatacgataaagctggggaaccaacaacgtgggcagatttccccccaggactcggcccacttccccagactcctccagactcctccgcagagtggaagatgcatgtttcttccaggttctgtgccgaaataagcctctggtatacttaatggcagatgtcgagctcgcacaatgcagtaaagtaataccgagctcgccaaagccctccaaagcggcatcattgggcgaactcggctatatgtctacgtgttggatagaatagagtgacaagtcacgatcaatagtactttttacaatgcaaaaaaaaaaaaaaaaaaaa

SEQ ID NO: 3766 - DNA, 435 bp, Trichoderma harzianum
cctcaatctcggcgattcaatatctttctctcgacgtggttcgatttcgattcgacgtatcggtgggggggcatgaataaggtaatggttgtgtttagttgggctcgaaactaatgttacccatcagtagtatcacctattgctgacgtcggcttgaggaagtgggttcaatcgtgatacattcggctcgtacagtgcaatacagataagatgatgcgatcagagaggcaattgttaggtcatgattgacggaggattcgagccgatgatgacaaggcgacaagagctgggcaatcgaccccaattggatgattctggcaccccaagctgtgaattcggcttgacctttgaacatcaacttgctgtagggtagtgcaaccttggacgtaaagagaaggcagcgtcagcatttgttaaaaaaaaaaaaaaaaaaaa

SEQ ID NO: 3767 - DNA, 1154 bp, Trichoderma harzianum
gaacattcagccttgtgcaggggaagcagaagatcatatagagcatttatcaagcgaataacagaccctgagacactgaatcagagaagctttagaagctcttcttctctctgtctccgcgcctcttatcgcaaacagcccctctactgctgctgctgcctttgtcaggcctgtcttttcagtgtcgcatgccccgcctcatctttctaccttgcacaactcagcctttgcgctaatcaacgacatctgcgatctgtgtcggcagcagaagagtcccagatcactgtctctcttttattctccttcttctaaacagatctgtgttgcccccaaagcaagcgagaatacgtcaagatggctcttccgaaacgcatcatcaaagaaaccgaacgccttatggcggaaccagttcccggaatcagcgccgtgcctcacgaagataacctgcgatactttgacgtcgagatccacggccctgcatcgtcaccatacgaaggcggcattttcaagcttgagctcttcctcccagatgactatcccatgactccgcccaagattcgattccttactaagattttccacccaaacgttgacaagctgggccgcatttgcctggatgtgcttaagaacaactggtctcctgcgctgcagatccggacgattctgctttctatccaggccctcctcggtgctcccaaccccgatgatcctcttgcccccgatgttgctaagagctggaaagaagacgaggcggcagccatagcaacggcaagagagtggacagagaaatatgcaaaggcctagacttagaatcggaagacgagaggcaagaggaagaaaagagagatatatgaagatatattttcaagacctgcgataagttttgatatcaaaacggaagcttgctatggggtacgaacattattatgggaggagttgagagattattctttttttccattttctttggcttggttgcaaatattttagaaggctcaaatttgtttcgagatgagccgcaagcgttactgtccgcgcttctatggtgtatgttttagatagtacaagtggtcttgcagcagatataccactggcgcaatacatcatcacattacacttgctgtttagaaatacaaaaaaaaaaaaaaaaaaaa

SEQ ID NO: 3768 - DNA, 733 bp, Trichoderma harzianum
gttcttgtcattaattaactcgacccacgcgtccgctcacatcatgtccaacactggaggtatcaactatgcggcgacgttgaatgcctaccgccttgttcacgataagccgatgccgcatcacttgctggttctcgattctacacctggaagcgccatcttgacccgcgagaacttgggccgctggtcacgcgccatggccctgggcactgcaaactggttcccttggccatttgccgtcacacagacgctttgggctggattcctctgcggaaaccgcttcatcgaatgggtcattggcaaggagcccgcgccggtgttcagcgtcaaagcggtgattaacccatactacgagaccaaggatacgcgacacttgtatatctacagcgaagatgatgatctcatcccgtatcaggaaattgaagagcacattgcacaagcacggaaaaggggatacaagtctgataatcacatgttcaagggaagcggccatgtgcgccacatgcaaatgtttaatggagagtactggggagctatcggaacgtcgtggaatagagcgacgagcgagccttctgaggaggcgtaatgggttgtgctcaaggccaaaaggggtcaagatggaaatttgcgttgctttctatagacgaactcgcgttgcttgtttgcgttccttgcgttatacataacataatcgatctagaatgttgctggttaaaaaaaaaaaaaaaaaaaa

SEQ ID NO: 3769 - DNA, 791 bp, Trichoderma harzianum
aaacaaccatgcctcacaaacacaagtcaaaaaagggcgaatttgaagcagaattcgatctcgcccctacagagaaagcgcgatctcttccagtaaacaaacgaaaagcggcatcaagttctggagagcaagtcacaaagaagcgtgccagaagctcattaagaggcaatgacactccgcgagcattcaagagaatcatggctgtggcaggggggaagaaaattagatcaggcttggatgatggtcaactcgacaaaacgactacgaaggctaccgatgtaacgagcgagaaacttcaaattcgtcccggtgaaaatttaggggcctttgccagccgggttgatgcggctctaccagtatcagggcttgcgaagaaaaccagcacgaatgcagagggcaaagacgcattaggattgaaagtgtatcgcactcgcaaagagcgcaaaatgcacaaactctacgatcagtggagggcagaggaatccaagatacgagaaaagagggaggaggagctagagcgcatagcagaacgcgacttggaagacgatgctgccggcattcttacttcagctgccttcgaaaacgacaatagccacacgaaaaagaggaaggggggcaagaggaagagaatagtagaggaagacccttggctagaattgaaaaagcgaagaggagagaaaaaggcaaaggttcatgatgttgtattagcaccgccggaacttcataaagtagaattaaaataaatagtaatattaatattaataatataagaaaaaaaaaaaaaaaaaaaa

SEQ ID NO: 3770 - DNA, 1036 bp, Trichoderma harzianum
acaagaccttgtgttgctttctgaccagcttgccgagaaggaaaatgaactccgtaatgagattgagaccaaggtgcagaatcatcggaggtggaaccagaatcatattgatctcactcgagatccgctttcgccggtaaaagcattgggtatggagctcaagttcagaccggcaaagacgcaatacttaatgacgccgccggcgtcaacgtcttcagagtcgatggatgtcgacgacgtacctgagcctatgcaactggacaagctagagctgccagtattccagtttcgtggtgcggacgtcgacgagacaccgcaaactaatcagccggcgttccgacgccgtatcggccgactccaacggctctggatcgatcgaagaggtctttcgacaccttctagggcagatgcgtacgagtactcggaccggtggaagtatgattctgatgatgaagacgatgagcctcccgtatacgaggttgatccctttgacacaagagcgctgaagtttagggctactatccctctcagcccatacatcttccgggcgaggccaacggcccctacagaagcggtaaacggcgtagcaaatggaaacagagtgctaccgccgccgccacaaccgcaacagcagccgcaagtgccgcaccctcctgcagtccaacaggcgcaggcggcatcataaagaaaccccctctccccgatgaatccggtactgcatccctgtatgagtatgggtgtgtggaggtgtatataattttcagctctctttttttctccaatcacgctggtattgaagggttctcaggaacggacagggcggggggaggtttgggaggaggaaggaggaaggatatcttcgaggtagatggaaacgaccgaatgtatagtaccttagccttggtaaggcattgcgaggagttggggagttggggtcggtgctttaggattagaagaggaagaagcccccccaacgggagcaatgaagtaaagaaaaaaaaatcatacgaaacctcaaaaaaaaaaaaaaaaaaaa

SEQ ID NO: 3771 - DNA, 495 bp, Trichoderma harzianum
cccacgcgtccgcccacgcgtccgaaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactgctgttcagaatggctctactagctgtgtcattgctgcttgtggcgtttctgtcgccattaaccaagttctgcctgccacccaggctctttgtgccaaccagtgaactcatccatcgagagggagaaaatgacatgggagaaaatcaggtactcttgtacattgacaaacaagtacatagctgaatggtgtgaatgaataaaacgcattgctgctggataaaaaaaaaaaaaaaaaaaa

SEQ ID NO: 3772 - DNA, 286 bp, Trichoderma harzianum
gtggcgggtttacattgataagtgacggatatgcatcccgaaaatgacaaatttgtaagcatgtcactgccggcaaagaaccctgaatgctctagatgcttccgaaggattctccataagatgatatcccatgcagtttgtgccaaaatgggttaacggacgcccgattccgtgggtgtgcatttgattgagacccccatgtttgcagtgaatcggttgggtaagatgcattggagaggatgtacgtaggaggttcatttattgccaaaaaaaaaaaaaaaaaaaa

SEQ ID NO: 3773 - DNA, 260 bp, Trichoderma harzianum
gatgaggacgatgttgaggatgtgattggagaagacatggacgaagacatttatgattaagcggattgatcaatccaggaaacaaagtttcacccaaaagttatttttcttttctcgtcacggatatggcatacggagtttcaggaggaaatggggaaaccgtttttggtttgagtaattactcataaattggccctctataatgtatcataactaaaaatgaaaatattgttcattaaaaatgaaaaaaaaaaaaaaaa

SEQ ID NO: 3774 - DNA, 483 bp, Trichoderma harzianum
gaaaggcgagcggtgacacagagttgactgaaggacggacttatgacatggatatgatgattacttcaaaccttgaaaacccttggtagcacagcatttttgtaagttgggctcgtacctacattgtatgggtctgtttactatctaccgaaggtatgactatgatgcaagcagcggttccggatattcggtcgatacaatggcgcgagctgcttggacaatgccgcttcgtgtagttacacaatccgcgcatgcaggtattcgtacatttacctaaggtgttttatgcttgatgcggcgccggactggtgctcgtacctgtatggtgagagattgtggggggtggatgcgatgcccgtcccgaggcttctgagacagagcctctgatctgatgatgcgcatcgtttgaagaaagaaaaaccgatgagtgataaccagggtgttttggtgtgtgtacgctcgtaaaaaaaaaaaaaaaaaaaa

SEQ ID NO: 3775 - DNA, 476 bp, Trichoderma harzianum
cctcgaccgacgctcggcaacaatggcgacaattgcaagcggcttgcggcatgcgagatgcgcaagctcgattgctgcagctcaatggcggccggcaatcttcccgcggtcgaactttcaactcgccatccggtctataaccagcgactctcaaaagcctcccagtcttgaacttgaagccgccgagtccgtcccgatcccataccagggcgttacgcatgcgcgagttgttccggcgacaccatcttatttctcaagagaaccccagttcaacgatttatacattggaatctccaagctgctcaccaagtacaaccacctgcccacagtgccgccaagtgaggctccgcaaatgccatggacaaagctggaggagatgcgggcgcagatgggagagcccatcaagtcatcacactatgcgaaggtcatgcgagtggccaagcgcttgaacctcatcgagcccagcctgcggccgc

SEQ ID NO: 3776 - DNA, 203 bp, Trichoderma harzianum
gttgggtcgtgttgatgcctcgttttggatatgcatcgtatacttgcttggaggagatgaggtttgtgctgaagagagagagacagctttgagagtcttgctgtttgttattccgtgggggtatctcaattcgaggatgtatttatttactagatgctagcatgaatttttttttgatccttgaaaaaaaaaaaaaaaaaaaa

SEQ ID NO: 3777 - DNA, 389 bp, Trichoderma harzianum
ctcgtgtggcgccttgtctcagggacaacagacgacgagcaactcaaagaccagagctaaacatggcttggctagatggcaataagcagagcacgcttcaatcgagaacagacgcgctcgacaataaaggatgtgctacggcacagccattgggacagatgatgtcgcggttcaacggtaagtcttttgatcttgttgattgagcatcataacgtgaggccggctctagttgttcaggacgataaatgccacttgcaatgaccgaagctgtttgagtctcaatacactctgtaccagatgaaagggcttctatgtctgctaggttttcatagatttgtcatagttatgactcctgaagaagtagttgtactgcgaaaaaaaaaaaaaaa

SEQ ID NO: 3778 - DNA, 460 bp, Trichoderma harzianum
cccacgcgtccgcgcatcttcaccaaggcgccgtcatcgcgcggcatcatcgtcattgacttgagcttggaaagctcagcaagatgccagcaaccatggcccctccaacgcagactttcaacctcgatgttgaggcaatctcgggcatttgcggatctatctctatagcctgttgggtggtcgtgttctctccgcaaatcatacaaaatttccaacgcagcagcgccgacgctctttcgattcaattcatcattgcttggctcctaggagatgtcttcaatatcctcggagccgttttacagggagttctccccaccatgatcatcctagccatctactacaccattgccgatctcgtactgctctgccagctgttttactatcgcggatttacgtggcgcgacgagccgactccatccccgcccaagacaaatggccactcttcgacatcagcggccgc

SEQ ID NO: 3779 - DNA, 257 bp, Trichoderma harzianum
attgaacgcacagtaaaagtgccactggatagggacgaggatgttcaaatagccgactcagcaattgcactcaaaatgatgattgaccaagtgagtaagaactggtgagtatagcgaattgagaaaaataagacaaggaggggggctattagggaccataactgtctcgtaaattaagagttgtctagctaatacactacgaatgtgtatgtaatgcaaaatttggatgaaaaaaaaaaaaaaaaaaaaaaaaaaaa

SEQ ID NO: 3780 - DNA, 236 bp, Trichoderma harzianum
cccacgcgtccgcaaaacaacataagcccaacagtttaaaatcgatcatcgtcaggttgttcaaagccaagatttagaataatcacctatgcgtgtaattagtacggttcagagaagatgcaaccaactccaagtcaggtacaaatttcaatgattcaaagactggtatatatggccttgttttgcagagcatcaaactttctgccgggtcggtacctaacaaaaaaaaaaaaaaa

SEQ ID NO: 3781 - DNA, 424 bp, Trichoderma harzianum
cagaatacataaaggaatcagccaaagctcgcgcgttaccccgggggtttggttctccatctgactgctttgtactgctactactgcccggagtgcgagtaacacccgctcgtattatcgcgacgcctttacacttttgattactcgagttggtccctccgatcttcagggaccgtttaatgcggctattctcccaagcggagcttcgtggtcttaacggttgttgcgttgccgagccagtctgtgtattagttgtgtcccgagcttattgaacctgctgcacgcacttaatccgcttctttgcccttgatacctacatgcctgcatttggcagcacacgccacctggtacgttgtatttagttactcttagtctatgcagacaacaacttctctctcccaaccaaaaaaaaaaaaaaaaaaaa

SEQ ID NO: 3782 - DNA, 868 bp, Trichoderma harzianum
caacttacaaattacaacctacaactgcccacaatgtcgctttctgttggtgcttctctgcggcctgcggccttccgctgcgttggtgcgtctgccgtgcgcatgcgatgtgcttttggcacaactgcgtccagaaggagtgagagctcgacgccgggcgagcttggggttggagagctgcagggcgcatcgtttcgcattgagcctctccggagggttggggaggatgcttcgactatgcgagcgagacttttataccaatctcggaagcgcggaaccctcgagtcggatcttttactgtctacgtttgcctcacagaacctgcccaccatgacggccgaagaactgcggcagtacgacctcttcctcgacgagaacgactgggacatatactactgggcgacgcagcgggagccgaattccacgacgaacccttccgtgacggcgagtccggcgagtgcttcggcgagcgaagggttcgaggcgagacagcaggatgagttgcccaagaatccgccaaagggggagtgggcgcagacggtgggcaattttaagcctgcgtataggccggtgccgcagaggtggaaggatagcgagattttggagaagttgagggcgcatgtgaggaggaagagtgtgaatgggggggaggggacggggatggcgtttatgccgcctttggagtcgtgattttgacgatggagaaggtgaaaagagatgaagtaaggaacggtaaaaggattttgggtgggaatgttacgatagggtttacgagatgtgtataacaggcaggattaagtgacgacggaatgtcgcggatagaatcaaggatcgtggatcttgtatgatcaaaaaaaaaaaaaaaaaa

SEQ ID NO: 3783 - DNA, 432 bp, Trichoderma harzianum
gatcactccaccacgaagcacttttcaaaccgaagacctacacgcatcttcattttcaaccgccaaaatgggtatgatcgacgccaagaacagggtgacggagcaccagcgcttttaccaggctgcgtacaaggctcacacccgcctgtggaagattaacccccgaagcaactggtacatggccccctacctcgtcgccctctggggaggtttcggagctaccctttacgctgccagccgaaaggttgccggccacaacacctggttcagcaaggattaaagtatcggtatctatgggacgagccaattgagttaccccaacttgcgtcaaatgcaagattgagggtatgtatgagtttaaagtcttatagacagtaaatataggatttgtcagtccgtctcatacgtctcgctgctaaaaaaaaaaaaaaa

SEQ ID NO: 3784 - DNA, 715 bp, Trichoderma harzianum
aagaaacacaaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccggcgcgcccacgttcacgcacggcacgccgccgaaagccaccccaccgcccacgccgctgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacagggcaaggcattgctgatggtgaatgcacaacacgcgtggcagactggccgaaaattgatgatttactgatgggcgactttggacttgaaatggggcatgccggatgggttacttgacagtatttacaccatttctattcaacaataaatggaatctctaaaaaaaaaaaaaaaaaaaaaaaaaaa

SEQ ID NO: 3785 - DNA, 342 bp, Trichoderma harzianum
cgccaatcgggaacaaaaaagggctgcgcgttctttttgcctctcctgactccttacagatgggtggcattgctaaggtacagtgtggagtctgcagtggattcgagagctgcgatttcagttgtttggacctggacggagaattttacggagcagctcacccttgatgcagtttaggtaggcggtgtctcttgttggcgtgttttataagagcaactttgctggtggtaataatgatgtccatgctattttcgtatttctggaataggtacctggtatggcaaagagaatagaatgatggtgaatgagattacacagttcgaaaaaaaaaaaaaaaaaaaa

SEQ ID NO: 3786 - DNA, 706 bp, Trichoderma harzianum
ggagtttgttcgtttatttcgttctccctaagatgttgcggatcatgatgtagttgctctccaagtatacataagatagccataaacatagccacagcagcgcccaacaacaactgtgaccaagggtgggtggaagtctggcttccagcacagtactttgcatgatagagtcatgacaatgtcatgaaaagagaattgtatgtacatgtcttatatttcctgatacagcttgggcacggagcgcgtgtgacgaaggtaggtgatggttgctaggtataggtaggttgggattgaagtcacatgcttcatcctcacttgtatgaaacccgtttctcagcccataccagcatatttgaaccagttgggacggcaatcttctcggtggaggaacggctcaccatccgtcagtcgaccagtaacacagcccttgcatttgggagagttggggcagttgaagaaggggatgtgctggtagccaatatcacggaaccagtggattttgctagaatcctcaaatagacccagcgcaatgctatgaacgggagcatcgccccatcgctcgtaaaagaagcctcccgcacggtcgaggtgctcgaaatagtcctcgtaagccttgctcctccaaaactccatgtcagcaacctcaaagttgctccagaagtggcaggtggagaagccctgggcctctctgttgtgctgcggccgc

SEQ ID NO: 3787 - DNA, 728 bp, Trichoderma harzianum
cgacaaaacaggatctcctcgtcgtccaaatccaaccgtcaagatggtcaaggttaacaagaacatttcctcctccaggagcaagagccgtgccgctcacttcaaggccggctccggccagcgccgtgtcatcatgagcgctccccttagcaaggagctgcgcgagaagtacaacgtccgcagcatccccatccgcaaggacgacgaggtcaccattgtccgtggctccaacaagggccgtgagggcaaggtcacctccgtctaccgtctcaagtacgtgatccacgtcgagcgtgtcacccgcgacaaggccagcggccagagcgtccccctgggcatccacccctccaacgtcgtcatcaccaagctcaagctcgacaaggaccgtgagagcatcctgtctcgctccaaggtcggccgtgagctccgtgtccccaacaagatctctgcttaaattcataagcaaatcttaacaattgggtgagacgaggagatgaatcttttttttttcaacttaacagtttttccatgtgatgcatccatggcacaatgatgggcaaggaatgggcatatatactccggcgttttagcgatacccgagacccctgcaggtccggctttctcagcagggtagatgaatcgagaattttacaattctcaatggccgtttcaccaacttgttgtgtgaaatgctccatgggaggtgtttcccgaaaaaaaaaaaaaaa

SEQ ID NO: 3788 - DNA, 200 bp, Trichoderma harzianum
gctcaatgtaggtccctgtatctaatgtactaaggacgtgtactactgcacctgtgaatgggggcctgctttgtgctctggctaccttagtgaatgatatctgacttttgttatttgatttaaattgattcatgtctcgatttgcatttctagagaagccacaggcaaaggcgacaagccaaaaaaaaaaaaaaaaaaaa

SEQ ID NO: 3789 - DNA, 219 bp, Trichoderma harzianum
ggcgtttgtggttgacagagggagaggctgtgtttggttgaaggaggagaagaagaagaagaagatgtgaagaggaaatgccgaaaagaaggatgaaagatatgttcttgtctcgagctctttccaattgctctggccttgtgcataccatacagaggcaggcagtcgcaagaccaaataacgaggcaatttgcaatgcaaaaaaaaaaaaaaaaaaaa

SEQ ID NO: 3790 - DNA, 455 bp, Trichoderma harzianum
cgcctgcacaacaccatcctcggcgccgctgctcctgcaacagctgcaagagaggtagtcgtacggccgcgccaagctgcgcctgaatgtcacccgcggccgtggcaccatgacgtcccgtagaggcgatctgctgtcatacaaccacgtctccgaaaatagcaccctctcggggcgtcttgtcccgaaatgtgccgtcagccgctctgacactgcgtcgacaatatctgtcaattgtttgtcttcgtcgcggagggccgccgagtcgcgactcagctggactcgctgagcaatcacagtcgtccgcatcaccttgctttggctgctatatttggtgtgcagcgtcatgccagcgctctctgcgtctgcttgcagctgctccaggcgcgagagcgtctcttctaggaagctcaataaagcggcatcttgttccttggtcgaaaaaaaaaaaaaaa

SEQ ID NO: 3791 - DNA, 495 bp, Trichoderma harzianum
ggggacattattctgtttttcacctctttgtcgttgtccctcatacggctttcgtaattacgccgttatgtacccatgtcctgtctgatgcgttggtcacgctggtcgacgctgcggggggaaggcaaacgaaggcaacagaacggaaaagggaaataaaaataaaagttgaacctaggggggtttgataatggccagcgtgcggcaggcttacaaaacaacgggaagattttcacgttgggcgggattacggctctgatttgttattcactctagctactagtcatggccgaaaacaataatgccaaggttttttcggtcaagcaagggaaagaaaaagcacaagcccaagctttttgggggcccagaaggagaggagagggagaggcaaacaggcaaacaaaggtgaacgggcgggctttagaaaacacccattcggcatgtaccgtggctcggatctcataagcatcacggcaaaaaaaaaaaaaaaaaaaa

SEQ ID NO: 3792 - DNA, 197 bp, Trichoderma harzianum
cccacgcgtccgcccacgcgtccgcccacgcgtccgcacgataatagcaacattaattgttcttcttttgtctttgttatagacttgtcttccaagcgacctctattagactccgtatagaactatagagccacacggaacaaacccaataggctattgccagcacacacacccgggaaaaaaaaaaaaaaaaaaaa

SEQ ID NO: 3793 - DNA, 994 bp, Trichoderma harzianum
agacaccatattaactccaagattcagctccctcagctcagcaatagcctcagcctcagcctcagcctcagcctcaaaataaaatggccgtcactggccttgttgcagtcgagacgctgccccgattcctcctcccacggctcagctggactgcgccgctcgccgcatctcgatctgctgcagcccaaccctttgcccctctacaagcacgaacgaaccaaagagcagtgcccgccttcaacaccaatttctcggccagaagatacaacaatggccagataccggcgctgaggcgagggtttcacgcgacgagtcgacgatcccgagagcatcatttcgatacgctcaagtttgtcaagcagctcaaggatgagggctttaccgaggagcaatcagtcgccatgatgaaggttctcaacgacgtcatccaggagagcatccaaaacctgacccgaaccatggtcctccgcgacgatgctgccagaaccacatacacgcaaaaggtggacttcgccaagctccgttccgagctcacttcggcagacagcaccgagtccaacacgacgcgcagtgcgcacgagcgcctcaccaacgacattgccaagctcagcagccggctacgagacgagattggccggacccaggccagcgtgcggctggacctcaacctggaaaagggccgcatccgagaagaagccgtgggccaggagctcaagatcaaggagacggagaccaagattgagcaggaggtggcggcgctgagggagaagctggagcaggtcaagttccagacgctgcagtggctgatgggtgtgtgtactggttttgcggcgctgctgcttggtgcttggagactgctcatgtaagaggcatgatgcgtcctgggagggggtgttttagatgacgggcatttgtgaatagtcgtgcattatacaatcatcatccgaatcgaaagcgtttataaatagtttcaatattgaaaaaaaaaaaaaaa

SEQ ID NO: 3794 - DNA, 445 bp, Trichoderma harzianum
cggacgcgtgggcgacccacgcgtccgggggaggtgaggagggtttgtattcatgaaaggagatttgcgcctaagctcaagcgcaaaatgaatcctgggtcggaggtttacatacaattgcctgtaacagactgagcacatatgagtagtaccttagtactggatactcggtggtttgcggcgccgcgctttgctggagcaagtagctggatacttgcctgctccgtttgaggacgtatttgccgggattgattggacaggaaacgtctagcggcgaggcgcctggtggcttgcagcaatgacgcagggtggtgggatgagggaaagcgcacacgaatggttaccaggaaaggtttagcgcggcatggtttggggaggattgtgggaatgaattgatttgtctgggggaaggagctgagaaaccgaaaaaaaaaaaaaaaaaaaa

SEQ ID NO: 3795 - DNA, 432 bp, Trichoderma harzianum
aggaacattacagcccatagaaggattacaagcatcgtggcgtactaccgacaagagttcatagtcatcgaaaatttgcgactatggctcgggtagtttcagtggcattatctcggaaggcgggttcgatgactttgtacgccacgggggatagcacgttgtatcaagcctcttcaaattgttagacacggctatgtgctgttggaagtgggtgggcattaaacgaggcgaactttacctgatgagacccggggtctggaggagccataagcgagatacactgggaatgaaataaatcccatgtctctacagttggtggaacttggtggaggaatatgaattgagttgacttaggaagatggctatgcctgtggagaagctgaatagattgagtttttggttccatcgaaaaaaaaaaaaaaaaaaaaaaaa

SEQ ID NO: 3796 - DNA, 743 bp, Trichoderma harzianum
acaagtcgaaacgaacccaattggcacgcacaccagaggccatatacaaatacaaatatccccccccttgaaccgactctcgcccacccgcccatcatgcatctcatgtacaccctcgacgccagcggcaaccgcctctacaccctcaagaaggtcgcccacggccaggtcaccaagtctgcgcacccggcgcgcttctctcccgacgacaagtggtctcgccagcgcgttacgctgaagcgccgctttaacctgctcttgacgcagcagaaggaggaggctatgtaaattcgcatcatggagataccctcgaaccaaagaaatcccaagcggcgttaattgggagcgacttcgggcatgctttttgaggtgataattgattcgtcattgtcctctgttggcgatacgggataaagagaacggcaagctcttcttctagagagtcacaaagttggccattcgtcccaattcgggtaaccgactggctttgtttccttcgcttaggatcgatggaggaatacacttgagcgagcaacattgttcgtttggggacagcaatgagagactacaggagggggggtgagtgtctggcgagagcttgactaggtggatgggtggatggatgacaagttcaccatgttctggaattggatctttctcaatgattggggaatggatttggcgtttcttaggcgattacatgtacttgggctcatttgcgcatacgcaaaaaaaaaaaaaaa

SEQ ID NO: 3797 - DNA, 780 bp, Trichoderma harzianum
gcccdcgattcgttttaaatagatcttacagtatcactactccatctcagttcgtgttcttgtcattaattaactcgacccacgcgtccgacactctccaggctcacacaaaactcactacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacctggtccgttggcagcgccatctccaacccaacaacccttgctcaaggcggttcctatggcgagaccttctcacgagaccccgtaaccggcggtcgtgccatcaaggtcaccgtccagcccgatggcctctacactggcaagccccagaccaacttcgccatcaaccttgagggcaacaccatctggtacgatctttcagatgtctttggcgatgccttcaacggccacaaggtcgttgtttccagcgccaacactgcttgcccccagattgtttggggcagcggaatccctcctgccggaagccaggtcaagaactgcggtgcggataaggatgtgactttgactctgtgtgcttagagttaagggaggacggaatcatgtcaagggaaaggtttaaatcaagtttatgatagaatttcaagtcctagctatgtttaagacttatgacagtatgaattgatgagtttacttcgaaaaaaaaaaaaaaaaaaaaaaaaaaaa

SEQ ID NO: 3798 - DNA, 868 bp, Trichoderma harzianum
acaagttcaattcgcagcaacagaagcggcgcagacagcatgagctcatcactgaggagctgcgttgcggcccggccgctggctcgcatctcgcagacggtcgcttcacggaacggcgtccagagcgtccggtgtctgtcccagacaagcccacgatgggaggattcaaaagatgcaaagccagaaccacccaaggcggtgcctccaaagcctcgaaccgagtcgctcctcgacagcatctacagcattacccaggcgccaaacagccggtccgcgcagtccaaccccatgggcagcctctcccagagcatggtcttccaggccctcagcaaatccaacatcgacaccagcgtcctgtcaggcggtccctcgcaggcagcgcagaagaaggaggatgaattggagccattccatttccacgtctactcgcacaagcacaacactcacattacatgcacaaagcccaatcgggaacccatcatctccatgtcatgcggcaacattggcttcaggaaatcacggcggggcaccttcgattcggcctactctttgacaaagtacgttttggagcgattgattcacacgggatggccaatgaagattcagcgtctcgagctggttctgcgagggttcggccagggcagagaggctgccgtcaaggtgctgatgagcccggaaggcaaggtgctgcgggacaagattgtgcgggttgcggattcaacaaggatcaagtttgcaggaacaaggagcgagaagccaaggcgcttgtagatgctcggttgcatcagctatatgatgacatgctgccgaatgtaccatatcttgtacaaactataccaaagaagaatgaacgaaaaaaaaaaaaaaa

SEQ ID NO: 3799 - DNA, 865 bp, Trichoderma harzianum
gtttcctctcgttctactagctgggaaggggaagccggctagcagttagagcggatgggcatcgtgatgggcagtgacgatagtgtacacccggaaaaagtgactgcgtatcgctttgcccctccgtgtcttccgacgggattgtctcgataaaaatgacatcagcacgggaagaagaagagcatctccactaacggcacacacaaacacgcatagaacaagacgctctccgactcctcggagccggtgctctccctgcagggcgttggctacctgatccgcaagggcatcagcctggccaccatcaccctcgaggtcgagcagtacgagggcccgcccaagccgcccaacaccgccgccgacgtcgtcacgcacatcgacatcaagcagtccgcgtcgggcctgtcgagcacgcaggagaaccgctgcttcgacaacttcccgcgcgaccacaccgactggctgtttggcaccgtgacgggccgcagccgctgggtgagcctggacgaggtcaccgacgagttcctcaagaagggctgggaggtcgagggtgagggtcagagcttcatcaccaacattgctgagaacaaggagaagggctgggttgccgagcaggtctggggattccagattgttgatggcgagcgcagatactgcagacatattgttgtgaccaagggagcggagcgggctcagatccgactcgtctacgacttcaacgaagagtaaggggggggtttgtgtgacaggtgctcattttgatatcatatagaagagctgacggccttcatgtttgtttcttcaagaataaataaagagagtagctatacagtacctaaagttggttattaaaaaaaaaaaaaaa

SEQ ID NO: 3800 - DNA, 461 bp, Trichoderma harzianum
gcggtcgaataaacaccgactgcatctccatcagattgcgcttggcggccgggtctactgttgcagttgatgccgcccaactctggcaaaacctggcgctgcggctgcggctggagaccgggggagcgattctggctgcccaaacgagaaccgggggggatgtcaatgcacagttgcatcgaaatttggcgattaatttttttacgagggaggattaggattaggactttgcacggtagtattactaggacccctaggcagaaagttggatatagattgcattggatgttttgattgagttgccttgctgggatgttgagagtctatcaagcaagcaaggcagacgaggatgccttgtgcagagacggcatttcaattcactaattggataaaatagatatcaacgtattatacagaaatactgcatgcaaagtaataacgaaaaaaaaaaaaaaaaaaaa

SEQ ID NO: 3801 - DNA, 419 bp, Trichoderma harzianum
ggtgtagactatgtgtatactactgtacaagtttggaatcaactaaaattgtgcagaatgaagagagagaaaacagagcttattaggatggcaataatgcaccgtcaaagggtagcgccgtttccaatgtggtgcccaacaaagtggagggaaaatatgctcacttacaaacccacatgcaaaatcgctctcctctatacaggcatcctcacctgcagttcatgtccgttcgatggtgagatgacaagtggattgatttctcatcagtatgtaatctccatctgagtcgtacatgtagttagtttaccgatacacggctgcctacgcaagagaccaacaaccaagacgagttaacgaagtaagactttggtcaacagcagtattagtccagaggtcgacaaaaaaaaaaaaaaaaaaaa

SEQ ID NO: 3802 - DNA, 576 bp, Trichoderma harzianum
tccaaccctcctttgtatggcgccagaatcgctagcaccgttctgaatgacgcccagctcttcgccgagtgggaggagaatctgaagaccatgtccggccgcatcatcgacatgcgcaaagctctccgttccaagcttgaagagttggagactccaggaacctggaaccacatcacagaccagatcggcatgttcagctttactggcctatcagaaccccaagttctcaagctccgcgaggagtatcacatctacatgaccaagaacggccgaatcagcatggccgggttaaataccaacaacattgaccatgtggctcaggccatccgaaaagtcgttggtgagactcagtaatttgtatgataatggtttgatagatgggcttcgaggacgtgacgataattatcaccgccgctggccaggaacttgcgttgtttcgattagtgttcttttttcctttgtattcgatagcacatgggtgtgtgggcatagatgcagctagacaaatagcaaatacggctttgagggcctcggggagtttcatcccttgacaatgaaaaaaaaaaaaaaaaaaaa

SEQ ID NO: 3803 - DNA, 716 bp, Trichoderma harzianum
gcagtctccagcagagtaagcccatcaaactcatcaggctggacagaatgccgtccgaacgccatcctctcctatccaaccgcggcgagtcggccgaagccgcccaagcaaaggctgccttgcgctcttcacgcatccgcgagattgccttcttcgcctggggcctgctcgccactgccgccttcatcgtcgctgctgtctggatccagcatgacgctcagaccggccatggcgacaacaacaataacaataatactgtcgctcccaagcgcaacttggtcttcatggtgtccgacggcatgggaccggcgtcgctctccttgactcgaagctaccgccagtacatcaacaacctccccgagaacgacactctcgtcctggaccagcacttttggggcaccagccgcactcgctccagtaactccctcgtcaccgatagcgctgccggcgccacggcctttgcctgcggcctcaagagctacaacggcgccatctcagttctgcccgactttgagccatgcggatctgtcatggaggcggcaaagagggtcggatacacaacgggacttgtcgtcacaacagacatcacagatgccacgcctgctacctttgccagccacgtcctgaggcgagagatggaggactcgattgccctgcaggaaatcggagagggcgtgctaggccgttcagttgatctcatgctcggtggcggccgc

SEQ ID NO: 3804 - DNA, 372 bp, Trichoderma harzianum
catgtggccacgggaatgacgcaaaaggcgccgagagcggaaatggagagaaaaaaaacccaattgcacctcgtgatgatgccactcaaatgtctgtggtcgagccactggcttctacctacgcttacattacctaacaaggaacgaaacattttgcggcaaggagaattggatcattgacttggcgaatggcctaatgaatgtcgtcaattgcaggcctcgtggtttggcggttggatgagagggggaattggagtgagtgggatggggagttggagtcattggattcatttgacaattggttattacgagcggtttaggtaagaatgtaacaatggaacagcaaaacgtgcacgcaaaaaaaaaaaaaaa

SEQ ID NO: 3805 - DNA, 411 bp, Trichoderma harzianum
aatcggacgacggagtaatagataggacacgggcagagaagcaaggagggggcggactgcagcgtgatatgacaaaagggcagacctagttttcggagaggcaaagaggagaaacgacttactcatccttgggtcccggggcgagatactctgtgagagcctgcttcgtctgagcgacaacaccatccgcctcagccaatggtttcaatcctggcagaacccaatggcgccaaaaggcaaacttggggtcatctggcgtgggtgcatcgggatcgacaaggagcaacatatacgatgcgtctcccgatgaatccccagcctatatatatgtgtgtgatgggaaatcgtcaggaactctagcttcaactccatagaacaactttaaaaaaccaaaaaaaaaaaaaaaaaaaa

SEQ ID NO: 3806 - DNA, 295 bp, Trichoderma harzianum
ctcgtagcaccagctgtatacctttagtatgcttgtgatgcgtgttcagataaaattgtcttgaaatgtacatttgatgcttttgagggcttctaaaagtaaatcaactctgagaccagcggggcaaacatggtccataggcacgcatgctacgctgccgtaaatagagcaagacacgcagggttataggagcgcgcccaggtctcaacctaaaaagcttcaatccatgttcaatctgaagcacaacatggatgaaatattcaaaccgaggagctagaaaaaaaaaaaaaaaaaa

SEQ ID NO: 3807 - DNA, 282 bp, Trichoderma harzianum
cccacgcgtccgaagtagggcaggctagctggtcccctggagaaagatgaggaaaagacccggaaggagaaaagggaatcgtgtgatttaatttgctatgccggatcgtagccgtggatgtgagatgaggcgggaagggagaagccggagaaggcgggccttgacacggagctgaagaattttctttttctttgtgtcgcgtgttgtgtgctttgatcgtgattcttttgccgtagccctttttttacatacatttgtgtgcaaaaaaaaaaaaaaaaaaaa

SEQ ID NO: 3808 - DNA, 297 bp, Trichoderma harzianum
aagaaaatagagaagggggagaaaagaagagagcctcttagaggatgatgctgaatgacgctgtggatggtgaaatgtgagatgagcaaggtttgtgttacatgtatattaagaggattttttctttttgtggacggttttttatatgtgatattatggagaaactagcaaggatggagaaaagggggagaaaaggaacgataagtttatctctgtttgggcatgtatgggtgttaatatgattgacttgtcatatgtgaatgatgagtagatgatgaaaaaaaaaaaaaaaaaaaa

SEQ ID NO: 3809 - DNA, 654 bp, Trichoderma harzianum
gcggcgtctcctacaagaaatcgttcgtttccctctgtcattgcgagcctgttgagcaacacaacaaaaaggcgtcaacacacaaagatccaatcgccagatctaaagcctctgtgctactcagtccaacaattgcacaaagcgacacaacataccgaaatctgcaaacaatgtgtttccgcgtggagccaaaggccaaatactactaccaggaggaaatcattccctcacggccgtaccgccatcaccatcaccatcaccattcttcccaccactcgccgcgagcgagctactcggcggttgagcgctacagcccgcgggtcagcaccagcagctacagacgcagcgtgccgtcgagggtcgtgtatgaggagacaacgcggagtcggtactgaatgggcttttgattaggaccaggaatatcctgtgattttcttactctttgtttttttaacgactctatggtactggttatgggaaatgagacacatgttagaggctagaataatgggcggattgggatggaaactcgaggcaggcgatggtttcatgaggatatgagaacctggaatgcggtgacggcgttggtaacatatatttcgcctttacgatttgaatgaatgagatacataaaacactaaaaaaaaaaaaaaa

SEQ ID NO: 3810 - DNA, 439 bp, Trichoderma harzianum
cggacgcgtgggaacccgaacaaaatgcttatgagcgggccgcgggtaccatgtcagtgtacgggtactcgtacaagttctctggacgagcagatgcaaccatccggcagtcaaacttgatgctacttgacctgtaacatttgcattgatgagcggcagcagggcctggcaacctgggtagtactcccaagtattgcccgtacacgtcctaacatgcggcaggcgatcaagccgttctcagggcgctaacaagggggggacgaggcgcactggaagcgctgagaacacatgcatcgtgaggtgatggagtcggtgggctcgggtagatgtacctaaagggcacataaccttgcctggctctttggtcctggaaggggtgatgtgatttactttcaatggaagaagccggatgttgcgactgcttaaaaaaaaaaaaaaa

SEQ ID NO: 3811 - DNA, 331 bp, Trichoderma harzianum
ctccgtccaagcaagggaggccacgatggcaaatgccgccagcccggaagagatgcctaaaatgcctcctccacggcttcttctggaagcatcagtcaaactcgttcacttgcatgcagaggcgctagcaaggcctggccgcatgctgcgcgacttttgcaagtgagttcgaaggaaagcggccggccacgttttggacatggggagagaagagagaggagggcatgctagttagttgccagattgagcgtcggtgtccaatgtattcatgtttcggaaagatttttgttcttcttccatagctattgtaacggcgaaaaaaaaaaaaaaa

SEQ ID NO: 3812 - DNA, 368 bp, Trichoderma harzianum
ggcaggcagacagcatagatgaggaacttcttttcatccaggcagccaaaaagggcagtgcaaggcaggcatcgtcagttgcagcgcgggtgattggctcatccgccgggctctttttttgcccttcgacttgctttgatgcccggagggatgtgaatccaaagagaggcgacctgcccaaagagggaaacagggcaacgtgagcgggtagattcgcagctaggaacaggacaagcatcacacatgtatgtaagatggtcactccggcccttgctcggaatcaaccgcggggacccgtgtgagcaaagatagataccgtatgaatatatcgtatcctacgaaaaaaaaaaaaaaaaaaaaaaaaaaaa

SEQ ID NO: 3813 - DNA, 296 bp, Trichoderma harzianum
attgagttgaatgacgaaaggagtttcactgctacaaatgtactgtacagaaggtatacagattgacagtcagggtccacgatgcttcaagatcagtcagatcagtctcccatctcagctccgctatgacctcagctgcagagccggggtggaggcagcactcgacggctcggactgctaacaaaatccccaccgaagatcggcatcgtctccgaagggtcccttggccggatacagagcgaaacgaccgtgttggatcgcattgccctaaaaaaaaaaaaaaaaaaaaaaaaaaa

SEQ ID NO: 3814 - DNA, 676 bp, Trichoderma harzianum
gcgtcgaggcgtcaacttcacggcatcacgaggttcctggacaagccgtcaccatgtccactgacgatctgagcacccatctggccgactccggcatcaccatgcggtccgacagcgagcagtactctccgggcgatgaggtctcatcaccctcgtcatcaaactcaccggttattctctacaagccccccacagcatggagtctgatacggagcgccgccatcaatctggttctgccattcatcaacggaatgatgctgggatttggagagttgtttgctcatgaggcagcattccggttaggatggggcggtacaaaggttttccctctttctcgaagacgagcccaccccattggcccaggcatcgaagtccgtgaacgaccagagcgacccgggccttcactaagtgattacgcaagcttagagtagaagggaagaatggaatgaggacgataggggtattgtatatgaatcaatcatgtctaaataaacagatgcaggcgcttttccaaaagactgtggcccatctgctgcactttcagagctccccaaccatataggcagctagtagcggcggataagtggccgcgaattgtacaccagcagattgcacgaagctgtagccactgcattaaaataaatcaattcaactttcaaaaaaaaaaaaaaaaaaa

SEQ ID NO: 3815 - DNA, 971 bp, Oryza sativa
attattcaaaatgaagttcacaaccatcgtcaccgctgctgtctcttcagccattgccgtctccggcactcccatccacaagcgcgagatcggcggcgtatgtcttctccctctcctctcccttgcatcttctccattcctatcactcgtctgattcaatatcatctctaactattggtcaatccctcacaggtcctcttgtgcaccggcgtcaatgcaaccggcacctgcagctacaacgtctacgaactcaagacgtgccaccagcttcccgcgcctttccaccaaaacaccagcacgtttgcccccgacggcgaagactttgagtgcttccctcgtattggcgactgcggttctatttgcaccagcccgacgggatgtacctttggcagcgtcgactttaactacaagaacaagttcaatctgggggctattaagtgtaacaccttgatttccagctttgactgttcgctgaagacgacgacgacttcaactgagtaaaaaggaaaaaagacaaaattatgttttacaaagtgttggaggatcgcatcttgttttgtttaatgtacgacttataccaacgatgaggatccatctcatccgtcaaaaactcgaagactgacagctgcccctccatcagcttaaaaacttacatggatgccaggatatgacatcaagccaggggtggtttatttacacgagaaacggctgttttaatttttttgcttttgttttgtgcttggaaatgggcgtttatactattacccgatgcctttaatgatttgctgctttcggacatagttcgggcgtcatgatgatggaaatagagagctttcggaggggtgctttggcaggtctggtggtggggtaaatacggatcaatgtgtcgatgattgttaaatagcttctacccttttaccaattaatgagtagtatcttgtgcttcttctttttcgaaaaaaaaaaaaaaa

SEQ ID NO: 3816 - DNA, 369 bp, Trichoderma harzianum
gatgaattgtccgtctccgggcatttctcaatggcgcttacttcaggacgtgattggttcagccctaaggacaagccatgatacattgcaacctttgagttgggcaaatgacagatcatttcaacatctagatggatatacagcaagtgaaggaagtcggaaagagagtaacctctaagaaactggatctttattcttcattcttttcaccaggtggattatgacctaccaagctccggctgaccgaagacattgccgcccgagttagaatgaagaacaatccaagtcgaataaattagttgttatagctatcgtaaaattatctcaaaattaaatacaagttggattatcttgaaaaaaaagaaaaaa

SEQ ID NO: 3817 - DNA, 373 bp, Trichoderma harzianum
agacaagagtgaaccacgcatcatccacgctgagattgagatgaccaagggggaaaaaaggggggcaagttttctgtttacgccactgggacgaactccccttttttttgatgagaagaagaaacggatggttttagtgtcttacgcatatatatgaactgagcggcaatgcttaataccgtgtagctgctttgctttgctatttagagagtggcgaggggggagattgaggaggcctctggagaaagcaaagagccttaatgtctgtttttaccattggatggtttcttagttccaaggtggctcttaatttgtgcttagtgctttgttggaacaccgactgttgcttcagttaaagaaaaaaaaaaaaaaa

SEQ ID NO: 3818 - DNA, 319 bp, Trichoderma harzianum
ggcagagctacaacggccctagcacacaattggccacaattcacgcctcacaatcgccaagattgctctaattctcgggcagtcaagtcttgtcaagtcttgtcaagtctcgaactcgtatccttgagcatatgcaggtggcgtctgtgtctcgagacaagagagggtgaacatgtgcacagaacaaggcaccgaagccgaaagggacaaaccgaagccgaggtgggaaaaaggcgccacgaaccagtatccaagagtttagccactgtgtcctaatagaatccccccttcttttttttccttcaaaaaaaaaaaaaaa

SEQ ID NO: 3819 - DNA, 478 bp, Trichoderma harzianum
ggctggctggcctgagacgatctggcagaccaacaacgagacaagggctttgccggcggttagaccccagtgatgagattcgcaaacaggcgcgcccgctgggagacggcccccagctgattgattgatacctggtagtacatgggcagttggagtactcgtatggacaaagtaccgtaccggtactcggggcttgtaagacggctctctggaggggaatacgagctggcaaaacattaaaaggcaaggctcagggcgggctgtaagccgcagcgcagtggctctttttaagttgtcggggagatagatggccacagccgttctggggaccacgacggcaaaaggaattgagagaaaatagtctaaaagtatgtcctcttccgtcaagcacaaagtcgatggacgccgtcaccccaaagaatctgggtgttgctgcaacgggatcatccccaaggctggattcaaaaaaaaaaaaaaa

SEQ ID NO: 3820 - DNA, 349 bp, Trichoderma harzianum
gaggtgcttgttgtctgtttctgtctagaggtattggatgtaaataagatcagcacgagatgagatgagatgagcagacagacgatcagatggcgagattgagaggcaaattgcaagtgaatttaaattgcttcgctggcgcctaaattggaagcatccatggctcgccttttgcctccccacgtgtggaaagtagagccgagagcgatccctagcggctattctattctggcggtttggagtcaatctggccccccggagattgagatggtggctgtcgaggtgccggatgggatgggatgggcttgtctttggatacttcatcttttcatcaaaaaaaaaaaaaaaa

SEQ ID NO: 3821 - DNA, 379 bp, Trichoderma harzianum
cacgcggtggtgattggaggtgcggatttcacgctttctgatgatactggcagcaattacatttgcgcggctggcgttctttgcaaggatgcccggaatgcggttgtctttactgtgagctacaagagcgggaagggatatgcgtttaacgtcaagggcacgcaaaagtatctgtctattggcgggcgtggatcgtccagttatgtttccttgacgggggggctgggatactggcaggcttatagcgtgagttattgaatgtctgggaatatatagcatggctagtattttgagatggattcattgagtatgaaaggggttggggttagacaaagaaattaaaatagcattattcatttcagccaaaaaaaaaaaaaaa

SEQ ID NO: 3822 - DNA, 249 bp, Trichoderma harzianum
agtattccaaggatagaaggcttccatagggggctcggagcgtacgagccgtcgaatgttgggtcttttaggagaatgccgagagaggggggttgaggtaaggtgaggagctgacgcggatccgaagctgcggctggggatgtggagagccggaaaggcgggatatgcactcgcacggagaatatgatggatcccaaggggcggtgcccgtgtcgacgaggtttataggaaaaaaaaaaaaaaaaaaaa

SEQ ID NO: 3823 - DNA, 219 bp, Trichoderma harzianum
cggatggatacttgcagtaatatggggtaagtgagtgagtgagtgagtgatatggatacagcgggatgatgatgatggtggtggtggtggtgttgtcactgatgttgtcgagtgagttgtttgttttgtttacctttggaattgattgaaatgaaatgaaatgaaacagcccaatgcacagcctaagtccaaagaaaacaaaccaaaaaaaaaaaaaaa

SEQ ID NO: 3824 - DNA, 388 bp, Trichoderma harzianum
atcatatccgtaatgggggactcattcgatttccacggctaatgttttgcacggcgcataatggcaacggcggaaaaagggctgggttcgaaaaacagaaaaaaaggccgcaaactcctacttactctactcctactgcttgaccctgtattccaacccacttcatacatccatctacgcacttaagtaccttgggctatctgcatgtacgttctgtcctggacgacttcatctacgtttggttatgtttttggctgttcattagatttagctattttatacggcgttgtttacataccacaatacatatgtatagcctatcctgtataacaaggcaaaaaatgcaagagaatagacaaaaactacgcttctcaaaaaaaaaaaaaaa

SEQ ID NO: 3825 - DNA, 402 bp, Trichoderma harzianum
cgaagcatatcgggctgaaacccccacaacgggaagacgggacgatacgaggcaatgaggcaattcagcggccggtagctgtcgggatgttttttccccggggaatttcgcggtggctgacacttggcgtctcgggaaatgatttgacggatggatgcctaagaaatgatccgactgatcaggtacggcttatcggctgttaatgacgcagcataaacaagttgcatgtgtatcctaagagcatgctcgccagatgtagatggacagagggcacaaggattggaagaatacattgccaatagtggttcatatagggagtaactacatgtatcttacgcttgagcgcctgcttttaagtagctatgtagtacagatggaggaagcaccaaaaaaaaaaaaaaa

SEQ ID NO: 3826 - DNA, 309 bp, Trichoderma harzianum
caaaccggcaaagaaataccctgcagtcctcgagactcgcgatagagcagaagtacatcagtcttatttactagcgagcaagacagtcaaaatgtcgtgggcgggtacggagcttgcggatgccccgctgagagagagggagaggggctgacgggattctaggattcaagaagaatgtgaaccgcgcgacgacgcaggtgatgatgaagacgggtgagcagcgttggtattcattcggttgggatagcattctgatcttgtggttgcagggcatgtggaaaagacaaacgatcgaaaaaaaaaaaaaaa

SEQ ID NO: 3827 - DNA, 399 bp, Trichoderma harzianum
gcgagggagaaacgggtatgggctgggggggccgcactagattctttgacgtgtcttgtacggaattccagcgcggtggaagggtgtggctgctgcacgttttcgggggccaggttctttacactattcccacggacaaggttcccaagtgaggctgatggagggtccgcgggccttttggggggggagggtccaatcgagtgttgtttgtgtgttcaccaagttcaagtacatgggtatgcgtatatttcggccatgtatgcgcgatggattcctggtgttcggcagcgagcatgagaaaaaagggaaaatagactgcgagagagagagcgacaaaaagaaggaaatgctccgatcacgattaggggcggaattggaaatccgaaaaaaaaaaaaaaa

SEQ ID NO: 3828 - DNA, 488 bp, Trichoderma harzianum
aggcatataagtacttaggagcgagtgaaagttgtttcttacgcatttcacatggcaattcatttcatcctagtcagacactgaagtcgtttcttcatcttatcagaatcacaattgcgaaattgcagattgagagaatattcatgaatataaatatcacattatgaattccactacagacgattcgtaagaaggtcaaaactaatgaaaacgataactcacttcagcgactcttccgtattcgcgatttgataagggtacgtgttaattcctctatagactacctgatgctttttcgaaattggccaatgcaacaaattctagtacaacttcaatcaaggtgttaatatagactacgtaggttaaccctggctggagacatgaagcggcattcaactgttcgacttgatcaatgaacaactgcccatcttggaatcataagagcaatcaaagctccatcatcatcccaaaaaaaaaaaaaaaaaaaa

SEQ ID NO: 3829 - DNA, 496 bp, Trichoderma harzianum
agaagatgaagccggcgttactgcaacggcagtttggtaagatcaagtatgctaatacggtgtttagggtgtgatagtagaggcatccggcgaggcggctgagacatatgagggcgaaacaggagtagaggagacagtggcagcagcagcagcgttaatggcaataacaatagatggcagagaacggccgggccctcggattccctcttgagagcgaaggcgaaggtgaaggttcagctgatggataaaaccgggagacagccgagcgacgcagaggatgtcaggcgtaggttgcgtgagggtggctgcagaggccgagagcaggttcaatcaatgggcgagagacggctaatcgagcagagcgtgacgaggagcgcggcaatggcgagtgcgtgaaggggtgttgattcaagactgcgcgcgtgagggtgtgggagagatgaggcagaggccagaggcagctcaaaagggttcaaagttgaaaaaaaaaaaaaaa

SEQ ID NO: 3830 - DNA, 262 bp, Trichoderma harzianum
gatttcttggcaagggtacaacacccaaaacacgcggcgatctgaggccatcgtccgcgccaaagatccctgcctccagaaactctttccaccccctgttgtctttgtcgcctggttacggatacagtatttgctcctccgagtcagtttcgcgggaccctaaatgctgatgggctccgtatcagcgcgactccctcatcgtatcgtagctagtattcgtgttgtccttagccgttccccttaaaaaaaaaaaaaaaaaaaa

SEQ ID NO: 3831 - DNA, 465 bp, Trichoderma harzianum
gcgaaagggcgagattttgggtgtgaggcggcagacggtgattggggcgatttgggcagctctgccaagggttgggttcatgaagatacagtacgtgttagtgatgtgaagctgctccatgatgggactcggaatggcggacggatgcggtcatgggcttttggagattggcttttcttggtgggccgagacggcatctaactggagatttgatgaaggggaattcgagctatcaatacggatatgcaggactggatgattctgatttgatggcccgaggtgaaacttgtctggaaacttgattcgggggcagcgagaaagattgcccaacgaccgggtgtcttttctttcttcctctctttgtctaagatgtacgagtacgtcggcggcagggcgagcacagttagccagaagcaaggggatggactttttgacacagacatacggagtaaaaaaaaaaaaaaa

SEQ ID NO: 3832 - DNA, 346 bp, Trichoderma harzianum
ggctgacagatgctctatgacggagaggcgaagctgggtcgaagcagacgggcaaagcgatttgaaatggtgaacaggggagaatttgctcgctggccaagggggaagaaatgatgagagaaagatgagaagaagaagaagaagagggaagagaattgctccagcgggatgggcagaaggtggtgtagggacttattagtgactgaatggatggttccggcgcggtaaatccaagtgggtggaagtgacgtgcggctgctgcgcctgcaagaggctagcagacagcagctaaacaggacctggtagtgggttcagtatgtaatgcgaaaaaaaaaaaaaaaaaaaa

SEQ ID NO: 3833 - DNA, 420 bp, Trichoderma harzianum
ggcggatagttgtgctatcgttgtcttcatgttttcatgtttgcacatagatacgagaagagttgtgggagttggttgcgtcatgacataagttgtaattatagtatttgctgattatagctgattacgcagggtgtgtttcctagttgtgtggatggatgtgtgttgatctggccccctgcatatttcggagtaaatcatcctcccgatggctatagtcgagaggttaatgggctctactcgagttctgtcgtgtaacagcatccataaagacagtcataaagaagttcttgagtcatttctgattctccctgtcaacatcatgattcatccaactgaggaaccataatgagcttgtataaacactcactaacctcattctagagcatccttaagagggtctctaaaaaaaaaaaaaaa

SEQ ID NO: 3834 - DNA, 203 bp, Trichoderma harzianum
tgtgaattcgcgagcgaatgaaactcgtcgcatgctttggatcctgcttccgacaagctcccacgacttggcttggataaacctctaacctccattttggaatcgagtgtcctccatggctcgagaataagtcacatattcaatcaacagtatacatagttgtaatcgatacaccaatttctactggaaaaaaaaaaaaaaaa

SEQ ID NO: 3835 - DNA, 321 bp, Trichoderma harzianum
acgagaaaaaggaacaagccgcgggttctcaaagtcttccggtgccgccggccgtttggctgcggaccgaaaggtggacaggaatcaactcgtgatgagatccgggaaatggcggcctccgccgggatttggattccattctttcgttttttgttggtttctaacgttgatgaccattcagtggcggcggctatgaaggatatgatgagaggtggtgcttatgccggtgtgtatcaagtaacgagtccgcctggtccaggcatcatcatacgatccatcaatcataatcaaggggaacacagaggcaaaaaaaaaaaaaaa

SEQ ID NO: 3836 - DNA, 431 bp, Trichoderma harzianum
cgaccattaccatcatacagccaacctctacataagcacaaataccattcaaaatgtcttacggcggtgacaacaacgacaactctcgccgtaatgacgacaactttggctccggaggagattctttcggctctggtggaaaccagcaatatggctccggaggagactcatttggctctgggggagattcatacggctctggtggaaatcaattcggctccggcaaccgccgtaacgatgacagctcatttggtaccagtggccagggcgagttcggctctggaggtaactatggcagctctggcggtgactcctatgggtctggaggaaacacctatggctccggcggcaatgacaactttggctctgggggcaatgatacgtacggctcgtcccgtaaccaagagtcttcttttggatccagcggccgc

SEQ ID NO: 3837 - DNA, 340 bp, Trichoderma harzianum
gcaaacatattgtgagtggatcgagggcaacgagctcacgacatacacatattgcgtaatgacaagtcaaactgcaaataaggaagttctgctctttgagcgttataaggatcttccttccgtcaagacccatggccaaacaaatgagttcaagtctatgttcaaacgaatttcgccttggattgaaacaaagcgtaccgaaataactccatggagcgaattagacggttctttcttctcttccctagacttagaagccacagcgaagctctaaagatagctctatattccttataattttgtattttttcttctattctaaaaaaaaaaaaaaaaaaaa

SEQ ID NO: 3838 - DNA, 475 bp, Trichoderma harzianum
acggtgtccatggcgggcggatgggcgggacgagagggggaagctcggcgccaccatgcctttacaaaaagtatcattgatgaatagagtcgtaaatccgattcacggctgcggaggcagtgagcggaagatcgaccaacagattagcgatgagcgagagggtcaaggaaactgacagggtgattcagatgccccccggaagtggagaggaaacaagaagccaggggtgtttgtcgtacacatgttgccagcctgcatctggcatctgctgccagctattgacagctactttcattggccagatgctgcaaattggagctgcactgcacgggcacaagttcggatgggggatgacggaagcaaaacggctgcgtattacctgcgttggtagaatactaaggtattgatgtaatatttgggtaggtacggatacggtactttcatacaaagaatcacttagtcatggcaaagaaaa

SEQ ID NO: 3839 - DNA, 328 bp, Trichoderma harzianum
tgaagatttgctttgttttctaagttcatttggtgcaattgagtcttctaaagcgtgctggtgcaacattcaagctgacgttggataaaccttcaaccgtaactcttgtacctctcaagacatcagaatcagatgatggatggattgatgaactgacctgcatctgcccactcaacaatttaatccagtcgagcttctacaacgccaatctcaaagctcacaactctgtattcactcatcttgaccaattctctttcagtttgacctcaatcactctttccctcatgaagaccgacgacgcagtgtcacaaaccaaaaaaataaaaaa

SEQ ID NO: 3840 - DNA, 689 bp, Trichoderma harzianum
tggggtcgcaaatctacagcaaaaatggcctcgacaacgaccaagcagaccccggcgtcctttgtcgggaccagcaaggtcgtcgagactgactatccgctcatcgacaacgaccctcactttaagcgggttatcggatatgcgagaacgtcagactacgtagctggtgcaacctctgcggcctttgcaccgactgctctctatgccctcgagaggctcgccccgtcgcatgttggccggggaggctttgccaaagccatgcggttagccggattcattggcttggccggcggtttcctctacttttaccagcgatcagcccttcgattctacggcgccactgagaactcaagggaagtcgagatggatatgcgagagatggtttccaaggtcaaggcgggacagcctctgtatggcgagagcaagctgagccctcacctgcagggagttgcggcccgacagagcagatactctgcgctctttttcagcacagtaccgtggttcaactttgtcaaccacaaccagcacggcgtggacacggccaagtactatcagcaggccgagagggaactggaagcagagcgggcggcgggcaagagctagacgggaccaaatgtgtatatttagcgggactaccacttcttgcggagaaggaaaaaaatattggaagcttcaaaaaaaaaaaaaaa

SEQ ID NO: 3841 - DNA, 215 bp, Trichoderma harzianum
aagagggactgtactgtacagtaactgtaccttatgcaattgtgcaggattatgtctctgctgtaatgtatctgcggacgtatctgcggatgccggggatggactccggtgtacttggcacggctcgcttccgtttgacataaaaatgcagtgtaacaggtagatggacgtacatgtagatgtaaatgcggtactaaaaaaaaaaaaaaaaaaaa

SEQ ID NO: 3842 - DNA, 398 bp, Trichoderma harzianum
cgacttgcgggctgggggatcaaatcacgccctgaccttgtgagcgggcgacttttcagcttgttcccccccaagggagtcggcgcttgctgcatggcaagtcatgtcttacgtctcgccattgcagccgccggccctgatgaaaccagggaatcgccagccagcctagcttcagatggggtttgaagttcagtcaactgaactacgtgggcggttaaaagggcctcggggattgctcgcagcaaggccagagagcgatgagatgggatggagagagagagagagggctgccgactaccggtgcactgcatgttatctgccgtaacatatacatgtacctacttagttaagatgtatcacgcacgcgaccatagtggctttcgaaaaaaaaaaaaaaa

SEQ ID NO: 3843 - DNA, 942 bp, Trichoderma harzianum
gccgagcctcgcgcagaacccaaaccaaacccgcacagcaacaacacacactccacctcgagcttctggtcttttaatcataatcgttacactccaaggctgcatttctttgctgaatactctattcaaccagactcaactcaactcgactcaccaggcttccatctcctcgctactcaaaaaggctcagccttaccacttcctcctcctccaacctcatggcataaacgacacacctctctctctccgattggtgatggcaaaggcgacaacgccgcctccgagctacgaggccgtgtccgccgctcctcctcaccctcctcatccttcacatcctcctcaccctcctccgcctcccatctccgtcgcgacgccgggcctgtctaagcgccgtcccgcctcgtctccctcgtccccgacttcgtccagatcatcgtcgtccaacccctggtcatcgcccaccaagtcttggtcatcgtcgtcatgtccgcctccgcccgcgcctgtcctgcgacgtaacgtctcgtcttctagcctctcgtccggacggccttcggaactgacgcctctgaccaccaatggtcccctaacctcgacctcatcctcctctactgctcgcatgcgctccgcctccctctccgtcgccagaaccgaaaagcctcccgtaccgtccatgctgcagccccgcgtcgccgtcgtgctcaacgtgcctcagccatggcatccctggctcttcgccttgcgcctttgctcgatcctgccggctctgtggtgggggctaccctcgctactacgcttgctacttcacttcttgccaggcccacctgatcagtttatgctcgtcaaacaaattgccatctcgggcagcaatatggatgctctccagacatctctcttgtcctcgtgctcgcccgaggaaggtaaagcagccgcggcggccgc

SEQ ID NO: 3844 - DNA, 156 bp, Trichoderma harzianum
gatgaggagggggggtgtttgtgttgcgataggtaacttagtacgagtagattcaagatggagggggggaatgaatcttgcttgcttgactgcagtctgtagtgtaatcaggcaaataaggcaaatgaatacctgcaaaaaaaaaaaaaaaaaaaa

SEQ ID NO: 3845 - DNA, 198 bp, Trichoderma harzianum
aaacaagttatcgtggccatgggtttacacgaacgacgcttgcgattcaactggtgcccattaggaaagagaaaggaaatcagttgaaaatgctggcatgagaacactttacagcgaacgattgtaaatatcaaagtgacaaaatcaagtatcatggagccaggaagcggcaaatgtcaaaaaaaaaaaaaaaaaaaa

SEQ ID NO: 3846 - DNA, 398 bp, Trichoderma harzianum
caccatctcgctccggacacgggagagactgcgctgtccatctgatggcctagattggcagacgccggggcaattggcacgtacgctgccaccgactttgcatccccggggtcctgtcctgtctctccaaatccaaagacctcttctccatcgcacacgaagcatcgagccagagcatccagccccgcccagatcccagcccgagtacgttgcgtgaatgagcggccaagacgggacaaatctcgaggttacgctgcatctgttctaacctgccacgctgctacagtacaaggacaccctcaatcacatacggatcggccctgcgaatcagccctgcgactaataatagccctgtgaatcggcccctgctgaaccgccatccgaaaaaaaaaaaaaaa

SEQ ID NO: 3847 - DNA, 297 bp, Trichoderma harzianum
gtttgttagcctttgtgatgcaatagcatgttgtaagattgtttgtgtaagtgaagtctatagcaatgcctggaatgtgatggaacataggaatacaggatggatgacagagttggtgatggatatgtacacttaccctcgctgatacggcacgtcgtcaacggtctggtattcttgtggctggacgatagacattgttgcggttttcgaacggtttgttatgtgcttcaatggtttcttggctttgtaagttgtcacacgatccaaataacccaaaatcaccaaaaaaaaaaaaaa

SEQ ID NO: 3848 - DNA, 1101 bp, Trichoderma harzianum
cccacgcgtccggctcatcctattttgccttccctcctcccaactccttccgaaatctcggcatcgtgaactccgggctccaatggctaccagaacgggttcgaccggcgtggccacctatgccgactgcgtcgattcgctgcgcaactctctcaaattcctcgaggcctccgtggagaccattgaccgtggcgtatctgacttccctcgcctcgtgaacgtcctcaagacagtccgacactacgaactcattccccagcccacactcgctgctgctgaggcttccctgcgcgacgaaattgggccctacatcgcttttctcctcagccgcgctgatgctcaagttgaacgccaggaacgccgcattgagacgctcaaagcccgggctgagttacaacagggacggttaactaggcctgatgaaccggcacgcagcgtatcaaggcctgcttctgcaaggagccggcagctccgaggcgaggacaagctgagagctcggattgtgcgccagcgtaaggaagctctacgttatggcattgagaggttggagctagaagtgctccagaaagaaagagaattaagaaagcgactggagaaccgatagtgaggcgcaggagtaggcagctctgcgtaccgtcacgatagctcaaagttgatctactcgtgtagggcggttacaaggcagcctgtctcttggataggtgcacgactagagacacccagaggcagcgtccctgtgcccttgcctctcaccctgctcaaacaccacaacaacgccggcaggatcggctttcacgatgcctttgtctccgcgaaatcttgcccgcataccggtctgacgagcagcgtccgccctccgattgcgcttgggcaaacctgcctcttgcgcgcacgcgttgagcgccatgtctcgccctatcagctttgagcatttacctccccgccagagtttgaggcctgtctccctggtttggtctggacccgcgttctgagcttcgtatctcagtagcatgttgttatgggctatcatgttactactattagctttacgagcacgacttttgatgaacatatttaatcaccacgaaaaaaaaaaaaaaa

SEQ ID NO: 3849 - DNA, 906 bp, Trichoderma harzianum
atgctccaccattgcttgccttatcgcattcaaggccaggtaacgacacttgctgctgagtcgaacgcaacaccgccttcaacagctcctctgcaagtctcccgcaaaaggacaggctcagtcttgtgtgggcagcatgcgcgtcattgcccttttctcggccctgtgtgccgcagctctggtccaggccgatttccacacggcgcaaatctatgtgcagcccgtcgaaaactccgagtcgcccagcctcctcgccgaagtggcatacgatcctagcatcagcgggtcgtcctctatcatctcctacgaagctcctgaaatcccggagtctacacagctggtccgcgtcgggttgtacgacgtcaagtctgcgcgatggatatctggcacaactgttgcctcggtggacaactttggcaagggctactcgcccaatttgatactctcagtcgatgaaaagggagagcttctcagtgctgctctcaagggcgtaaggatcgatgcgggtcagacgagagacttggcccgcaagcggtggtgctgccggtgctcaagggcaagcagccagagctgaacaagccaattgttctatcgccagaggggaagaaggttgaggaggttgagaagacgccccttcagaaatactggtgggtgattgccattatagtgttcctggcagtgagcggaggaggcggcgagaaatagagccggcaattgacacatactgtacatcaatctgaatatacgcttccgtgatgggatgaccgctggcaagggttgagctgttacagctgtcagtgatccctgtcctctcaccactgtctaggtacatgactatattgtttgtctttgatacataataccctataataagactattgcctgttcaaaaaaaaaaaaaaaaaa

SEQ ID NO: 3850 - DNA, 649 bp, Trichoderma harzianum
cattggcctcgacgacggaactgaacagcgacgcttctcgctgcgaggcgccttatcttttggcgcgagactgagattggagtccgattctggccggtgccccgcgagaggcgcatccaatttccagccggaggagcgcgttgacatttgctcgatccttatcttctttttgctgcttgggcggcagtcaatcacatcgacacggcaccaagtttccctgctggccgttgtgtttgatccggtctttgctcgattggcatgactctggacggcgtatcgacaatctaaaccaattcgatttccccctccgacacccaaaaaaaagcacccctgattacgaagtccctgctatcacagatctggcctctatactgccactgccacatctccacaccacattcgatacgaagcctctgtcatcgtcagccacggcctgacctgattcctttttgcccgaccgatttacacgtcgatatttggcttgctgttgctgttcctgccgcataggcaggctggttgctcgtcgccatggacttgttcaggcgatcaaaatcgggtgcgggacgccattcagaacttccgacgtcggatgagaagcgttcaagaaacaaggggctgtcgtccagtttggccttcttccagcggccgc

SEQ ID NO: 3851 - DNA, 693 bp, Trichoderma harzianum
gcattttggggtcgcaaatctacagcaaaaatggcctcgacaacgaccaagcagaccccggcgtcctttgtcgggaccagcaaggtcgtcgagactgactatccgctcatcgacaacgaccctcactttaagcgggttatcggatatgcgagaacgtcagactacgtagctggtgcaacctctgcggcctttgcaccgactgctctctatgccctcgagaggctcgccccgtcgcatgttggccggggaggctttgccaaagccatgcggttagccggattcattggcttggccggcggtttcctctacttttaccagcgatcagcccttcgattctacggcgccactgagaactcaagggaagtcgagatggatatgcgagagatggtttccaaggtcaaggcgggacagcctctgtatggcgagagcaagctgagccctcacctgcagggagttgcggcccgacagagcagatactctgcgctctttttcagcacagtaccgtggttcaactttgtcaaccacaaccagcacggcgtggacacggccaagtactatcagcaggccgagagggaactggaagcagagcgggcggcgggcaagagctagacgggaccaaatgtgtatatttagcgggactaccgcttcttgcggagaaggaaaaaaatattggaagctaaaaaaaaaaaaaaa

SEQ ID NO: 3852 - DNA, 1055 bp, Trichoderma harzianum
catatttgaacaatgagcgatgagacagggcaccgaataggcacaacacgtgcgtcagcacactctgcgaacatcagtggatctagttttggggacaacacccgaatacaacaagcatttctaaacatcttcttcagaaaccggagaaatccaacggtgtcccccgaaaacaccccgtcccctgcagtgcaagctcaattacaagagaaagagagaacagactgtcgacgctctctcagcttccgcgatcttgacgcccgcctgcagaatatctcaccagtacaacaaggcacttgcgaatggatttttcaaatgccggtgtttcagaactggtatgagcatactgaatgtgataatggattgctttgggtcaaaggaagccctggtactgggaagtcgacattgatgaagcatgttttacaatactgcgaaaccaaaggaaaatatgctatcgcggcatacttctttaacgctcgaggggccgaacttgagcaaacacctctgggtatgctgcgctccttactatttcaactactccggcatgaacctcgtttatatgaccagcttcttccaatttatcgccaaaagcagcaagatcacagctcgggggactgggagtggcgtgaacaagagcttaaaagctttttgctgtcagagataccaaaatgccagtcaggaccgctccttttaataatagacgcgttagacgagtgcagtaaagacgatatgcagaacgtcgcggaattcctccagcatttgagtaagaatgcgacagatgctggtcttacgctcaatatatgtctctcaagccgtcacttcccatccatccacttcgcagagtatcaagaactggttttagaaaaggaagaaaagcacgatgaagatattatcaaatatatctcttctaacttaacgaaaaaggataaagagattgaagaagcaatcagaaagaaatcgtctggtatttttatgtgggttgtgctcgtcatctcgatgttgaatagagcatatgaagatggcaaaatcgaggttatgaaaccaaaaaaaaaaaaaaa

SEQ ID NO: 3853 - DNA, 451 bp, Trichoderma harzianum
atcttctacacgattgcggacaaagtctatcgcggtttctactgctgttcaatcattcttcaacattattagcacaatcgccatgccgtatatgctaaatagcgaccaggccaactggggaggtaaggcgggctttttgttcggagggttcagtttcttctgcaccatctggtgtcatttcaggctacctgaaagccagggaaggacatttgaggagcttgatattctgttccagagaagagtgccactgaggcagttcaagacgtatgacctcttgcaagaggttgaaggagaaaagactacgacggcataatacctaataaaggaaagaaattaatgcttctaccactcgttcgccgcgaagtcggttccatagtatgtgaataattatttaatagggttacacctttaataaaaaataattctcgtttgctggaaaaaaaaaaaaaaa

SEQ ID NO: 3854 - DNA, 414 bp, Trichoderma harzianum
tttttttttttttttttttttttttttttgggttttttttttttttttttttttttttttttttttttttttttaaatatgtgaatatgatcatgtatttaaataataacatggaaaataagagcagcaataaatgaacctcctacgtacatcctctccaatgcatcttacccaaccgattcactgcaaacatgggggtctcaatcaaatgcacacccacggaatcgggcgtccgttaacccattttggcacaaactgcatgggatatcatcttatggagaatccttcggaagcatctagagcattcagggttctttgccggcagtgacatgcttacaaatttgtcattttcgggatgcatatccgtcacttatcaatgtaaacccggactagttctagatcgcgagcggccgc

SEQ ID NO: 3855 - DNA, 654 bp, Trichoderma harzianum
ctcactacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacctggtccgttggcagcgccatctccaacccaacaacccttgctcaaggcggttcctatggcgagaccttctcacgagaccccgtaaccggcggtcgtgccatcaaggtcaccgtccagcccgatggcctctacactggcaagccccagaccaacttcgccatcaaccttgagggcaacaccatctggtacgatctttcagatgtctttggcgatgccttcaacggccacaaggtcgttgtttccagcgccaacactgcttgcccccagattgtttggggcagcggaatccctcctgccggaagccaggtcaagaactgcggtgcggataaggatgtgactttgactctgtgtgcttagagttaagggaggacggaatcatgtcaagggaaaggtttaaatcaagtttatgatagaatttcaagtcctagctatgtttaagacttatgacagtatgaattgatgagtttacttcgaaaaaaaaaaaaaaa

SEQ ID NO: 3856 - DNA, 297 bp, Trichoderma harzianum
tgatgatgaatagaatgatggaccaagggaatggttggtaagatgttctgggaggaatctgtgtttttctcagggtgagagtgtataaatgtgtagcgtgtacatgtgttgaggctcgtcgatacccggcaacatgatgactgtgcgccaccggccattgatttgtgctgatctctgcttgatgaacactgccctgtttacactgtcgtgtactgttagtatgtccatcgtgaaatggtggtgtgcgatgtttgtcgcgggctatgaagataaagcaatgagaaaaaaaaaaaaaaa

SEQ ID NO: 3857 - DNA, 654 bp, Trichoderma harzianum
cctggatggggtccggactggtctcactggattttcttcttcttctttggctgtcctccggttctttcgggctcgggctctggcggtcttcgcggcaaagggagataagagcccacgtgcgaatttacgaaagccctagcgctgatcgggtttaaagcaagtgacgtgatgaatccgagttcatttgcataaaaaaaaaacataaaaataatagagccagagatttgccgaccagggcagggggcgcaaccatcttcatcgtccatcttcgagtgtgtgccacccggagcagcaaagacggtgcctcggccaagagtcaaatgtcaaaagatggagatgcaatatcacggaagccgagctccacttgatgctcgggcggcaagtattacacaatggcaagagatccggggtaaacaccgcagtcccggccgatcctcgaggcctattggatgagcgttccggcacccaaagggatttttcggaaccgatggtcggggattcccacccccagcttgctttctcccatgtgtctgtgggccagaaccagaatgcggggagtagatacatagatctagaattgccttgagatctcctgatatttgaagaataggaaattttttaacctttaaaaaaaaaaaaaaaaaaaaaaaaaaa

SEQ ID NO: 3858 - DNA, 1186 bp, Trichoderma harzianum
tcaattgcagtttagagacatcttagaaatcagaatgtttgccagatcagttttccgtgcggcccagccgctgaagatgcatgcgcgccgctatgccaccgagtctggtgccaagggcagctcaaacactctcctgtatggcgctggcgctgttggtgtagctggtgccgccgcctacttcctcagcggctccaaggctgagagcaaggtcaaggaggtcgttggcgctgctcccaaggcggcgtttaccggtggtgaccagggctggctgtccttgaaggtctcagaggtcgaggatgtgaaccacaacaccaagagagttcgattcgagctgccggagaaggaccaagtttctggcctgcacattgccagcgctgtcctcaccaagttcaaggcccccgatgccgagaaggcaactctccgtccttatactcccgtcagtgatgaggatgaccgaggcttcatcgatctattggtcaagaagtaccccgatggacctatgagcacccacatccacggcctcaaggttggcgaggagcttgccatcaagggccctctccccaagtacccctggtctgagaacaagcacgaccacattgccctcatcgctggtggcactggtatcacccccatgtaccagcttgtgcgagccattttcaagaaccccaacgacaagaccaaggtcaccctcatctttggcaacgtcaccaaggaggacattctgctgaagagcaagtttgacgagctcgagaacacttacccgcagcgcttccgcgcattctacaccttggacaaggcccccaaggactgggtcggcggcggcggcttcatcaccaaggacctgctgaagcaggttctccccgagcccaagagcgacaacatcaaggtctttgtttgtggccctcctggattgatgaaggccatttccggcaacaaggttagccccaaggaccagggcgagcttaccggtgctctgaaggaccttggctacaccgctgagcaggtgtacaagttctagacggcatgttgatgtgatagagatggagcctaggaagagacatacacaggcatcatttgatcgataaaaaaaaccaaagacatagaccaatttgccactggtagagaatagaatctaggcggctaacaaatgaacatgagctaccacaaatgtaaaaaaaaaaaaaaa

SEQ ID NO: 3859 - DNA, 421 bp, Trichoderma harzianum
agagattggagtttgataatttttacaaacttgtacataatactgatgcattcagcccttggtcctgatggcatgagcagacatagcctcggccgacgattttgcccctgcaatggttctctgccgatgtttcccgcagcttcttggcagttggggtaatacgataatacgacgatggcatctttggcctgcacgccgaattggggtcaaatagacggtattccgaacatttcatatttaagaagctgtgctgcacgccaaccaacctttggaatggtgtgaattgtgaaggacatgatgcatggtataggccatgagctagtctcagagagatggagcctccggtgtaaaagttgtacattaatacgatcaaagcccgctacgaaaaaagaatggcaattgtattaaaaaaaaaaaaaaa

SEQ ID NO: 3860 - DNA, 558 bp, Trichoderma harzianum
caacctcataacaaccacaatggctgcacaagaaggacgagctccatatccgccattcacacttgagacagctcaagtcaaagtcaaggccgctcaagatgcttggaacaccagaaacccagatggtgtcaaaatggcatacaccccagactcaatctggcgcaatcgcggcacatttctacaaggccgcgacgagatcaaggcgttcttaaccgacaaatggagcaaagaagacggctaccgacttcgcaaggagctttttgcttttacagacaacaagattgccgtgcagttctggtacgagtggcatgatgaggcaggccagtggtggcgcacgtacgggcttgaggactggacttttgccgagaatgggctgatgaggaaacgtcagatgagtggaaatgacgtgaagattagcgatgcggagagatggttcaaggatggcgttgatgtgaacaccgtcgacatttccgagaagcactggtgagggaggctatttactaaactttaatgaagtcttttgaatatatagataagcaaaaaaaaaaaaaaaaaaaa

SEQ ID NO: 3861 - DNA, 435 bp, Trichoderma harzianum
agcgatggaggacgagattcgaggtccttgcttggcccgggtggcgtggcgtgggtgtgcccggggctgcggtcctgggagccgggccttgctgctgaagaatttcagaagtttggaaacaaggcacgttgggatttgtgcatgtatgtaggtactaatgtatgtatgtatgtacatccaagtacatgtatacctatgcgaggtcggaccagccaccatgtacctacaaaggaatcagtgcaagcgtgcattcaacatgacatgtcaggtagcggacttgacatgtttgctggtcccttgcgcgagacgagattgggatggacaaggtcgaggtggcttaccacgtgagtttagtgcacagggccgcctgcaataatgggatcaatctgattatggcctcaattccaatgattacagttgaaaaaaaaaaaaaaa

SEQ ID NO: 3862 - DNA, 773 bp, Trichoderma harzianum
cgagagacttgcgcttcggcccggcatttgcacattttgagaaccgaaacgaagaagaaaaaggataaaaaaaacatggcttctaatcagtttgattcccaggcctcgaccaactacaaggaggcttttgccctgttcgacaagcgcggcaacggtcgctgtgccgtcgactcgctgggcgacctgctgcgagcatgcggccagaaccccacgctggctgagatccaggaactggagaagggccttggaggcgaatttgatttcgaggccttccagcgcatcctgaaccgacccggcggattccgcgaccctggcgagcccgaagaatactgccgtggcttccaagtgtttgataaagacatgacgggctttatcggcgtcggccagctcaagtacatcttgaccaacctgggcgagaagatgacggaggaggaggtcgacgagctgctcaaggccgtggacaccagctctggccagatcaactacacagatcttgtccgaactatcctcgccaactaagattccccttgtacgaagaacctaacccccggtggtatctaagtgcatctgcgaacgggatggcgttgctatgtgtttgttttgattatggcagtgaaattgggcacgcttgggattgatgaatttttcttttgtacgggatggccgtagactttgtttgctaccagtggaatatgaacatgtgttggtacttggagtgcacaatgaaatgagtcggccaagcactaaaaaaaaaaaaaaaaaaaaaaaaaaaa

SEQ ID NO: 3863 - DNA, 914 bp, Trichoderma harzianum
cattgtggccatgaccgtcctcaacaccgcacaagccctctgggcccgcctcgtagcaacccacgatccccataccatagacttcgtcggcaccctcatcatccaattcatcttctggtggatcccctgcatcctctttgtctctctcgactctatcgcgccctccttctccgcgaaacacaagatccagcccgcccccaaacaaccctccgccaacgacatcctccactccgtcctcgtctgcatccgcaaccaagtcatcgtcttcgccctccacgccgtcctcctctatgcctcctctgccaagggccagtcccccagcatcagagtcgacgcgagcttccccacggtccaggagttcacctaccacctcgccgtcagcgtgctcgcccgcgaagtcctcttctacacctcccaccgcatcttccactggcggcccttgtacaggcgcttccacaagacgcaccacaagttcaccgcccccgtggccttctcctcgcagtacgcccatcccgtggagcatctcatggcaaacgtcctgccaatcttgcttccgccgctgctgctggggtctcatatcctgaccatgtgggtttttgtggcctttcagctcatcgagacatcaacggtgcacagcggatacgacttctttgcgggagcagctagaaagcatgatagacaccacgaacgcttcgaggtctattatggcggaatcgggctcctagactacgtatttgggacggatgaaagagagggccctaggagagataaaaaagaatgagcatgaccatttcacactctcttcatgtcttcatgataagtcatttgacaaactgtttaagttttcttgtatatagctctcttcaaagttcaaacattaaagtcaagtgttgcttctcaaaaaaaaaaaaaaa

SEQ ID NO: 3864 - DNA, 799 bp, Trichoderma harzianum
aacaaccaccaccaccaccactcaacctacaaacaacgtcacaatggccgccaagctctccgccgatctcctcttccagatggccaaggtccgccgctccatctatcccttgaacaagactctccccatctcaacctctcgcatccacgagatcgtcaaggaggccaccctccacactccctcctcctttaacgtccagaccaaccgtgccgtcgtcctcttcggcgccgagcacgagaagctctgggacatcacctccgagaccctcaaggccattgtccccgaggaccagttcaagtccaccgccgacaagctcgccctcttcaagggcggcgccggcaccgtcctcttctacgaggacaccgacgccaccaaggccctccaggccaagttccccatctacgccgaccgcttccctccctgggccgttcagtccctcggcatggagcagctgctcatttggactgccctcgaggttgagggcctgggcgccaacctccagcactacaaccccctgattgacctcaaggttgctgagacctggggcgttcccgctcactggagactcgatgcccagcttgtctttggtggcaaggctggcgaggctggtcccaaggagttccaggacattgacgagcgtgtcaaggtccacggtgcttaagcggcatcatcttttcttgatttgaaattttgaatgggaatgcatcggccggagtttgtttttgaagcttctctttagacttgcagtcatagatagagatatacacttgtttgttttcgttcaaaaaaaaaaaaaaaa

SEQ ID NO: 3865 - DNA, 655 bp, Trichoderma harzianum
attctggtttgttgggggctaagcctttcaacgttatgcgtgttactcccggatattatcttgcaacatgggcttgtcatctcccgccagccattcgctgtgattcgtcccgggatgctccgcggacattgcttcctggcgtatttcagcatccggcattggtgaagttcccactatggagatagaatcatggattttgcccccgccccttttttttttcttcttttccacccttctttatgcttatctctcagcccctagcaaacggtggacggatattctcatctagattgctgacaacatgccgttagcccccatcaaccacgaacccgtcccgacccggggtccaatattcgttcagctcggctgttcacccgtatactcgtgcttgacttttatttttgtttttagttgggagattattttgtattttgcagaagcaatatttgccacctgggcaatattctctcgagtcagccattgtaggcagctgaaaaggctgatctgtcttggccttgctcgtttccccgcgctgcaatccatcatgtgagaagcaatggatggagacgagccatgcatcaagattcttgtctggagatctcctgtgcagatcacggattctcccaaagccaacttatcaaaaaaaaaaaaaaaa

SEQ ID NO: 3866 - DNA, 518 bp, Trichoderma harzianum
atacgacaaagtcaactacatgatgagctcccacaagaagaagaacgacaacaacaacagcagcaacatcccggaggcaccactgccgccaacattcaaggagcagctcgaccaggaggcgatcgacagccgggttcaccagcatgagagcgaagaacactcgacagtgaaggatattgtcgataagatatcgcatgccattcctgctgtcgcccctctcatcggcggatcaaatccagacaacaaggtggaggagcataaagaggtgcctccggggcctcctaatcgaccagagcatgatacccagattgaagagtttgtgagggagcagcatcgaagcaacggcatcgagaatctgagcgagggaaagtcgtgatggattcatccacgctctcggttcagcagagtttcttcatgtaccaatagccatcaagcttttactttttcttgctttaatacagtgaaacctgcggctactatgcaggctctttacagataatccaaaaaaaaaaaaaaaa

SEQ ID NO: 3867 - DNA, 258 bp, Trichoderma harzianum
cattctaaaacagtcagcagggctcgaggccttgtgcggcagatatgggggccagcgactccaagataggatttaagcagggcatcttcagattatcagaggagcgcaacattgcggcgcatgatccttactggacttcggttcgtcatgcctttgatcccagatggccgcggggatgctgatgctgatggggtcatagttttgggagcttcctgaatcgtcggaagatgtttttagtcttttaaaaaaaaaaaaaaa

SEQ ID NO: 3868 - DNA, 531 bp, Trichoderma harzianum
cccacgcgtccgtcttctccaactaaacaatagctcttttctacttctaattttttttttatctcaactcaccatctgagctatcaagctagaaagtaaccacagcaaataatcatcatggagctcgtcaactacaaccacaagacctgccccaagtgctctgccaccatcacctccgagtccaagacttgctcgagctgcggcgctacttgccccgtctaagctacctcagctcgacccgccatcaacctcaaccatcgcaacaacatgacgagaatatcctgaggtgtggcgggactgcaaggacgcgcggatgagtgaatgaatagatgaatgaaggaatgatatacctcagcaggacatggtgcattaagacaaggcgttgatggaagaagagaagcgatcatgtatgtctaatattctaagctatatgccagtccttgttacagacaggcggctagaatagttcctcgcaatggaaggaatctagaatggcaatgggcaatgggcaatggcaaaaaaaaaaaaaaa

SEQ ID NO: 3869 - DNA, 514 bp, Trichoderma harzianum
ggatttgcgaaagggcgagattttgggtgtgaggcggcagacggtgattggggcgatttgggcagctctgccaagggttgggttcatgaagatacagtacgtgttagtgatgtgaagctgctccatgatgggactcggaatggcggacggatgcggtcatgggcttttggagattggcttttcttggtgggccgagacggcatctaactggagatttgatgaaggggaattcgagctatcaatacggatatgcaggactggatgattctgatttgatggcccgaggtgaaacttgtctggaaacttgattcgggggcagcgagaaagattgcccaacgaccgggtgtcttttctttcttcctctctttgtctaagatgtacgagtacgtcggcggcagggcgagcacagttagccagaagcaaggggatggactttttgacacagacatacggagtacagaagaagaagatgcagggagcgtcatcctcccgcaagatgtcaaaaaaaaaaaaa

SEQ ID NO: 3870 - DNA, 525 bp, Trichoderma harzianum
gtcgagttttctcgctggaaggtagttagcggggactgccgaagatgcatgaccccgggaggcttgcaagcaggcggagagcatacataataaagcttgacgaagctatcgcggtccgcctggaggtccccatagtacttgctcgcaaactgggcttttgtatcgacagtcaatatggcttaaagcagatgcgcggtaagagaggcacccttatgggcgagacgctgggagaggcactcggagacatacaggcaagctcgtcgggcggtaagccttttgcgcacattagtatattagcgcaagcaagcagggtagacgcaatggcaatcactcactatccatattgacttcctgaaagtttgagcacggagcttgcttgacaccaaaaggcgagggtttttaggggtgaactcttgaggtgagacagtgagtgagttgtgaaaaatagtatgctaaagggaagtgagactattatatagtagaataggaagtttcctagtgttacgacctaaaaaaaaaaaaaaa

SEQ ID NO: 3871 - DNA, 500 bp, Trichoderma harzianum
cccacgcgtccgcccacgcgtccgcgcaatcgaaaaaggattaatcgcaactccgagatcctgctgaatcacaatgagacctactcaggttcgtctgggcggcggcgcccctcaacccaagactggccactggctcggtgactggggctcctttggtggtgccaagcagaagggcattatcgactacggcctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatgttgaattatgggtgtccaggggacacagtgtatatcagcgtctagattaggagaaaacaatagaaacgtttgactctacgaaaaaaaaaaaaaaa

SEQ ID NO: 3872 - DNA, 470 bp, Trichoderma harzianum
gtggtgtcgatccaaggggacgcgtggcaaccgctgcacagcccgcgtgtggtgactagaggcggctaacaggtggtaagtaatcggatctgctgtttctcttgtgcagtctcacacatgtcgcaggggtgggttttgaatggagacgaagcttgttgcgatgaatcaagtcatgctagctgcatgcctgaccgagatgaggaggagagatggagagatggagaagagaacggagcagtgggagaaagaaaagaggaagagaaagaggctaggaagcattgccacattaagtacaacaggggggttgattcagatcgaggagagcagaaggggagaagtggatagaatagggctttgtgtctgtgctgtggaggaggcatgtggccgtgctgatgaaagaattggaacatgaagcttacctctatattaggaccaaagtacggagtagaccctaccaaaaaaaaaaaaaa

SEQ ID NO: 3873 - DNA, 496 bp, Trichoderma harzianum
cccacgcgtccgcccacgcgtccgcgatgataaagttgtggggtaatttagatagagatgattcggctgcaacgctgaaaagtgttgatcaaactggtaggattcagttcattattgttccttcgcccttcgtggatcgacgcttcgcttaacagtggcagtgctcgcggatgatgatccgtctgacgcgatctggaggcggacccagaatgtggatgagggaatctccacaaggcgtaactccttggtttactcttgttcgcacacagatgtatcttgagagttgttaaggctataacgagtgcggttgagatacgtctacgactaagcatcttgagcagagtgttagttgcgaaacgttcaattgactaagtaagagtagagagtatcaagcctgcaaatccatccccccgaatctccgattttatgagccaccatagctcttttcgccaaatgcaaatgccgtagatagtgcccatccgaaaaaaaaaaaaaa

SEQ ID NO: 3874 - DNA, 386 bp, Trichoderma harzianum
gaacaagccacatcggggagacgggaagatggtgacacggatgcgtttgtggaggtgggtaagctttgcgcaacatgtgccagccttatcttgatattggacgcggcgacggcgaaatggttggaagggtgtgtctatgtgtaccgacaaacgcatggctgatgagacggtgaataaaactgcaccaagaaagagatgcatgagagatgaatgaccagtacctaaggtctatgacatgtcgctttgcactcggtcggactcattcacatgtagtaaatactacataacacccacttgctccagtaatcatcacttataataatacggcgagaagacaagttgacacagggcgaaacagggcggaacaaggcaaaaaaaaaaaaaaa

SEQ ID NO: 3875 - DNA, 529 bp, Trichoderma harzianum
cttcagagaatcatttctatagtattcgtctcttgctttggttcccaaaagagccatcgaatccaccctggttgatgattgtatatcctcgatatccaagagtgaatatttttggtcctctcgaaccatccggaaggatggcggtagaagcctcgtgcatctgctgtatagagagttgttttttctcttgatgatctcgaccccgtcaatggtctgccttcgggcgcattggcggggtggatgtcgatggacgtctgacaggctttttttttcattacatttctgaggcttgccttggatgtgaagaagagtggaattcacattccaattttttctttcttttctcctacgccgctgtgttggaaaatgttgcctcgtccacaaagagtttcgatacaggccttggcgatgcttcttcatccaatggcgtgtccctggccagcattccctcgcttttttgatccatagaacctatagaactaggtgaatcgcaagaagatcaagccgatgatccaaaaaaaaaaaaaaa

SEQ ID NO: 3876 - DNA, 422 bp, Trichoderma harzianum
cccacgcgtccgcacacacaactcaaccacactttcaactctcaactacaccacaacttacaatctcatctcgcgaccaaccaactttcacaatggagactgtcaagcaagccgtcaactacgtcgctgagtccgtccagggcgctgcctctggtatcagcaaggagaccaacaaggagattgccaaggacagcaacgtcgacgtttccactcgtttgtccgctggcaaggacgcccttggtgacaagatcgacgagactggccacaacaacaaggccgaggctcacaagcagctggctgagcacaactagattggcataaggagcttcgattgcttcacaggcgttgaaccggatcagagcgaagggaatatatagcctcactaggcaggaattgatgatttgaattcaaaaaaaaaaaaa

SEQ ID NO: 3877 - DNA, 559 bp, Trichoderma harzianum
aagcattcgcctctcgttcagatctcaagacaaaaagcactcaaaccaatcactcaacctcttcaagaccacctttcaaaacaaaccttcaacatgaagttcaccgccgttgcctttgccgccctcgctactctggctacagccagccctcaccctcctcctcctcacggttgcaagcctgctacctactcttgccttcccaacgacagcggttggcaagtgtgcagcactgccggtcagtgggtgtttgctggcacctgccctcccaagactgtctgcaagttcgacagccaaaatggcagcccctactgcgttccccccaacttcaccatcccataaatccattaaatggggatcaacggggctacttacaaaagcctaccggatgagcatgagatttagagtttttggttgctaagacgtttcgtggcctgtcattgtcttgcagatcaatcctggacataaagtttacacataacatatggtacactcctttgaatgcgatgtatctctatagctatatgaatacaataaattgaagtaaaaaaaaaaaaaaaaa

SEQ ID NO: 3878 - DNA, 285 bp, Trichoderma harzianum
cgcatgatattgaatggttggaaagtcagatggaggcgttcaaagcaatcacagcgaccctgccgcagctttcctttcatgagacgaagcggtcggaacatggctttgtcgtcgaacagcggcattccatgtctggctcggatggtgtgcggatcggcctgtccgctactcattcgggtttgatccaatttgagggccgcgatgcaaactaccagacgtttgtagaaaagttccgcgaaatgatacataaagccaggaaaaaaaaaaaaaaaaaaaaaaaaaaaa

SEQ ID NO: 3879 - DNA, 370 bp, Trichoderma harzianum
ccctttttctcgcaactcgctgcttggctccagtatctggcattagcacctgttgtgtgcgttggcctgccgtaggttgatgcatctgcagctgcagcgtttccgcatcacatcaccttcatcttacatgacaaaccccctctttttactcccttcgatacggttattggttcgaaggctttacaattcagacgtgcaggcactaagacatccatctcgactgttagaggttgtcttgctgcagacgttatcgtaccagcacggcttatatagcaccagacagacccctccgctgcagctggtttacttctttttattaatctcaactatcaccacggctacctattcttcacttcaaaaaaaaaaaaaa

SEQ ID NO: 3880 - DNA, 344 bp, Trichoderma harzianum
cgcactacgtggtctcttggggtgtagcaatcaatacttgtgtacacgtagatacagtagtctatgtccgtgtgcttctgggggtgggcattgattatctccgtgcggaggaatatgggggtgttcgtgtgtcttggtatcaatcaggctatgcgggaatacgatgtagttacgacgcctcctctactgtacattactgacatgccctgtaaagacaaggtgagcatacgagacaatgccgctgtctctttgggagggaattcgttagagtcagccaagagcgccatgttgaatgaaagaatcggacatggcttatcttagtcccccggaaaaaaaaaaaaaaa

SEQ ID NO: 3881 - DNA, 433 bp, Trichoderma harzianum
atcttgggatgttctgcagacgattgtcaaagccggattaaccccgcaggcattgatggctgtctctcatctccactttgcatcctgttgttggggtaaaagaataagctcaccgtcattgctcagcttctcgaaatcgtgaagaatgaatcgccgaaaattgattacatgtactcaccagggacatgtaggcagcttcatatttcactcctccgacgtctcggctagacttagccatgtcgatcaagcatgagcaaatcccacattgttagctgtcaatcattgtccagtgtcatctccccacgtggcaaagacggcgtcaatcaatttggacaatccctgtgatatcttagacgcatccttggcatcttctaaatgcttagagttttgagctgaaaatcggtcattaaagtaacgcaaaaaaaaaaaaaaa

SEQ ID NO: 3882 - DNA, 646 bp, Trichoderma harzianum
gtgctctgctatctcaattatctccgatcttgcttgcagaagagtcatctgtaccgcaggaatctcacctaacaatgtttccaaccctcgtcagacggctggcccaatcagcaaaggagcccctcaccaaacaggttcccttgactatcataaacaatccctacaaggctcgaaaagtatggccacctgacttcaaagggttgactcatcaacaacagcttcggtttgagaagaagtacaagcgtcgcattaccctcgcacaccattcaccaagatgggagaagggtgtgaaatatgcgcagctcattacaattggagccgcgttggtatggttgcttttctattctgaattcgagtggtggggacgacagtataagccatcagaagagttgcgaaaacactacaccaatctctttggcgttcttgatcctgaaaagcgatacgagcgccggaaggacgccccagaagtaaatccatcatcaaaaaccccagagtcgaaatgagctgtaggataatggagctctccgatgcgtgtaatatagtacttgtatatatatggcgtttggcgcgatacccgtgttgggcaagggaggagacaaagaaatgtatgcatatgctggccatagttctatccaaaaaaaaaaaa

SEQ ID NO: 3883 - DNA, 171 bp, Trichoderma harzianum
ggacaggggaagggggtgttagttgcgatagccgatgtttgcatgtgaaggccactactttaccaaaagaggatgctgggatggctgttgccggtcgagtaattaatatgcataatagtatccgcaggtgatgaggtgattttaatgtataattgctaaaaaaaaaaaaaa

SEQ ID NO: 3884 - DNA, 332 bp, Trichoderma harzianum
aacaaagacacgctgccagcattgggcaaaacagcttcaacgagggcaattgctgggaggaaaacggcgtcaattggcagcaggagagactcttgagtctttttttcacaggggatgtaaatagccgtaggcggaatgacgtcagggctagcgcggacagttgccgaatttggaaatcagggacacgaacgttgcaaagggaacggcaccgaccaaagggcattgacagctggtataattgaggcatgtggatgatgtgttgagataaacagcacgatttacatgtcattgtgagaattgagttgcgtgcattgtttgaaaaaaaaaaaaaa

SEQ ID NO: 3885 - DNA, 550 bp, Trichoderma harzianum
aaccacggccacgacgaccgcgtctgtccgggattgatcctgtcaactgctttaccagatatctagccgtgccacgatagagcgcgcatgtcggcgagaggggggcagaagaggagaagagtcaagagaagggggggcacagctgatagacagagcgccgtcgagcctgtagcatcgccaaactcaatgtaggtacgtctgatgagtgtcgctgcatgcagatgacagtcgtggatgcatgtcattggcacttgatcagctccatatttgacagtgcccctccaacggcggcaagcgagagtgaggggtttgctgttgttatttgttgttgctgttgctttgctgttgcattttcctgaggcatatgggccaagatgagagatggatggatgacatggatgagattggtttttgtgtataacaaagcttgataatggcattgaacaaagcttgtgccggctagtcgataaggacgatgtcgataacgcgtatcgcagctatcagcccatctaatcgcagcacagcctaacccccgaaaaaaaaaaaaaaa

SEQ ID NO: 3886 - DNA, 215 bp, Trichoderma harzianum
gtggagatcattttactgtactataacggtggtggctggatcgtcatgaggcaaatcgggcaatgcgatgcgatacgatggatcacggctaacatgacaatattgattagtagcatgatgatgaaccaacagcacagatctggatggctttagctttgaccacatgccaagcaggctgcccaggttcacagaccagccaaaaaaaaaaaaaaaaa

SEQ ID NO: 3887 - DNA, 392 bp, Trichoderma harzianum
ggaatgcttgagccaagagattgcctaggtaaggaaaaaagaagagagagaaaaaggcaatttgttagcgatccatggattgattccatgactagctaaacgaggctagatgagatgaggcagcgtgagagagatggatgggacgagatctggtgggtttggtttgggaggcggtttggaggtttggggatcatacagtagtactagtactacaagtgctgatgatgcatagataatgtacttgaggggcgatgagatgcgatgcgatgcgacgcggtgcacgcgtatgtcatccatcagcggtgatgccctctcagacgagtacggagtcggtaccagacagcaatcaaaattggcgggtgttggctctgctctggttaaaaaaaaaaaaa

SEQ ID NO: 3888 - DNA, 360 bp, Trichoderma harzianum
aatcaaactcttaatctctattcttaaatacatctacctctcacaatggatttcgtcaacaaggctatgggcaaggaggagcgctccactcagggcaccgctcccgctgctccccaagcaggcggccaggtccagaaggacgattacgtcgacaaggctttcgccatgggtgccaaaaagagcggccacaacatggatcgcaacacacaggagaagattacggatgcaggccgtaacatgtacgagaaggtgacaggaaacaaggtcgaccccaagtggtctaattaatgaacggacgagttatgactcacaacaagactgtacaatagtaataataacatcttaccaaaaaaaaaaaaa

SEQ ID NO: 3889 - DNA, 372 bp, Trichoderma harzianum
ataaattcgaggtgttttagacgcaagcttctcttttacacactgaagctgctgctgcaaccatcaccaacataccacacgcaacaacacaacaccaccacgtaataacgagcagaacacccctcgcttgaacttgttgcaaaaaacactctcgcctctatttcataaatcaaattacacacgaacaaaacaatgaatccaacagtcagaggcttctcaaccgccgcaagagtgcacccgccctttttgccacatctccgcccatcgccgcgccgagccccgatccgacgctggtaagcactcaactctctctcacgtcccccatccataaggataccatagcagcaaaaagacacaaccaaaaaaaaaaaa

SEQ ID NO: 3890 - DNA, 616 bp, Nicotiana benthamiana
ggctattatgtgttgattagggaactatggcttcaaaactacctatagtgaaagcaaaggctgttgaagtttcaaaattcttgaccaagcatggatgtgcatactacaagcagacgttggaacagaacaagcaatatattcaagagccacctactgtggagaaatgccagcatttggcaaaacaagtattctacactcgcttagctagtattccttgccgctatcaagcattctggaaggaacttgatgtcaagcacttgtggaagcacaaacaggagctgaaaatcgaggatgctggcattgctgctctttttggccttgaatgttttgcttggttttgtgctggggagatcataggacgagggttcacgattactggttattatgtctgaatgtctccaagtattaggttcgaaaggaatgacttatgtcactgttgatgaaaggtcattgtcaatctctactttgagcgggataacacgtatcagcgagatacagattttcaattttcatgtttagcaagtacacaatgtatgcagaggatgaggtcttctgctaaagatttcaaaggctgagttaggagtaatatacgtgcttcaataaaaaaaaaaaaaaa

SEQ ID NO: 3891 - DNA, 695 bp, Nicotiana benthamiana
cacacttctatcttacatatttagccaaagcatcgttaaaatggcgtacattaagcaagcttttctcttgattgctctctttgttgcaattacagttaatctctctggatctcctaagttgcaagtgatggctttacgagacttacccgaagaggttgcaatgatgaaagataaattacttccattaggtgatatagtaacttgcttgaaatactgcaatgtcgaaagcgattgcagtgatggttggatttgctccaattgtgttccatctgcatttcagggatggagatctcaatgtgactcgcttactgctactggtgaaggttattttggaactatactccgcgctaagcacaacaaaatataaattatattgctgcaatatatgaactatttataaatgcttgatctcgtgttatattcaagcattttaaataatataatgttgtgtttcctacttgtccaagtttatgtaagaaaatgaatatgtaaccatgtttcttgttgttgtcatcttatatgcagttattatgaaatatatgttctctattatcccaattaaagtggcacgaaacttaatgggagataatatttactatatatgatatgaatagtgtcattaacaactggtttggatggttgttatgttgtattgttattttaaatacaatgtttgttttaaaaaaaaaaaaaaa

SEQ ID NO: 3892 - DNA, 314 bp, Nicotiana benthamiana
tttttttttttttttcataagaaaaaaatgaaaaaaacgatgtttccagcttctggtctttgacataaagaaataagtaataacgaaggggacattttcaaattatctcctagccagaccccacttgtaggaccatactgggttgttgttgttgttcttgttccaactccattttaacggtcagcagctgctacaattaaatagctacttagaattacaactcccacaattatgtggccaccaacagtaaatgaataacaatgacagaatgtgtaaatcatactcgtcttcaagcggacgcgtgggtcgagggg

SEQ ID NO: 3893 - DNA, 276 bp, Nicotiana benthamiana
gggatctgcttcaagattgtgcagcttgttgagtagccagaaatgatttaaagctaccttaagcttgacttcaattttggcaattattcgtcacactgcctaagaagaacctaaacttatccaggcctctggagtccaataagtagctccatttaagaggctttctatgtccaaatagtttgaaacagagtcagttgctatcttgtttatgttatgcccctgcaattatagcttgcttatatgagactggcttaatgatgcgaaaaaaaaaaaaaa

SEQ ID NO: 3894 - DNA, 508 bp, Nicotiana benthamiana
aaagcaagatatgattcaagcaagtgttgatcttcaacttaaagaccctcttcctttggattgggaacaatgtcttgatcttgaatcagggagaatgtattacctaaataggaaaacattgaggaagacatgggattggccaaaggatcaaaagctagaccttgaattaaacatgtcaagtttcagccaacaagaaacaatggaatatgatcataactactataataactcaaagaagcagaacaaaagcaacaacagcagcagcagtagtagcagtatgatagctttgccatgttcaaattgtcatctcttagttatagtgtcacagtcttctccttcttgtcctaactgcaagtttgttcattctctactttctaagaaacatccttctaccgcaaaatgttatgacaccttgagcctcttgaactgaacttggatgtactgctgcacttgcttctgtttgaacaatagttgtcagtgcaatggagattaagtaaaaaaaaaaaaa

SEQ ID NO: 3895 - DNA, 399 bp, Nicotiana benthamiana
tgtaggtttgaatgcttcccagtgttcctcttttattattgagggagaatcggggattatgcagatggaattacgttggggcagtaggctaattgtacatagtaggaaagaacgtaaaaattcttggaggttttactgaagtaccaagactcggatgcttcaaattccttatcttgcttctgcctcgaggatgagatgtatccgacttatgaaaggctacaagttatatgtacttaacagtgtagacaatatgagtgtaattgtttatttagtagtagtttgaaattgtagttcaacatcccatgtgaatgacgatctgagtttgtgaagcaaacagctcttatgtaagagatattttggctgcattaaaggccagttcggttactaaaaaaaaaaaaa

SEQ ID NO: 3896 - DNA, 722 bp, Nicotiana benthamiana
ttttttttttttggaagaaaagaagatcaaatgacattcccattagaggtttctgtacaacttcaggcgacagacaaaagttagaggtttctgtacaatttcaggcgatagatatagcgccaataaagatgtttctggacaggttgaccattcgccataccctgtagagtatgtacaaacatatagtacagtttcaggaacgcaaataaatacttagcaagaaaacaaaaatcatcgttctttttaatgatagatccagtgaccatctatcacttgctttcacaaatcctttccttccgtcaacaatgctgtggacttgcagatgggacaattgttcttcataatcaaccatttctttacgcaatctgcatgatactcatgtccgcacttgagtgtcccaatgctctcttgatcatcgtaatcagactggcatatgacacagaaatcagtcttgtgatccgaacatgcagccctttccaaattgcaaggagttaccgatgatgaaaatgatcttgttttcaaatggctaacaatgacctcctctgataaaccggtttttacagttccaatctgctctcccaatgcaagaagctcctcataagacatgtgatctacgtccatacgcatctctccgtgctgatcagcaggatcacgcacttcatggtagccaggaatatccaacattgccaccggacgcgtgggcggacgcgtgggtcgagggg

SEQ ID NO: 3897 - DNA, 326 bp, Nicotiana benthamiana
tctcttggggaagaaattggcatcccaatagaggtatatggacctgaggcaaccatgactggtatctgcaaacaggctattgagtgcatcactgcagctgcatagaggaaccaactctgtattcttcaagcttaattgctttgcttattcttttctagctttgtgttagcatgatgttgtttgccaaagataaaagagatgtgtttgtatttttatgacttttttttacataagaaacgagccatcagcaatggcttcgtttcaaatatggctcgtttcaaatcagtttagtaacgcagaaaattgctgcaaaaaaaaaaaaaaaa

SEQ ID NO: 3898 - DNA, 395 bp, Nicotiana benthamiana
tctgtttatagtcagagactgatcagttgtcctgccataactttggcacttttgacatttctgtagcagggtgcctgaaagaaaaacattctcaaggtggaaaagtcggttgaaaagataaagcattttgccatgtgaatgttatacttctactcctgctgatagacgtgaattccttctgagataacaagattaggtttacaattggtagtcagatttgaagctgtattatttagggaaaaagtagccctttctttcagttcagagttctcttttgaatcacttttgacttctctttagttttggtatgtgtacagcttaggattgttattgttgcaacaaatatacataacattttgaggcatcatatccttcattttgaaaaaaaaaaaaaa

SEQ ID NO: 3899 - DNA, 600 bp, Nicotiana benthamiana
aatacagtttggattttctttctttgtatttttcaaagcaaaggcaatggaagggaagactatgttcaagttatctcatgtagttgctttcttgctccttgcatcgctttttcaacctcttacggcaagagatctagtattcgaagtaagtgacggaatagaagtcttgcaattcccaatggcaaaagaaaaccaagtggaaacacttgatgatccctctctctcaataatttgcccaggaaagcaatcatggcctgaacttgtgggaaagccagcggcgactgctaagagaataattgagaaagaaaatcccatagccaaagttcagtttttgttccctggtatggttaggccacttaattatgtttgtggtcgagtttttgttgttgttaactggaaactcattgttcgagatactcccagcatgggttaattaaatagttctatgggactattatggaagattcagaataagttgccccaagaattaataaatagagtactggtgttctatagtgtactcttcatgtactgtactatttcaatataataaataaaataagtgtggctttttaaatttgtattaaaaaaaaaaaaaaa

SEQ ID NO: 3900 - DNA, 149 bp, Nicotiana benthamiana
caccagaatagcacggcgtgcaaataagaattcattttacagatgtcaaagtgaaagacccttcactgtgtaatcaaatcttgatgtctttcttccaacctaattaccctgagttgggtaaaaaaaaaaaaaaaaaaaaaaaaaaaaac

SEQ ID NO: 3901 - DNA, 567 bp, Nicotiana benthamiana
agagatcgggaagaaaagatgcgtagaatggtagagtatggttggcaaaacacgtcgtcgaatgagtatcttgatcatattaaacgaatggagagatcgccaacgatgcaccctgatcttcctctctacccaaatgtccactccctcttcaaaaatggaatagtgagcaacggacaagaaaagaaatgcactacactaacaccacagtcgcagaagaaagttcatttcgtggaacctaaagctgaacttaccatgaatgaaaagaagagtattgacatggaggctgatggctatataaagcagaagcacgtcaactttgagctccacaaatggagaaccttcaaagcttgttaaaaagtttccaacgtacttcatacaagatatactacatgatatcttagtataaataacatgtaatatatgtctgtcttattagcttctgtttgtactctaaagggaaagatatctcttatatgcgctgtgactatatatttcgtagatgtggtgttttgatttcaatttatctaataataaagctataggtatgtttattaaaaaaaaaaaaaa

SEQ ID NO: 3902 - DNA, 675 bp, Trichoderma harzianum
aaagccaagaaaccattgaagcacataacaaaccgttcgaaaaccgcaacaatgtctatcgtccagccacaagaataccagaccgttgacgacgtgccgtatcagcgaggccgtcctctcccaacagtcacccccgtcttccagaacaagctgcccaactcgcctggcaagacgtccatcggcctcctcgtcgacttcccgcccaactcgtcgacgcccccccacacgcacggcggcgcggccatctccgtcttcgtcatcaagggcaccgtgctcaacaagatgaacgatggcccgactcgtgtgatcccggcgggcggcacgtggttcgaggcccccggctgccaccaccggaccagcgacaacttcagcaccacggagccggcgcagattctggcgacgatggtggttgacacaaagactgttgaagagggagggatggcggctcttgttgtgctcgacccggagtatgctgatatcagacttggttaaattgatatggatgctgcagtgaagagaaccggaagctcggaaagggtgtgggtgttgtcaatatcagaagtggccagcggaggctcggattgctgttagtaaacggggcatctcagcaggaaggcaaaatgaatatgtaaagcaatcaatggcaacgaatcgttttgaaaaaaaaaaaaaaaa

SEQ ID NO: 3903 - DNA, 475 bp, Trichoderma harzianum
tgccccttatgatgttttgtgtttgagacacggctgatgagggctgagaagttgttcaacattgcacaacgtctggaaagacggcagtgggccattcgagtaagaaaagaacaacagacggatccagactcttggtagtagctaggcagcagtttaacagaaggaacaaaacgggtaatgcgggtggttttggacgccatgtggcgacgtctctccagctttctccatcttctccgtactgactctgtctccatttggcgggttagtcttgtcagtttggggttggtctttgtcatggagccatggccagagccagtgtgggcggccatgccgagttgaatggctgaccaaggacaatgcagcatttacgattatatgaatgtgctcgtatatacgagtgctactccgtaccatgctggtgtaccaagtgatatatgaacggcatgcacgcactgctcacttaaaaaaaaaaaaa

SEQ ID NO: 3904 - DNA, 498 bp, Trichoderma harzianum
actgcttcgattccgcgctcgcctgttcatctctctacgaaaccgccccccaacacacgatcctacaagaggaaaagcggattgattaagacccgccaaagaagaggcgtcacgcaacatggcggaggagatcctggacaaagttcgggatgtggtggagggccaaattgactttgagggccagagacgagcagaaggccttgccactctgttacttgccctgacaggactcatcgcattcaacgtcggatacgtactacaagacatcgtcaaatgcctatatgttggactaggaggaacggtcttgacatttctcattatcattccgccgtggcccttctataacaagaacccggtcaagtggctgcctatcggatctgcatttaacacgggcgggacatgacgactggataacgccgctctgagtaggccccggcgttttgtcacgttgtcaaaatcagcatgtagcttaaatcttttcgagaaaaaaaaaaaaaa

SEQ ID NO: 3905 - DNA, 820 bp, Trichoderma harzianum
cccacgcgtccgccaggcaagggtgttcagtcgaaatccaacaagggccctccatcaccgacattggccaatgttgcgcgccactttgctgtggacagcggctcaacattgcttgccacggcggtaatcacagtcttgatattcggtggatgctgctctaacgtgtatgctttagaggccatcatcaacttcgagccgacaaacggaaccctcgtaactttcgttcaattcctattcgtctctataacgggctacgtagcgcaattcgatagatcacgcccgccgttcttcctgactcccaacgtcgtcccgcttagccgctggcttgtcaatatcctgttgttctttaccatcaacgtcttgaacaaccatgccttcagctatgacatatccgtaccggttcacatcattctacgatccggaggtagcataaccaccatggctgccggatacctttacggcaagacgtattcgcgcccccaaatatttgcagtgtttctgctgagtattggcgtcagcctcgctgcttggtcggattcaaaagacaagaaaccgagtgacggtatttctgaccctgtattcaaccctgggctcttgatcatctttgtcgcccaagtactttcggcgatcatggggctgtataccgaagcaacatatcgaaagtacgggccacagtggaaagagaatcttttctattcccacatcttgtcactgccaatgtttttgccctttgcgccctccatgtggcgcaacttactcgtgcttaccaaaaccactcctgttacactaaacataccatttactgcaaaaaaaaaaaaaa

SEQ ID NO: 3906 - DNA, 658 bp, Trichoderma harzianum
catcgacaatggcatccctgctgcgcacgctctctctggccgcagggcttttgcgctcttctcaggttgtcaagccgtttgcggctggcagctttgcgacggcaacgagcagcccggcttcctcgtggatgggatggttgtccaagcccgcagttggagggaccctgcagcagacgcggggcatgaaggttcacagctcggtcaagaagaggtgtgagcactgcaaggttgttcgacgaaaggccggcaagcgacacaacggatacctgtacattatctgcaaggccaaccctcgacacaagcagcgacagagctaaggcgactgcgaggatggttcttctcttttttgacgacgatgacgacgatgacacccggatgagtgggcattctgtatattattggcgtataaagggtgacgaaagggagcgacgaacaaacacacacaacggtctggcaaaaagcaattgatagacgatactacggcaatgggcttcgaagacgtggaggacatgacacgagcccaagtgcgagctttcttgcatgctcgagaaatgacggttcagagtgccgtcgtaaaaatgtacaattttatgtagtgttacatacccccgatatacctctccatgctttccctaaaaaaaaaaaaaaaaaaaaaaaa

SEQ ID NO: 3907 - DNA, 558 bp, Trichoderma harzianum
tcttacagtatcactactccatctcagttcgtgttcttgtcattaattaactcgacccacgcgtccgcccacgcgtccgcccacgcgtccgaaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactgctgttcagaatggctctactagctgtgtcattgctgcttgtggcgtttctgtcgccattaaccaagttctgcctgccacccaggctctttgtgccaaccagtgaactcatccatcgagagggagaaaatgacatgggagaaaatcaggtactcttgtacattgacaaacaagtacatagctgaatggtgtgaatgaataaaacgcattgctgctggaataaaaaaaaaaaaaaa

SEQ ID NO: 3908 - DNA, 373 bp, Trichoderma harzianum
agagcatcttcctgacatgccggggttgatgcaacgctttgactgtatggaaacatccgtattgctgacatacatgtcttccatgttgtcttacactgcactcaggaggagcagtcatccaccgagttgattcacatggcagcaaaattgtgctggatctactgcagcgcagatcctctatttgggcatttcttctcggagacagacacagatcggctcggcgaacccgagagcaagtgatagcaagacaagcacagatatgcttggcgaggctgtcctcaccaggaaacgaaagaggaggtttcaccagcaactccattcccagcagaggtcagcctgtcctacctgtcacattagaaaaaaaaaaaaaaaa

SEQ ID NO: 3909 - DNA, 592 bp, Trichoderma harzianum
gggaaaatcaggagagatgaagtggtatagagaaaggaaaaagaaggaaaagcaaggaaaaacccaagccagagccgataaagaggtggaaacgcacgacagcacgcagagaccagacgatcgttgggtctaggattcaatgggctgacatgccacgcgccaaattttctgcttgttcctttcgcctctgacacacacacgcactgacaaagctgactggctgtgggcaactccctaggccgcctcgctctcggtcgtatggcaccgagaaaagggaccagactgatagcggcggggcctcgataaacgccgcagcaagggtctaccgtcaagagccggaagttgttggctcgcagctagttgcccggttggtggatccgataatgcgaagagagtctttgggacctgcgatcagattgcgcaatactagggggtggcaagagatttgtttgttggtgggatgttgttggaggagggaggacgaaggaggaagagaagagaagagaagagaagagaagagaagaagagaaacaagagatgaagaaagaagaagaagtggaaactaagagagaagtaaaaaaaaaaaaaaaaa

SEQ ID NO: 3910 - DNA, 690 bp, Trichoderma harzianum
cccacgcgtccgcccacgcgtccgaagactacaaagcttttggtccagcaaccataaatccaactcattgtccctccaccacgaaatctagcaacctctcctcctcgccacacagcccgcaatgctcacaccagcttcttcaagaatactcgccagcggcgcccgccgtgccctttcgtcgcgcagcttccacgcttcggctcggcatctgaacgactctccccccctgcccgcgcggaagcccatgggcgccttcagaggaggtcttttcggcttcttgtttggcagcgtcctggccggcggtgccgtctacagctacgtcctgcaggagtacaaggcatccaacgagttgcttaccgaggatatctacactcttcaagcctccgtcacccgactgacaaaccacgtcaagatccttgaggagaagatccagcagaagagaaagtaaagcccgaaaagataaaaaacacaaatagcgcaatgtcattagggatggtatgataccagcgcttcaacgctggtggaaaatactgggcaaacgaacagcattatggcaatacttgtgtccttgtttgtaacaacctaacaaagcctcaattgtaaattgtaccttaagtatctagcctctgaaatatctagcacaggaaacagcacaaaagcccatcatacgtttctccaaaaaaaaaaaaa

SEQ ID NO: 3911 - DNA, 538 bp, Trichoderma harzianum
gtagcattagctggaattttgttcatgcatctggcccagcaacaaggtgagaagagaaagacacgatacggatttgcaagtcggtcttcgagatctactctgctaggagacaacatcttgctcggcttttagaattctgacatgtcttgccgtggtgaaacgctcatcctccaggttaggtgctagacaataaacctcgacgggatcttcgagtcatgatgacgcacggcaaggcctccgaccttcctatcgaaacctggaagcctggtcttcttttgatacgagcaagatgtactgtacatcgtaatcaatatagctggcagagtatggacctggaaagattggcgatgcctccagactccagatcgaataaccaaattcttcgtcagaagttgccacagctgcacggtccctcgcgccctctaatcaagagagtcagctactcaactcagatagggcaacatatcccaataaacctctgcaataggcaggaggagatgcgtaatatactaataatggaacaaaaaaaaaaaaaaaa

SEQ ID NO: 3912 - DNA, 427 bp, Trichoderma harzianum
atggatttgagacaccaggaaatgcaatgcacctgtctctcgctactctgctggttaatttctgactctggcgctaatacacaacgacgatggcgatgctttttccataccccatagacccgctagtcccatctgacattactcgacgatcagcacatgtcgaccatcatatccgcgcatttgggctgctacggggatatttagatgccaagggcgagcctaaatgttgagctggttgaccaacgctgcttgtgaccaacaaggagcatgagttggcctcgtcagcattgctcccgccagaaatcttttacaacacaatactacagtgtacctccttgggcttgactttctactactcgtacaggtcaagccatgtcagatagtcagaccgttggtagttccatgtggagagctgaaaaaaaaaaaa

SEQ ID NO: 3913 - DNA, 241 bp, Trichoderma harzianum
agataccctccccttcttcttctcttctttcccccccttcacatttgtgtcttgacgtcgtatttcgcttcagcgtcatcccccatcacacatacacacatagcaacttgccgacgtcatggctgagcaactgagatacgacggccaggtcgtggtcatcaccggagctggcggtggtctgggcaaggcctatgccactttcttcggctctcgaggcgccagcgtggtcgtcaaacggaac

SEQ ID NO: 3914 - DNA, 141 bp, Trichoderma harzianum
cagaggattaaggattgggaaataataagagagttgtcgagaggtcactggtggcaaatgtttttgttataggtagcccatcaacccgtatcacacaagactgagcagtatatatagaattctcagaaaaaaaaaaaaaaa

SEQ ID NO: 3915 - DNA, 321 bp, Trichoderma harzianum
aatagagggaaaacaagaagcgctgcttagccccgatcatgcgtacaatcttcacacacttgtgtcagctcataccaaatcgagctgggattggttgcctctgattcggggggtatggcaagaaggcacatggtctggaagccctgagaatggccgctgatttcgtctgtggccaacacgagttggtgcccgacgtggaaggcattgcctcgtcgaaccgcagagcaactttgctcataagacaaactatgagcgctgtgtaacatatcctttgcgagattcggtgtgtgatcgctggctgggcggggaaaaaaaaaaaaa

SEQ ID NO: 3916 - DNA, 677 bp, Trichoderma harzianum
agattgtgagaaatacgaagatattagtggatttctcgtaccaggaacgaggacagacattggtgtgttgatgaaaatagaaacttgaaccggcgaaaccttgaacggtgagtacgagatatggaagacgaatagcagcgtatgagtcaagttgcagcactagacttcttggttaggcccttttctcttcccattttcccgccatgagcgtggatagatgcatctacatggtgataggcgagccgaaatcgaatcatttctcacgtctccaaaggcccagccctacgttacagccggccatcgctaagcagatcgcctactcggtgctaaattctgacttctcaggcagcacgagatgccgtccagtcgctgcttgttcacgggcacaagggggggatctctcccttgatgcctacttgtatacgagaagagagacgacggacattagccgcatgcaagattacgaacgggtcatctcgccaagagaaagcttgtgttgtatgttaccgcttctttggaattaatcgctatcgaaaggaacagggcctagaacttagtagcttcccatcgaaattctcgtgctattgtttccttgattgtgccaaatagtgcagctagctagcgcgtaattgcgtttacgaattgaagctattggtgctggatggaaaaaaaaaaaa

SEQ ID NO: 3917 - DNA, 361 bp, Trichoderma harzianum
gtttttgctggatggctcggtggttagcaaaacggcacggcgcggcacacggctgaatggcatgtccgcatcttcggctgttcgggagctgcgtcaccagaacaaggttggcccgatgtctggatgtcgctgctgatgggctgagaagtgctgatgtgttccattgcgtgcctgtaagctgtctatcagtcacacaatcaagtcatcctatatggctcgtaatgctgaggtttgatctcgttcgcgggtttcgggccgggggggagctgttttattgtacgagtagcagcacgttaattaaggtggtgccagatcgacgagctgggaccgagtacgggtacatggaggaaaaaaaaaaaaa

SEQ ID NO: 3918 - DNA, 320 bp, Trichoderma harzianum
cccacgcgtccgcccacgcgtccggggggggaattgaacgggggtgagggctttatgagagaggcgagctttcgtacgagccttcggatcagataagatcaggtcgggctggtgacaggcagccacggcccaccagggtccgccataggcgtacaacgaccccgtaagatcccagtaatggctcattaattgctccagctgtggctggcatgatcatcgtcacatggccgggtttgggcgactaaaattagcgggctgtgccagcaggatgagaccaagacggcagaggagcacggccgagaaggaaaaaaaaaaaaaaa

SEQ ID NO: 3919 - DNA, 639 bp, Trichoderma harzianum
ggcgtgggaatatgtgcccctcggaccgttcaacggaaagaactttggctcaactatcagcccttgggttgttgtcgcggatgcgctggagcccttccgagcccagccgctgccgaatgatacccctgttcaggattatctcaaggagtcacagaaggagagcgtgtttgacattcagcttgaagtcggccttacaactgcggatggcgaccatgtcgacctgtccaagacaagcggccgaaatctgctctggtccttcccgcagatgataacgcaccataccgttggcggatgtcctctcagggccggagatttgttgggctcgggaaccattagcggctcagagcctcgggaacgtggtagcttgcttgaaatgaccgagggcggcaaggtcgatgttcagctcgaaaagggcggggtgcgtcgcttcatccaagacggtgacagcctgaacatgcgaggatactgcgagaagaacggagtgcggatcgggtttggcgactgtgagggcacgattctgcctgctcacggggcgtaaaatttgggaggggacaacggcataatgagaaatgtaaccaaaatatccattagatgaaatcaaaaacagaagccaagagctctttggggaaaaaaaaaaaa

SEQ ID NO: 3920 - DNA, 245 bp, Trichoderma harzianum
gtttcggaggctgattgagtcggaggggctgccttattgcggcagaggaatagtgacgtcatgactatcaaggaccctggaggttacctaaaagaaaagcatctggacgaggtgacgtagccatcaatgcgatcgattgtttgctctatctcctcgggtcggctgttgatttagtattaaactaatggatatgaatagtgttagagtgtgcgaatggatctcattgtttgaaaaaaaaaaaaaaa

SEQ ID NO: 3921 - DNA, 520 bp, Trichoderma harzianum
cccacgcgtccgcccacgcgtccgagatcagattgcaggcaccctcaattggcatcacatcatgctggcgacaagagcactccgagcggcccacgggcccaagcccaacatcaccggcttcaacatgcgagccctcaaagaggccactggccagccccgatacgacccttgggagagagccgaggcatggcgatacaagggcaccttttccagatggaaccgattccggagcggcttccctggcttgggaatcgcgtctgttgcatttgccggatactgcgcctacgagtacctcttcctcaaggatgaacaccacggcgagggacatggcgaggggcaccactagagcgttttttttttgcgagcgagagcagtcaggagtgtgcgagaggagaagagagaggaaatgtatatacatctctccaaagacaagaaaactcaggcctggtcttgcggcgggcaaaaaatgaatccaacacaaatcaatataaactctatttagagcaaaaaaaaaaaaaaa

SEQ ID NO: 3922 - DNA, 253 bp, Trichoderma harzianum
aatgtcaatggaattgaatgattgcgtcctggtagtacgagtaggacttgtacatcaatgtatgccggcggctgacaatcaaggttctcacagcggccggttagccgtcagcatctgcccgtcagaaagggagttgataagatttgttgggtcgaatagtagatcgttgatatggctgttgtcgataaataggcctcagggcgagatagaaaaaaaaaaaaaaaaaaaaaaaaaaaaaaaaaaaaaaaaaaaa

SEQ ID NO: 3923 - DNA, 440 bp, Trichoderma harzianum
atgaggctatgtttgccctacctgccatgggccaaggccctctcttctccatggccactgccgccgcccgtgagaacgagaagaccaacgtccgcgttaacgaggtgtatctgatgttccgcgttgaggttgacgaggctgccaaggagcatggcgtctcaagcagctccgaattcgcctccgtctacgaaggaatcctgaacaaccctgagatccgcagctcgcgcgttcgtgttgcctcgcctgctgacttcaccgacctgaagtgggctaagaagttctaaaaagactgatgcgtcttttttaaaccttcgtgtttctctccattaagcattttgagaaatcatctccctgttgctggctgattacacatggttcagtagttgacaatactgttaaaaagaatgaaatgaaataaattgaacaaaaaaaaaaaaaaa

SEQ ID NO: 3924 - DNA, 122 bp, Trichoderma harzianum
ggaaccgcccggaggttgttgcaagatgccgccgcccagcagcgtcactatctcctgaccatgcggccactttttgttttatttcccgagagagcaaaagtcgtcccatcccatgcggccgc

SEQ ID NO: 3925 - DNA, 623 bp, Trichoderma harzianum
ctcttccgccttcttgatgacttttgtggacgcgcgcagtatctccttgatcttgtgcactggccgcaaatggggcttgcctcgtcgcctgtcagaaaaggggcacatgtcagtcattccaatgacgtgtataacgagggcgagtgaatattctgatacttaaggggtgtataggcagctatgggggtctgacgagatccagtgttactcacattttactttgcgctgcctgcacgtatcgctgttaagcagaagccgacggcagaagcgattagacactggcgtcgatagtctgaaagacgaatcattgcttaccaggctgtgataccacaaggtcagtaagagtaacagcggcagggtatggaagcaggggagtcgatgcaaagataacatgtccacacacacacgcacgcacgcaccgttgcatgcgcgacagtacgcatatcaggatacatgtatgtacacactcagatgcataggagcaaaggaatgggccgaacctagcgtcctgtttgaccaccaagcgcttacctgctatattcaatgctcgaggcattggctctcgatggtattcacagaagtgttgaattgacgagcccttactcttgaaaaaaaaaaaaaaa

SEQ ID NO: 3926 - DNA, 656 bp, Trichoderma harzianum
aaagactgctacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacctggtccgttggcagcgccatctccaacccaacaacccttgctcaaggcggttcctatggcgagaccttctcacgagaccccgtaaccggcggtcgtgccatcaaggtcaccgtccagcccgatggcctctacactggcaagccccagaccaacttcgccatcaaccttgagggcaacaccatctggtacgatctttcagatgtctttggcgatgccttcaacggccacaaggtcgttgtttccagcgccaacactgcttgcccccagattgtttggggcagcggaatccctcctgccggaagccaggtcaagaactgcggtgcggataaggatgtgactttgactctgtgtgcttagagttaagggaggacggaatcatgtcaagggaaaggtttaaatcaagtttatgatagaatttcaagtcctagctatgtttaagacttatgacagtatgaattgatgagtttactccaaaaaaaaaaaaaa

SEQ ID NO: 3927 - DNA, 391 bp, Trichoderma harzianum
ctcgtgtggcgccttgtctcagggacaacagacgacgagcaactcaaagaccagagctaaacatggcttggctagatggcaataagcagagcacgcttcaatcgagaacagacgcgctcgacaataaaggatgtgctacggcacagccattgggacagatgatgtcgcggttcaacggtaagtcttttgatcttgttgattgagcatcataacgtgaggccggctctagttgttcaggacgataaatgccacttgcaatgaccgaagctgtttgagtctcaatacactctgtaccagatgaaagggcttctatgtctgctaggttttcatagatttgtcatagttatgactcctgaagaagtagttgtactgcgaatgaaaaaaaaaaaaa

SEQ ID NO: 3928 - DNA, 192 bp, Trichoderma harzianum
agagacgactacgtttgggtcacatgtgctctggagtttggtacctagttatttgaatggacgacaacgtggaggaggaagctcaggtaatgagtgggattggcttacagtatgttgaataggatgtccgttagaatgcggaatgcaagtagttttcaatgcatcttgatttaagccaaaaaaaaaaaaaaa

SEQ ID NO: 3929 - DNA, 448 bp, Trichoderma harzianum
catcaaagaacaaacgcatcgttcaagatgagagccaaatggaggaagaagcgcgttcgtcgccttaagcgcaagagaagaaagatgagggctcgctccaaataaacgactcgctctaccacttgacttgacacatctttcacattttgaatgagttcacgataaaacacgacaagcaaagctgctgcaccacggtaccactctatgaccgattacagccatcaagttggaatcagcatattggtgcgcctctccaattcagctacgggagtcaatggacgaacgcgagagatgaggactggacaatttcagtcaggtggagacatcgttttgaggacgcgaaggccatgaagcaaaacgctgctgcaagaagcacgcttaggatcgatacgttgcttgacaaagatcaaaggcagaatttacttcatttccgaaaaaaaaaaaaaaa

SEQ ID NO: 3930 - DNA, 345 bp, Trichoderma harzianum
cccacgcgtccggctaatacatggctctttcccgctcagatacgtttacagtagcaggtactgcctaccaggactttacttgcttttggcaacttgggtaggccacggctgtcatgaaggcgcatctaatccgtacattagcggtgataccctgcgcacctgtattttgacatcccgcgtgatgcgggattccagagccgtttccaacggccttttgggcattgatatttagttttcgatatgagagctagtacttgcagatgaacaaccatgaagcactattgcggcactagcaacaggattgcattgacatcgactcaatatgtagcaaagaaaaaaaaaaaa

SEQ ID NO: 3931 - DNA, 661 bp, Trichoderma harzianum
aaattaatctatcgtggtgatcaattgggagcttcataccaccactgagctcgttccggcttgctcgggcttcttcttctcgccaggacgagccttcttggctgctttcgcctgctgagagcctgctgctggcagacatagcaccgcgtatgccacctggacaacggcgacgacaggcagcgcggattgcagcgtcagcaccggctctgccaccaggtcgttgaattgagcggccagtagcccgagcaggacagctactcggccgaaagcgatgccctttgacaaggcattgtcgaacgtcgggaccgcgcccacggtggcctttggcttgctgtcggtagccggagctggaggagcttttgccagtgctgaggacatggtgattgtgtctactggcgcattcctgtgattcttggagtttgagctatttggacaattcgaggttccagaaacatagttcggccaatggcggcaatcacgtgaccttgaccaagggagcttgtcgacccaacccttgcttcactctgcgtacatgtacgagtatatacttgaatctggaggtatcacgatcaaattattacggacagttgattgttgcgagcagcatataaatacaaatgcatgatcaatctttaagacttgagacaaaaaaaaaaaaaaa

SEQ ID NO: 3932 - DNA, 378 bp, Trichoderma harzianum
ccccaatcgccaaatacacaaatccattgcgctacaaagaacaagcaccatggcacgccaagcctgccactttctccttggccgctgcgccagttgcttctcccgcagcctccgcgagcgcttccaagcccaagccgtgctgcgtatgcaaagaggaaaagtcgaagcgcgatgagtgcatgctcttctcaacggccaaggatcccgcagccgactgcagatcgctcgttgaccaatacaagagctgcatgcagggcttcggattcactgtataaatcaaaatatcttcatcttggcgctatgcctttgtacattatcaccatatagactactcggaaaagtacagcgctcgattattctactaaaaaaaaaaaaaaa

SEQ ID NO: 3933 - DNA, 199 bp, Trichoderma harzianum
ctttttcggcgtttggcatcaaaatcccttggtcagcgaaccccgagcccgtgcgcttgggaaaagtatgggggattgacttttcgagggagggtcatgtgatcttagtacgtaccgcagtttttagtaacagcctagaggttgcaagtttttttttagaaattcccaacgccaatgttggctgtggcaaaaaaaaaaa

SEQ ID NO: 3934 - DNA, 583 bp, Trichoderma harzianum
gtttggcttgcagtaagaccggcttatgagaaagaccattgtgagagatgtaaggctgatccggagctctacgtcatctgagacatgacattggcatgatgagggtccagtaactacctgatgattggggtaatcgaaagagatgcagagagaaacacgcaactctgagaaagcgtcccgttacacacggaacacactgcctccggacagcggcttgtggctcattgcttgagtcccttaatcagcaatccccaggttctcttgacagctcagcggtgcagttttgcgggcacagctgatccacccgtcaacggggcgggacgccgggaagccgggactccggggctaaaatgacatcgccatgacatccgcaccgtccgaccagaactgctactactcaagacggtaagcaagtgctagcaaaagtgagttttacgaggtaagcaagtaggaacgtggcttataaagccacagctagcttgaggcgaaggctgctagtaggaactaaagtcagcttatactatttataagctcactgcatgggctagtaataatagctcaaaaaaaaaaaaaaaaaaaaaaa

SEQ ID NO: 3935 - DNA, 322 bp, Trichoderma harzianum
cccacgcgtccgggatcaccgaaactgaggatgtacgagtacagatatttgcatcatggatctgatattgggagaggagaggagatgcacgggccttgcttttttggggatgcagggaggggaaaagccgtctgacaagtcattttcgcgtattgagatggacagagttctagatccattactagttgcaagcacggtctgacggcatgtcgtatggtgttactgcgtcttgtgtgaggccaagacaggacataagatttggtattttctgtgttgttgaatggattgatggaggttttacaatacgaaaaaaaaaaaaaaa

SEQ ID NO: 3936 - DNA, 678 bp, Trichoderma harzianum
cccacgcgtccgccgtgactgaagttcaaccacatcccaaacacaatataaaaccctcacattttcaaaagaaaatcgattattatcacactagaaattaagaaaaataacaggaagcatgtctgacgaagagggcggcacaacaagatgctgcgccccgttcctcgctctcaccgagcccattgaagtcagcgaactaggatggcctcgacaaaccatccgcatttttccaatggccctggcccagtcccctcttgttcatcaacgaaagtagcgatgcgcgggatcactgcgccaacgagcgaactttcctttcgtacctccgcctgtcgatatacatggccatcgtctctgtcgccatcaccgtctcgttccacatcaagggtacgcccagcgatctcgagcgccgggtggcaaagccccttggtggcattttttgggtactgtctgttgtgactttggctttaggagcgggaaactatatcaggactgtcaatttatatggtaaaagagccgctattgtgcaatctggctggaagactcaggtggtgttgggtataatagctgcttcaatcattgggacgtgcatcatattgttagtcgtagataaagtagggcaaaggtgacgatatacagcaactatgcacaccgcaatatcatacgaaaaaaaaaaaaaaa

SEQ ID NO: 3937 - DNA, 372 bp, Trichoderma harzianum; identical to SEQ ID NO: 3804

SEQ ID NO: 3938 - DNA, 578 bp, Trichoderma harzianum
gaagcaaccaagaatctgcacctcactcgataataaaaagaaatcggtactcaaggtttataactcattcaaaatgcgttatactgctgtcctcgctgtcctcggcttctccggagtcatggccaacaaaaacttcggacccttcggatttttcggaccctggttcgatggcgacttaactatcgatgacctcgctgactttcagtttcctgagaacccttgtgagttcattggtggtacttgcgagatcgccacttcccttacattctgcgctggtcggggcgacttcagcgttgatttgccttgtggcgttggcctcggctgctgctggcaccaggacaccagcaatgtttggtttgagcaatggaaggagtggctcgagctacacagccgcatcaactaaagccgctttaatgtcttgacgctttgatggcttgacgcttctatggcttgacgcttctatggcttgatgctttaatggcttgacggagtcttcaattggcacggtagtgggtgatggagaaattagccgtactgaactcaatgagagattgttaaccctgaaaaaaaaaaaaaaa

SEQ ID NO: 3939 - DNA, 408 bp, Trichoderma harzianum
gcgcgccaaaagactgtacacagacgtcttttgatatattttcaaaatgggtggcggtggaaaaatcccttaccccaagcacgtctggtcgccttctggtggttggtacgcccagcctgccaactggcgcgccaacacgctcatcgccggagccgccatgttcggcgtcatcgctattacgtggaagttcagcgccgacagggaacgatgggcgcataagccggagccgtgggagtggcatcctagccgatactggtcaaagcagttgatcgagtgggacaaggaggacaagctgaaggcagcaagcaacagcaaggagtagagttttctttttgggagaaggataatagacgaaattgtacaaattctatacgaacaaaaggcaaacatttcaaaaaaaaaaaaaaa

SEQ ID NO: 3940 - DNA, 449 bp, Trichoderma harzianum
cacacatcctaaggtcgaagtcgacacgcgtgttttggagtagttgctgaatgctatggttggtttatatcaatatgatgagtttcagattagttcacaaaggttctttatggctcttttaaggatgggaagccgcagagagtcgtgatcctttcaaaacccaaggcgtcgcacgtccgacgctgtgtctgagcaaacattgttcacccttcaagtttccactacaacctcgaccggtaccaccatgagcggcatagaaaagcgcatgtggcttggacacctcaacaaggacctggggcccattccgaggccagaaatcccattcgccctcgtctggcttgtttaacgccttgcaggggggggagaggggaagctgagcatgggagagggagacggaaagaaaaaaaaagcaaacatatttgatcatcatgcaaaaaaaaaaaaaaaaa

SEQ ID NO: 3941 - DNA, 472 bp, Trichoderma harzianum
cattcgtgtatatccgaggaatgccatgcggttgttttggtgtttgttgctgctatggaagagagtccaccagagctgaaaactgcttgctctcttccattgccattactaccaccactactgctaatgcttacgggcttggcacggtcaagcataactccaagcttgggctcgggaataaagtaaaaaaaaaaaaaagacttaacaacaatgcaattgtctctccctgagtggctctcggcttacagtactccgtatccctggcctgccatgactgcaacttgtcggctctcggcactatgcccaagggagcagcaaaaccccttcaaggcttcaagcattgcgatatggggcttatttccgtacaacaaagagagctgaagaaagatcagcatcaacatcgtacgttcctttccaggcgcctacagagggcacgggtacgaggaccgtctacggtaaaaaaaaaaaaaaa

SEQ ID NO: 3942 - DNA, 399 bp, Trichoderma harzianum
cccacgcgtccgctgttcctcctcctagcttcaaaaagacgccaaaccctcaaaactgctcccaaccaaaaataatccactacaaacgctttcgataaacttgctcaaatgctctcagatgggtaacgcagatgcgtgtgattggctggctgtgcgcctggtccctgttttagcctccccgccattcgggatccggaaaccgactgtctcttttggactgggctggaagatttggaagaaagacggtactgtaggggaaagatgatgcttaatatttgctgtaaattcttattgttactcattgcatgttacgcaatcggggccttctttttggcttggcagttggttatgttagtaattggcatgtacagtactgtatgactctgcaaaaaaaaaaaa

SEQ ID NO: 3943 - DNA, 389 bp, Trichoderma harzianum
cccacgcgtccgagagcatcaaatctttcgcgagacaagatcgacggatacacaaacatgagctacgaagatactttaattcgatcgagaataacgggtttatcctatataaccaggagaaattccacgagtgacacatcaacaggaggcaccagtcatgactacgtccccataattgttatgactgttattgtcgtggcgatcgttctggtactccttatccttgcgtacgtttcaaaggcgcccagtcttgttcttcaaccatgcctgaaaaatgcaaatagctgatagctgtaacagtcaatacacaaaggtgcttgatcggaaaaagccagccaacggatttgatgatccagaaagcgcacagaatgccggcaaaaaaaaaaaaa

SEQ ID NO: 3944 - DNA, 380 bp, Trichoderma harzianum
caggaacctgcgcggcaagggacaaggaacatacattgctttcgacacaaccgacccggccagcctcgtcaagaagatgaagagcctgggcgtcaacattggcacatgcggcacccagacggtgcgactccgtcccatgctcatctttgaggaagctcacattcctttcttgatttccgcattggacaaggctcttggatccgcatagattgaaaagttgaaaacattttgggaagcataggggcgttgtttaatcaagagaaagcgatatttcattttacttggactttgtagtatatattggatggcttggttggcatcatagtttggtcctgaaaatagggttgcaaaaaagaataatcttacgaaaaaaaaaaaaa

SEQ ID NO: 3945 - DNA, 317 bp, Trichoderma harzianum
cgttgtttcttttggtggcgggtttacattgataagtgacggatatgcatcccgaaaatgacaaatttgtaagcatgtcactgccggcaaagaaccctgaatgctctagatgcttccgaaggattctccataagatgatatcccatgcagtttgtgccaaaatgggttaacggacgcccgattccgtgggtgtgcatttgattgagacccccatgtttgcagtgaatcggttgggtaagatgcattggagaggatgtacgtaggaggttcatttattgctgctcttattttccatgttagaaaaaaaaaaaaaaaaa

SEQ ID NO: 3946 - DNA, 658 bp, Trichoderma harzianum
ggctctatcccctcatcatgaagtttgcagctcttctggccactcttgccccggccgttctggcattgccggcctctgatgccgcattgaccagacgccagaccagcctctcaaccatcacagaccaatatctcttcagcctcactctccctgatttcatttcccgccgcaatgccaagaacccagccacccttgactggacgtctgacggctgcaccagctcacccgataacccttttggattcccttttgttcctgcttgctaccgccacgactttggctaccaaaactaccgcatccaaaaccgattcacagagagcggcaagctcagcatcgataacaacttcaaggccgatctatacttccagtgccagacatcgagtgtccaaagcgtttgcaatgctcttgctgatgtttactacgctgctgtgagagcgttcggaggcggcgatgcttctcctggaaagcgcgaacaatcacaagaggacttggttaaggtgtatgaagagaagctggagatttacaacaacgccgtgaaggatgcccaggacaagggactgctgcccatcttggagtaaggggataaagcgtactgcatacttttatatgattgacgataccaaatatgaaataaaattcttctaaaaaaaaaaaaaaa

SEQ ID NO: 3947 - DNA, 206 bp, Trichoderma harzianum
agatgttgattccaacgccagagactagctgtgggactgctattaaaatagaataaagatcttacttggcagccgttttccggttcaccaagctgcggagattagatagagggctacatgcgacccttgtacgatcagcgcatatcatgagaacaattctggactcagaattttgacgagaccagttccttaaaaaaaaaaaaaaa

SEQ ID NO: 3948 - DNA, 704 bp, Trichoderma harzianum
ctcatccttttgcttccagcagctatcaagacttgacttaaaaaaaccagtcctcataaagacatctacaatcagtcaccatgcagatcaccaagagcctcatcgctaccctctttgccgcttcgaccgcctttgcggctcccactcctgcggacaagtccatgatggccgctgtccctgagtggacaatcaccaacctgaagagagtgtgcaactccggcaatacctcctgcacatggacctttggcgtcgatacacatctcgccactgccacctcatgcacatacaccgtcaaggctaccgccaacgcttctcaggccaccggcggccccgttacttgcggcccttacactatcacatccagctggagcggccagtttggccctaacaacggcttcactacctttgctgttaccgacttttcgaagaagctcatcacctggcctgcctataccgatgttcaagttcagggcggcaaggttgtttcgcccaaccagagctacgccccgaccaacctgccatagatggaatgaatttgcttggaattactatacgcaaggtcaatttactcccaaaggaacagctggtgataattggaaacgacaatgaatcaggcgaggggggatacgtaccacaaaatttaatggtaatagatgattgactatgataatacactattgattaatgtgaaaaaaaaaaaaaaa

SEQ ID NO: 3949 - DNA, 722 bp, Trichoderma harzianum
cattaaaccgcccctacttgcttttgctctctttgttgttcactcgcagctacaactctcgcccacaatgtctctcaagaatgacgctttcccttcctccgaggccttcgaggccatcaacgccgctctcagcagcagcgaagccgaccgcaaggacgccatcaagaatggcaaggccgtcttcgccttcaccctcaagaacaaggccggcgagacggccagctggcacattgacctcaaggagaagggcacagtgggcactggcgtcggcgagaaccccaccgtcactctgtctctctccgacgaagactttggcaagctcgtcaccggcaaggcccaggcccagcgcctcttcatgtccggcaagctcaaggtcaagggcgacgtcatgaaggctaccaagatggagcccatcctgaagaaggcccagaccaaggccaagctgtaaaaagcgggcattggcaagttgggctgttgattatgggaaaacaggtggaaacaaaccattaaacggcatttttttgtttttatatgtatcataccatcgctgtttactaccactgatgtttactgttttttctttgttccccggccgcaaaagagttcggctagggacggttggttatagtgccttatgaatactggcatagacgagaataccatattccggctggacatgtttccagtctggagttcctttttttactaaaaaaaaaaaaaaa

SEQ ID NO: 3950 - DNA, 521 bp, Trichoderma harzianum
ctcctcgaggcaatattgttttcgaatttccgcatagcgagtggcttcgttggtggtttgagggctggagccccggtgcccagacaatgagatttgtggagttttacccgtgttggttttctttagtgacgtattgatgaacaggtacaacgacttcaggcgatcggcggcgacgcttatttcttgcacgcccccttggatgggtcccgcgagaaccttggtaggtttaaaggaggtagctgtgctccgtaacggggttgttatttataggctagtattaaggagctgaatgacgcgctcgtgtcgaacccaggaaatggaatattcatttttgtgtggtgatggcgacagagagtagggtttggttaccccgaagaaagcaagatcgagattgaagtgtgtatcggcgatttatcagatctaggccgacttgagcatgtgagatgacacgagctaacaccagcatgatacagctggcagtcaataagagacaaagcttgttgtacaaaaaaaaaaaaaaa

SEQ ID NO: 3951 - DNA, 719 bp, Trichoderma harzianum
cattaaaccgcccctacttgcttttgctctctttgttgttcactcgcagctacaactctcgcccacaatgtctctcaagaatgacgctttcccttcctccgaggccttcgaggccatcaacgccgctctcagcagcagcgaagccgaccgcaaggacgccatcaagaatggcaaggccgtcttcgccttcaccctcaagaacaaggccggcgagacggccagctggcacattgacctcaaggagaagggcacagtgggcactggcgtcggcgagaaccccaccgtcactctgtctctctccgacgaagactttggcaagctcgtcaccggcaaggcccaggcccagcgcctcttcatgtccggcaagctcaaggtcaagggcgacgtcatgaaggctaccaagatggagcccatcctgaagaaggcccagaccaaggccaagctgtaaaaagcgggcattggcaagttgggctgttgattatgggaaaacaggtggaaacaaaccattaaacggcatttttttgtttttatatgtatcataccatcgctgtttactaccactgatgtttactgttttttctttgttccccggccgcaaaagagttcggctagggacggttggttatagtgccttatgaatactggcatagacgagaataccatattccggctggacatgtttccagtctggagttcctttttttaaaaaaaaaaaaaaa

SEQ ID NO: 3952 - DNA, 503 bp, Trichoderma harzianum
gacgattcgtagcgattcaacacggcaaatcgtgagcggacgttgggaaatccggaaaagggaaaaagaaacagaacaagatggcgcagggctcgatcaaaaagtccaacaaggccgccgcgccaaaggccgtccactcgaagcgccaggcctccaaggtcaccaaacccaagaagaaggtcaacgccgacaagatgctcaagaagttcacttcgggcatggtagccaagacggaagcgctcttgggcgagagagcgggccatctggagttgattggacccggaaagaaggggagcaagaagctgtcgcagaagggaggatcaaagaagtttggctaaagaaagagcttggaaaatggaggaatgggcgctgggtgggattggaggagagggattgggataaggcgacatattcggactgcgagcgatattgattttttaacaactattctttttcttttttttacgatgacaaacatttctcgataccaaaaaaaaaaaaaa

SEQ ID NO: 3953 - DNA, 584 bp, Trichoderma harzianum
ccgttaagcgtctcttcatggcgccaggaccactggcactctgccagatttgcccaagtgcagctggggggggaggttgttagcatgtcgtctcggtgccaatcacccggtatgtaccaaagggagatagcctctttctttgctggcacggtacagatgaagcacagcaaggccggcgttacgtatgtgtgacggctcatcccaagatttgtgaacgcacacgcttcctcctaccgacgatcgaagccaccaccgactaacctggagtgaaccaatccagccaaacagctgcgcgagctgaccaccaatgcctctagggatgtgagcacgactgaaagatgtgtccatgcccgccaagcagcatgtgtgtgttccaaccgtgcacatattctattcgtgcaaatccaatgggtgcaattggagcattcatcctgcttttccaactggggctgtaacaagttcgtgctgtagaccaagttcatgttaccagtcacggtgtatgctctgcacccaaggtcaccgacaatacacagatatctgcacaaggcgccatctgtgggatcctgctgtgcattagcggccgc

SEQ ID NO: 3954 - DNA, 432 bp, Trichoderma harzianum
gacgagacgagtctggagggatgagacgagacttggagcaaatatggcgttaccaaataagacgcggaggatggtccttggaacaagcactacaagagctcaagagctactatatagatgctatacgcccatctcggaacatttctgctgcagctactgttgctgttgctgctagtaacactgctagtaacgacgctcggcgaaaaccgtgcaccaaaacatatgctactaattactccttacagactactacagacattagatgacagagtagttgattccgaccaacgactggactggattaatcatacgaccacacgagaaaccttcaacatggcttcgatggatagatattgactgtttgtttttgggctctgacttggctgctctcgctaactccatctcaacttaccccacaaaaaaaaaaaaaaa

SEQ ID NO: 3955 - DNA, 661 bp, Trichoderma harzianum
cgatagagccgacgaaccggaatatttgccattcaggcaaacaaagatagcttccccacgcgttaagagattgcagccgcgctaccaggccctcccaaagcttgcaagcactccgtagagacccgtaaacggagatggcacctcccgctccgtgagcgatttcggggagggggaggggaccaaagatcatgggggaggctttttattctatcgactctcgggaagcatctgctctcatcatcccattatcggcagcaaagcagccaagagcccccaccagacggccagaaactcggggtcagccctggcaacctggctcgatttctgtccttgtgtgggcgtgggcgcgtgggcgaagatgttttgagtgatggatgagaattaggaagagaccagggagagcaaccaataagaatctgacgataagcagccctgctgtgtggcggctagtgtgagccttttgggcacatgtttggagattcttgcgcgcccttgtacttgtactccgtagttttgaatggactcgggtacagtacggagctgatgtcgtgatgtttctaaattagataggagacgggcagacggagtaaaggagcgaaattggcctactgcatcgtgaaagcggttatcaagcgcgtttatcgataaaaaaaaaaaaaaa

SEQ ID NO: 3956 - DNA, 476 bp, Trichoderma harzianum
cctcgaccgacgctcggcaacaatggcgacaattgcaagcggcttgcggcatgcgagatgcgcaagctcgattgctgcagctcaatggcggccggcaatcttcccgcggtcgaactttcaactcgccatccggtctataaccagcgactctcaaaagcctcccagtcttgaacttgaagccgccgagtccgtcccgatcccataccagggcgttacgcatgcgcgagttgttccggcgacaccatcttatttctcaagagaaccccagttcaacgatttatacgttggaatctccaagctgctcaccaagtacaaccacctgcccacagtgccgccaagtgaggctccgcaaatgccatggacaaagctggaggagatgcgggcgcagatgggagagcccatcaagtcatcacactatgcgaaggtcatgcgagtggccaagcgcttgaacctcatcgagcccagcctgcggccgc

SEQ ID NO: 3957 - DNA, 648 bp, Poppy
gcagatactttacaatttcgcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgactttgccggtgtggtccgggacgacgtgaccctgttcatcagcgcggtccgggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgatatcgcggccgc

SEQ ID NO: 3958 - DNA, 962 bp, Oryza sativa
tctagatcgcgagcgccccaatcccaccaccgatcgatccattcctgctgctcgcggccaccggagaaggagagagagagagctcgacctcgtcggcgggtgaaggatcgcagcagcagcagcggcggtagagcaggaggagaggcgaagatgtcgtcggtgttcagcggcgatgagaccgcccccttcttcggcttcctcggcgccgcctccgccctcgtcttctcatgcatgggggcggcgtacgggacggcgaagagcggcgtcggggtggcgtcgatgggggtgatgcgcccggagctcgtgatgaagtccatcgtgcccgtggtcatggctggtgtgctgggtatctacggcctcatcatcgcagtcatcatcagcacggggatcaaccccaaggccaagccctactacctcttcgacggctacgcgcacctctcatctggcctcgcctgtggtctcgccggtctcgctgccggaatggccattggcatcgttggtgacgccggagtcagggcgaacgcccagcaaccaaagctgttcgtgggtatgatcctcatcctcatttttgccgaagcgcttgctctctatgggctcatcgtcggcatcattctgtcatcccgcgctggccaatctcgtgcggattaggcatgtttcaacacgcaaacccttagtgggttcttgtttcatattcctgaaactacaagctgagctctaggggtttattctgtcttagtttctgttcttctgttgggtcatgaacaaaaaaacatctgtatccaagggatgtttgcccttgtggtgccattctttttcgctatggtggtgctggcggcggtctgaatcttatttatgcacagtttttttgggtctggctagacagtgatgtaatctggtgaataagcaaataattcgtaatgcaatgggagcatgagactcttttgttcaaaaaaaaaaaaaaa

SEQ ID NO: 3959 - DNA, 374 bp, Nicotiana benthamiana
aagttgtcatccaaaaagaaaacgccattagattgtttacacgacagtctagacctagagtaggatctgtacaggcattaggtgcaatttactcaaaaggcttcctattttttcggaatgccgcctcttttgagctctgtatatctgtcatgttagttatttcattgttgtatcttcctgcctttgaagttttcaaggcacttgccattttagagatgtagccatatttcctttacctccctaaccatttctgttccctgtacaaatgataggcttgtatttgttgtacatttactgtgaatacccttatttattttgatattttggaaaattatcgaaaaaaaaaaaaaaaaaaaaaaaaaaaaaaaaaaaaa

SEQ ID NO: 3960 - DNA, 1781 bp, Trichoderma harzianum
cacaaacacctctcaaccatctacctctttatttatctcattagttttctcatctctcaggacttgactgcttctacttcatattcataagtgagaaggaatagacgcaatggctgagtccgagaagcatgacctcgagaagcgcgagctcgaggacgtcggcgtcgatccgatccgcgactcggagagcaatgccaagcccatgacgcttcaagacagcgaagaggactttggcttcacgcctgaggagcagcgcaagattctgtggaaggtcgacagacgcttggtcgtcactgttggggccatgtattgtgtatcattgatggatcgcaccaatttatctgccgcgaatattgcaggtatgggtgttgaactgaagctcatcaacaaccgctacaatatcgccaatctcgtctttttcaccacatacatcgttttccaacctccttccaccatcctcatccgcaagatcggacctcgtctgcacctcgccttcatcacgctgctctggggcgccgtcatgatcggcatgggctttgtcaagaactttggccagcttgcggccatgagaacagtcttaggcgtcctcgaggccggctttttcccttcttgtgtctaccttctgtctacttggtacaccaggtacgaggttggaaagcgatattccatgttttatctcctaggctgtgtggcctcggcctttgccggcattctcgcctacggtcttatgcaactcaacggccgcgagaacctcaccggctggcgttggatcttcatcatcgaaggcaccctgacctgcgccctgggtatcgccgggtactggctcctcgtcgattttcccgattccaagcgtctgacgtggaattttcttggccagcgtgagctcgactggatcgtccaccgcattcaaagcgaccgcggcgactcaaaggtcccaaagttcaatctgcgaaagttccttggcgctggaaccgattggaagatttgggcgtatgctcttatttttgggttttcgaccacgattacctattctttggccttcaccctccctttgatcttaagacaaagcctccatttctccattggagcgtctcagtgtctcgttgctcctccatatgtattagcaggtattgtcatgttctcaggtgcatgggtgggtgacaagctgcgagtccgtggccccattgtcatcttcaacatggtgctctgcctcatcggactacctattatgggttgggctccgagtcctggcgttcgatatttcggcgtctttctcgtcacggctggtgctaatgccaatattcccgctgccatgtcgctgcaggcgaataacgttcgtggacagtggaagcgtgccttttgcagtgcgacgctcgttgggttcggcggcctcggaggcattgctggcagtttggtttttagagagcaagacgccgctaccggatataagccaggcctatatgcctctattgcttgtgctttattgaacatcatcctcgttctcttacttgaccttgggttttggagggcaaacagcaaagcagacaaggaaggtcttctgcttgaagctcacgatgaggatgctacgcctgatttcagatacacgtattgatgaatctagaggaagatgtgtgaatcaaggtttacgtgtatatgaccaatgatggcaacaaataagttgcgatgctacgtataataattctttctttaaaacgacagtaatgatgataaaaattacatctttatacactactaaaaaaaaaaaaaaaaaaaaaaaaaaa

SEQ ID NO: 3961 - DNA, 1828 bp, Trichoderma harzianum
gctcgttattatcttttgtgtttaatcggttgattgagaaatcatggcgacgactgtgtcggaggcgcccaagatgggcattgagatgatgctggagcgcatcatgggcgcgatggagaagcagaaccaagaattgactgagctgcgaaaagaatgctcagatcttcgtacgtcgaacaagagcatggagattatgctccagaacattgctcaaggacgcagcaatagccctccgggtctctccgccggcatgtctcccagcattggccgcgagcgagcccgctcgcctttcttgcctcgccgctccacagccccccaggctggtccttctcaggtcttaatcacatcgccctctcacgatatcaccacccactcttttcccttcccggatgatcgtgagatccccggattctacgtcgtcatccctgcaggcggtgctggtacccgcctgtggcccctctctcgcgagaaccaccccaagtttctcctcgatgtcaacctttgcggcaacagcttgctgcagtcgacctgggaacgacttcttcctctggctggcccttcacgaatgactgtcgtcgcgggacctgctcactccgagggcattttgggccagctgcccaacctggattcttccaacctattcaccgaacccggccccaaggattccatggccgccatcggcttggctgctgctatcctgctcagacgcgaccccgaggcagtgattggatcctttgcagctgatcatatgatctctggcgaggatgctttccttggtgctgtcaccgaggccgtcgaggtggccaaggaaggctacctagtcacaattggcatcgcaccctctcaccctgccactggattcggttacatccgactaggtgacaaacttggactcaaatcagctccgcactcacgactggtgagctccttcaaagagaagcctgatgctcacaccgctgccaaataccttgccacgggtcagtaccgctggaacgcaggcatgttcgtcaccaaggcctccctcctcatggagctgatgaaggagaactgccccgctctctatgagggtttgatgaacatctctgcagtgtgggatgatgagaccgcacgcaagactgctttggaggaagtttggcccactctggagaagattcccatcgataatgcggttgctgagcccgcggctgcccaaggaaaggtggcagttatcccgtccacatttggtgagtcattgatggattgatgtcgattgttgcacctgatggataaattgtactgacttgcgcaggttgggacgacgttggtgatttttcatctttggccgagatgctgccggctgagtctaacaagcctcgtgtgcttggtgaccagagactggtggtatccgaacaaactgctggaggaatcgttgtgcccgtgtctggccggttgattacgtgtcttggtgttgacgatatcgtcattgtcgatgcccctgatgcgctcatggtcaccactagagctcgttcccaggaggtgaagtcgctggtcaagaagtgtcgcgaggctggatggaagaatttgttgtaatatcagctgggaatatgcgttgatttgcttttcttcttcttcttcgtcttgttttttttacggtttgtttggatgggagagaccagagtggaactcgaccttggcgtatctagcctgatgggcttcttgccagctgccttttgccagctgctaatgtcacgcacatctaaggatatgctgctacgcacgtatcatgcttttaatgttcaattcagttcagatttcaatttaatcttttccaccgaaaaaaaaaaaaaaa

SEQ ID NO: 3962 - DNA, 1404 bp, Trichoderma harzianum
aaggaaacgctcaaaggtacgtttattactttgcacagctgcgagactcccatcagccataagaaaaccaaagaaaaacggggtttgttcatcatgtcacatccaccacctccaggcacgaatctccctgcgcgcccgcccgccagcacatcgaggccgggcttcagatcgagcttcaacccgtcgggccagaattctgccgccccggtatcatcgtcgtcgacgtcgtcgtactcgaatgcaaactccgcgcgagcagccgccgcctcgagctacccagctgcccaaacccactatggctcgtcctactcgagctatcctagccacggtgcgggctcgtccgtgaaccgctctgcttcgggatactcgtaccctcaagcaggcaatcagcagcaacactatccccagcaacaacaagcgcaaagctacgcccctcatgcctattcgcagcaacaaccgcagtcgtaccagggccagtcataccaggctcagccataccaaggccagcagtaccaagcagcaccgcgtatccagaacccttttcctacgccgggtgctgctgctgccgctggacccgattacgacccggacatggctgcccagattgcccaatggcagagcgcctacggcccccgcgaaaccgacaaggacggcaagcccgtgccagcgccagagtacgcgaagcctgaggtcgtagaccgactgcgcagacggacaagaagaagactgtcgttcgagagggcggcggcaagaagtggactgacgacacgttgttggaatgggacccgtcacacctgcgcctctttgttggaaacttggcgggcgaaacgacggacgagtctctcctcaaggcgtttgcccggtggaagtcggtgcaaaaggccagagtcatccgagataagcgcacgacaaagtccaagggatacggcttcgtcagcttcagcgacgccgacgactttttccaggcggccaaggagatgcacggcaagtacatccagagccatcccgttgtcgtcaaaaaggccaatacggagattaagacgaccaatgtcaagaataagggacacaacaacaagaagaagggcggcaacagtggaaatggtaatcgtgggaacgattcaggggctggagggtatgagccgaatcttggtcctcgatcgggttctggcgtcaccaaggctggccagaagacgaaaaatggtttacgccttttgggttaatggagaaaggggagggattggttcttttgatgacatagaacgctggcttttattgttctcgtggtttttcatgtttgagtctacgcattggcgttggggaaagggaggaacattatcaggacatacccgtacatggaaataaaaaaagggattacttcgatgcgaaaaaaaaaaaaaaaaaaaa

SEQ ID NO: 3963 - DNA, 297 bp, Trichoderma harzianum
ggcgcccaggagcaatgtctcagggcccaacgaatgtgcggtgaacgagctgctactgcaccgccgattgtctgatgcaagcaagggagttgtttgtttgctccatccttgattcactttaatgcttgttattaggtactttaagagccaggttgaaagggtactttgcaagtgcttaaatctccattctgccttatactccatgcctgtaattgtatagtagcaccagggtaagccagcaataccgcaagctggcagtatcaatcgccatttttctctacaaaaaaagaaaaaaaa

SEQ ID NO: 3964 - DNA, 1488 bp, Trichoderma harzianum
agctcccggcagcttggtgacacggaaggatatatgattcaattccaggcggagcccgaaaagtatgatgcagccgtgaactggcttcgtaccatgatgttcgattccgtctttgacccagtccggatcaaggccgctgttatgaaggcattggctgacatcccagaatcgaagcgtgacgggcgcagcatggccgcggaggtggacacagctattcacatggaaaagtctactcttaccgttgccagacgtgttgttgtcaaggcagtttatctcaagcgtctgaagaagctcttgaagaagaatcccgaccaggttgtggagtggttcaatgaaatccgcaactctcttttcacatttgagaacatgagagtccttgttacggcagacttgcaaaggcttcccaaccccatcgccacttgggatgcgctctcaacagcgctacagtcgcagaatggttctatggctcctattccaaagccatcgagtcttttgaacgctgaaggaaaagcccccggttctgtgggtgtcaccatcatccccatgacagctctagacagctctttctccgtcagcaccgcccctggcctctcttcgtttttagatcccaggctgcctgccattactgttgccggaggatacctcgagtcggtagagggacctctgtggaatgccgttcgcggtgccggatacgcttacggaaccttcttcacgcgcaatgtcgagagcggagtcatatcctttaaagtgtaccgctctccggatgcgtccaaggccatcattgcttcacgggatgctattcagaagattgccaacggcgacgtgccaattgacaagcacctcctcgaaggtaccatcagccaaattgtggtgggcttcgcagatgagcagtccactatgcctagtgctgcccagcagaatttcgtccagagcgttttcaaggggctacccaaggattggaacaagattattctgaagcgtgtgagagaagtgactgaggatgagattcgccaagcgctcaaggatttcatcatgccctgctttgagccgggcaagagcaacgtagtgattacgtgcgccaaacttatgcaagaggtattgtattattccattcacctcaagttttaacttgttatatgtatgaagcatgctgaccattatctgcttagggtattgagactgcattcaagggactgggctacaaggttcagactcatgagctaagccacttccacgatgactatggtttgggtgctggcgaggacgaagatgaggatgaggatgaggatgacgacgaagatgatgatgatgaacttgatgatgaagaggggagcgaagaggatgaagatgacgatgacgatgaagactagatatctaggtttagatggacgcaatgtctagaggatatgttcgtataggataacacaggcaactaaatgatttgacaagatagtaagaagacacatttgtgaaaaaaaaaaaaaaaaa

SEQ ID NO: 3965 - DNA, 654 bp, Trichoderma harzianum
gctcctctctcattgccccgatgccctccatcgcttgagcgtatttgctgtccccaaagctgtcggtgatgagggatcgtataatggctcccatctgctttgtcgcctctgcaatatgttcgacctcttctgacgagttcaaagctcgcttgaaatcgggaattgcattctcaggactaattgaacccttcttttcttctcccaaaagagcatccacatccagccccgagatgggcttgaccgcttctctttgacgtttacctttagccttgggtggtactaaggagacattagcacattaaatttccagtgtctgggatgcttgtaataatcacctttcttgacatctgcagcctggactagagaatcaatcttggcctgcactgtttcaatcagttccgttggaggagctgcaaatctcagcaagactggggggacttctggtattggcctttctgggtggactgctcgctgcttgatggcatgggtgatgcgatgtattgcagggttatatatttcatcaatggtggcgtattcggcaggctccctgacaaaacgagcaagattagcgatggaaacttatctgaaggggctatctccatatactcacccatcctcgtcaatgccataatttgatataaaaaaaaaaaaaaa

SEQ ID NO: 3966 - DNA, 414 bp, Trichoderma harzianum
gagggccggactaacacggaacgagacagggtgtggatgagacgtcgagcacgtgtaccaccacttttgggcagcggaagtgcgggcgcgggatacgtaagattgacggggttttcgaggtagtgggaatggtgtgtctgccaagagaattggcgtttgaatagaggcaagtggtttcttttttctggtgacaaatgaggtgcggggttttgatatgaagatgatgaggattgtggtgatgccggagatgggcttgggatgtggtggtttgatgaggtaccctggatggtgatatttgagattgggaggctcgagatgggggatctcagaggaagcaaaatagaaatagaaacggacctcggccgaaagtaacccaaaacacaatctatgacggttaaaaaaaaaaaaaaaaaa

SEQ ID NO: 3967 - DNA, 790 bp, Trichoderma harzianum
gcaaattggacatacacgataatgcaatcctcatccatggccagcgtagctttcttgactactgcaaaagtaaaggacgatgagacaaaggaggttgtgaatggcttgcaacaacttagtgcccatctccaactccccaataccccatgtctagccggagcctgctttttgtccgcggccaagaaggaaacgggtatcaaactcatcggtcgcttggaaatatttcctagtgaaagcgaacttgctactgttcaaaactctcctgaatataagcgtttcagcgactcggtcaccggccaaaaacttcacgaaggcaaggagactgccactttatggcagcccaccggcggttttctgacaaggaagaaccaagcctcgacaacaaaggccggtgtacttgttttagccaagttcatttgcaatgataaagagaacgcagttcaaaatctcgtgaaagagttgcaaacatattgtgagtggatcgagggcaacgagctcacgacatacacatattgcgtaatgacaagtcaaactgcaaataaggaagttctgctctttgagcgttataaggatcttccttccgtcaagacccatggccaaacaaatgagttcaagtctatgttcaaacgaatttcgccttggattgaaacaaagcgtaccgaaataactccatggagcgaattagacggttctttcttctcttccctagacttagaagccacagcgaagctctaaagatagctctatattccttataattttgtattttttcttctgaaaaaaaaaaaaa

SEQ ID NO: 3968 - DNA, 1441 bp, Trichoderma harzianum
cgctacggcttatttactcttctgaccggaggtctcggtattgacatgaccttggagccatcgctgccgcaacgaaatggagtactcgtacatgtagccgcagtctcttgtccatgcgagcgggcatttcgtcggcgtcccaatggtcaccgcgagacctatcatttgagatactgtctatcttcctgcatgttggctgtacgagacgaacgatatgacggctccctgcctttgatttctatgcagcagtagccaaaagagaaaaggtgtaatatgcagcaaggccgctatgttgccaccccacgagacctcgactgcatgcacgtccagcgatacgtctccacgaggccgcgcatgaccgctgtgtcgagagtggatggactgcggacacctctctgcttgcaacggctcagcaaattttgccgttgggccaccgaagccaaacggctcaccgtctacgcaattggcactctaaatgctcctttccgcagccgccttgctttcaatacgcgtccacaagcgtttgtagcccttgtcaggccgttgcggttgcccgcgtaccaccgcccagtggagaacaagcgttctcttgtcatttttcttgtgccttggaggtcccacagtctgccgccaaccctgttcgcgtctgttgcggtttgttttgcgccactccgtgagacgtaacaaatcagaggcctggcctaaccaagtgcatgagaagaacctggcaaggtctcagtcttgtggaacgtgagcggcacggcgatagcatttggcgccccttgtcgcgctaccggcgtcagaatggggagacgctgcacggagcgcatggaggtttgtggagatgaagcatccgatagtgacgggggacggagtactccggatgcacaagagctcgctcactacgcgaggcctagacggttctccacagcatcccgactctgcagagaaccagcggtgaacagatgatcgaacgatctattcttggagagagagcactgactatgataccaagcaagctacgccatggagcggagtagcagcaatgagttctccatgcatctcaaatctcgtcaatggcaaggaaagcggaaacgcggaggagcaccttcatgagccgggaaggggtctcgccgtttgttgccattgtctcatcagcttcttattccctggccttatgcactagcccaagcatatacggttgcagtgcagtgtggctggaactttggcaggctgaattccctgttccaaggatgaaggaaaagccaacaaagtacgaggactaatccgtatcttcttgtgcatcatgtagcgcccaactacctacccatcaaggcttcccctgcagttggctcctcttgttctgtgccagtcaaaaatagtacctactcagctgaatcgaagactcgatgagagcttctgctgcaaaaaaaaaaaaaaa

SEQ ID NO: 3969 - DNA, 553 bp, Trichoderma harzianum
gctccttctaccaatttaagagagcggagactttatgttgttggcggtgaatggctcaacatcgaagctctaggcgccggaggtattgctcctgttgcaagcttggccgcaaatgggaaaacttttatgccgggctgtttttttccggtttgtcaatggggccgtgcgattacctaagatgaggcagagcagcggcggcttcgagtttgaatttacaagaaacatggattgtgctcggagtacgccgtggtatgtaggatggtctgtggctgaggtcgtccagcttcaggtgtttatatatggctttaccggcagatttcacaagctcaatcgacttttggaaagtgtgtttcaggctattcttgaactttatactcgacgtataagtctggctaagagattttgctatttcctatatcattatcataacatgggcatatatgggtcaatggatggtaaatgaaatttgatttgtacgggataaataacagacaccgtccatacgaaataacgctattcattggcttaacacctttcgaaaaaaaaaaaaaaa

SEQ ID NO: 3970 - DNA, 2048 bp, Trichoderma harzianum
cccggattaggtttctttcattctttctttctcccttcctctgccgagctcgacgaatacccgcctcgaaccgaatgacgctggcaatatcccgttcttgattccgttgcctctttgtcctccgttgtgccccgcaaaacctgcccaacgcgcttcctcatcatccgtgcttcgcgattttctaccatcgacgcctgaggagacataatttcacccaagatgaaatccatgaagggcctttctatgaataagatgctggggagcatcaggaaaaagaccagtagcacagatcgttcagctgccacgacaccaggggacacccccgaagtaacggcccataacagcgtgaaagcattttgcgaatctggcggaaccgcaaagagcgaggaagtgcttttcctccccccgattgtcgatgccgccgagtcttcacccaccgccgctgccgaatgcgcacgcatcatcaggaaatacatgtccaaggagtattcctcgcggccgtcatggcagtacaacgccattatgctgatgcggatactggccgacaaccctggcgagacgtttacgaggaacctcgacaccaagtttgtagacacaacgcgggcgctgctcaagggcacaaaggacagcagtgtgcgccagattctcatggatacgctggacgactttgaacgcaccaagttttacgacgagaacttgaccctgattattacgctgtggcaggaggaaaaggaaaaggcgatcaagcagcatggaggtcgagcacctacactaccccaacgccctccgcagtcagcgccgcctgataacgggtattcacaaaactacttctctaggcatcacagcaaccaccggctgcccgaacccgtcgagctgaccagtcggctggaagaggcgcggtcttccgcaaaactattggagcagcttgtcattaacacaccggcagtggagttgcttgagaatgagcttatcagggagttttctaaccgatgcctgagtgcttcaaggagcatccaaggctacatggtgtcgaccgatcccgcgccagacaacgataccatggagagcctcatcgacaccaacgaacagctgcagactgcgcttagccagcaccaacgtgctatacttagcgcccgaaaacagcttggtctcaacgagcgatccgagaacccatcacccgcccctgagcagcaatcacttcacggttctaatggtgttcagggatggcaggtccccaatgcatcgtcatctagatccagccccgcccctcccactgtctcagttggcaacggaaagggcaaagacaccgacctttatagccctccgtcgcatcctccaccaaacaatggcaagcaggtagacccgggccgcggcagagctcccccccctgagtccgagcctctggtagatccattcagtgatccgcaaccaggtggtgccagccccaatggtcatctagccgtcatggacgagcctttccaccctggctttgggttgaatagccatcgagatggctcgtcaacacacggcaccactggatccggtgttgcttccgagaatcattcgacacacaatttacagcctgactaccaagtgtcagacgacgaggacctttatacttctcctccgaagagcagcaaggagcccatgtatcgatactgattaagcgaattgagagcaaatttcgagtagaagaacagggatttaaacacgagtatatttgcagatgggtatacaccgaaaatcgcaggagcgtttgggagacggaggattcctttgttttgtttttatatatttcccagcactttacggtgctagttaggcatcgtttggctataagtctccgttttccttccaaataaccagatccgtttgctattccccttttttatgacgaaatcccactttaacgttgagcaagcgtgagagcgatcgatatctttttgtatttattacatacaaattcgcaatttggcaagtcaaagtagcgtcgagttgatagtttcttaacatcaaatcacgtttgttgcttgagcaaaaaaaaaaaa

SEQ ID NO: 3971 - DNA, 300 bp, Trichoderma harzianum
gtatggggggcttcaatcaatcatcacttttgggattaatgggcgttactggacacactacaagcgcggtgcactgatagactttgctattttattatttttttaccatcatttgtttatttctgtatatgtggtacatattctggaaaggggcggtaggggtggaccttgggtcggggatcaatcgataatgggagcgtgacgaagttacggaaacggaaccgaagcaagcaaacagagcttttgaaatagaatgatggcaacaccaatgccactcttgaagtaattcacaaaaaaaaa

SEQ ID NO: 3972 - DNA, 1586 bp, Trichoderma harzianum
tctacatcttccatattggggattgcttgcttacaggtcatcggccatggctctctttggaaacagagctcgcgctcctgcgggacaggccccagcagccaacactacgactacgccgacgacgacgacaaaacggagatggggactcggccgtggtggaggaggatttggccgtggtcgtcaacacactccgtatgcgatgcactcgcgtcctagctttgggcaatggctcagagtcacttggttggacatcttgaccatggtagctatgggagccatcggcctcggtgtctacgaagccaaaccagcgcctacacgctcgttccccgtcacattttccgatggagaaatcgtctggcctgaattcggctaccctcttcgaaaggagattgttcccatctggctggcagctttcctcgcatccatcatccccatcttcatcatcctcgtcatgcagatccgcatccgctcattctgggacgtcaacaacggtgtcattggtctcttgtactctctcatctgcgcagccgtgttccaagtgttctgcaagtggctcatcggaggccttcgcccacactttcttgacgtgtgcaaaccggatctgagccgcgtcacaacttcaggactcgacagaaccggattccagcagatctactttacgcgcgacatttgcaccggagacccagaccagatcgacgacagcttggagtcgttccccagcggccacaccaccgcggcttttgctggcttcgtctacctctctctgtacctcaacgcgaagctcaaggtgtttgccaactaccacccggccatgtggaagctcattgccgtttatgcccccatcctcggcgcggtcctcatcggcggtgcgctcactattgatgagttccacaactggtacgacgtcatcgccggcgccatcattggtactgtcatggccttttccgcttaccgcatgctgtacgcttccatctgggactggcgattcaaccacatcccgctgaaccgcggtgttgccttcccgtataccgtgggcaacggtgacttgttcgattcaaccttcacgaggcgtgttggatggggaacggagagctttgctggaggcactactaatggtgttggcaacggatatggacaccatcatggcaagcatgaatacggatataacaacggcgctggatataccaacggtgctggccacactaatggcgctggatacaccaatggtgctggtacggcggccaatggagagtatgcgaacccgacgatgcctcgacgagcagttggacaccctccggagcagatggtgtaagatgttggcatgggggttttacaccactcgttttgtcaatgtctgcttcttgagaaacgtttcttttcttttgtgttgaatgagagattgaaaacttgggcgtactgaggtgttgttcgtgttattattgcatctggatatgcgtaatgagcaatgatgctaatgagggcgtggcttttcttacacggttaatgttttataatacccgcagttgaataattagtatacagtccgtttgtgtaaaaaaagaaaacatttctaatgaaaaaaaaaa

SEQ ID NO: 3973 - DNA, 1190 bp, Trichoderma harzianum
cccacgcgtccggcgtgaagataggagagaatagagatagagaggcaattgcacggaatgtttagccaacaagttgctcgtggcgggcgccgcatcggccagatggctcgaggcggccaatatccgtcactcgctgcgctcagaggagctgctcaacgacgatgttatgctgaggctgcacaggcagcccccaagggacgtatcggtcgaggcctcgggctgctcctgtatggcgttgcatttagcggcctcggagcagcagcaacattctattcgatggtacaaaagggtttcgcctcgttcaccgacgccgagtcagccaaactgtttgtcccagatagcgacgagctgcaacaaatcgaagagacaatcaacaaacacccgctcgtccaagagcttcgatcacgaccagagttcaaggagtcacgaccacacctaaagatgtcaagcgaagtccgcagccgcaccctcaccggcggcgctctacaaggcgacggcatgatcatggtcccccccgtcgccttcatcgaggacggcggcaagtccatcgtcagcgtcacgtacattggcgacaaactatgcggccacccaggcctcgtgcacgggggcctgctggcgacgatgctggacgaggggctggcgaggggctgcttcgacgcgctgccgcacaagattgccgtgacggcgagcctggagatcaactaccgcaagccgacgcaggccaacagcttcctggtgctgcgcggcaagacggtcaaggtcgaggggcgcaaggcctgggctgagggatgcattgagacgttgcctgcgccgggcgagaagccggtcgttttggttgaggcgaagggattgttcatctctcccaagtatgcggcgctgatgccccgaattacctaaatgatacatgcggtggagtataatggcgagatgagaagacgagcgcatagagctgcgaagtttttgttttgcacccatttttctatgtttactttgccctttttgacattttttggaaagcgacggcgggaatagattatacatactagaactgcacatattttaacagcgaggcagtagacgccgtgctagaaagcagagaggagattgcttgttcgtctttgcagcagatggagctgagccagatgggcgctttacatgatatacctctagtaaaaaaataaaaaaaaaaa

SEQ ID NO: 3974 - DNA, 469 bp, Trichoderma harzianum
acagtagtaggtgagtatgatgatacactgggtcaaacggatgttgttaacactagttacctgtagtggcgcttgctttttacttacttgcagatattgtggttaagcagaatcccaactctccagtgcaagacactctgtcaggttcaagcccaatttccttccgctgctcattggcaaactcacgaagctcgccacgaatctcatttaccacgtcccacatatgcactagagattcgtaagtccgattgtagatacgatcagcgcaaagcgatacaatcttcattagcttcaccaaggccgccatcatcttgtcatctgtgggaacaggtatatccaagccgagctcggacatagacgtctggcgcccaagaataaagcaaacccatcttggcacaccagtcaagttagttatttcatcaagataaaaagacattgaggggcactcacacttccccaaaaaaaaaaa

SEQ ID NO: 3975 - DNA, 1314 bp, Trichoderma harzianum
aaattctaatcgaacgacgctggggagatttcaaccacggcgttttcccttcccacatttcgccaatggcacgaataacgaggatgcggagactgcagtctctgcaattggccatcccgtcacaatgcgccgcttccagaccttctttcgccgctgcccgcgccatctcgacgaccggccccgcgcacagcaagaacacggaatggatccggggaaagctctggaagggcgaggcccccggcccggctgatccctatacgcagaggatggagcccgaagcccagtcgaatctgcccgaggaggcactcgagagccgggcgcgccaggataagacgcccgcggccgtggaagagtccaggttgactctgcccgcgaggaggactgaggcgacggcggagaaggaagtgcaggcggcagacccgtcgtatgtgcccgctacggatgccgaagggctggaggagattggggcgttgaacacgtggtgggagcagccaggacactggggcgacgagagtgtcttcaagggattcggcagcgcggacaaggttgtggaaagggaagtcctggaggttcacctgcgacgagccgttgttgaggcactggcgctgcagcagacgggagtcttttcagaatgggctacgaagaagtggtctgagggaggatccagggacgagttggaccaggcattggccgtgcaggttgaggtgcaggatggcaaggctactttgaagggagacgcttcatcgattgtggaagttttgacgagcgaatctcaagaggtcgaatcatcgacagttgtgactgtcgaagaggcaaaagagatgatcaagtcatgggattcttcatggaagaacattacgctggatgactcactacgatttgcgctccgcaagcgcctctatcaactcaccggaatcctcatcccagacgccaaactcgccgccgccaacaccgccaagcacatcctgacccttgcggccagagaccccaagccgctgaaactagcccagatgctcgagaagcgcaatgccttcaacgatctggccaacgtcagggtacacgagcgcaagattggccccatcgacaaggaggttgccgtgggacgctggaaggtgattgaggaggagctgaagaagcgtgacttgccggtgacgggctacggaaacgcggcaaggaacaaggagagggattggttgactgggaagatataaaactcatgatttttacgcatagatggggctggagaggaggaaaaaaacaatgtacgaatatggcatgtacaacagcaatgacaaaaaaaaaaaaaaaaaaaaa

SEQ ID NO: 3976 - DNA, 555 bp, Trichoderma harzianum
gtgggttctgcggtgccacggctgcttcaacatcaccaaggacatgaacaagcagttctgccccaagtgcggccaacccaccctcacgaggacaagctgctcgacggaccagcatggcaacttcaagatccacctcaagcagaactttcagtggaataaccgcggaaacgtgtttagcgtgcccaagccagtccacggcagcgccaacggaagacttcctaagaatgtcggtggcaagaatggctggggcagggacttgatcctggctgaggaccagaaggagcacgtcaaggcgctggatgaccagcggaggcagaggaagaaggatttgatggacgaggatttcttgcctggtctcttgacgggtaacaggtcgggagcgggcggcaagatcaaggttggtgcaggacgagctgtgaactctaggcggaagcggtagacggagagaggctggttacggttgttatgaaaaagaagataaaaaggcagatatagaagtgaatatccatcatgattgtatgactttaaagaaaaaaaaaaaaaaaaaaaaaaaaa

SEQ ID NO: 3977 - DNA, 1248 bp, Trichoderma harzianum
tataaatagtagctgcttgttgtgaagcactgctttcatcaaaacaagtactctccaatcacatctggtgttcgaacaaggtcaccacccaacaacatttcgcatattccatcaggtcgatcgattcccaagtccgacaatcaccatggctgacgaaaccgtcaacatcgctcccaatgagaaggagaccaacggtgtccagcagcagacggcggtaccgcgccagggcttcacacacaaccaccacagcgacttcaatgagatgaccattggccagtatgctcaggcttttggtggtgctctccaacccggggcatggaggccatatgagcaccgcaagctcgccaaccccgcccctctgggtctttctgctttcgccttgactacctttgtcctctccgccatcaacatgcacgctcgaggagtctcggcccccaatgtcgtcgtctctctcgcctttggttatggcggtcttgttcagctgcttgctggcatgtgggaggttgctgccggtaacacctttggtgctactgctctgggttcatatggtggtttctggatctcatacggtattctcttgacccccgaatggggcatcacggctcctgatggcccgtacgagggcaacgttgctagcgtgcttggcttcttcctgactggctggttcatcttcaccactgtgcttctgctctgcaccctgcgatccactgttgctttcttcctcctcttcttcttccttgacctggcctttttcttcctcgccatggagcaatacgctgccgacttgggcaacgcgaccgcttccctggctctgcagaagaccggtggtctctttggtttcttggctgctttcgcggcttggtacaatgccttggccggtatccaggacagcagcaactccttcttccaggttcccgtcatccacttcccctggtccgaggccgctcgtgagcgccgtgccagcaagtctgagcgtgctcaggcataaatttcgtctttggaagtgtgatctgttcttggttatgatgagcgatgttgggaaaaggaatgatacctgagtgaagcgagcgcgcggttcctagcgggctgggctgcgagtaagaatgaatacaactgggccttttttctttttttatctggttaacaaacgttattgcgatgtaatacaggaagctgcataccagctgctgatatacctattaatgaaactgacgtctacgtcttctgaaaaaaaaaaaaaaaaaaaaa

SEQ ID NO: 3978 - DNA, 381 bp, Trichoderma harzianum
caatttacaacagcaacctaagcgcacctagatatcatggcggacaacactaaccccggaaactttgccaaccgccccaaggaggaagtgcagtcgattgcatccaagggtggacaggcgagtcaccagggcggcttcgcttccatggatcctgacaagcagcgcgagattgcgtccaagggcggccaggcctctggaggatcttttgagcccggaagcaagaaagctcaagaggcgggccgcaagggtggtttgcagtaaagcatgaccgtaactctagtgtcgattcactggtagacggtgtgattatctcttattgtagataaacatacactagcaattttgctctaatacaaactaattggtcctaaaaaaaaaaaa

SEQ ID NO: 3979 - DNA, 1069 bp, Trichoderma harzianum
gcttatcccccaggttggtggcaatgcccgtaagaccaactatgactacaccaagggcaagctcaacgagcttaccgacatcatcatcgagtccggcgccaagctgttcgtctccgccgtcggtgttccccccaaggccatcgtcgacaagctgcacaagcatggcatcctgtacatgaacatgatcggccacgtcaagcacgtccagaagtgcatcgacgtcggcgtcgacatcatctgcgcccagggcggtgagggcggtggccacaccggtgatatccccaccaccgtcctcatccccgccgtcgtcgagatctgcaacaagcacaagtcgcccctgaccggcggccccgtccaggtcatcgccgccggtggcatccacaacggccagctactggcggcctccctcatgatgggcgccggcgccgtatgggtcggcactcgcttcatcctgaccgatgaggccggcgcgcccaagtcgcacaaggaggccgtccgcaccgccggccacgacgacaacgtccgcaccatcatcttcaccggccgccccatgcgcgtccgcaacaactcttacatcaacgactgggagaccaaccgccagcaggagatgaaggagctcgccgccaagggtgtcatcccctacgaggccgacctcgacaaggtcctcaacggcggcgagaagcccaagattgagggcatccagaccagtgccaacgatgacgacgacgacgatcctcttgagcagttccgccccttcttgatgggcaaggctgccgccgttgtcaacgagcagaagcccgccaaggctgttgtcgaagagttcattaccgatgccgttgcctggctgaaaaagggcaactcaatgctggttggcccttcatccaagctgtaaaaatttgagaaacgaaaactattttccttgtttttttcttcggtcttgttttcacgaagccctgtcatatctccttaatgttttcatgccactccatgtagactattcagcatataaatgttcataattagcctatatgtaccaacaaagcaaataaccgtcaaaaaaaaaaaaaaa

SEQ ID NO: 3980 - DNA, 1198 bp, Trichoderma harzianum
aagcttctgctacatcgccaacattctgttttgattataacgatctgaatgcctacctcctcaccgttgtgggtgtttctcggcctgagagcgatcaagccacgctttttcatgacatcatgaccaaggctcaagggggagctcgtatatcacttcgcgagatccagaccttgtgttccagagaagccatcgtcaaattggactcgggtgtgaatctagctcaagctatagaaaagcttggtagcggaatacacagaatcttggttactgaacaagctgggaatgttattgggattataagccaacttcgcatggtggagttcttctggaacgaagggatcaattttcccaccattgaccgacttaatccagtcacgctacaagagttaggaattggagtgcggccgataatctctgtccacgccgacgctcctcttactgaagctttatcgctcatgtatgatgagggcctttcaagcgtagctattgtagacaacggacaaaatgtggtgggcaacatctcaacaaaggatgtgcggcatttgacaagctcctcgagtgcatatttgcttggtaactcttgtatgcacttcatttccatcattctaaacgaaaaaggggtggaaaggggacaagatgtctatcccgttttctacgtaaacccttactcaacattggcacataccgtagccaaattggtagcaacaaaatcgcatcggatgtggattgtggatgcaggaccacaatcgtcacctatgtcaacgcctacgacaccaatgaccacatcacagacttctatatcggcggggacagttccaggaccaattgcatctgctgtgcctgcagtcacagttccggcagcttcgatggccggggctctgttgtcaggcaaactaatcggcgtggtctcgctaacagatattctcaacatatttgccaaatctacaggattgcacccctctgagccatgggaacagagagtacgccgccgacgcagctcgagtagctccgtacggcccagcgtagagtctttacgatccagtgtggaaacaaggaggtaacttatggtgatattcgagtttaattcgtggaagactttgaggctattcttgacacaggcgttgcacaaatgttcataactcctgataatgctaaatacgatgtaattcatgaagagtgaagcaaaaaaaaaaaaaaa

SEQ ID NO: 3981 - DNA, 470 bp, Trichoderma harzianum
cccacgcgtccgaacgattctcatcaaagaacaaacgcatcgttcaagatgagagccaaatggaggaagaagcgcgttcgtcgccttaagcgcaagagaagaaagatgagggctcgctccaaataaacgactcgctctaccacttgacttgacacatctttcacattttgaatgagttcacgataaaacacgacaagcaaagctgctgcaccacggtaccactctatgaccgattacagccatcaagttggaatcagcatattggtgcgcctctccaattcagctacgggagtcaatggacgaacgcgagagatgaggactggacaatttcagtcaggtggagacatcgttttgaggacgcgaaggccatgaagcaaaacgctgctgcaagaagcacgcttaggatcgatacgttgcttgacaaagatcaaaggcagaatttacttcatttccaaaccaaaaaaaaaaaa

SEQ ID NO: 3982 - DNA, 863 bp, Trichoderma harzianum
ccttgcccagccagaggcccttcctcgcgtccacgagacacggccgcctcctcaacacgatgccgtacccaagccgatggccccaccgcaggttgaagctcagtcgccttctccaacaacctcctcagttcctccatctcccaaagccgccgagaccgatgcgcaaaagacacagcctgctcccgctgctcgacctcgttccaagcttcgcgcgcgcaaggccgcaatgaagctcacacccgccgccgtggagcagctgcgcgcactgctcaaccagcccgacccgaagctcatcaaggtcggtgtgcggaaccgaggctgcagtgggctcgcataccagctggaatacgtcgataagccgggcgctttcgatgaactggtggagcaagacggcgtcaaggtcttgattgacagcaaggcactcttcagcatcattggcagcgaaatggactgggcggaagataaactgagtcagaagtttgtgtttaagaaccctaatattaaggagcaatgcggctgcggagagtcatttatggtctaaggagcttgtgaagctacaaaggaacaagacaaaggccatggcacatgagaatactaccaaggccgatgtatggagagattgtacgatgacgactagaaagaaagaatattagggcgaggcaagtctctcaaatagatacgcctcagcccaatccatgaaatggtttgattataatggtgccgatacaagcacgttacgagcacggagcaaagaggcaatagcactataggggcatgataccggcgttaggttagaggcacatgcggccattgatcgtataaatgttgaatttactattctgaataaaaaaaaaaaaaaaaaa

SEQ ID NO: 3983 - DNA, 1530 bp, Trichoderma harzianum
catcatcgtcctctcaatctcgttcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctgggaatcggcgcctaccgagataacaatgcgaagccatgggttcttcctgtggtaaagaaggctgatgagattctccgaaacaaccccgaactgaaccacgagtatgccccgattgcaggtatcgagagcttcaccagcaaggctgcggagctgatgctcggcgccgattcgcccgctctcgcggagcgccgcactacgtctatgcagaccatctcgggaaccggtgccgttcacttgggagctctgttcctcgccaagttttacaaaggcagccagaccgtctatgtgtcaaatcccacatgggcaaaccaccatcagatcttttccaatgtcggcatcaaggtcgcccagtatccctacttcagcaaggagacccgggggctggactttgatggcatgaccgctgccatctcagcggctcctgaaggttccatcatcctgctccacccctgtgcgcacaacccaaccggcgtcgacccaacacttgatcagtggaaggagttggccgtcattatccgagagaagaagcacttccccttctttgactgtgcctaccagggctttgcctctggcgaccttgctcgagacgccgccgctgtgcgttactttgtcgagcaaggcttcgagctcgtagttgcccagagcttcgccaagaactttggtctttatggagagcgagctggctgcttccacgttgtggctgctcctgccgctgatgccaccaccacaatcacccgcattgcatctcagcttgccattctgcaacgatcagagatttccaaccctcctttgtatggcgccagaatcgctagcaccgttctgaatgacgcccagctcttcgccgagtgggaggagaatctgaagaccatgtccggccgcatcatcgacatgcgcaaagctctccgttccaagcttgaagagttggagactccaggaacctggaaccacatcacagaccagatcggcatgttcagctttactggcctatcagaaccccaagttctcaagctccgcgaggagtatcacatctacatgaccaagaacggccgaatcagcatggccgggttaaataccaacaacattgaccatgtggctcaggccatccgaaaagtcgttggtgagactcagtaatttgtatgataatggtttgatagatgggcttcgaggacgtgacgataattatcaccgccgctggccaggaacttgcgttgtttcgattagtgttcttttttcctttgtattcgatagcacatgggtgtgtgggcatagatgcagctagacaaatagcaaatacggctttgagggcctcggggaaaaaaaaaaaaaa

SEQ ID NO: 3984 - DNA, 698 bp, Trichoderma harzianum
aaaaaggtttgaccttggtagaccaaagatcgcccacttctcgagatgacatgacggcaaaccaggctctagtggagtttgcttttaagaaacgacgaagcaaggcgaaggtgcaggccaggcagcatctgcttacttgcctccaattcgccgctcgggatggattgcagcaaatgggctggagatggcttgcccccgctcttggacgcgttggcacatgcgtggcacgatagaagagactcgccttgcaaggcattcatgcattcggaggagaagaatgtttcatctcgattggatcccagtcggctttcttttcattttggcgtgattgccttgtgatttttgcatcagctggagtagttgaagctgcgtcatagcttcccagtgctgcttggaggctgccacaacacaactggataatgcctgctgtcagtaatgggcaggcaatcgttgagggaagctcaaaggatatcagtcgtcaattggagaggttgttagggcaaatgatattcaaaaccggtgattagacaagccatgtataggcgatggttttttggtcagtatgttggatttgtttggatgtgccgaaaatcggccaaagggaaagaatgtgcggctgaacgcaacactggtacttgaacaagagcctaatcttcaaccttgtaaaaggcatacaacttcaccaaaaaaaaaaaaaa

SEQ ID NO: 3985 - DNA, 1756 bp, Trichoderma harzianum
cccacgcgtccgcccacgcgtccgggatcttggtgggcaccacgacgttcttctccatcctcatcttctcgatcaacactgtctttgctcaggaaacactcgcgcagtggattggagattacctgactcaatctgctggtgttacggttgtcttcgaatcagccatagtgcccaagtggaagaatggcgttatcgcatttcgtaatgtgtttatttcaagaagacccgggcagatcgaatcatccgtcagcaagggatcgtctgacgctgctgctgttgctgccgcagggcgccaggttcagcataacgggactgttaccgaagacgatggcaactatacgcaatttgatgtaacgatcgcaaacgtcaatgtcacactttcattcctcaactggtggaatggcagggggcttctcaaagatgtggaagtaaatggtgttagaggaattgtcgatcgcacctctgtccgttggccactgcagcaaatcgaccccttgtcttaccgccacaaacaccaaccaggcgattttgagattgaatctttcaaattggaagatcttttgctcaccattcgccaacctgatggcttccgccccttctcagtgagcatatactcctgcgaactccctcgactgagaaaacaatggctcttttatgatttcctatctgccagccatatgtctgggtcatttgatggctctctctttacaattcatccgcgacaagttcacggtacggtttcaagtcgataccagggagtcatgatggggctagaggaatccaagtcgtggaaaaaattcaaccggctacggattgatggcttgaagattgaccacctaaaccgtggagtggagggcccatttggctggatctatgaaggaaacgttgacatcgttgctgatgtcatgtttcccgaggatatggacgacagcattaccaaggtcgtaacggatttctacgaccagctggaaggcacagttattgctaatcgttatcgctttctgccccgagcccctacacccgagaaattctcagagagcgagcgcgcaacgagcgagaagaaggctcagaaacaagccaacgagtctgaggaggatagacgccttgtcatcatggacttgcgtattcatctcaatgacgtcaaggctgccgtgcctttattcacccccgatctgtcatatgtcaaccaggcgcttgttcgccccattggtggcctatatcaatgctaagaagacgtacattcccatctctagccgcatcatcaagccgctaagcgactttgacggaagttggacagtctttgattgcgggctcttggatgatgcatctgccgagacgtatgaggcttttgcaaaagatgtcgaagatcagcaaagccgcgtcaggcgattccgaaaggttggattctggactttgtcgctggccattcatgctctattcatgggaatggccgggaatgtggtttaaggggagaagacatggagaagaaaaaagggacggtggtggattcctgtagaattgctgtatatttacaacgacatgatgggacgggcggtacatgacgggatttttatgatggcgttgcgttgttacacgggtatcactccgggcatttcttggcgattttgggggtttttatggatctttatgagaaatacttgacgcttcaggagaggctatctatatctgataccctgacctcttgtctactgaagcagtgcaatacaaaacaaaaccactccaaaaaaaaaaaaaa

SEQ ID NO: 3986 - DNA, 1510 bp, Trichoderma harzianum
atttgtctgccgaataacgcgctgcctcatctccatctccatcctccttcaaagcgaccccaaagcaggacaggcgccgcagttccagtggcatcgagagacgatttgtccattgacttcgtcaagaggatgccgcaggccgagcctctagaccccggcttgatcctcgatgattggatcaaccgcgttcagaatctccccgaggagattcgctttatccaagaagagattacagacaaggaccgccagtacaatgagtgtattcgaatgattgaggatcgtgatggaaagattcaaaagtggataaagacgaatgggagccatgagcccaacccaaaggaggatatgctacgggcccagattcgcgaaaactatgctcgcgccgaccagtttgctcaagacaagatcaccttgatacaaaggctacagctcgttatggacaaacatctgcggaatttggatgtccagatcaagctgctatacgaccgtgccgagcctggatttacagaccctgacgaggttccttcactcctccgccccagtgcgactaatcacagcgctccctcagctcggactctaaacctctccaacaacatccactcagctggccctctggcttcacctcggaacccgattgtcagctccgccaatccagccatggttcggctgcccaaccaccctcaaattagaaatactcaggcccagcagcatgtcgcgcaataccatcagcacccatcctccgcaccagccacgccagccgcaagcataatactaaatagacagcgtgagagctcagcgggcccggccacaaagagagggccgcggtccattacagggcccggaaatctgccgacaacgtcaagcggcttagcgagacattcatcccttggtcctggtatacctaagagcggctctggagctaatctgggagccggcggtgctgtccgggcaggaagtgctggaccgagagcaggatcggtcaaaggggttgttggagtagcgggtcgcagaggcaccccgacgatgagtggtcggaagaagccacccaacagatcgtcactttcacgggtgaagaaggcctcaaacagaaattcgccggcatcgacggcggatagtgatttgtcggatgctgcaagcggcagcggcgaagaggaagatggtatggaatcacggccgagggcctccatggcggatggcaaagatggggatgaagtgctcggagacgccgatgacgacgaagacggtggtgatgacaaacgatactgcctgtgccataacgtgagctatggcgacatggtggcttgcgacaacgacaattgcccctatgagtggtttcattggtcgtgtgttgggctgaagagtgaacccaatggcacttggtattgtcccgagtgtaccgagaagtttcaacgaaaagggaaatagaaaaccatgtaatcttgtttgcgtgagtagtttaatattacaaagctgcggctgacaatctattgccaaaaaaaaaaaaaaaaaa

SEQ ID NO: 3987 - DNA, 1390 bp, Trichoderma harzianum
cgtggatcgtaacaaatagccttgccatacaacaaaagggaaacaattttctttgattcagtgttcactgaaccgttgtctgtcgttcatctcgcttgcattgtgccatttttgaatctccagaaccgcaacacctttgtatcgtcatccacccaaacgtaggcctttcaaccatgggaaacacgctattgaagctattcagcttgtccatgtataaaacggaaatcaaggcctaggtggaaggaacattggatctagtactcctgcgaattatatcataacgccacccgctgtcccaaggatttacctgctaaatgaaagctaacgtcatgatgaaccgcgctctttccatccgcaccaagaacaaatctactccctccaagggtcatggtcgtggtcgtgggtttactttccgctccctccgcgagtccgtccagcccgagctctctcgcaaactgttccgtctgatcaagcttgagaatgatctcattcacacacacgaggctgcgggtcgcgaacgtacggccatcgccacgcagctctccgaatggggtgagcagaccagcgatgaggccgtcaacgacatatccgacaagattggcgttattctaagtgagatgggtggattggaggaaacgttcgtcacttcgctggacttgtcgcgcactcatctcaagatgatccgcgacaccgagaggagcgttcaaccgagccgcgatggaaagagcaagctttacgacgagttccagaagctcaaggcgaaggagcctcagagtgccaggctagtcttgctagagcaggagcttgttagggcagaggccgagaatctagtcgccgaggcgcagttgacaaacgttactcggcaaaagctcaaagaagcatacgatgtcgagttcagcgcaatcatagaacgcgctgagaagcaaattatcttggccaagcatggtcgtcgtctcctggagcttctggacgataaggcgctgtcgccgggagacgttcgcatgccctatgaaaacggcgctcaggctcgccaggtgctgaacgatgctgaagatgatctcaaggaatggcaaccagagcaccaccataaggctgtaagcgaaaacgggtcagagacatccaagggcaagagtccggttgagcccagcgcttaggcagtgctgtgagatgaagccgcgggtatttcgaccttgtatgactttgactgagaaaacgttcttgtttgtgtcttcttatcccccttaacaatcatcctgcttctggttgggagttttgttagagggtttggcggttcttttcaggtttatatatgcgtgctgttacgttttgatagcatatctagttatatccaatcgatgcgactgttgatttccgaaaaaaaaaaaaaaaa

SEQ ID NO: 3988 - DNA, 753 bp, Trichoderma harzianum
cgcccctccttcatacgatgatactcccgctcctggcgtccccacgcgctctccggctccggctgggaagcccgttttggcccatgcgagagccttgtaccgctacgatgccagcgatgcccgcgacctgagcctggaaaaggacgataagatcgatgtctacgaatacatgaaccaggactggtggatgggccgtaaccaccgcactggcatggagggcatcttcccccaaaactacgtttttgtcgagcaggagcaaaaggctcctatgccagctcccgtggcctacccccagcagccggcatatggctacccgcagggacctccggcgcagcagaacccttacaatgccagtgtgccacctatggcgatagcagagggcggccagccgtctcaacagcaaggcggagatggaaacagcaaggttggcgagtacggaaagaagtctggcaagaagcttggtaacgccgccatcttcggtgcgggtgcatcgattggtagcaacatcgtgaacagcatcttctgagggcaatacgcgatcttcttcggcctctattttgctggctctgttttattttattgaactttcaagtttggcgtttggaatgggtttgaggcatcacctacagttctcgaaatgagtgaacttttcgtcttttattatggagagtgaatgtcaacgagttgatcctttgatctctagagatattaattgacaatgatacaaaaaaaaaaaaaaaaaaaaaaaaaaaa

SEQ ID NO: 3989 - DNA, 287 bp, Trichoderma harzianum
agaacaacagacgaggaattgctgtggttgtataagttgaagagtagcggtatgtttaagcaccaccaagtggtcagatgaaaattaagcgcttcggtacttggcctgccagagttcagttgagagtgaagatgctccgtttgatccataattgacatcagccccgagggcctttctttgagggtggagcggcatccctgttggactgtggaaccgatattgtgggcggccttgaagagcacaaagctctcgtgacgatgctgtctgtagctcgaaaaaaaaaaaaa

SEQ ID NO: 3990 - DNA, 713 bp, Trichoderma harzianum
tgtatagctgtaaaatcacaactcataaacagatctcgtcctttacatcttattctcttcaagctcatcacagcatcgtatcatcatagtcaacatgtctctccaatacttcccttccgtcaaaccctccgccatcgccctcggcaccttcttcaaccacggcgtcgacctcgtcgtcctcgcccccgtcttcggccagacctaccagcgcgcaaaggcctccaacacaaaggaggagttcatccgctcccgcgaggccagcggcgccgccgtcgcctggggcacctcgtttgtgggatctgccctgcagagctacggcgtgggcgcgctgcttaatgccacgggcaccctgagccacaagggcgctgcgtatctcggcgccttgatcttcgcggcgacgtcagctcctggattcatctctcagatctttagcgaaaagaggcctcttgacaccgtcggcgtcaatgtcgctgctaagctgctcgagactatcggcctgtccttggttctcaactggtggggaaccaggaccaatccctttgagtaaatgggatatctcttcgtaattctttcctgaggctggttctgggaggagttgacagggaatggaaaggccccatcatatatgacggcctttgttgtataacatcacacctaaattagtcaaatttaatttggaatattaataacttcaaataaaaaaaaaaaaaaaa

SEQ ID NO: 3991 - DNA, 278 bp, Trichoderma harzianum
caccgcgttgccgaagctctcgaggttggcatgattggtgtcaacacaggcatcatctctgaccctgcggcgccgttcggtggtgttaaggagagcggtttcggccgagagggatcaaagtacggtattgcagagtaccagatcaccaagatgattacttacggcggcatgggtaagcctctgcaaagctaagtagttaaaagcgagatagagtagccaatgctttttaatgtcccacgattcaatgaaataacgataattacaaaaaaaaaaaaaaa

SEQ ID NO: 3992 - DNA, 784 bp, Trichoderma harzianum
aacctacatcatctaattcaacaaactcaagtataacttatacctactatttatacctactcaacagtatactcgaccttgtccaacaaaatcaaaacaaaacaacaaccgaggcaaatcaaataacaaactacctcaaaaatggactcttcaccaccaacaaccccaaccaaaactcaacaatcacaaaacctccagcaatcttctcctcacccccaagactcctcccccgcctgccaatccgccatcaaacactcctcatcgtggaagcccagctcgctcgaccgccgcctcagctggagctcccaggaccagaagcacgcgctgcagatgagcggcattgacggcgtgcagtcgggacaccagggctttacggagcgatgaatgcctttccatccagtcggggtctttctttctttttttattctatggagagaaggtgtagattgggaatgaaagagggggaaagaagatgaattcataaaactctatatgagcgtggttttcttcttcttctttctttctcttttcaatgatttgatgaaacaaaagggctattgggaaaatttgggaaattgggtcactggcattgcatggcaacggagcgaaaaagaaaaaaacaataggcataatgcacgcgactttgtgtgtcaagattgagctgctggattttgagaattggagatgtgacgccaagtcacgcatcattgggaaattggcagatacctataatagctccgtactgaatgttgacctacctattaattgataaaaaaaaaaaaaa

SEQ ID NO: 3993 - DNA, 1502 bp, Trichoderma harzianum
catcactttattattactggtatatattactggtatttgatgatgtgagcagtggataaagctggattacgaacgaggattgggagcattcaaaattcacattgtcaaccacgcatcgcagcacctatacgtgcattttcgactatggcctccaacaaggatgcgccagctgcgattaaacgcaaggacctctacgaggccctgaggctctcgcgactcccagatgagcagagcggctcacaggatcccatcaagagattcgtcagtcgtacaccagcctggaggcctgggaatgagctgccatggggatcaatcgactctgaagggtataagaagggcaacacggttgactttaacccggctgcgtttggaggccacgtcttcgcccaggcacccttggcggctgcgagagcggtggaggaagaagagaatggcaatggcaatggcaatgacaaactaggcattcattccatccaaggcgtctttacaaaagcgggcgcgattgatcggccattcatctatgatgtgacaaatgtccactcaagccgttcattcaccaccaagctggtccaggcacggcagcccacagaggcttcagatgctccgaatggcccattcccgagtctgatgcgaatcggccgctgggccccgtcagtttcacctgtctcacaacgttcaagcgtcccattcccatgccatcgcccgcagagctgcagatcaaagggtcggcacaggaacgctatgccgacatcctttcgcaacgagcgccagaccagtgggaggccagtcctcaggtggatatcgatgctgttacgagaatgttccccaacgctggtcacggaggttttcccatcttggacatgtacaaggtggacatgaaggggtacaatgctgataaagacgtccctgaacggcgcgaactcatcctctaccgaccgtataagccgattaacgaggacgatccaaatgcgcatatcgtcgcacacgcgtacgaggccgaccggaacgggctcattatgctcaccaatcatcttggttggggcttcaacctcggctctgcggctagcttgtcgtattccttctatgtgcatgtaaacgctgacgaggcagtcatgaagggagatggatggtggattcaagaggtttggtggccgagagtcagtgcagggagagcaatgatggaggttaggatatggagtccagaggggaagcatgtggcgagtggttaccaggacggagtagcattgccgtcgagtgatttgaccaagaagaagaagaagatgggagagaagctgtgatggtgagtagaagggggttgacccagggattcgctgtagagatagacaaccttgggacgtttatgggatttgagtactggctgtactacctagtatacagcgtaggtgtatgggacaccggaataaagctatagaggatgaaagactagagatatactggatgatcaatgctattaattattttaaaatagaaaaaaaaaaaaa

SEQ ID NO: 3994 - DNA, 615 bp, Trichoderma harzianum
gtcatggagaacgtcctcttcaaggtctcctaccctgccgagttccactcccagaccgtgaccactgcatccagtacatggcctccgtcatgctcgtcttcggccgcctcgaggccaccgactacgtcgacggctctgaggctgctacttcggagcttgtcgagtctctgcgcaagaagatcaagtgcgttgaggacccccagtacactcaggactaccatgaccctgccctgcgaaccatctccaacgccctgaccgttgagctcaacgacggcaccgtcctcgaggaggtcgctgttgaggctcctctgggccaccgtcttcgtcgtgaggaggccaagcccgtcatcctggccaagtacaagcgccacctggctcctcacttccctgaggccaccgtcaacgagctcgttgagctcagccaggacagcaagaagctcgaggccatgaccgtggacgagtacgttgacaagtacgctgtcaaggagagcaagtttgttgtttaaattggggttgtgcaaaagtagaagaaaatcctgatgtacctagatgtttatgatgacggtcatatagaccaaacaaaagtagcattatattaataaaaaaaaaaaaaaa

SEQ ID NO: 3995 - DNA, 1277 bp, Trichoderma harzianum
actttgtgtacctcgagatcgggtataaagttacctcggggcgcctcttagtgctggcgttcgtggcttgtctgctaacaatcaggttatatccagagcttgggcaccagagctcttcttacactgccaatctctgcatcatctcgtaaacagagtatacaattctggatacaatttttcttcgctccatggggtctcaagtccaagaagagctgacagtgctcgtcactggatttcagcctttccggccagaatatccaatcaacccgtcatgggaaatcgcgagagccctcccagaatacctccctccgctaagggccaaggacccaaactctcgaaatgccgtcgacatcccgcctgtgcgcattctggtgcaccccgaccccatccgagtcaactacaaggtggtgagggagcttgtgccaacactgtgggaggagacgtacgcgggccgcaagattgacgtcgtcattcacatgggcatggcagggccgcggctcatgtatcagatcgagagccgaggacatcgtacgggttacaagtctctcgatgttgacgggaagcaccttgacgagctcgatgggaaacgggacgaagagtggatctggcatggcctcccggatgtgctgaagacggacttgaatatacaggacatctggcagagatggcagcagcacagctcgaatgacatggatcttcgaatctctgacgatgctggccgttatctctgtgacttcatctactactcaagtttggcaacctgctataagcaggacaaggagaggaaggtcatcttcttccacgtgcctgcggatagctctgaagccgtgatcaaacaaggccaggaactggctgttaatctcatccggtccattgtggagagcgaagttgcaaagaagcaaaaggcgacggagatggaatcctaaaatttcttttgagtagctaggtatgcaagctttggatcagcatttagtggtgttggtattggtaattggtattagtgcaatggcgccgaggacttgctggagcggagaaaagaatgctcttaggctgggctttttggtgttctgggagaaacgaaggagaaggaagagtttaatgtttatgatggtagtgatatgatatcagagactaactgagtcggaaggggggttttcggggaggtttggctgaagcaacaaggggagattatgattgactatggtaattcggaggaaattgagtaattgctgttaatcatgaatcgaacttgccatcacaaaaaaaaaaaaaaaaaa

SEQ ID NO: 3996 - DNA, 487 bp, Trichoderma harzianum
cccaaagaaaaggtctccggctctgcagcaggcctggacctggagagcctaagcagcagtagtgacagcagtactgtcctgtacggagcagtggcggctgcagcaaccagcacaactggacggaacagcagcagcaagcagcagcagcagcacgacctggccctccctgccatctccccacccctgccctggcccgtggctcgactaccgctacgataccagaactgcactgcactgcttgtgctcgctatacctgccgcaccgctgtctgtgacgtgtgaggaggccctacagggaagcacaaccaccaccaagtactgcgcttttcccgcaccagacacttgacctccaaacctctccacacaaccaacccgttttgcccggcgtagcgagaacacgagagcgaaatagaagccgaggccaaaggggaacggagacaagaagcaggaaacaagacagagtgagagagaaaaaaaaaaaaaaaaaa

SEQ ID NO: 3997 - DNA, 1119 bp, Trichoderma harzianum
aatggagtgacaccgcacatcagcacatccaaatcgctgtgctgagctacaccgaacaagctgaaagcagtgacaacatagcaataaagagacgaagatccaggtcttttgataccaaagctgctctctttggcgcaacacaacatgtcgacagcttcctccagcggcccgcgaaggccccccaactccagcgccatcgccggcccatcatcatcctcatcatcatcctcacctcgctggttctcccaaacccaagccgcctcgccgccctccgccccgtccgtagtgacaacctccgcctccgccacagccatggcttctccggcattccatcccgctcctctccagcccacgctgccctcggccgaaacccagcggcacgtctccgaggcccgcgccgccgtggtcgcctccatcggcaacatgctcgactcggagctgcagtcgcgcgcgggcatcctgcactccaacgccgccgcgctggagaagcaggagcgcgacgtgctgcgcgccaccgacggcctgcgcaaggagacggcaaagctaaaggccgaggcggacaaggccgctaggaaggtgaaagagctgggcaacgtccagaactgggccgaggtgctggagcgcgggttcctcgtgctggaggagacggtgaggctggccaacgggggcgaggactcggactcggcaggcagtcaatgtacctgcagctgcagcgagtgcggcagcgattcggacatgggcgctgaagagggcgaaggccgtgatgatggcggtaatggaaacggcaacagtggtgctgagaacggcgctgagaggaggatggatgtggatggcatgtcggatgccagtcgaagtttgatggacctcgactcgagtaccggcacggggcgagcaaaggggtctgagacggcgtctatttcgacggggtgatacctctgccacctacatgtatggcgacgataaagagacggaatcaacacagatagatacatgaacagaggccagctactggataagataggtagtcacattgccatgagatcagatagatgtatacgccatataggtatattagtagtatattataaccattgctatccgaaaaaaaaaaaaaaaaaa

SEQ ID NO: 3998 - DNA, 772 bp, Trichoderma harzianum
agcaaataccgcaaagatgtctgacgacgggctctcaatatacgatgagatcgaaatcgaagatatgaccttcgacgaggttcttcaaacatacttctacccgtgtccctgcggcgatcgtttccagatcgctatcgatgacctgcgcgacgagcaggatattgctgtgtgccccagctgtagcttgatgattagagttattttcgaccttgacgacttacccaaacctcctcctactggcaatactggtggccagataccagtcgctgcttaaagccatcgctatatttgagcttccctgggcgaatacttgatctattcggcagacacatcgagatactacactaattaggcccgcatagcgtacacagtgcctcaacggccgttctgaagaggcttctcagattgatccgtctaacatcggatgtattgatagacgcggacgagaagacgacgatgtaccagcgacagaccaaagtcatcccaagcatccaagctactgatgcaaaaatatgcgtgccttgggagtaccactctccgaggcaaaaattcagtcacttaaagagacaggcttcgggaatgccatgaagaattcaggctcacgtgggggacatttgatgaaagaacactgccgaggcgttggcaatacagaatggacctatgaaggacggccatttcactcatataccgtcaacataacaaaccaagataccaagggtgtattacatattcacctaaattccatgaatgcaaactgaaaaaaaaaaaaaaa

SEQ ID NO: 3999 - DNA, 1521 bp, Trichoderma harzianum
caaacaacgaaacaaccgcccaatcgccaatcgccgcctcgacatggtgctcggcgactacgaggaagcacaataggcgggacgcgaagcaaacaagcgctgggcgtctgagaagtagcccgagagtcacagctacagctacagctacagtgaacacgcgatagagtgattcaggacatccagagacgagacgaggcgcctgaacgagatacgaagcaaacagacacgggaaagcagatgcaatgtcggcaaacgtaacaaagccggcgcccaatcggccgcagcggcgcgtaacggccggccagatcctgtcgatgccgccgaaatggctcggcatgtacgacgaattcatcaccaagaacgccggccaggtgtcgcagattgagagcgcgctgaggagcttgacgtatatcattccaggccgctttcgcgatgctgaaatcgcctccgagtcgattcactcgggcgtccagctgctgtcgctctaccacgacggcatcctctcgcaggcagtgtccaagctgcccacgccgcctgtccggtcggctcatgcgcgctacacgcgatactggacgcagaagagcaaaacgtaccgcaggatagccatggtgctgcagatggtcgtctacacggagctgctgtgcgaaatgagcgccaagcggcgcggcggcgaaaagtcccggtggaacgtcatcgtgctgctcgaggccatcaaggccttttgccgcctcatcctgctgcgcgtgacgcggtcgcgcccgctcgtcacaccggtgctgccggagcgagagcccatccccgaggacgacgatgtcgacgaggatctgattacggccaggagcgagagcgagctgatggacgagacttcgcccaacggatccgccgtccttgtcagcagcagcacgccgccgaagcctgcgtacgagagagaatggacgatgccgcggacgggaatgagcttgccgtcgttgcccaaccctggcgatgttggctcgtacctcttggggcgcgtcttgacggccgacgacatcaagcctgccaacaagctcctcaacactttgcaaggaggcggccagtttgccgagatgctgcacattctgacgcccttgatctacgcagtggcgctggctaggacaaagaataagaagtcgtggacgccgtggctggtgggtgtggcggtcgagtatgtcgctcgccagctccgccagcgtaacctgcgaacctcggctctggagcgagacgagtggaacaagagaggctgggctatgatctggtggatgatgcgcggtgctttttacgagaacgtgactaagggggccgtcaacggggtgacgagcagaatgccaggcttcatcggcggaatcctacaagactacgaatatctgtgggagaattactactttagcacgagtggctgattgactgtcatgccagccgtggagcggtggcgctcgttcctcttctctctcgccatataacttatattggtgctaccgaagcacatgcaaaaaaaaaaaaaaa

SEQ ID NO: 4000 - DNA, 1107 bp, Trichoderma harzianum
gttcttgtcattaattaaactcgacccacgcgtccggcccacgcgtccgagtaacgcattcacaatgtctggacctggcgtcggcttcgagtatcctcctcagtccgtttcttggctgaagcgcgatgtgcttctcttcgccaactctatcggcgctactgctgacgagcttcacttcctctacgaactccaccccaactttgccgtcttccctacttaccctgtcatcctgccgttcaagggcgacacacaggaagtgattgacttctacgcctcccagaagaagatcaaggtccctggcgtccccgacttcgactcccgccgcgtcgtcgacggccagcgaaagattgagttcctcaagcccctgcccgtctcctccgagggccacaagttcgagatccgccaaaaggtcctcggcgtctacgacaagggccgtcccggctccgtcgtcgacacccagctcgagctcgtcgacgccaacaccaacgaagtctacacccgtctcttcggcagcgccttctacgtggcccagggcaactggggcggtcccaagggccctgccaccgagaacttcccccctcccaaggacaagaagcccgactgggtgttggagaaccagatctccagggaggctgctcacctgtaccgtctgaatggcgactacaaccccctgcacgccacccccgagcctggtgtcaagatgggcttcccaggcgccatcatgcacggtctgtattcgtggaactctactgctcacgccatcctcaaggctgtaggcggcagcgatcctgccaacctcaaggagtaccaggcccgtttcgccagccccgtgctgcccggtgacaagctcatcacccaggtctggaggacaggagagaagaagggagagtttgaagagattcggtttgttgttgctgtcgagggcggaaaagtgtgcttgagcaacggacgtgccttggtcaagattctaggagacatcaagggaaagctgtaaattgtataataatgtgctattttgatgactgattttggagagaccccacgatgggtcctttagcgaaacaatgaatttcacacgcttccgcgtagcctttgaaaaaaaaaaaa

SEQ ID NO: 4001 - DNA, 1066 bp, Trichoderma harzianum
gcgaatgatgctgatggattgatgatttgacgttcagtctttttcccttctcgctcgtcgccacaatgtcaattgcagcagcgcccaatgcgcttcgagcctcatcaggctgcgcctcaaggctggggctgtctctccagaaaggcccatcatcaagccttttcctgcgggtagcaagtttctcgacaacggcgccgcaatgcaagcgcaagacaaaggacagcaacaagcgacgaggcgtcagcagcctctacggatcgggcccgcgagagccgctgtccatgtccaacatgccgctgccgaagcccgtcgagttcaagcccaagatcgaggtcgacgagagccacgggctgtgggggttcttccccgcgccggggaagctcctgctgacgcccaaagagacggaggagcacgggcgagcgtgggaggtggaggagctgcggcggaagtcgtgggaagatttacatgctctgtggtggaagtgctgcaaggagaggaacatgcttgctacggcgagggcggagctgttgagggggaagcttgggtttggagagcgggagattgattcacgggatgaggaggttacgaagacgatgagggcgatcaagcatgctcttacggagcgattctatacttggcaggatgccgtcgaggttgccaggtcggaccccgagatcaacttggagggaggagagggtcaggtgtacacaccgtctgcatatgaagagggatacgatgatgttactgctatggaagaagcagacaaggagttgaaggagcctaccaggtagaagccaggcgaggctaggagatggacgatcaaaactaacgaagagaataccgaggtcaatcttagacgaagaaaaaaggaaaggaaaagggcagcgaggttaaagggggggaggtcggttcgacgacggccagcatgatatcacggggaggtattctggcccggccgcgtgtagtactaagtatgggaatctgtgtacctatatccgacgaagcaattggcatgtatattactaccggtacgatatgatactcgtaaaagaaaaaaaaaaaaaaa

SEQ ID NO: 4002 - DNA, 1123 bp, Trichoderma harzianum
cggacgcgtgggcggacgcgtggggatggaggccctcctgcgcaataccacgcctctccccctatgccaacttatcagcctccctctgacaagccggctattcctcagggatggattcctctctttgaccagagtcgccagcgatggtattatgccaacaaggagaccggggcgacccagtgggaggctccaggctacattgcccctccacgacctcccatggagagctaccccagcgaggaatcacgaggcagcggcccttcgccgtatcccccagcagccccatacgggcctacgcctggaggctacggagctcctcctccaggacctcccccctccgcctcttacggtgcacccctaccacctgctggctacggggctccggcaggagagtatggccatagtagccatggtagttatggtggcgagggccgcggtgagggctacggtgaagagaagaagaagaagtcatctggaaagggtggcttgcttctcggtgccgccggtggtgttgctgccggtcttgtaggtggtgccctcttgcatcacgccctggaagatagcagcagcgacgaagaagaggagagacgcgaagaagagagacgtgaagaagaaagacgctacgagtatgaacaggcaccatcacagacaatcattgtcaacgagtacaacactaccaactacaacgactataacgatccctacgaagagagtggtgtgccgggtatcctaccttcaagagatgcagagggtaactatgtgtctgaaagcgatcgggagtctgttcaagaagcacgtgaagaatacgaggaggctcttgcagaagttgagggctcttcaagtgcaagcagcagcgactacgaggagttggcagaggctagggaagagtacgaggaggagtacgaggaaacttatgactagagacaggcagggttgaacttgaagaaaagactagccgtcatctcggcagtctgatgactatctggacgctgttggcattatgaaacactgtcattttttatagatctaggagctagctgtctgtcgtgtgagtatgtccagcacacgcttgcacaagacttttactatgaatatatcatatcctgcaagataaaaaaaaaaa

SEQ ID NO: 4003 - DNA, 355 bp, Trichoderma harzianum
ctctcgcctcaaaattcatgcgcctcaaagaatggaagaaaacacaggcgaatgacgtgaaacgaaagataaaaagacaggcgccttcatgcgagggtttcgccagtcgcctctagcgtgtttcgaagcgcagggttgaaacgcggctgcatgatgcccggccgcccatctgaggcatggcggctaccggaacaggacgacatccgaagacttgaggaggctccgtgtttgttcgtttcgtttcgtctttcgagtgaagggttggttcttgttttcggctgttgtgtgttttggttgacttgtgtttacgggttgggggtgagttgaattgagtgcgagactaaaaaaaaaaaaa

SEQ ID NO: 4004 - DNA, 1722 bp, Trichoderma harzianum
ttttttttttttgtggatttttacaacgttctcttcgtgaaaagcctatccttctttacttctaagcctctcctttgccggtcctttgagatatcattcttttattacacaaccctctttattgagcgaaaatgatttccaagacgacttttgccgtgctctttgcagcccttgctgctgctggccccatccaattccgagaggtggcctctcttgacccagctgctaccgctgaggcccatcccagagacgacactgctacccgcgccttttccaatgtccagatcaagacgcaggcctgcttcaactttgaccctcgacgtgcagccggaaaccaggtcctgctcttctcgtgcggtggacgggctgatggcggcggacaagtgaccaactctcagctctttgcctttaccggaggcaatggcccgctgagcttcgcccctgagaacgatcccacaaagtgttttgctgccaagggcaatgtcattgacattgctgactgcaatgccaatgatgccacccagaagtttacctttggtggtgctgctgccggaggttctggcaatgatagcaacaacaacagctctgccgccgccagctcggctgctgctacatctgaggctgctgcctcttccaccccggccgccgccgtgacgaccgctgctgctgctgcttcttctgcggccccggcgaatgacgacaacgcccaatgctctgctcccaaaattgttaccgtcactgaggttaccactgtcactgcgggatctcctcctccagccgatgccagtcaaactgcggaggctgctgctaccacttctgctgctgctgctgctgccacaagtgacgcagtcgttgtcaacccaggcgagggcagctcccagaccactgcagctcctcctcctcccgtcatcaccggaaacccaacgacccccgtgcccgtctccggagctggaggcaccctgaacccttctgccgtggccgaggcccaggcatttgatgccggcgccgttcgacccctggagagtgtcaacatccgagccgccgatggacgctgcttctttgtcaaccccacggccggtgatttccgcgagaacctgatccccgttggactggctacctgcagcgaagacgcgagccagaagtttgacgttgtcaccaagggagtccacgacgacgctcaggccggcgaggcgctgcttgtcagcgtgctcaccaacggctgcatcaactttgatggccgcagagccgccaacgaccaggtcatcatgttttcttgcggtggacgcgccgatggaagtaagtcattgacatcatttccccccaccccatctcggtgatctgctcgatccacccgatccaagggcatgcgagttatcgcgtttgtaccgttttagtttcacaagagatcaaatgctaacgatgaacctcaacaggtggcaaaaccgcgacttcgcagctgttccccttcaaggcgggcgacaacaacatcatccttactcccgcctcggccaccaacacgacttgcttggtcgctggcgctgaccgggtggagtctgcgcagtgcagtggccagaaggatcagacctttgaactggtggagattctgtaagaaaaacatgtgagagtgagagtgggagtgagaatgagggtgagagtgagagtggctcgtttcacgcggacgcgtgggcggacgcgtgggtcgagttaattaatgacaagaac

SEQ ID NO: 4005 - DNA, 1717 bp, Trichoderma harzianum
ctcctgcacaaattcatagccgtacgccttcaggcgcgaagcatggcgtctacaagcaggacttacaatgatgcgattgacaagctcaatgagctgcagacgccgttcgcggtgattgaggcccgtcgcaaggccgggattctgcctgattctgtgcttggcatcgccaagatgagggcgtatctcacaagaatcggatacacacccgcggatcttgatcgcctcaacattgttcatgtcgcgggcacaaaaggaaaaggcagcacctgcgcctttgtcgattccatcttctctcagtaccaacagcaccatggtggccctcgtaagacgggactcttcacatcacctcacctcatggccgtgcgtgaacgcatccgtatcgattccaagcccatatccgaggagctgttcgcaaagtactttttcgaggtatgggaccgactcgaggaatcgcgagaggctcccgaagaggacacgccttttggatcaaagcccgtgtatgctcgctatcttacgctcgtgagctggcacgcattcttgcaggagggcgtcgaggtggcagtgtacgaaaccggaataggcggcgagtacgactcaacaaacctggtgtcaagcccggtagcatcgggcatcagcacccttggaatcgaccacgtcgctatcctaggagacacggttgagaagattgcctggcacaaagccggtatcatgaagacgggcagcccggcgttcacgattgagcagctccccggagcggcagaagtcttgatgaaccgagcaaaagaaaagaaagtcaacctaaaagctttgaaaatcgatcctcgcctggatggcgttaaaatcaggccaaacgcagtgtttcaaaagaagaatgcaacgttggcaattgcactggcagagactgtcctgacaaagctgggtctcctgaaagaagtttccgagtcaaagctcccccaggaattcattgacggcttagagaagtgtgtcttcaggggccgatgcgaagtcaaggaggagaagaacgtgacctggcacctcgacggcgcccacacagcagacagcttgaaaatgtcatccaagtggtttgctagtgaaattactggccgaaccggcaccagagtcatgatcttcaaccaacaaggccgcatcgaagcaatcgacttcctacagcccataagcaccaccctaaagggcatcaacaaggaccaggaccaggaccgcccggcctttgaccacgtcgtcttctgcacaaacgtcacgtactcccagacgggctacaagcgcgactttgtcaacaacaccatcgaccccgcggaaatcgacaagctcaccgtccagaaggcttttgcggagaagtgggcggcgatagaccccaagtcaaaggttgttgttttgccgactattgaggatgccttgaattacgcgagaggtgtggcgggaggattgccggagggagaggtggttcaggcgtatgttacggggagtttgcatttggtgggcggtgcgttggggattcttgaggagacggatgcgttgtgagggacgttgcaaagattgcacgatggaagaggatcggtaatggtaattcaacaaaaacttgggtatagagcgataatgggataacggtaattcaacaaaacttgggtatagatcagtatttttagacttgcggacaccaaaaacatacattggagtgctttttcaaaaaaaaaaaaaa

SEQ ID NO: 4006 - DNA, 1226 bp, Trichoderma harzianum
attgagtccctaggccagaaccgcgcgagtatacatctatctgcaacatctcttacctccatcttcgcaatggcttctgataagatggaccgcggcctcgacgaaatcattgcagacaagcgcagcaatggatctcgaacccgacgcggtggcgaccgccgtcgtgaccgtcaagactatccccgtgatggggtgaaaaagtctctccgcaacgaacctcgaaacttggatagcgaatgggtacatgatcgatacgaagagaacacgtatcgcaatagaggccctgcaccgcgtcgcaggcgcgagtctcccagcgggggagatgcccgcggcgcacgactccgagtcgaaaatatccactacgatctcaccgaggaggatctcgatgaacttttccgaagaattggccccatcacaaaattgcaactgcgttatgatcggtctggacggtccgaaggtgtagctttcgtaacgtatgagagcaaagacgatgccgcagaggctgtgagacaattcgatggtgccaatgcgaacggccagccaattcgtttgtccgtcatgtcaagtgggccttctcgaaacccgtttgatactgctgtgatgccaggcaagcctttgtccgaacgcatttctgctcctggtggcagatctcgatcactctcccctcgccgatacgatgaagaagatgccgctcgcagaggcattgatcgatatgttccaggcggaagtcgctctagaagccccatgcccccccgccgtggaggggggggtggagggcgccgccctggtgcccgacgagagggtggaagggatcaggatgccgctcgtggcggccggggaggcagaggaaacggaggaagcggaggaagcgaccgtgctgcacgaacaaacacaccgcgactcaagaagacccaggaggaactggacgccgagatggaggactacttcaacgccaacggcggtgcccctgagcctgctgcagaagctgctgctgcacccagcggagaggctactgcacccgttaacgctgatgacattgacatgattgagtaacctggatcattgtgttttggtaaaggggaatgtgttttatgagggtattggagtattggactcgttttacagaaaatgccatctgaagcatgggaggacagtgcatatatataattaagcagggtgtgttgtcattacgaatgtattgcttttcgggccaaaaaaaaaaaaaa

SEQ ID NO: 4007 - DNA, 1274 bp, Trichoderma harzianum
aatataccttggtatcccaaaagttgaaaagatgtcgtcgccccctctagccgccaccaagaccccagactccccacaagatagcagcatagaagaagcagaatgcacctctgtcagacagtctgcctccactgcttctattcataagtggagtgatgagaatattgaagatagaggaatgtatcgattactgtcttcaccaaatagagactgccatgacgagatcagaatttcgacacgtcctgcaactccatctaaggcactaatgtgccttatactttcaatacataaaaataggattttggatccaggagactgctatgacgacattaaatcgataggtgctttaactccatctatggcaccttatattttcctaacaaaagaaaacctcgtgtcttcaatccttcgagatcgttttttgcgtcgaggcgagcctgataatttaacctgtacccaaatactgaaaatgctagaggagcctgctaacagctcacataagcaagaaggtggcctcgacatctggaaatgctgaagagcttaggacgcgtcgacactgggatgccaaaaatgcgaaaagagatacgaatattgacgttcacttattttcaccaggtgaaagtcagcgacatgatgtctctaacatagttacagtaacattgaagcgacagctttacgagtcagatttacttcaaaggaagacaaggaaatcatgaacctaaaggaagaatgtcgtggtcagcctaatgcatgggcaaaaatatttccaggcagatctcaaaagtctatccagcggcgttataatacaagactgaacgcttttgaaaagccaattacaaagacattcaaagagacagaggacaaccaatacccagcgttttccaaaattttcgcagttatgccactgtagcagatattgaacctcgctatctctgatccgtgacctctcaactgtcaatccttcaacgaaacctacatatatcttgtcgaattcacctactagcattgggtaaatatccttctttggaatccaatctctggaaggatacccggcccatgataagaggtaatgattatgcaactgcgcaagtatacgctctactgggagagtgagaaattcatgagcctgaatattctccgcagcatagcgatgtatggattgctacttgagagccctgtgttggaagagggatttattatgcaactggcctgaccaagtaaggcttttttataattatagatatatatgatgtgagtgcgacgaaaaaaaaaaa

SEQ ID NO: 4008 - DNA, 1364 bp, Trichoderma harzianum
tcggatcggcctcttttcctctcttccctctctgctttccatctgcccagcagaccgagtttggcagcgcaatgttgcctctatcggtgcggcgcgcggtggccgctgctcctcagggggcaagtgggctgacttctctcgccgcgtcggctccaaagatcacagcctcgagcttcatcctgaatcgtcctcagcggcgctactcctcgtcgaaaccctcaagatccgatgagcccaacgatattgctgccggccagtcggtgccggcatctacctcgcgcggagagagcaaaggcagcaggaaacgaaagagcaaggattcagccgaccgaaatgcggctttcaagaaactgcccagtgtccctagcactcaccacatgtctcaagaggccctgagcttatcgagcttcttctcactccaccgtcccatttccatcacccagaccatgcccaggactgttaccgacgagcactttgcatccatatttgcgcctcgatcaaaatcgaacaggatacgagacactgtctctacaatttctgacaccattgagcagctggaaggccccatggctcaggtgacaataggatctcaggaccaaggggctggcgatggtatgcacagagttgatgtcaagaaccctgacggaaccgagtcgagcatctatctccaggttgacaccatgtctggagacttcttgcctttccgcccccctccgctgcccgaggcgcagcaaggcattgaggctgaaggagttgcggctgaggctgaagctctggaagaggcagctcaccaccgagtttacaaggccatgttcaccattgaggagtccacagagtcagacggccaaatcaggatcatcgcccacagccctcgaattatccaggacgagcagccccggagcttcttggagcgtctggcagtccgccaactgcgggttgaccaggctcgcggtcagcgtgacctctatgccatcagcgttaagcgacaacggaaacttaagatgaagaagaagaagtataagaagctgatgaagcgaacaagaaacttgcgtcgcaagctggatcgaacctaagggggctaggcttgggctgtgtagaaattcgcatttatttcatttttcctctattgcgttgggattcgaccggttcatgggttggtgtctgtctggcggttgacagctttttgtcagccatgagttacgcaacgcgctcctgagactttttctcttccatagactcgtgaagatgacttgttgtcatgtgttgtggtgcatggctggggcatggcattttcccgttacatcgattttgtaaaattagtatgaataagacgaacatgtatcaacacaaaaaaaaaaaaaaaa

SEQ ID NO: 4009 - DNA, 1419 bp, Trichoderma harzianum
cccacgcgtccgcccacgcgtccgcccacgcgtccgcccacgcgtccgcgagcacttggaccgccatggccgcatatataaagtccatgacgggggttgagctgcccatgctggacaagctggtctcaaccctcaattcattcaacatctggcgttcgcccgcaatggctctgccccaggtcaaatccctgcaggactgcgtcgactactcaaaggtcgttgagcctttcttgccccagctctaccagcttccccaccacatctgggagagcatcgacagtctcgatgccctgagagagctctatgtcacgacgaatcccctgatttcaggctttgcggcctctctggttgttgggcttctcgccttgatcgtgtccgagatcaatcgcaactattctcagatcgaccgcctgtggagtatcctgcccaatctatacgttgtccacattgcgctctgggcacgtgtagctggtttgccgcatggtcgagtagatttgattgctgtctgtacaacattatggagtattagattgacgtacaactactggagacgtggcggctacaacattggctcagaagactacagatggatgattgtcaaagcgcaactcaactcagttgtctggttcatcttcaacgtcaccttcatttcgtttatccagagcatcctcctgtacctcttctcgtgtgtgccggcatacgtcatcttgctatcatctcagtttgagcctgaagttcaggcagttgatctggtctttgccggcgttgagattcttcttgtcctgagcgaatggattagcgatggccagcaatgggcttttcaaaccgccaaatacaaatacaaggacactgggaaactcaccagtggatatacatcggctgagctggataggggcttcatcacaacgggcctctgggcttatagccgacaccccaacttctttgctgaacaaaccatttggttcatgctctaccaatggagctgcttcgccaccaacacgccatacagctgggctggtatcggcgccgtcctcttggtgttgctctttcagggctccactaaccttacagagaacatcacgtctggtaaatatccagagtacaaagcctatcagaaccacgttggcatgttcatccccaagacactgattccgtatgcgacccctgggccgaaagtcatcaggtcgagcgagctggttaagcgtgctgagcagaagcagaagcacaagaagaagcaaggctgaaaagaagaactctataaatacctgcacaactttcaatgctaatgagctgcttcaatggtgtaattatagaacttttacgaaaacaatagtcgctatatacggataaaccaagaggggggatttaggatatagggaaaatgttggaaatgcttttttggttaaaaaaaaaaaaaaa

SEQ ID NO: 4010 - DNA, 464 bp, Trichoderma harzianum
ggagcagctgtccttgactccagctaggcatggagagatttttgggcggtttgcggtgccttttgcggtaaggctgagcagtgtttgaggtcggggagaatggatggaacgaaatcgagtttggctgcgtgggggccgcagatcgcatgtcagatcgccggtcggtctgctaagcgatgcttaaagtcggaattgcccgatcgaatctccattccgatggcggagatagaaggctgtatgatggagagccagtctgacgagaacatgggaaaagatggaagatggggatggaaaggaaatggagatggagatggcgatggagatgatagagatggaaaatggaagatgaatatctattactctgggctcgaagagagtcagtagagtcagaacggtgggggagagataccttaggctttgatgtgctgaacgcgcgaaacatcgcgagaccgaaaaaaaaaaaa

SEQ ID NO: 4011 - DNA, 1140 bp, Trichoderma harzianum
agccagaatgccgctgcaaaggccagggcggacagcagcatgagccgcagccgccggcgcaacagactatgggggagcaacatatggcttatggtcacaaatcaaatgacctgcgacgcgcgggcatacgtctaggttcgtaaagacgctgtaactccgagcacagcaaactggcgatagtacggtccaggctcacaagcacgtgggctcaatcgagttagtcccttcgcgggggggaatcccgacaacttgcagcagagcaagcaagcacgagatacgagacaatttagacgactgtctgtttttgacaggatgacacgcacaaacagtagctctgttctgttctggaacaaaccggcgaggctcagagggtgctttgaccaaggcaaggcagagcacaagccacgagccagagcccagagagaacaaggccaaaatccaacacgtcgcagattcttacaagcaccgccagacacaagtaaaatcaggggccagactgtggttctcggcccttgtccgagctggcagggggggcattcattcggctactggcacaggtaagccctggatcggtggcccgaagctgcggctgtcgtagcaactacagtagtttgggcgccaacagtggcgcagccgagcccgggcgctggagaaggagaaggcgaaggacgggcggtactttgtacgtaaagatgatgcgggaatggcatttggatggagtcgttagtagctggaagaggcgaggaggaggatgaagagggaaaaaggaaaaaggaaaaagggaaaaggaggagagacaaaaacgaggcacaaactcgggtacctgggtaccgtacacagcgcctggtaccttccgctggaaaactcagtctgccgcaccttcccttcggcctggggcgtccgcgggaaggagcctggatggcacctgcgcgatgccatttgctggcgcgcgggctcgcctagtcccgaccaggcatcgatacggcgactactagctccttcccccggcgcaggcccaggcaagtgctaatgtagtgctaaggtagcacctcgtgtcaagtatcccacaaggcactttcatgccgagtcccggcagagtctcgacttgcgagtgacttgtgtgcgaaaaaaaaaaaaaaa

SEQ ID NO: 4012 - DNA, 274 bp, Trichoderma harzianum
ggaatgacccctaccaggatgtcgaattacacaacttgaacgaggggacgagccaaggggcacagcacgggaattgattcgagagtttttaaatgatacccatctcccagcgaggagattgcacttagaaaacgtggcggaggccctcgaaggagaaaatggtctttgttttgttcttcatcttctgccttgtcgaagggtcatgtatatgtcaggaatagctgtgcactaatatttaaacataagttccgtctaaaaaaaaaaaaaaaaaaaa

SEQ ID NO: 4013 - DNA, 1047 bp, Trichoderma harzianum
gtgagactgttattgaaaagactctttgccttggttggcagattggttgtattaggcatactgtttcgatacgcttcaacgtactttttgagtcgcaaagctaccatgactgtggctcctgtgattgcgctctcacatggtggaggtcccctccctatccttggtgatccctctcacaaggacattgtttactctctcaagaacagagtgcccaagattctcaagctcggcactcctgagcagccccgtgccattgtccttgttacggcgcactggtcgacgaagaacccgaccatttcatctgcggcttctcacgacctctactatgactactacaactttcccaaggcggcctactcgctcaagtacccagcgtcaggccagccagaggttgcgcgcgaagtcaaggcggcgctggaagagcagggcctcgcatcagttctcgacggcgagagaggatgggatcacggcgtcttcattcccatgctgcttgtgaaccctgacgccagcgtgcccatcgtacaggtttccgttctggagtcggaggatccagagaagcacctacgtatgggagccgcactgtcgaagcttcgccagaataacatcgccgttgtcggatcgggctttgcttccctgcacaacttccaggcttactctgagctgcgatctgggtcgcctgctaaggtgaatgagtggaagaataagattaaccagtggaacggcgcgctgacgcaggcggttggtgcggagagcaaggaggagaggtggcggagagtgtcgggatggcgacagctgcctcatgcgaatgacatgcacccgccgatgaggggagagcacttcatgccgttgattgtgtgtgctggggcggcgctggagggggagaaggcgggtgtttatgaggatacttatatggggagcgggattaatacgtattactggggggcggagacggtggcttagatttgaagaattgatacatatttcagggaatagcgattacacagattgaatgaaggcattctatttttatagaaaaaaaaaaaaaaa

SEQ ID NO: 4014 - DNA, 1576 bp, Trichoderma harzianum
ctcaatgccgcctccatgaacgactcgagcttcgtccaagcccaacagcgcgtcgctgagcgacgagcggcccgcgaggtcgaacaacgggcccgaatcgcggctcagcgcgaatcgtctcgcgtgaacaaccagctgcagcgtctgccataccccctcaatcgcctcgccggtgtctgggatgcagccgcctctatagaaaacacccggcctgcgtttcgcgttgcgcaggttgatgccgagctgctggatgaagagctgctggagctcctcaaggggcaggttggcgacgccctcagatactatgccggcgggcatctcaaagacgactggtcttccgagattcagctggcgctcagggccatcctgttcaaactgaccgtctgggataacgatgcaacgtacggagcggctctacaaaacctcaaatacaccgacgccagaaaagggggccccgtgctgtcacccccgacgaggctacaaaagtcactatacggcctggtaacggtctttggaaaatatgcctggaccagatgggaggactggcttgtggatcaggacgatggatacagcgacccgagccctcgagtccagaggctatctcgattaacaactgcattgacaacggcgcactcggctgcggcatgcgtctccttcctggtgtttctattccgcggacagtatcgcacccttctcgaccgtgttctacgcatgcggctggcaccccctacaagccatgtcagccgcgaggtttcctttgaatacctcaaccgacagctggtgtggcatgcatttaccgaattcctcttgttcgtattgcccctgattggggtcaaccgctggcgacgatggctgagccgcacctggcgaaaaaccacagacatcatgaacacaactcaaaagggagattcttcaaacggcgagctcggcttcttgcccgagaggacctgtgccatctgctatcaggatcagaacgccgccgcatcatctgagtcggaaatcatggcagcggcagcatctagcggcgtcatcggatcagcgcaaaccgatgttaccaacccctacgaggccattccatgcgggtgcatctactgttttgtgtgtatcgcaacacgcttagaccgtgaagagggtgagggctggacttgtctaaggtgtggagagcacgtcaaagagtgcaagccgtggaatggagatgtgctcgagccgtcccgtaagtcaacatcgacaaagacagtggcattttcagacgatgtgattgggggctctgacgacggatctgtcatttctatggaataagccgcgttggggctgaggcgctgaggtgagatgctgagagtcatgaaagcatagagcttctatatcatgccacgtctttcttggatagagggaagacttggtctgcgactatttattcaaaagggtgtgcatctgtttttgggattattttgtatagtataacatgatgtgttgggttgatgggacatacatttttgaagttggaaagtttggtaactgggcgtggcgccttagagaatttggacacatttacagcgttattattgaaaaaaaaaaa

SEQ ID NO: 4015 - DNA, 467 bp, Trichoderma harzianum
cccacgcgtccgaccgaaccgccagcgaatcgacgagggcatctgtgtcggtaccggatgctgcctttgcggatggagcgtcttcatcgagacggcaggtagaaggaaagacatggccttgtttgtggcgccgcgggcactggcaacgttggtccctcggcggtatcccctggagaagcagtggcgagagaagttgatattcgcagcgagcacggcagtcgtgtttacttgcgcccttgagaatccaaagagagttagaggcgtactaggggggattttgggcatggtgttgaagaaataaaccgggcatatgggcaaatatgatctcttttagggagttctgagacgtgacatgactaatttcttcttcttctttggatgtctttggaataagctacggtttttagatgatatacacaaacaaccctgatgctataattggtaataaatcaaaaaaaaaaaaaaaa

SEQ ID NO: 4016 - DNA, 415 bp, Trichoderma harzianum
ggaagggtttcaggggctcggcgcacatgtccacgactggctagtaggcaatgcgtcctgatcgcttcttcaatttagcattcggctgagccctcgcaccgtgatgaaaacaaaccagcaggcgggtcggagccgctttgttgactgaccagggaagcggccaagatgttctatacctagaaatgcgcggccctgaggtacaagtagcgttcgcgccaatgctagcagccattcctggatgggcggaggcgaaaacaaagaccagaggagttggctactgcacccatttcaggactaggtgacattaacgcgaagcacaagggttgctcgtatgggcaagttaggtatgtacgagtacaatatcaccaacaaaagttgtacttgtatgagcacacaaaaaaaaaaaaaaaaaaaa

SEQ ID NO: 4017 - DNA, 382 bp, Trichoderma harzianum
gcgcgccaaaagactgtacacagacgtcttttgatatattttcaaaatgggtggcggtggaaaaatcccttaccccaagcacgtctggtcgccttctggtggttggtacgcccagcctgccaactggcgcgccaacacgctcatcgccggagccgccatgttcggcgtcatcgctattacgtggaagttcagcgccgacagggaacgatgggcgcataagccggagccgtgggagtggcatcctagccgatactggtcaaagcagttgatcgagtgggacaaggaggacaagctgaaggcagcaagcaacagcaaggagtagagttttctttttgggagaaggataatagacgaaattgtacaaaaaaaaaaaaaaaaaaaa

SEQ ID NO: 4018 - DNA, 990 bp, Trichoderma harzianum
gacccttgcttgagtacaataatttgacaatgggtaaaccattcccgcaagttcagcctggagggagcctgattctggcttaccgcgtcaaggacaagaatgtcctggtggtaggcggtggtgaggtcgcggctggccgcatcctcaactgcctcaatgccgatgcccaagtcaccgtcgtctgccctgcgtcaggcctcaacgaagaggtcgcattccgaattgccgagaagcaggtgacacacatcgaccgcctgttcgagccgtccgatttagacaaagcagacatggtgctggtcgccattgacgatccggcagcctcgacagcgatatggaaactgtgcaaggaaaagagaatcccggccaacattgcggacgtgccccctgagtgcgacttttactttggcagcgtccatcgtgacgggcctctacaggtcatggtcagcaccaacggcaagggaccgcggctggcggcatcactacggcggcatattgccagccaactaccgcagaatgttgggaatgctattgagacaattggagagttgcggacacggctgcgcaaggttgcccccaatcatgaagacagtcagaagcgaatgcgatggatgtcaaaagtcagtgatacctacaagtgggaagagatgagcgaaatcacggaagaggatatggacaaccttttgctgttctacccggtgaacaaggttccggatatcgacatcttgaaatcgctgcgcggcccggataacgacgtgaagaagctcgacatctttgacgggtcctttggcttcagcgtggggtcatgatgatgataaaaaaaatgaaagtgccggcgatatggggttgttttgtttttgtttgggcagttaaaatgggaatctcctaatgatgtgtttttggtgttgatgtactataaggagcaagcacagagcttttttgactaccaggtatagaatgacgtatttcttttctcacaaaaaaaaaaaaaaa

SEQ ID NO: 4019 - DNA, 1618 bp, Trichoderma harzianum
gaataagcaatcacgagtaacatcctgtttcacagcaaaaaattgagaaaattcaagatgccacctgaaagattgatcgagaccaaagctcagaaagcctgccgccactgccgtctccataagcggagatgtgacaagcgtttaccgaaatgctcgcgatgctccttaaaactcctcagatgcgaatatgatgacgacgcgccgattgaggagacaggaccagataccaagctgctgtggagcgagcacctggccatcaagcgagactcttgcggcctcgaattgactccagcaggcgagaagcagctcctatggatcgcttgccagactcaagagcagcattccgatcaagctgacaccaagtcattaatgagtctggtcagcgacatcttcaagtatggcgacacctccgcggagcaagtctcgaataggtactttgccacagcccatcactggatacccattgtagacgaaccaaggttcaagttcactcttggagtcaatcgaagctatacggaactctaccacgattccttcgcattactactgttgtgcatgctcctgatgaatcaacaaccctgtcaccacccctaatcacacccccaacagcgcgctctatcggaccacaaggcggctattctctctcctcaacacggctaccattgacacatattccctcgcaaggctgcaagcaggtctgctactgtctgcatacgagtgtgggcacgggatgaccagagaggctagctcaacattggcatcgtgttttggcctcatcaggcagctggacatgatcgccgtgcagaataaagccgagaatgggcatgggtacaaagacacccaagagcccgatagaaggctgtgctgggccagcatcgtctttttagatcgctccatcgtcctttcatgtgcagacaacactgctgcgcttcttattccgagcagtgcaatcttgcctcaggatgctgttccctacatgaataaagacaagtacgctcttatgaacacggcgaccaagttccaaacaagagcctactcagccctcttaatcggcgaggctataaaggccgtccacggtgatccagagtcttcggagtgcatagaagcagagaagctactccacgatctcgtccggcagcatgcggcaacctcccaaggggagtcataccccgtttgcgaaggcgtaaccatggctcttagcgccgtcgtatcagcctacaggaatagggcaaagcgccttggatggtctactgcccccgatgcaaagctcaacctcgacctccaatttgcctataacatagtgttcgaaatgtgccgagttgaaggcctcattatgtggaagaggtatacatccctcaacagaatgtgtttttctgggctgggttgtctctaccgcgcagcagtagacctagtcgaggtctaccccacgacggccttgcccgaagacgtcaaacagctacgggaaaatctagagtggttctcgggccattggaaggtagcagatgttttgctacagcggctgaatcggaacgtcaagatcaggtccttagaggtcgctctagtttttcataggtaacgctggtgtccatggatgcaatactacaaaaaaaaaaaaaaa

SEQ ID NO: 4020 - DNA, 356 bp, Trichoderma harzianum
acatcacaacacttacaactatcaacatctaccatattcaagatgccttctttcattgtcaccctcaaggacgatgtgtcagatgaacaggttgccgcagccaagcagaatgccaaggatgccggcggcacgatcacacacgagtacaccctgatcaagggctttgccgttgagtaccctgagggcatagttcactcgctcgctgaggacccctcagtgcaggccgtcgaggaggataaggatatgaggacgcagtaaatggagctctctattctgttcttgttgcatctacatctacatacatctacattagaaagacgtaatatagagattgtatcaacaaaaaaaaaaaaaaa

SEQ ID NO: 4021 - DNA, 971 bp, Trichoderma harzianum
cctacaccagacgaagaaagcatccaatcgttcaccatgaagccccaaactttcgttgtcgctgccctcggcctcctgtccggagaagccatggcccagagcgtgccgcctctgatctcgtctgtgtctgccgccgtctcctctgccattgcctctggcagtgccattgcttccagcattcgctccgaggcctcgtccgtcgccagcagcatccgctcagaagcttcttccatcgcctccagcgagaccaataccgcaaccactggcactgagaccaccagcagtgagaccaccttgacaactaccatcgccaccaccaccacccaaaccactgtcgagtctgccaccacagagcctgccactactatccccggaaccaccaacagcgagactaccagggctgccaccaccattcctgctactacccgctctgccaccactcgcgtcaccaccagaacctctgctaccacttctacctctaccggtctggccattgctcccactgctgatgccaagctgctggctcccatcctcggtgctgccgccgccgtcttgatgctgtaaacacctgtctcttggaactactactatctatttcatatgttgggcggaggacttgatatggagcggacgtcaagggaggaatgagtcgacaattactacgagagaaaaggaagaattacgcatacacgggacctactaattaatgtgcttgtctactcgacacacgacggcgttagttacttctttttaaattgatctctcagtctcattaccgtatgcttcttctcttttcctttctctgttttcttttgcggtatggttcggtgattcatggtcataatggatgaagtgaggtgctcaaaagaattaatagttcttcttgattcttgcttgctttgaatgttatagcatatccattcttgtttggattaatcattgagtgacctatttagaaaaaaaaaaaaaaa

SEQ ID NO: 4022 - DNA, 889 bp, Trichoderma harzianum
cccacgcgtccgcccacgcgtccgcattgactttgaagctctgtaattttgttggaaatttcggggcgtttgaggctgcctttaccatggccgctccattggccaccgccaagcagcagcttaggcgtctccttaagcagaggctctccaaagtctctcaggattccgttctcgcccaaagcagcacaatattcgaaacgctcaaaaccttcaagccctaccaagacgccaaccgcatcagcgtatacctcttccatgcccgtcggagagattcagacggacgcaattgttcgccatgctctaaactcgggaaagcaagtctttgtcccgtatctacacaagtcacccctagacgaacctggaactccagctcgcgtaatggacatggttcaactgcaggatgtccaggactacgacggccttcagagagattcttgggggattcctagcatagatccagctaccgttcatctgcggcagcgcatcctcggaggaccagatgtgcacaaatcagatcagtccaccttggatctgatccttatgcctggtgtggcttttgataccgatagcgcgggaagtgtgagacgactcggtcacggcaaaggcttctacgacttctttctcaacaggtacttggctgcgaaacctcatgatgaagctggtaatgacggccctgtactacgcttctacggattggctctcacggagcagcttctcgacccagagacggatgatccggtgcccatgggccagtatgaccggaagctgcatggcttgatactgggcaatggcgagattaaactttcacctgatattcagacaataagcgcatcttgataccatatcttgtcattacgattcttgttcaatttgcaaaaaaaaaaaaaaa

SEQ ID NO: 4023 - DNA, 1692 bp, Trichoderma harzianum
accgcatcttcaatctcgtttgccgtctttgtctttgcgctgacagaagccctgccgaacccgaagagccaccgccatccgtggaacgagattaaaaaccgcgtaaagatccggccaacagcgggagcaaaaaaggaacctggaaaggataagggaacaagagaaagagaagaagaaaaaagggtgcgctctgttacaaaagcaaagatgccggatctcaactcggtgcccccctcgcctcacgtcctggccagcggaacaccttctcgtcgtcagtcggccaacttgcagtccgcatcatcgccgccctctgcgtctgcctctgtcaacatcctgccttccccccgcctcagtcgcccatgggctcagccgatgccgccgttgggccaggcccgggacctctgcggcacccgaggcctctgacagcctctgagcttcacatacagctggaaaaggagcaggaggcagtggtaaatcgtctgactcgcgagctctcgatgcttcgggtcgcccacaatgcgtcggtcgtttcaaacgcctcgtcgacgtcgaatgctacttcttcccacgaccccattgtcgagtcgtcgctcttgtccggctccggattttcgattcctacctctcgccgccaccatagaacctcgtcttctacatcccagactttccccaattttgcctcgtcgtacgaagcccgagctcgaacatcccatcccgcatcgctttcacggcagaatagcagtgcttctcgcagaagccagactggatcgcccgcgccaccaagttccatagatccatcgacctattttcatcagcagaggaaccctgccgctgctagctccgtcatgatgagctccgtggtggctactcccggtagctccgttctgggtgaccagatgagccccggcctaatgcccgcgactttgcgctacgaagagacagctttttatcgacaggagctagataacgcaaaaaaagagaacgaggccctcaagaggcgtatccgggaactggagaggcttgtccgagagaggcgatcgagtgatgcgagcaggaacaggagcgacagcgcgagcacaacggcaagtgcaagcgttgcgccgggcggcggcgttagtatcgcgggccctcgagagagcatctatggtcatggccgagaccgcgagcgagctaggcaaagcaccacaagcttggctggcggagtgagcattggggttcctgacgaggaggtcaaggtgggcgagagtgcggcaagcggacgaccagggaacgacaaccaggggtaatcatcgactataaatgactagattatattggcaagacggacgggtatactaggtatggaagattcgggctccgttggtactaagtggaagatactattggcgttctggtgtttattagcgagactcttgcgttgattctcaaaattggttgagcttttcctttgtttttctccttttctcttttccgctctactcattgtcttgggtttttggtactggatgcggcaaaaagaccgatggcccttagcaaatagcttcttttggccctttgccctttcatttgcagcacagacaagctaaaatagtttgatgccgagttacatctcggcttcaccattaagaaataatgaattatgaaccaacaattatagtattacctagttctcactataaaaaaaaaaaaaaa

SEQ ID NO: 4024 - DNA, 1069 bp, Trichoderma harzianum
gggcgatacgtcgagatgattcgtccgcagcttcagtccgtgagatgctggtgctatcagatgctagcagatgttatcccaagttacccgatgctacagaccatccacgctgcagatcaacggccgcttcgtgatgcaagtctcacgcaaactttaccctctttcagttcttacgagatgcaagggattgatccactggagtcagagaatctgaaccgcgaccgcgaccgcgacggctacgcgcaaagtttgggccagtgactgacgcggccgttgtttgtcatcaagagtcacagagttcaatggccctcaggacagcggcatttgctgaatacgaagcgctgtgctcatggcatggggcaatgttcctgcagtagcgcgtgatatgcaaaacctctgtgcgtgcagcttgcatgatgctaggatgcaagagccactgcggttcactgggctgagcccccagactcctgacatggcttacaatacaatatggatgctgtgctcgtaagcaaaaggcttctccagtaggtaccttgctgcccgtttggaaaagcgccgagagcccatgagatatcgcaacaccgggcgattagtcgttttctcgcacagaacaacaacacatgcgggattaccacgacatacatgtgtgggagttattatttagccaacaatagtggagcatatacttgacaggcacaccaactcttgatgtttgtttttctcagcttcagtcgcggtatgatcaccaagagagcttgtgaatgctcaaaccactaccgcagattaccgatttgattcaaaccctcgattttatgccgccgcgtggcttgggcgcgattgagccctggtcgcgatcatatgtaaacgctttggccgccgattgacgaggcaagaggctacgcgggtttcagtgcgattctttgaccctggccgtcatggcaaactaggacgcccgagattctgatgaaacacccgcgatggccttgcgcatttgctatttcatacagagaggacggaacaagacatggccatcagcatcgttatcatcttgtccaaaaaaaaaaaaaaa

SEQ ID NO: 4025 - DNA, 381 bp, Trichoderma harzianum
ggaggatcaggtgcgatgtgaggctgatttggggtgtatgattcgtgagcgtgtaagaggaggcagcccacgactttctctctgtgtctgtgcttgctcacttgctcgcctccttggattcggcctgttgatccgaatcagaagtaaatgtgtttgagactgagacttggtctggtcgagacgatatgagatgtggcatggaattagaaacacgtgtttggtatggcgattgcgatgcgatgatccgcagaaagcaagatctcagggcgactaacacggatatacggaggttcgaccaagacacgaggaatgatggggaaagtctcagtatgtcactacggaatttatgattacgtagcaatgtataaaaaaaaaaaaaaa

SEQ ID NO: 4026 - DNA, 1301 bp, Trichoderma harzianum
caatcgcgctgatggccctgacgaatctcccggcgctttgccatggcggatgacgatctgctggaaaaggttcacagcctcagcgacttggagctggccgtgctgctgtgtttagtcaatcgagagcacgtcctgattagcactccgccggcagccattgatgacttggtgcaagagcttcagctgatagcaagcaagacatacagtctcaaatccgtcgtcgtcaactgccacccgtccacgacactcgaggatttcgcctcagctctacttctccagcctcagcagactcccctcaactccgcctctccggccatctcgccgttcacccgaaacgattcgtattttgcgctcaactcgctttcgaaccatcgatcctctacaccgctcagcccccgtactttcctctctccgcagatcgcgcactttgtcatcgcaaagaacctcgaccgtgccccacgagtcgtccagatccaggcgctcgaattactgcgcacgcgacgcatcttcactcgcacatcggtacaggcggcgccgaagcagtttgtctttattcctgttttgggagccgcaagcggtggtgaagcacacgtgacggcgcatctcaatgacttcttctcggttgcgcattggcataacccagaagatggatatgtcaacctagatgaggctgaaagtcgcaacaaggatgacgacgagacggcatccacggagagcgttgtgaagaaggcgtcaaatgacacgacgccatcgacggccttgatatcagacattgaaatcagccaactcgcaaagctaagccaggaagtccaaatcgacgtcgatatccttcgataccagatgaacatcatctccttccttcgaatgcaccgagcagtcgcaggtggcatcacgcctgcggcaacaaaacatctccaccagcttgtcaaaagtcttgcccctttacataagcttgatttcgtgacgcctgctttgatcgggctagccgtgagaaaagtctatctccaccgtatacgcatcaccgagcctgaaaaggagagaagtatgcaatgggggagccaactcgaggcggtagaagcgctgctcgaagatgtaggtcccgaggaggtgatggaagaggttttggaaatggttacggcgcctctgtgaaaaaaaatcttgtatttttgctccatgttgatttctttcaacccgagccagcttgtcgccaaacaaaaaagacaagccccccttaataatttcccaagtatacataatataggtagaatctcagattccaaatggcaaaaaaaaaaaaaaaa

SEQ ID NO: 4027 - DNA, 817 bp, Trichoderma harzianum
acacaattcctcgctgcgtgtgactcgtgtctccagcaaataccgcaaagatgtctgacgacgggctctcaatatacgatgagatcgaaatcgaagatatgaccttcgacgaggttcttcaaacatacttctacccgtgtccctgcggcgatcgtttccagatcgctatcgatgacctgcgcgacgagcaggatattgctgtgtgccccagctgtagcttgatgattagagttattttcgaccttgacgacttacccaaacctcctcctactggcaatactggtggccagataccagtcgctgcttaaagccatcgctatatttgagcttccctgggcgaatacttgatctattcggcagacacatcgagatactacactaattaggcccgcatagcgtacacagtgcctcaacggccgttctgaagaggcttctcagattgatccgtctaacatcggatgtattgatagacgcggacgagaagacgacgatgtaccagcgacagaccaaagtcatcccaagcatccaagctactgatgcaaaaatatgcgtgccttgggagtaccactctccgaggcaaaaattcagtcacttaaagagacaggcttcgggaatgccatgaagaattcaggctcacgtgggggacatttgatgaaagaacactgccgaggcgttggcaatacagaatggacctatgaaggacggccatttcactcatataccgtcaacataacaaaccaagataccaagggtgtattacatattcacctaaattccatgaatgcaaactacaactgatgacaaaaaaaaaaaaaaa

SEQ ID NO: 4028 - DNA, 1103 bp, Trichoderma harzianum
cggaaccaatgagtctacggctagccactcggcggctggcgctgtcaagcccatcttctccagcctcattgctggcgccgattaatggagtttcacatggaacggttggcgtactgactcagcgtcgtcacaaatggtcgatcaatgtgttcaaaggatgggggaaatctagttccaaagaatctggcgacagaggccaggacccatccgcctctgaattggacgatcccaagaagcgacagcagttcctgcaaaggaatatgcggggtggagtcgaagacaacattttccaggacgagattgaggccgcgaagccggtaaccgattctccagctgcccagacgacagaggaaaggacgaaggagagcctagcaatggtggtcgatccagatgctcggagccgtatccggtggcagcgaagaaaggtcatccaatcagtgcgccgcaacgggcagctgacgagagaggagaagatcaaaatgacggagcgcgagctcattcacaagagcgactttttcccaaccagcgtcaagaaactggtcatgttggcacggcagattgccggcaagccagtcgacgaggctattcaacaaatgaaatggtcaaaaaagaagtttgcggccgaagtcaaatatcacctggaagaggcgcgggacatggctgttgttcggcgtggcatgggccttggaaaggtcaatggtgacattctagacaagccgcgcaaggtgcgaaccaaggatggcaaatggattgagattgaagacccgacccgcctctatgttgctcagtcatgggttggacgcggcccctggcgtggaaaggaaattgactataagggacgagggagaatgggtgtcatccagcatcccagcacgagttttacagtcattctgaaagaggaaaagaccagaattcgggagtatgaagaggagaaggctaaggaggcacaaaaaggcccttgggttcacttaccaaaccgcaaggtgcatggccagagaccatactattcatggtaaagacaagagaatgaggatggtgggaattcggaagcaatagagtttgcatgacaatgagcatgtacctgtatcaaaaaaaaaaaaaaa

SEQ ID NO: 4029 - DNA, 947 bp, Trichoderma harzianum
aaagaccaagatcaggacaagacaattcgagagtgccaaaaacagcaaaagggcagagagacgtcatcatggctcaggccaagttcgccgtttatcccagcctcgtcgaccgcaccgtcgtcatcacaggtggtgcgcagggtatcgccgccgacatggtcgagcagttttccctgcagggttctcaagtcatatttttcgacgtcgaggacgagcttgccgctgatttagtccgaaaagtgtctgatcagggcgtcaaacacaagcccatatactaccactgcgatgtcatcaagatcgacgaggagctcaaacccacagcggccaagatcctgaaagaccatcccaagatcgacggactcataaacagtgccgcgagggcaatggtgaagccctcgcaggatatcacgactgagtggtgggatgagagcgtcgccgtgaacctgcggcatcagttcttcctgacccaggccttgctgccggggcttctccttgctgctggaaacgcttcggtgattaacatggggagcatcaactggctcgtctctgcgacgggtcaggcgccttacacgacgagcaaggccgccgttgtgggactgacgaggacgctggcacatgagtttggaccgcagggtatcagggtgaatagtatcatgccggggtccattgcgacagagagggagaggacggtggttatgacgcccgagtatgaggccaaggttctgggcagtcaggcgatcaagaggctgattgagccggtggaggtggcgaggatggccatgtggttgattgcagatgatagtgctgcggtgacgaaccagagcatgaggattgacggtggatggacataggatgtgggctttgaataagtgaataatgtcggtttttagatactctgctgatggttggaacattgagatggcatgtataagaaaaaaaaaaaaaaa

SEQ ID NO: 4030 - DNA, 1028 bp, Trichoderma harzianum
gacgctatcgagggctgacctgcatcgtcgtcagtcggcagacgagcggattaacaacattctcgagacggctctgcaacgagcagaaacgatggatcccgcctctctaagccttctccagaaaggctcttcccacaattcctctcccaactatggagcctccggaacggtgacaagagggatattgcaagactatcaggcggtaccgaccagcgatgaaagcgatgccacccgtccgagaaaggtttcatacagcgatgcggcgaagaaggccgggaaccatgcgaagagccagagctctctgcggcaacgaaacggagtctccggctcggaggatacaagatcgccaacaaaagcaaagtcatcatggacgaaggaaacatttcgaaaatttcagtcccttcagttggaaaacaagggaagcgtggctagagatcacctggctctcgaacgcacatttctagcatggcttcgaacctctctcgcttttgcatcgattggcgtcgccgtgacgcagctattccgcctcaacactgataacgcttccgcctccgatttcgaccacacaaggctacaaaagatgggccgcccgttgggtgcgacattcctcgccattagtattgtgaccttgctcctcggttgcagacgatatttccatgcccaggaatggatccttcagggcaagttcccggcaagccgagggaccatcattatcatgtcactggtggcattggccctcatgattttgtctctagtggtggtcattgtcatccggccatcatagaggctttggacagctatggaatcaccgacttttgactgttgattttcagttggttcctttttggaatgaagaaggatctatgggcttggtacttgtgatttaggatagcattgggtttgaagcatgtgattaacgggttttggtgttttggactttgcagggtaaatgtttggatcatatatgcatcgatgtacatttgcaatggatagaggatatctcttcactggttaaaaaaaaaaaaaaa

SEQ ID NO: 4031 - DNA, 1546 bp, Trichoderma harzianum
ggaacgtcaagtgcgaaacgcactggtgtcgcctgacgaagcaggacaagagtcaatcaattccaaaccagccgatagatctcgaactctgttcaagaccaataccaagatggaaacgaaaataggagaagagcctatacgacataccgattttgccatgacagatgctcagggagggcgaggcccgctgcagcaaccagccaccacggcacgcaccggcttggcgatgggacgcaggttacaaaaattagctcgcccaaaacgctcggcaagtcatgaacagcagtacataggtgacgagctccgtggccaaactactaggcccagatcatcttacgacccgttggtctcaacagaatatagtctaagacgtccaaagcaacatgcgacacacaactcgactgcagaacctacggtaaatactgtcattaagcctactttacggcgacgaggatccgactctagtgagagcagtttcgtacgtagtaggtccatcggcagtcctcgaagtggatttaggtcatcgatgcgaagcagctctttcgatccgaggccatcatcatctggtaataagggtagaaacaggttgactctacgctcgttatcacccacaacgtcacatcagaggcaccattctgctgcgccagctgctccttctcggcaaatggtagagaatccaactcgtcagccgttccagcgacactcagttgcgccacgtatcagccagtctctatcaaggagagatgaggattcgacatacggcgatcacttgtcagattctagtgatgacgacatgaacacaactccgttgacaaacggctctatcacgggtgatgaaaacgaacccgttcattcgaggttgaaacaatctattcttaacatgtatgcacgcaacaacctccctgaccaaacttctagtgccagcgcaggtatcaactccggtttgccaaaacacgatgcgcccaaaccgagagttgaccaataccacaatgaggagaacccgcatctacctcttgatcagctacccggcgcctcggctcgccgaccagggctcatctccacactcaggcgcaagagccatgcaaacgtcaaagaatccagcgacgctgacggtgcccgtaatactctaccgcatcatcacagtgaagacgcaacgtctacccggaacagcgtcatacccaaccacgcaataggctggccattgcagaacaggaagggcgagacgaatgaagcttcaatgacgtcaccgcttggagacacaggaagacgatccgcagctagcggctctattttcaaggacgagctgacgtcagaaccccgccatcaacatgagcttcagctttatgaaggtagctcggatgcgaaccacgctaatactttcctatcacaagaacctaagcgaaagaagtttaacagcctgaggaaaatgtttaaaattaataattaggtaattatagaattcgaataatgagataagattatatagcaattaatggtgtaaaagaatttaatggcacgctagtttcgctacaaaaaaaaaaaaaaa

SEQ ID NO: 4032 - DNA, 1429 bp, Trichoderma harzianum
aagcaatatcattgtttgctcaggaggccaaagcgagcttttcgattgattgtcctctttgttctttgttacatttcatatttatttgcgtcttggggagccattgcaattgaattgctgcgctctgggcatcgtacacacgcatttttctcggcaattccggcttgagctgcacggcatacgaaattgctgccggtgcggactcttgcagctccgaggctccgctatctccatctcaccggtgattccttgtgcgaggttcggcgagaattccagcaattattgtcactctttgtcctttcacgaacggagcgaaatatatataatcagctacgctgggtaaagagaaagaagaggaacctctgcactcgccgcatcctacgaaatgattcgggcggcgtttcaatcgagagcggcaccgtttggagcggccaagagcacgacggtacaatatggagcattgagggatgcttgggcaaggctattttcgtcacagcctgtcatgaagtccccgagcaacagcagcagaacatcatggacgaggttacattcaattcagccctggcggggaaccacgcgccacggcgcttcgatgcgaccaaatgtcaggatagctgacagctttgcgaggggggcgcaaaggcggagctttatgttttcggcatggaggcgcaacactgcgcaaggagctcaggagaagttgtcgctgagcgggagattcaagaagctctccagggaatacgggtggtcggccgtcggcgtctacttcgcgctcagcgtgctggactttccgttctgcttcctcctggtgagagtggtcgggacagaacggataggtcaagttgaacactacgtcgtgtctgcagtctccaagtttatccccgaatcggtgcgaacacgatggaacgaatggcgagagtctctgaagtctgaagagaagcagcacctgggcagcaacgaaatcagcgacaaggtggaaatggcgggctggggagtcgagaaggcgcaacagcgcaacaaggaagaagccagcctggcaacgcagctggcactggcgtacgccatccacaagagcttcatctttcttcgggtgcccttgacagcggcggtgacgcccaaggtggtcaaggtgcttcgcggatggggttggaatattggcaaacggaccccacggtcataaatgacagatagtccgaaggaagccgagattggcatttgagatctgcaagtaagcatgctattctatctggctgtatgaattttgtaatactattatcaacgtttgtttggggggagggcgcagtggtgcagttagacacgggcgtacggatcgcactactatacatctagacaggttttggcaaatattaggctggaagagtacagacatgacagagacatgacaaagacaacgaaaaaaaaaaaaaaa

SEQ ID NO: 4033 - DNA, 818 bp, Trichoderma harzianum
agccgaagcgctcgtagtagctgatgttttctttggagcttgactcgagttacttaccttggcagccatgtccatgatgagcttcttggcatagcctttgcctcgggcgctcggcttggtgccgatataagcaaggtaataatactcacgatctcccatgacctcgtccatggtctcatgcagaagaggcaggacgtcttcgtagtagcgcttgcggccctcggaaccaagttggtagtagaggcgccacatgccgcttcggaagatggtccaccagtcgtccatatgcatcccgggaggcatcctaagatgaacagacgtcatagtcaggaccaatggtcgtgacaacgccgctatagcaatgggccgagaccagataggtcatgatgcggacgtgaagcttccacttggtctcgtccgagtagcggtcctcgccgtcgccgtcgagaagatacatgctcagagcatcggcggcgaatgcgtgggcgagagagactcccgcctgctcgcactcggccagaccgatcttacggacagacttctcccaggcctgagggacgagagagcgacgacggtccacaacaacggcagaggaagctgtcgtagcaatggtattgatcgcggtcttacttataacatgcgccatgctgggctaactgttgttctcgaactcttgcttatttgtctttttattcgagttcttgtggattcttcactcgatactgcctgtataagtggacaacgcaaaagaggcgcctagtttagtgattgactctggtaagctctatatgatcactcacgtataaaaaaaaaaaaaa

SEQ ID NO: 4034 - DNA, 317 bp, Trichoderma harzianum
gttcgatgcactgccaccatcctcggagaaaggtgtgtgtagtggacaatgtatgtgtgtcattgaagaaagtaggagtaggtggcggctccttggcaaagtggcaatgttgcttggtattatggatcggtgggttgtgcccagctggaatggcttgtcttggcgatagggggaatatggagtcgttttgatgggaacggcctttttggtttaccgaggaggggtcaacatgtgcgagcatgtatgttcaaagatgggagagggagagaagaagagagaaaaatcaagaatcagttgtgcctaaaaaaaaaaaaaaa

SEQ ID NO: 4035 - DNA, 214 bp, Trichoderma harzianum
tggctggggggagaagaaaagccagaagatgcgatggggccgtgagtttgagtgtgagtattgcggcgttgtccaggtacaacgggggggacgaaatgcgaaaagcgcacaagacaaggtaaaggaaacggctaaaagaacagacagggcgtgaggataggaaaaggaaacaaaaacgaagagattcccagtattatataaaaaaaaaaaaaaa

SEQ ID NO: 4036 - DNA, 1365 bp, Trichoderma harzianum
taattctatttcactcttctgcagacgaggacggacccgattgaccatgttgcgacaatccttcagagcctttgcccgcacggctgttgcgagaccggccgcggcgagaagctacgctaccttcaactgggaggatcccctcaatgcgaacaacctctttaccgaggaagagcaggccattgcagaaaccgcagagcgatactgccaggaacgactacagcctagggtcttgcaggcctaccgagacgaacactatgaccccaagatcctcgaagagatgggcgagctgggcctgcttggctccagcatcaagggctacggatgcgctggcgtttcttcggtggccggcggcctgattacacgagcggtcgagcgagtcgatagcggctaccggtctggcatgtcggtgcagtcgtccctcgtcatgggcggcatccacgagttcggcaccgaggagcagaaggagagattcctccccgagatggccaggggcaagctcattggcgcctttggtctgacggagcccaatcacggcagcgacccgggcagcatggagagcgtcgcgaagccgcatccgaccaagaagggatactactcactgagcggagccaagacgtggatcaccaacagcccaattgccgacgtgctgttggtctgggccaagctgcaagagacgggcaagatcaggggcttcttgattgagaggaaggactgcccgcctggaacactcgagacacccgccatcaaggacaagaacgggctccgagcttccatcacgggcatgatccagatggacggcgtcccggtgcctgaagccaacatgttccccgatgtcgagggcctcaagggaccctttagctgcctcaacagcgctagatacggcatctcgctgggtgtcatgggcgccctggaggatgccattgctcgagctcgcacctactccctggagcgcaagcaattcaaggggaaccctctggctaggtaccagctcattcagaagaagctcgctgatgccgccacagatgccgcctatggcacactggccgcggtgcaggtcggcaggctcaaggacgagggcaagatgactcccgaaatgattagcatggtcaagagacagaactgtgattcggctctgcgcaacgtccgcgtgctgcaggagattttcggtggaaacgctgtgagcgacgagtatcacattggaagacatgtggcgaacctgtttgtgacgcagacgtacgagggacagagtgatatccacagtctgatcttgggcagggcgattaccggcatacaagcctttgtgtaaaatatactagcaatatagatgatgaaataaaagcatataatcacaaaaaaaaaaaaaaa

SEQ ID NO: 4037 - DNA, 1110 bp, Trichoderma harzianum
cccacgcgtccgagtatctcaaagatgggcaccaagatggatttccaacactttgcgccgcaaatcgacaagatccccaaagttacaccgaggcaaatcgcttctactgctctttggaatactgtccgcgacaacttctccatctcgacgtggatggccattggagccaccctccagggtctcttagttttgttcgctcgacctacattcgcgattgcaccggcaacgctcatcttgctttaccgattctcccacacgatgctcatgcactacggctttattcgcaacacgcagatggaagatgtcatcatgggaaagtataccgtgcaaattcccgacaaggacggtaaaccgccaagtgagccgtcggggacaggcatggctgtcatcatgctgggcttcagaaacaattccgccctcggtatgtttggagcaggcgggctggagacctccctcaagtttcaagcgatgttgaaggatctcgagaatgatccggactccggctttcttggcatgtgtgggtataaagctgccaatgagcgaccgacggccaacggtttcatgtcggtgctttatttccgtagtgttgaggatatcaatcgattcgctcacgccccgcttcatcgtgaggcctgggattggtttgtcgagctgagcaagacgaataagcatttgagtattatgcacgaggtgtactcagcgccaaagaagaactgggagaacatcttcatcaattatcacctcacgggcattgggaaaatactgaagcccgtgatcatcaatggaaaagagtatacgcccattgccaatgctcaacgtgggccattaagcacacacaagggacgagttggcaattcgagatcaggtgccgatgaaaaggagtatcttgtacatgctgaagagtgaatacagttcttgtgtattatattgcctttgaaggccggatggactgaacaacagcggttatctgttcttcgtttggccaaggctactccattctcacaaagccacaagaattccggtttacaactttgcaaaaatggttcccaataagatatttttaatacttgatgtaatgaaatacccattctagctaaaaaaaaaaaaaaa

SEQ ID NO: 4038 - DNA, 1109 bp, Trichoderma harzianum
atggcgctagaaagtcggcacatcgagcctcgggcattgtcagtccattctcgccatggcgaatcctctaatcccaacacagcacacaaatctgcctctatgagcgcatccgtcgaccaggaagcggctcagagggatgaggcagaggcttccaccgtccatgtgcgggctatggtagcagccgtgcagcagcagaagacgcggcgccgcagaggatcactcaggaaagttgcgctgctgggaagaggcgcccagcgtgacaggagagactggccgctggccatcgagactgacgcgatagctgacgcgcccatctctgaatctgctcgttttggtccggcctctggttctggaagcacggtgcacaacgctcttggcctcaacatctcccctatctcatccccgacaaatgaatatccttgccagcccaatctcaatcttattggttcgccagctccttcagcctgttttgatgccggaatgggcgggagcgagagacaggcggacatgtacaatttcacaaccgatgaggaagacataatccagctggggactcatgcttctcagtcgcttcgatctagcctccccctgtcatcgggatccgaatcttactatgctggacggacggcaactgaacgtcgacaaaaggccaaatccccgctctcctattacgcctcaactctgcctcagccaggtgtaggctgggactattccgagactgagtggtggggctgggtagttctgacggtgacctggtttgtctttgttatgggaatgggctcttgctttggcgtctggaagtgggcatgggatgtaggtaagacgccatatgcaccgcctgagcttgaagatgaccttactctgccaattgtgggttactatcctgcgctcattattttgacgtgcgtcatggcttgggtatgggttgttgttgcttgggtagggatgaagtattttcgacacgcaaaaatcagtggcgattgaacccatctggtgttttttttggttctcccaggcgcatactcgtaattttttcaattattatctagacggtgttatttataccctatataaacttaatcgatatacatcacaaaaaaaaaaaaaaa

SEQ ID NO: 4039 - DNA, 964 bp, Trichoderma harzianum
cgcaattatattatgcttgacaagttgaaactgaccaaataacaaaatacaacaacaccatggctaccaccaacggcccatccaaattcatcccagaacagctcttccacactgttctcaccataatcgactactcccacgacgcctccggcgccaaccgcacgctattcgtcctcaaaacccacggcaccctcgccgctgcaaagaaatacgccagccacgccctagaagccgtcaacttcacagccgaagactttgaagtctatcgcatccgcgccgacgaagacccagccaaaccctggacccacggcgacggcgtgctggttttcgctcgctcctttgatgggcaggagtttctcgtgggaatcgacactactccgaacaatgaggctttgaccgcgacctcggatggagagatggtgctgcccgagggcgcaaagttcttgcactaccttttgcagattacggtggactacaacgccgaccgtagcggcagctcgcagaccacggaaattgaagggacgtatgtccatcgtgcggatgcttggacggctgcgcatgtctctctcgatccaactgagtatgcagagtttgatcgtcgtggcgacgcacaatttgttgaagaatggccctttggcgaagacgttgcagttcatgccgtttctgagactggacaaaactactttattgcggtgaaaaggccccccgagcagaagcacgaggtaaagcatcactcgctgaaaaaatagttttcatgtctattgcattcggttcgtggaagtaaggacctcgtctgtcgtaatttggctacgctgtgactttcagatgttgttttaattaactcaaagctgtacattactctgtctaaagatttgggctacagatctagtaactataattataacctcctccaaacatctctccaataaaatgattcattatacattataaaaaaaaaaaaaaa

SEQ ID NO: 4040 - DNA, 280 bp, Trichoderma harzianum
gtaccggctaaatactcgacgaaatggtgtgaatcgtcgcgtaatggttggacgatggagcgatgtctttatactctgctacgcttacttatccacaactttatttcgattcaccgtgtgctacaaatagcaccccacggcgggctctcggaattatagctacagtattaagcaattgtataatagattaaggttagttttccgagtgagccgttgcatctcgggcggcaatctggggagcatattagcaatagatgagcaatagaaaaaaaaaaaaaaa

SEQ ID NO: 4041 - DNA, 771 bp, Nicotiana benthamiana
gttcttgtcattaattaaggccattacggccggggatggagctgcaagattggaaagaggcattgaagtattgcagattaactatcccggtttataagagagtttatccagaatgtcatcctttgctcggactgcaatattacacttgtggaaaacttgaatggtggcttggtgagactgaggaagcttataggtcactagccaaggcagcagagatactgcgaattactcatggaacaaacactaagttcatgaaggagctttttgtgaagttagaagaagctcatgcagagttctcatacaagatttcctccaaggaagaagaggatgattgaactgcatccgcagatgcacattacctttgtagacaacagatataaaattccatttcaccagttcgacaaagggcggcccctctttcctaattattacaatgaaaagtttctagtgagatgctgatctccctttcctactgtctacttttgatggaagttgaggttactgttgtgagagaaaataggctatcatggcagtttcttctatcttatataagagacttagagttttgatattcggaaaggggtgcaaggcatgtttcattggaagctgtaaatagctagaatttgtggcgttcattgcattccgagttctattaggggcctgcatagaagtgcaggaattctctatatataggagtaaaatattttgtcttttttgaatatttctgtatgaatgtattagggtatgattttgaataaaaaaaaaaaaaaa

SEQ ID NO: 4042 - DNA, 321 bp, Trichoderma harzianum
gccgcctcctcacaagtttgaagaagcgctcaaggacggcatcacggaggcaatgaagctgtacaaggtcagagaggtcatggtaaagagatggtcgagcaatcgaaaccgatgaatggactgttgatgtctatttcaatttctacattttcctttgcagtgtctttttgtgtaacattacggcgatacctggggaatttattgaatgtgcaaatgctatgggaatacacgtcggcgacaacgtgtgtaatgtatacgagaaacgatggaacgaatctggatcaaattacagatgcattttaaaccaaaaaaaaaaaaaaa

SEQ ID NO: 4043 - DNA, 1208 bp, Poppy
aaaacctcactctcatcgatataagcaacaccaccttgagcacgaatatctgctggtacacgttctaatgccatgacagcacaagcacctgcttcttcagcgattctggcttgttctgcattaacaacatccatgattactcctcctctaagcatctgtgctaatcctactttaacagagaatggtgaggtttttgcctctgttattgctccatttccatatactgttactattcctgtcatggctaaagctcgaattggtcatttcgttgaagctcagattcttgaagcgattggtgttgattatatcgatgagagtgaggttttgacccttgctgatgaagaacatcatattaacaagcataatttcaggattccatttgtttgtggttgtcgtaatcttggggaagtcctaaggaggattcgggaaggtgcggccatgattcgaacaaaaggtgaagctggaactggtaatgttgttgaagctgttaggcatgtgaggtctgtcatgggtgatattaggcttttgcgtaatatggatgatgatgaggtgttttcatatgcaaagaaaattgctgctccttatgatttggttatgcagactaaacagcttggtagacttcctgtggttcaatttgctgctggtggagttgctactcctgctgatgctgctctgatgatgcaattgggttgtgatggtgttttcgttggttccggtgtttttaagagtggtgatcctgctaaacgtgctagggcgattgtgcaagctgtgactcattatagcgatcctgacattcttgctgatgttagctccggtttgggtgaagctatggttggaattaaccttaatgacagtaaggttgaaaggtttgctgctcggtctgaatgaataatccaaaggctttgatttgactgaattgcacttgaggtgagaattagacctcatttccttgctgttctttggttattcatagaaaaaaaaaaagaaaatatatgaatgtttcgttttttatttgtttgaatgtgtctggtagatatagataaaatgttaggtgttctagttttgcttctcttccgtgtaactgaagaagaaaggttgttgtttttaagaatcttatggaacgatgtttggttcagatatattctattgaatattccctaataatgttatatgttatcgcaattgatagaaaaaaaaaaaaaaaaaaa

SEQ ID NO: 4044 - DNA, 274 bp, Trichoderma harzianum
cggacgcgtgggcggacgcgtgggtccggacgcgtggggactagataggtagagatggtttggcggtcaatgctgtgctcgttagatgtctcacgggggcccgcatgtatctccatgtagttcctcgcacgcagcaagaaagaggcaaaacccgcgcggtgttagtagcgtttgccatcggaagacgatcgcccagcacgtcaaagaggccatttgatcagttactcgattggtgctcgcacgggttggttacgaaaaaaaaaaaaaaaaaaaa

SEQ ID NO: 4045 - DNA, 1521 bp, Poppy
aacagaggaagagagagaaaaaagagaacttttatttatttcgctgcttcttctgtttctccttgtttgattcttttcaaatctcaaattcctcacttattcacttacacacacacacactctctctctttcttgattgttgaactcatctcttgtttccttagccgccatggatctagatctgtggattacaaaggttaaagaaggtcaacatttaatggagaacgaacttcaacttctttgtgaatatgtgaaggatatcctcatcgaggaatctaatgttcaacctgtaaatagcccagtcactgtttgcggtgacatccatggccagtttcatgatcttatgaaactcttccagactggcggtcatgtaccagaaactaattatatatttatgggcgatttcgtggatcgtggatataacagtcttgaagtcttcactattcttttgcttctaaaggcaagatatcctgcacatattactctattgcgtggaaatcatgaaagcaggcaattgactcaggtttacggtttttatgacgagtgccaaaggaaatatggtaatgctaatgcctggagatattgcactgatgtatttgactatctcacactctcagctattatagatggaactgttctctgcgtccatggtggtctttctcctgatgttcgaacaattgaccagatgagggtcattgagcgaaattgtgaaattcctcatgaaggtcctttttgtgatctcatgtggagtgatcccgaggaaattgaaacatgggcagtcagtccaaggggagcaggttggcttttcggttctagggttacaacagagtttaatcacataaacaacctggatcttgtttgtcgggctcatcagcttgtgcaagaaggtctcaagtacatgtttccggataaaggcctagtaactgtgtggtctgcaccgaattattgctataggtgtgggaatgtagcttcgatactgagcttcaatgagaatatggagagggaggtgaaattctttacagaaaccgaggagaacaatcagatgagaggacccagatcaggagtcccttatttcttatgatttgggagcctgtgtcatcacagaattatttatatgattttgagaagcttggcaatcccacgtctccatcttcgcctgatgaagaaaggaaagcaaagttaacacttgttacaaggaagaggcgtatagcacattggacatcattcttatttcgagatgctgagcttcactgatcatgcgatgtcactattgatagtgttgtatattagtgagttgacctttttaagtttttgatattttgggttgatgttagtttcattaatataatgtaatctaaaacaaagttgtgggtcgtgttcaggtttttggattgttgatttgcaatagcatctgaaatctgaatgcatgcattttctgtttagataacaaattgtaaaagcacattggatgatgttaatgaaaaattcaattttagttctttattcaaaaaaaaaaaaaaa

SEQ ID NO: 4046 - DNA, 1798 bp, Poppy
agaaccctcttcatcatcttcttcctcagaaatctcctgatcttctttctaaattcccaatctaaccctctccaatggatcccgtcaatgaatggggtaacacacccttaaacgttgcagatccagacatcttcgatttaatcgaaaaagaaaagagaagacaatgcagaggtatcgaattgatcgcttctgaaaacttcacatctttcgctgtgattgaagcacttggtagtgctttaacaaacaaatactccgaaggtattcccggtaacagatactacggaggtaatgaattcatcgatgagattgaaaatctatgtcgttcaagagctttggaagcattccgatgtgatccagcgaaatggggtgtgaatgtacagccttactctggtagtcctgctaattttgcagcgtatactgctttgttgaatccacatgatagaattatgggtcttgatttgccatcaggtggtcatttgacacatggttattatacatctggtggtaagaagatttctgctacttcaatttactttgagagtttgccttataaggtgaattctactactgggtatattgattatgataagttggaagagaaagctttggatttcagacctaaattgattatctgtggtggtagtgcttatcctagagattgggattatgctagatttagagctgttgctgataaatgtggtgctcttttgctttgtgacatggctcacattagtggtcttgttgctgctcaggaagctgccaacccatttgaatactgtgacgttgtcacaaccacaactcacaagagtttgaggggacctagggctggtatgatcttcttcaggaagggtcctaagccggccaagaagggtcagcctgctgatgctgaatacgattttgaagacaaaatcaacttctctgttttccctgctcttcaaggtggtccacataatcaccagattggtgctttggctgttgctttgaagcaagctatgactcccggattcaaagcctatgctaagcaagtgagggcaaatgccgttgccattggaaactacttgatgagcaaggactacaagctcgtcactggcgggactgagaaccatcttgttctgtgggaccttcgtcctcttggcttgactggaaacaaagttgaaaagctttgcgacttatgtagcatcaccgtgaacaagaatgccgtctttggtgatagcagtgctttggcacctggaggtgttagagttggagcacctgccatgacttctagaaggtttggtggagaaggactttgagcagattggtgaattccttcaccgggctgttcagcttaccctgaaaatccagaaagaacatggaaaactcttgaaggatttcaacaagggacttgtgaacaacaaggaaatcgaagacctcaaagtagacgtcgagaagttttcagcttcctacgacatgcctggattccttatgtctgagatgaagtacaaggattagattgaagtaaaatcttaaaatggatattactaggtaatatagtcttcaatgctacgtgttttgaaacctaaattttcaattcacatcccactttacttccgttgctcttattgaagcaaattaagttctatcttttcttttgttattcgagggttctgaataactttaggtttctgcttgaacctgaaatgttatttgttttattttttctcttttggttctccgtaaatgtaaaagtttctttgtcatgctagatataatctaccaatctttatttgggttttgaatttttaaaaaaaaaaaaaaa

SEQ ID NO: 4047 - DNA, 627 bp, Nicotiana benthamiana
tttttttttttttttagttaagaatcacaccatatcatatacaccaataacatcataaaggatcactttatccatataacacaaattccattacactctaaaaatcatactggaaaaacacacacacacacacaaattacatacatgccaagtaaaaaccagctccggcgacggctactgaagaagttcgccgccggtaatgaacactgaacagtggcaaagaaaatgaaagaagaaaaacttggaaaataacagtcattattaaaaagaatctgattaaactaatcacttcttgcctaagaagtcaccggccatcttaagataatctgatcctccttcagatgctttcgctgattcatcatctcctgatttcagaaatccttctgccattttcacgtattgccataccttctccttctcttccggtgccggcgccggtgctggtgccggtgccggtggttcttcggtatctgcggttgccggtgcctttgtttcctcagtatctgctgccgccggtgccggagccgatgcctttgtttcttcagtatctgctgccgcaggagccggtgccggtgcctttgtttcatcagtatctgctgccgccggacggacgcgtgggtcgagggg

SEQ ID NO: 4048 - DNA, 955 bp, Trichoderma harzianum
agcagcgactcttcgtcttcgtctccaaccaccacaatgtctggctacaccgtccgcaaggttgctgcccagaacactctggagcaccgcgtctacatcgagaaggatggcgtccccgtgtcgcccttccacgacattcctctctttgccaaccaggagcagaccatcctgaacatggttgtcgagattcctcgatggaccaatggcaagctcgagatctccaaggaggagctccttaaccccatcaagcaggacgtcaagaagggcaagcttcgcttcgtccgcaactgcttcccccacaagggctacctctggaactacggtgccttcccccagacctgggaagaccccaacaccgtccaccccgagaccaaggccaagggtgacaacgaccctctcgatgtctgcgagatcggtgagcttgttggctaccccggccagatcaagcaggtcaaggtcctcggtgtcatggcccttctcgacgaagaggagactgactggaaggtcattgtcattgacgtcaacgacccccttgctcctaagttgaacgacgttgaggacgtcgagcgccacctgcctggcctgctccgtgccaccaacgagtggttccgtatctacaagatccccgacggcaagcccgagaaccagtttgccttcaccggcgagtgcaagaacaagacctatgccatggacgtcatccgcgagtgcgctgaggcctgggagcgcctcatcaccggcaagacccagcccggcagcgtctccaccaccaacgtgactgtccagcactctcccagccgcgtggcccccgagtctctgcctcctctgcctccccaccaggacctcccccctgagaagattgacgcttccatcgacaagtggttcttcatcagcggtgcttctgcttagtatgcttaatttacgatgaaagtttgatggcgtcaaaaaaaaaaaaaaa

SEQ ID NO: 4049 - DNA, 470 bp, Nicotiana benthamiana
cgttggaaataagaagcgtagggtaataaaggaagaaaagtatgctgctcgaagggctatcttgcccatgcttcaagctgaagaggatgaaagattcgttaaagagtggaagaagtatcttgaagaagaggctagaatcatgaaggatgttcccggttggaaagttggtgaaagtgtttacaactctggaaaatggatgcctccagcaaccggagagcttcgtcctgatgtctggtaatatgttggcaggagacaacgaaaactgctttgtttcagtggagttcatacttacctttggatttctttcctcattggaataaaatgtatctgcaaaatctgtacacatgtttagaatgaagttacatgatttgctttaacgcggttagcgttctccctcctatctcatggaagttcagataatcagagacaatgctagttccatgttctcttaaaaaaaaaaaaaaaaaaaa

SEQ ID NO: 4050 - DNA, 1378 bp, Trichoderma harzianum
cccacgcgtccgccctcatatattgaaggcatcgccaacccgatcacaaaccttcttgtccagacttgcaaaccactcaatcgattccttgataccccttgggacaactctacttgttctctccaaacttacccctccaaataccatcatcaccatcaccatgaccaacgacgtctctaccaacggctcttctgccgctcctgcgaccacctttgccctcaaggctggtctcgcccagatgctcaagggcggcgtcatcatggacgtcaccaacgccgagcaggcccgcatcgccgaagaagctggtgcctgcgccgtcatggccctcgagcgagttcccgccgatatccgcaaggacggcggcgtcgcccgcatgtccgacccggctatgatcaaggagatccaggacgccgtcaccatccccgtcatggcaaaggcccgtatcggccacttcgtcgagtgccagatcctcgaggctcttggtgtcgactacattgacgagtccgaggtcctgacgcccgccgacgacgagagccacgtcgagaagagcccctttggcgtgccctttgtctgcggctgccgcaacctgggcgaggccctgcgccgtattgccgagggcgctgccatgatccgaacaaagggcgaggccggcaccggtgacgttgtcgaggccgtccgccacatgaagactgtcaacagggacattgcgcaggccaaggctgctcttgccgagggcggtattgttcgtctccgcgagcttgctcgtaagctcgaggttgacgtcgagctgctgcgccagactgctgagctgggccgtctccctgttgtcaacttcgccgccggtggtgttgccactcctgctgatgctgctctcatgatgcagcttggctgtgacggcgtcttcgtcggcagcggcatcttcaagtctggcgaccctgccaagcgagccaaggccattgtccgcgctgtcactcacttccgtgaccccaaggtccttgctgagtgcagcaccggactgggcgaggccatggttggcatcaactgcgacgctatgaagcccgaggagaagcttgccggccgtggctggtaaataccccctattatatgattttagcaagggaaagcaagaggaggaaaagcaaaagtgtggtatataaaaacggaagagacagaggaggaaaaaatgactggcacagagcctcaaaatgtatctattctactgttggatttgggcgttgtggactttttatcgctttgggtggcacttagcatgctgaacatcaaaattctgaagatgccgtcaggatatgcaacctattgaggattatacagcatagcacgaaatctacatttacttgtttgcaaaaaaaaaaaaaaa

SEQ ID NO: 4051 - DNA, 1143 bp, Poppy
agcaagattagttgcttctggtttgccgaatttccatggagtatcaagtactaaaattgatggattaaagctgaaagaccagagtaatggaagctatggtgtaatagaagcaaagaaagggaacccaccgaaatacagcaagattagttgcttctggtttgccgaatttccatggagtatcaagtactaaaattgatggattaaagctgaaagaccagagtaatggaagctatggtgtaatagaagcaaggaaagggaacccacctgtaatgccagctgtggtgacaccaggaggacctatagacctttcatctgtgttgttcaggaatcgcataatcttcattggtcaaccaattaattcacaagttgctcaacgagtaatatcacagcttgtaacactagcagctattgatgagaatgcagatattctgatatacctgaactgccctggtggaagtacatactccgtgttagcaatatatgactgcatgtcatggataaagcccaaggtgggcacagtctgttttggtgtagctgcaagccaaggagcacttcttcttgctgggggtgaaaaaggaatgcgctattcaatgccaaatgcacgtattatgatacatcaaccccagagcggatgtgggggtcacgtggaggatgtgcgacgtcaagttaatgaagctgttcaatctcgcaataaaattgacatgatgtatgctgcttttactggccaacctattgagaaaatagagcggcaaaccgaaagggatcgctttttctcttctgccgaggctttggagtttggtctaattgacggtgtgttggaaactgaatactgaaattcaaagactggcacaggataattataattctttgcgttggaatcgccatggtacacagactggtttagataactcgctattcctaaacattaaaccaaacttctaaagtagaaggattattgatcttgagctctacaaagtaaagttttacatttaaataccaatactggaagtcttggggttgtagttttggcagtctgtaaagagggcatttcatggaaatgcagcattatgaatcaagtaaattagttacaatactatcttttcacaaaagacattggtgtttgtttcgaaaaaaaaaaaaaaa

SEQ ID NO: 4052 - DNA, 900 bp, Nicotiana benthamiana
ttttttttttttttttaattctgaacgagcttaatcttatataaaatttaatttttttccttttgcataagtatacataattgaatctacagacctcgtcctagattcaaaattttattctaacacataatctcgaaacttcataaaatgtatgcgaatctgttcatttgggagcggaagcagaagttgtagcagcttgagaacgagctcggaaaaaagcaagcaactcatctcttggaggcagagattccttgagttggctgcagttagtgtactcatctctccacttagaaaaatttggaaatttttcacttgtcattaaaacaattccagaggcttcttcgaaaactcctagccaaaatgccaccaaatttgctgcaatatcagcaaacccaaatttgtcacctacaagaaacttcttatccttgagctcattgtcaagaactttcaacatctcccaaacttgctctttagctttttcttgttcctcccctttgctaaggaaagtattcactattacagtcaccttatcgtcaaggaacttagcccagaaacgagctaaagatcgatcataagggtctttaggcaaaatggaaggaccttcaaaagtctcgtcaatgtattcaagaatgacaagagactcagaaatgggtttgccattgtgaataagcactggtattttcttgtgaacagggtttgattgaagaagcagagggctcttgttttgtaaatcttcttctacaaattcatatttcacgcccttaagctttagagcccactcaactctgtgactaaaagggctataccaaagaccaagcaacttcactcctgccatatgatatcactactttggttctaaatgtttttgcggacgcgtgggcggacgcgtgggtcgagggg

SEQ ID NO: 4053 - DNA, 1032 bp, Nicotiana benthamiana
ggctctttctttgaccaatgttcttcattttgcttctcctcttgaactgaaaaattcattgtattgtgacaattggttgaagaaggagtaccacagtggggttgggatgtttgggtctggaatgaatttgataaccacaataattggttttggaatgagtgcaacttttattgtgtttgtgtgtataagactgatttgtgggaggataagcaggagacaatcaaggcaaatgtttgagattgaatcagggattgatcttgaaatgccagagcatcgaattaatgggcttgactcagttgtggttgctgcaattcccaccatgaaatttcatcgcgatgctttcacctcctcggaagatacacagtgcagtatatgtttatcggagtaccaggagaacgaagttctgagaattatgcccaaatgtggccataattttcatctttcatgcattgatatatggctaaggaaacagtctacctgtccagtttgccgtctttctgtacctgaatccattgaaaataaacaaaggcgtcctccaatgcttggcagggatcgaaactctgatagttctgagatttcagttgagcattcaaggcaatggctgctacctattgctgaacagtcgcagggtactgtaagtaacagcaacgaagctgtttctgtgtcaataaaccctgcatctgcagtctctgcggaagcagaagcaaggtcatgacaaaaggcaaacatagaggtaccataagatatttgcattcagatgttttcttgtatcagacccatcttattggagactaaaaaatgagactgattctgaacaaggagaatctgaagataaggaaggaggacacagcttcttctgtagtttaatgttgcatataaccagttaggagttgtagttgcactcttttaaagatttggagattttgggccaagtttaaggtacactggttatcttgtccaaacaaagtgcattttctttcatattgtacaatgccaatccgctggtaatattgctgcaaaaaaaaaaaaaaa

SEQ ID NO: 4054 - DNA, 1938 bp, Poppy
gtcgacgaattccccaccactaaaattattttttagtgagagaaatctttttttggggttgagaggagagagagagacacacagagagaaaaaatggcgatggcaatggcacttcgaaggctctcatcttcttcaatcaacaaacctatccgtcctctcttcaatgccgattcctactattgcatgtcatctcttccaagtgaagctgttgatgattctaaggataaatctcgtgttcaatggccaaagcaattgaatgcaccattagcagaagtggatccagagattgctgacattattgagcttgagaaagctaggcaatggaagggtctcgaattgattccttcagagaatttcacatctgtgtcggtcatggaagctgttggctctatcatgactaacaaatacagtgaaggttatcctggtgctagatactatggaggaaatgagtacattgatatggcagaaaccttgtgccagaaacgtgccttggaggcctcccgtttggatcctgctaaatggggagttaacgtgcaatctttgtctgggtcccctgccaatttccaagtctacactgcactattgaagccccacgagagaattatggcacttgaccttccacatggtgggcatctttctcatgggtatcagactgacaccaaaaaaatatctgctgtatctatattttttgagacaatgccataccgattggacgagagcactggttacattgattacgatcagttggagaagagcgctacactcttcaggccgaaactgatagttgctggtgcaagtgcttattcacgattctacgattatgcacgcattcgccaggtgtgcgacaagcaaaaagctatattgttggcagatatggctcacatcagtgggcttgttgctgctggtgtcatcccatctccatttgagtatgccgatgtggtgaccactacaacacataaatcccttcgtggaccacgtggggcgatgatattttacagaaagggattgaaggaagtcaacaaacaaggcaaagaggtcatgtatgactacgaggacaaaattaatcaggccgtgtttcctggtcttcaaggaggtccacacaatcacacaattactggattagcagttgcactgaaacaggcaactaccccagaatacaaggcttatcaagaacaagtgctcaaaaattgctcacagtttgccaaaaccttgaacgcattgggatatgaccttgtttccggtggtactgaaaaccatttagtcttggtcaatttgaaaaacaagggtattgatggctcaagagttgagaaagtaatggaattggttcatatcgctgctaacaagaacactgttcccggggatgtctctgccatggttcctggtggcattcgaatgggaacacctgctctcacttcaaggggattccttgaggaagatttcgctaaagtagcagagttctttgatgctgctgtgaatttggccttgaaagccaaagctgaatgcaaaaaaggtgcaaaattgaaggactttatggccgcggttgaaaacagtgctagcattcagtctgaaattaaacagctccgtcatgacgttgaggaatatgcaaagcaattccctacaatcgggttctgcaaaacaacaatgaaatacaagcaataaactccactattataagtgggcatatatgcttcggtagtgcagtggagtatctacaaaggcgaatgagatggacacgggaagggagcaaactgccttttaatgtagggaatatatgaatgctttcaatcagtgaatgggatatattgttgacactacagggttctaagcatgaagagagtaccatttggttcaaatttcattcttcattcaagaattgaattatatgtatattattaaacttgatcaattataatgcaacaatataaaaaaaaaaaaaaa

SEQ ID NO: 4055 - DNA, 488 bp, Trichoderma harzianum
agattgcaggcaccctcaattggcatcacatcatgctggcgacaagagcactccgagcggcccacgggcccaagcccaacatcaccggcttcaacatgcgagccctcaaagaggccactggccagccccgatacgacccttgggagagagccgaggcatggcgatacaagggcaccttttccagatggaaccgattccggagcggcttccctggcttgggaatcgcgtctgttgcatttgccggatactgcgcctacgagtacctcttcctcaaggatgaacaccacggcgagggacatggcgaggggcaccactagagcgttttttttttgcgagcgagagcagtcaggagtgtgcgagaggagaagagagaggaaatgtatatacatctctccaaagacaagaaaactcaggcctggtcttgcggcgggcaaaaaatgaatccaacacaaatcaatataaactctatttagaaaaaaaaaaaaaaa

SEQ ID NO: 4056 - DNA, 132 bp, Trichoderma harzianum
cggacgcgtgggcggacgcgtggggatcaatggaacatgaagttggatgtgcgcagtactgtagcatcacatagactagaagctacatggaaatgcgacacagtgttgcacatccgaaaaaaaaaaaaaaaa

SEQ ID NO: 4057 - DNA, 373 bp, Trichoderma harzianum
aagaggcaggaaactctcttttggccccagaaaatgccagactaggtccgaagaactatcgattctaacgccgatgatgtcgcttgccggcagtcgagggctcggaatcggcaacgcggttccttggtaattggccacaagctggggcactatctggagactatccgcccgagctgtccgtttggcctttcctaaattgcccattcgagttaatgatgtaatgaggagagggactcttgaaaatggatataagggcgcagtcgcgcaagctgttctgagctgaaaagaaaggagagagaaggtctctgtacaagcaggagaacaaatcttatctcaattgcaatttgaaattccatcgccaaaaaaaaaaaaa

SEQ ID NO: 4058 - DNA, 405 bp, Trichoderma harzianum
ttcacgaccatgggactcaccttgagggtgtcagcagttgtaggcagtatcttaagctgacacggacaccgtgctcggaaattttgtcaatggcagcgtccgtaatagacacaccctctgtcgtggcccggagcttgacaatcttcttaatctcgtctgccgagtatggggaggtggggatgatgagcattcgggcaaggaagtcaggaggaatgccatgagccgcgacaacgtcgtcggtacctcttattgtggacattccacggttggatgccaaaaccacaatgggggcgaggtgtgattccaatgctcggtttaaataggtgaagcactccacgtcaagcatgtgagcctattgtagtccagtgttagtatctgataccagtagattaaaaaaaaaaaaaa

SEQ ID NO: 4059 - DNA, 862 bp, Trichoderma harzianum
cccaagtccagatagtcaacagatcaaacacaagacaaacctgcctgttcgattactttgcctccttgtagtacaattcgcaatagttcaccaaatcaccagtcatcatgcctgtcactgagtttgccattatcaagctgaggcccaatttcgaccccctcgagtttctcgagacactcatggagtgtcaagagattcaggacaattggattcgccgcaatcagccatgcaatctggcgcctggcatgaacctgagcagcatgtacacggatgccacagaccaatcaacacttctcatcacggcgccgtgggattcgcccgaggggcatggggaatggatccagagtcttgagaacaggacggccaatggcaacttaaccgagttcagcgctccgggttgcgactccgtcttgctcttccacatggacccggcgggagcgaggccacagatgcgggaagcctttcagcacaaggataccaacgacgtattcgacgtctgtcgcttaacattcaacggcgatcagcgggaggcaatacaaaccaaatatcaagcactggaaaacgagctgcgaaaggaaggtctggagaagagcatatgggcgggctggaggattgaaaaggcagctggtgaggaagacaaggaagatttgattgtattctggactggcgatgttccgaagaaacgactggaaggattggcgagcctcgccctcaagaaagatcatcgccgcttcaggcacgtcgtgtaaataggcatcaccgagtaaccgggggggctccctttcttcaggtagcatagccggcacaagaaagacatcgggctcaccagattttggtgtgcgattgttgaaaaaaaaaaaaa

SEQ ID NO: 4060 - DNA, 782 bp, Trichoderma harzianum
aaccagacggagagtctgtttcataccttttcccagttctcgactggatccaacatcccacctaagccatcagcagaggagcgtgacatagaagcgagattggaggatgtattagacaagcgcgacaatgtcatcgcccagctcgcccgacttctggattctgaagcatccctcaacacatccgcgctcaaacaaaacaacctatccctgctccgagagaagcttgcctctcatcgccgcgacctgacccgtctcaagtctacactgcagcaagctcgcaatcgcgccaacctcctcagcaacgtgcagtccgatattgacgagtaccgcgcgaacaacccggaagctgccgaggccgattacatgttggacgagcgtaatcgcatcgacagaagtaacgatgcgacagacagcgtcctcagccaggcatatgctatcaacgaaagttttattatccaaagggagaccttggcgagcatcaaccggagaataaccatggccgccagcaaagtgccaggcatcaactcaataattggacgtataagtaccaggaagaggagagatggaatcattatgggaacttttatcgcattgtgctttatcgtcttcttctggttcaggtaaacgggccatcatacattcaccggtgctgcacatgtcgtttggcgtttagggggggtatatcagcggttcttgtctacttgtacaatatggcaggatccataaaacatatctaatctctttgtcgtttttaataatacaggcgcaggattttggagaga

SEQ ID NO: 4061 - DNA, 432 bp, Trichoderma harzianum
agccgagttaagcggcgatagaagcaacaaaggtgaagttgtgccggtctggtggtttattggaaagaaacgaagagaagaatgttccggtcaagggaagcggcctttggtcagtagccaaagggcagatcaagcgccgccttggaggattaaaagggcggctgcaggggtcccaaggctggtgcgcctcatggaattgtatcgaagaaagtcgatggtgtggcggtgcccgataacgcaaaaagctggcaacctttgtgctgccatgcgggctagcagcgggtaccgccgagtatttgtttgtcactgtacagaggcgagacgtgaggccgagattcgcattggttcggagtctggagtagggaggacaatatggtagcacgattgtcattgtgattgctttgtttattagtacttaaaaaaaaaataaaa

SEQ ID NO: 4062 - DNA, 426 bp, Trichoderma harzianum
gttcttgtcattaattaactcgaccccgcgtccgttgataccctgttttgatatacaactactacatgttgggcaatgatggcgcaagatgggatgggatgggacaaggaggacttacagcagggactcaaaggtatatccatcttacctccctcgggcacttgaagcatgaagctttgttttgtttttgcaacacatctttgaccgcttctgcatgtggttccatgtataattatcatttcatttgtttgcacgaacttgggagggaatttttcatttgtatggatcaagatgtatgaggcacgggcatctcatgacaagatggcttgttatgtaatattatttgatgtcatacgacatgaagcaaaatattttttacaaaaaaatattataatgaaaatatctaaagatgtaaaaaaaaaaaaa

SEQ ID NO: 4063 - DNA, 321 bp, Trichoderma harzianum
cccagcaccttgttgatacagtacagaaatgctgccagtcgtacgagagccatgggtgctccgtcgagcgcctctagcttgacgccagaaggatcgaggctgattgacgatggagccctggcccgcttttggtcctgtgcgcgacagatgctgggatgaggagaatcgtgatgacgaatatgtattgatatcatatcgtgagagagacatggttggggcttactggtctctgtacgagtacgatgctgtacgttcgtgttgaattatcttgtactgtatcgtgttttgtcgatctgggtggtcagtctaaaaaaaaaaaaa

SEQ ID NO: 4064 - DNA, 343 bp, Trichoderma harzianum
acaagacattgatcctcagtggtttttggtggaatgcgcatcctttctagcctttattatctgctgtgatgttgaggggcacaagagctgactggattggcagaagataatggcaaaaaagagatgcgcaaacgttagtacaagctcgaccaagagcatcatctttaccatcacatctcatttttcaaatacatgaaatggtcagatatattcatacgtgtccaagcgttcagaaaccagccaatctcagtcttacatacttggaacatttacatagtattgagtcgcctattcatcaggaaatcctggttcaacaaaactcctccactcaaaaaaaaaaaaa

SEQ ID NO: 4065 - DNA, 568 bp, Trichoderma harzianum
caacctcataacaaccacaatggctgcacaagaaggacgagctccatatccgccattcacacttgagacagctcaagtcaaagtcaaggccgctcaagatgcttggaacaccagaaacccagatggtgtcaaaatggcatacaccccagactcaatctggcgcaatcgcggcacatttctacaaggccgcgacgagatcaaggcgttcttaaccgacaaatggagcaaagaagacggctaccgacttcgcaaggagctttttgcttttacagacaacaagattgccgtgcagttctggtacgagtggcatgatgaggcaggccagtggtggcgcacgtacgggcttgaggactggacttttgccgagaatgggctgatgaggaaacgtcagatgagtggaaatgacgtgaagattagcgatgcggagagatggttcaaggatggcgttgatgtgaacaccgtcgacatttccgagaagcactggtgagggaggctatttactaaactttaatgaagtcttttgaatatatagataagcaaagtttggtttatgaaaaaaaaaaaaaaa

SEQ ID NO: 4066 - DNA, 144 bp, Trichoderma harzianum
cgaatagtttaaagagcaagggtataagactgaattagaaagtcacctccaaatagcaagagctaatgatagctccgtgttgactaaaggcattgcaactctatactgtaggtagtttaaagctctcaacactaaaaaaaaaaa

SEQ ID NO: 4067 - DNA, 194 bp, Trichoderma harzianum
gtcgtggatagcggatggatacttgcagtaatatggggtaagtgagtgagtgagtgagtgatatggatacagcgggatgatgatgatggtggtggtggtggtgttgtcactgatgttgtcgagtgagttgtttgttttgtttacctttggaattgattgaaatgaaatgaaatgaaacaggaaaaaaaaaaaaa

SEQ ID NO: 4068 - DNA, 499 bp, Trichoderma harzianum
gggagctatgatgggcttcatggcgtggaaattggtttgttttctctcattcgttgactcttttcaatcaatatacacaagcagatgggtattggttaaagagggcgagcgagagattcacttcaacgcaaagccttgaagagagaacaactactatagcagttacatcaccacgtccaaactatttcgtgcatcaggaatcctgcttcttgggacgcgcttgtggcacctcttcatcaatgggcatcagtgcgtctgccgtggcatctgcgcgacatcgtcacggcataaactggcgctacacctcgtgtgtcttcctccagggtagagccggccagctgcgtagttatgcagaggtagcttcttgagcccattggcggtcaggtcacttgtcgcccaatccgagctcaggaggcacttgcatggaatttatgcggatgacgcttgcagaagcgtttggaatacagtataggtgactacctcgaaaaaaaaaaaaaaa

SEQ ID NO: 4069 - DNA, 318 bp, Trichoderma harzianum
aagacggattactcgcacatatcgcgtgagaagagcctcctcgtggttatttgatgctagaaaccgcaggtccgtgggttgtttcgggagaggaggaaacccaggggaaagggtcgctttggatgaggctgtgccgtattagccgcgtatattgccaatgagtgtgctgtgtttggtggttgtgttgccttcaagatgcaaagtaatatatttccatcttggcatagcatgtattgctacgtacgtagtagtatgcagatggctgggattgatgctcttacatggagtatattcccagcttcctaaaaaaaaaaaaaa

SEQ ID NO: 4070 - DNA, 491 bp, Trichoderma harzianum
cggacgcgtgggcggacgcgtgggcggacgcgtgggcggcatttgacatctacaattggcttggtgaaggctgagctaataggagctgtgatgcctcggtattcagactcaggaggcggccttcacactcttcgccacagccaacccgaactctatcgaaatatcctccacgtacttcgtctgccacccgtcgactgatgcctttgaacacggggccgcccgaaaaggcccgaggcccgacaacgaggaagggaaagagcccgctggcgcctcgtttgatcgaggcggctatggggcggaactggtacagtatggaaagaagaggactaggagaactacgaggagggctaaagaggctcgacgccggcgtggccgagcgtggagtcatctccatttgtcccgtagaagggacttgtcgttgttgggagagtatgtatcctgtccaacatgaaatcatcgagagaatttgcctctgtcgaaaaaaaaaaaaa

SEQ ID NO: 4071 - DNA, 505 bp, Trichoderma harzianum
atgagacctgttcggaagattctgcaagcgactcatttcaaacccgtaatgaaagatggcaagagaatgttgacgccttgctctccaggagacccggagaagattgagatgacgtacgacgatgtcaagccggaagaactgtcggctccggacgtgacactccaagattttgagatagctttggccgactcacatcctacagtgtccaaggatgacattgagaagcagattgaatggacgaatgaatttggaagcgagggagcttaggcaatggggcgtgtctttgagagtacatggcacagcggcgctttgaggagttagaggggcatctaggcactctttgcacatacaatgttgaattcgggaatcgtaatgcatctgtcttactggaaaagaagaagaagctgttcatattcgattctttttatggtagatagtgggccggcatctttgtaggatgtgattaattttgagtccaagatgaattggtaaaaaaaaaaaaaaa

SEQ ID NO: 4072 - DNA, 887 bp, Trichoderma harzianum
taatagatcttacagtatcactactccatctcagttcgtggccactgaactgcgcagcttcggcgaggaaccatgactttcctcatacttgtgattggggacctgcacatcccggacagggcgctggacattcccgccaagttcaagaagctgcttgtgcccggcaagattggccagactctatgtctcggtaacctcaccgacaaacacacctacgagtatctccggtccctgtcgccggaccttaagatcgtcaagggccgcaccgatgtcgaagccacgtctctccccttgacgcaggtcgtcactcacggcggcatccgaattggcttcctggaaggcttcacgcttgtttctaacgagcccgacctgcttctagctgaagccaacagactggacgtcgatgtcctgtgctggggcggcactcaccgtttcgatgcctttgagtacatggacaagttcttcgtgaacccgggcagcgcgacaggagccttcttgacaggagcaagcctggatgcggagcctacgtctccaagcttttgcctgatggatgtccaaggcatttcattgactctctatgtttaccaactaaagacggatgaaaagggaaatgagaatgtggcggtagagaaggttacttatacaaagcccgtggagccatctatgggttcatcatgacacacctgacttaattgtagagagaggatgctcagctaatagaaaccattgtaattgccgacggcagaggtagagaagagtcaatacccgggccaacccaattatacataacaacttggtgcttgtcggtgtacaagtctgccattactttcaagaaccagaaaaagcataaagataaattcaaatatcattcgtaaaaaaaaaaaaaa

SEQ ID NO: 4073 - DNA, 449 bp, Trichoderma harzianum
gaccattactcgcatttgcgtccagagattggagtttgataatttttacaaacttgtacataatactgatgcattcagcccttggtcctgatggcatgagcagacatagcctcggccgacgattttgcccctgcaatggttctctgccgatgtttcccgcagcttcttggcagttggggtaatacgataatacgacgatggcatctttggcctgcacgccgaattggggtcaaatagacggtattccgaacatttcatatttaagaagctgtgctgcacgccaaccaacctttggaatggtgtgaattgtgaaggacatgatgcatggtataggccatgagctagtctcagagagatggagcctccggtgtaaaagttgtacattaatacgatcaaagcccgctacgaaaaaagaatggcaattgtattacccacgaaaaaaaaaaaaa

SEQ ID NO: 4074 - DNA, 304 bp, Trichoderma harzianum
gctggcggcaagtaatactgtagcaggtacctcgtggagctccatcgggatggggccggttgggagtcggttgggcacaaacaaggtttctaactggatctatttctttccatgtgtcttttaatcattttgaattttattttccccggaggccgtgacacgtttttgacagatgggaggaagaggcggaggcagagagcaaaaaaacgctcacacgtgtcagtccgtagcggtgccttttttctaactgtccgtatctggtcagaggcggcggcagtaaataagtgttgcctaaaaaaaaaaa

SEQ ID NO: 4075 - DNA, 824 bp, Trichoderma harzianum
cccacgcgtccggatcttgctgggagctgtgattttggcagcgcgaagcgtttccgggtgccaattctcaccactgcaatcacaagtcccgagtactactctgtcaaccatggcctcgattgtgcgaccttctctgctgcggcagactgcgctggcggctcgttgcgccaagcctgctttccgaaacaacgccatcaaggcttcggctttccacacctcgactcagctctctgcctttctgcctcccggacctcagcgaattgagggcacagtcaacgaccctgcccctattccccaacctaacgcctcgcacggctcctaccactggacctttgagcgcctcctcgccgccggcctcgtacccctctccattgctcccttcgccgccggctctctcaaccccaccaccgacgccatcctgtgctctgccgtcctcctgcactctcacattggcttccagtccgtcatcatcgactacatccccaagaaccgctactccggcctgcgaaagatcttctggtggggcttgaacctggcgaccgtcaccgtcggcgtgggattgtacgagtttgagaccaacgatattggcgttaccgaggctattaaaaaaatctggaaggcataaggatgatgcttaaagaagagaaggcgagacgaaaaacttgatatcttgtgattgcttgctggggagggaattcgttgggtttggaggcaggctgtgtaactgatattatgcgctaattgggccaagaaagggctgtgagcgcttgtatagaagtacgatcaaaaaagaagaaaaccacattactttccaaaaaaaaaaa

SEQ ID NO: 4076 - DNA, 535 bp, Trichoderma harzianum
gttgggactgccaacctccaattggatgcgcatcgtggtttgagggaacatgcgacaattaccttcctcaaacaccacagtcaatcaatcccgctgacagccgagggattgccccccatgccgccgcatctgcacccacggtcacgaatgacctcgtcactcttcgctacgacggtccttgccagcttcttcgttgttgccctaccgcacttattaccatgcccggtcccgcggacaaagtacgctgatggagagattatcgtcgacgaaaacggcagacggaagagatggaagaggagggatgtcgatacaaaagacggacttgtgcaattcaaccagacaacagacgatgagattgagcgtgcagcggagcgaatgacgagggaatgtcccgtaccgaaacccggagggatgttgggagagtggctcggattccacgccacggaagacaagacaagggcaaacagatgacgattgataccgccaaatgaataaaaagcaaagaaaaaagttcaaatatgaagaaaaaaaaaaa

SEQ ID NO: 4077 - DNA, 373 bp, Trichoderma harzianum
ccccaatcgccaaatacacaaatccattgcgctacaaagaacaagcaccatggacgccaagcctgccactttctccttggccgctgcgccagttgcttctcccgcagcctccgcgagcgcttccaagcccaagccgtgctgcgtatgcaaagaggaaaagtcgaagcgcgatgagtgcatgctcttctcaacggccaaggatcccgcagccgactgcagatcgctcgttgaccaatacaagagctgcatgcagggcttcggattcactgtataaatcaaaatatcttcatcttggcgctatgcctttgtacattatcaccatatagactactcggaaaagtacagcgctcgattattctacaaaaaaaaaaaa

SEQ ID NO: 4078 - DNA, 720 bp, Trichoderma harzianum
gatttctccaccactcgctcggcatttgttctctcttcctcagcgatttaaaggacctgacccgtctcacgaatcaagaggcataaccgttactgccatctcagaccgctaagcagcgatatcgtcatattcgcggcgctgtgaaggacaagaacgagaacgagaactgttgaagcttggctcacccagtccccgcagcaatgggcctggcctacaacacctacctcaccagcaacaagatctacggttgcaaaacatgcaaggcgcatcttgcgaaccacgaggacatcatctctcggaacttccggggccaacatggcaaggcctacctgttccatcgtgtcgtcaatatcgacaccggtgaccctaatgagcgtaacatgaccaccggccgccacattgtccgtgacatcgcctgccatcagtgcaaagaaacggtgggttggaagtacgacaaggcttttgagacttctgaaaagtacaaggagggcaagttcatccttgaagctgagctgctatgtaacgtcgcttgattgtacgaatttcacctctttagcatgatttcatcaagatgggcccttcttttttctctcatgtttttgttcttggcttcaataggcgttcaacagatagtagtttcagacaaagcacagcatccttgggctggagtgatggtttcaagagccgaatttagacatgttatgtactaaaaaaaaaaaa

SEQ ID NO: 4079 - DNA, 407 bp, Trichoderma harzianum
gatcgggatcgagtggggaaataagatggaagtcgagagtgccttatgtaaaaacctgaccaccggcaggatggaatcaccagaatcaccagacttgtctccgggtctttcctctatcctgcattttcctgcaggacagggagagctgcctgcacctgcacaccgaggtacctggatactccgcgtggtgaggggcaggcagcgtgcgtccgaggtactgccaggctgccaggtacttgggacggcagtgcacaagctccgtacttggcgcgccctgccctttggtccagctttgggaagagatctccgttccggctgcctatcctccgctttcgtgcagctggggggagggttaaagacggctttcggtcaagagtcgaatcggtcctgattcagaaaaaaaaaaa

SEQ ID NO: 4080 - DNA, 442 bp, Trichoderma harzianum
ggtgatctgaagagaatgggtcgaccagcgctacttgtacagtatcgaatgcacgatgcgtcttatgatcagcgcgtgtcttgcacatatgcatacgtcaaacaatgcatcctccacaatcttcatcatcactccacaaatagcttccatgttactttccgcattctaggtaccgcctcagtgttggctgaggtttgccacatgcacaccattgttgacgtaccatgtggctcagttcagccatcgacatctccagacaagcctaccaaagaaagtcagcctcagccttaactgctctcggagggtttcagtcatcaattagccctacagctccgccttccctcggcccgtgcggcaaaagacgactggagatctagattgtgagaaatacgaagatattagtggatttctcgtaccaggaacgaggacaaaaaaaaaaaaa

SEQ ID NO: 4081 - DNA, 355 bp, Trichoderma harzianum
gaacaatgcagctggtgacaggtttgtcaagtggcaggggagaatcgtattcgtgtggcgatggtgatgtcgaatttcgaatgagggagccttggcgcgaagaaaaaagaagagagagagagagcggagaggagaggagaggagagtgaaagaaggagaagtagagaggagagaggagagagacgctgtggtgctaagcaaccacgagagaggaagatgaatgcggtttacaaggttgacattggcgaacgagcttggaccgctttgacaatgtgatgtgatgcaggctgggtactccaaatgtttccaattgaacgaatatccaatcagacaagtagagataaaaaaaaaaaaa

SEQ ID NO: 4082 - DNA, 324 bp, Trichoderma harzianum
cgattgtctttaggccgagaggcgtttggcgatcttgacatcataggagctgctcttcgttgcggcaccagaacttgcgcgcatctttgaacagaatacttcgtggagcaattgctaccccatggctcgggagcatcgtgtcagatacattaatcactcatagctgcaagtactctttgcgccgggggcagtgcaaggcccatgagccgcgcaatgtcatcggtcttatgccggcattcaatcggaatacgactctggatccgtcgtgccggtctcgatatcgaagctcggggcaacaccaacaagatgtaacgtaaaataaca

SEQ ID NO: 4083 - DNA, 981 bp, Trichoderma harzianum
cgttaacgagtcgtttgttgagctccttttcccttcccagtctttcgcttttgggtccgcacttctcctgcaggtcgccgtttccataccattttctaatagtatcacttccgcacatcttcacgaacgcgtctccccgtcgtcgtactatacagtcaatatggtgtctttcaaatcagccgttgccgccgccacgatggcctttgtctcgttggccaatgcgaagagctactacatcgaccctgacagtgtccctctggccacaagacagagctggtgccgttctgagacgtcgacatgccccatcatctgccagcagaccaccaacaagccgacattggtcaacgactgcagtcctgataccttgagcttcggttgtctctgtggtgataacaagcagcctaacatttctgagtacaccttgacactgccctttttcatttgccaggagtttgtggtccagtgcaggacagcttgtggctcggacaacacttgtgcgtctaactgcgccgaggataacccttgtggtgccaccgatcctaagcgttacaactcaacttcgactgctacaacaacaaccgctgccgccacctctaccactgccggccccgacaccatcttcaccggccctgctggaagtggtagcggcagcagcggcaagggcaagtcaatggcagctcctgcggttgaggttggacgggcctatggactggcggttcttcttggaagcatgtttgtcggctttgctctgctatgatagctgccgcaacaacaaggggggtttcgaaaaggagtcatgcggtcgagcaagtgatagattgctcaattaagatcgcctaatgtttgattggttgctggtttcattagagcgtgcgtcttacactggattatcattatgcgtactgccggaagtttggtcacgggaattacttaatactgttgaatgccttttcgatacgatacattgacatgaatatatgc

SEQ ID NO: 4084 - DNA, 493 bp, Trichoderma harzianum
cagcaattgcgcgccaaaagactgtacacagacgtcttttgatatattttcaaaatgggtggcggtggaaaaatcccttaccccaagcacgtctggtcgccttctggtggttggtacgcccagcctgccaactggcgcgccaacacgctcatcgccggagccgccatgttcggcgtcatcgctattacgtggaagttcagcgccgacagggaacgatgggcgcataagccggagccgtgggagtggcatcctagccgatagtacgtttatttttgattgtattgggtgtggttgtgggaatttggtcgtttttgctaacgtttttcttttgcttgaagctggtcaaagcagttgatcgagtgggacaaggaggacaagctgaaggcagcaagcaacagcaaggagtagagttttctttttgggagaaggataatagacgaaattgtacaaattctatacgaacaaaaggcaaacatttcaaaaaaaaaaaaaa

SEQ ID NO: 4085 - DNA, 425 bp, Trichoderma harzianum
cagcgcagcaacagcccacgggacaggcggcaggacagtcgcagtcgggacaatctcagtcgcaggttccccagcacaagcgcgtctaccaggcgtgcatcccgtgccgtcgccgcaaggtgcgctgcgacctgggcagcgtcgacaacccgcacgacccgccgtgcgtgcgctgccgccgcgagagcaaggagtgcttctttagtgctacgcgccgcaagagaaagacggacgaggacgacagcgatgccgacgagtacgtggtgcgcaacggccgcaagaagctgcacgccgccgacagcccgcccttttcgcgcttcgacaagcgccagtacagcgacacgcccctgacccccgggggatcccatggcaggacccagccgctgcgcaggccggacggcaaggctggcggccgcgtcgagggg

SEQ ID NO: 4086 - DNA, 603 bp, Trichoderma harzianum
cggacgcgtgggcggacgcgtgggcgaccaccagcgccgccagaatgttcgccgcacgatcaagggcagtctgcgccgcccgccagctgcagcggacaacccgaacctacgcctccgagtcccacggccaccactcgcccgctccggtcaacgagtcctttggggccggatctgttattgccctgggcgctttcctgggcaccgtcctagtctaccagttccgccccacggagagcgacaactggacgccctctgccctgctcaacaagtatcgatcaaaggccgaggactgggaggccgtcaacactctgcacacaaaggccatggagcaggccggctatgacaggaatctgttcgagaacggctccaacaagcaccgatttgtcgacgtcgcataccccgaagctctccaatcccacgccgcgcgaaacatccaggccggccaccttgccaacattgaccatgctgtggaacactaccgacagcagcacctgaagatggaggagaagaaggcggccaagctggcggctgccaaggcagagtagttgcagttgctacagtatatccaatttatagaacaaagtttgcaacaaaaaaaaaaaa

SEQ ID NO: 4087 - DNA, 598 bp, Trichoderma harzianum
tgtcagggagcttccgtgggctggcgccagacgcggttcgtgaatgcataggtgctctgctggcaactgacgtcttggggcttgggttgagggatgcgggcgtgttgtatggagaggtgcatgatgtgggagagagggcccctggtgagaccccaccgggtgagcggtggccatatgagctagcagaaggcgggatagagatggaagacacgaagaagccgggtcgcgaagaggcgctgttcagcattgatgtcgcggattgagggcccgacgacaggcgaggagtaggagaaccgcgggatgcaccttggccagacatcatgtgtaagccaaggtcgtccgatgctgggctggcggcccggcgcttctgacctgcgcctgcgtatgcatcttcaatgtgaagtctcttgagagaggatgtctcatcaatctccatatcgtcagcaaagctgccctgggtggaagtggcatcatcgctgttgttccgtcttgacctgcctcggggtgaacgatctggttctgagttgtcatagggagagcggtggtcaatcggggatcggtggaagggcgttgagttgggggagaaaaaaaaaaaaaa

SEQ ID NO: 4088 - DNA, 461 bp, Trichoderma harzianum
cctgctcacttgacatggttttgccgcgttctgcgctcctcctccctggttccagactgttacccgtctcggaatacagcgagacacggacgacggagatcgggaatgtggggccggagaatccgatgttcacacggattgagtctctggaatgtgtttgctacgtttttatcgggccgggcgatgtctgagcacgtgaagggagacgtgtttgacgtgtaagcaaaagaaggaaataactttacttctgggctcgtgggcttgggcttggatgatccaacagcatatgacgtctaagtgttcgaattgcgtctaaactacgaacccccttgcagttgatgggttagagctgaaaggggacgccgtttgcaatcaattaataagatcatccgttctgaagcgctacagcggtttgagtttcggtaatgccaaacaagctgctgacatggaaaaaaaaaaaa

SEQ ID NO: 4089 - DNA, 549 bp, Trichoderma harzianum
agccattcctgcgcaatcctgtagctgccctcacgcacatcccccggcacggtgtggcccgcgccgtccacggccacaaacgccagccggccggagctcttccacgaccccgtcgccgccatgctctccggcagctcccgccacggcgcgaggcgatagtcggccagcccgctccagcgcaggttctcgtacgcccagatgttgcccggcgtgttgacgatgtagtcctcgttgccctgcaggaccagcacgcggatgtcgcccaggttgggggttcggtaggcgtcgaggatgcgggcgacctcgcgggtggtggtccggaagggatctttggagtggacgaaggcggagttgaggaccatgtcgatgtcttcgaatatataatatgggggaagcttcagggctttcttgatgtgggcttggttgatgtaggctgacatgttgcctttcctgatgtctgcgcagaagggccagttgggacatggaatatggactgttttgcaaatattagacaactacgttcagacattcaggagaaaaaaaaaaaaa

SEQ ID NO: 4090 - DNA, 424 bp, Trichoderma harzianum
ttgcatgttgcatttgtctttgctgttttttctcgggttcgggacgagaacgaaaaagaaaaaaaaagttgcgccagacgggatgaaaggcgagacaaggggctggcttgggctttgggcatgcactgggactttgggctgaaggttgaccgaaccgagttgctcaaactgcgacatcggtgctgtatcaggctgctatctatgtatcctcgtacaaggcaaatgcacacacggctgatctgagattacgggggggaagaaacgcactcagtggccaatatggtggttcgcacacccagcgtttgctctcctatgtcgtttgtatggcgggtatgctcatgcttgggctgaggtgatgcgcgtctgattccggctagcataccgaacccactaggtagcgagttgatagcaaaaaaaaaaaaaa

SEQ ID NO: 4091 - DNA, 581 bp, Trichoderma harzianum
gttgagaaacgcgagaacggcattgagaagaggtgaaaattcgttcgacatagagcacaatcatggccatgattgatgtctctcggcggaggaggtcgcttctgaaggatgcgactgcattggaccatctgcccgctgaattacttgaaattatcaagcatcagtcgtcgacgaagctcttcgatgctgtatcagaagccgcgctcataccatcacttacagagaggatctttgtgcatttcgaagatgtgttttcagacatttgcgcacgatggattctcaacgccggcaacggaccacgacggttattaattgcgtcagctattgccaggattttgccatttgcgccgtatctctcgacttttcttcaatgtcccggcagaggtggagaggaagcggcgcagggaccttcgcttcacttggtgctgccgaccattgatggagtgaatttggggttggatgcagatgcattgctgcaggctttattaacatactggagacttttcagcttcgacctgagaactttcagctcattaattccacccgagtacctgcagagcttgtttgcgcatgagagccgg

SEQ ID NO: 4092 - DNA, 922 bp, Trichoderma harzianum
ggaacacagcccaagcaatagcacaaagaggcgtctactccaaccatatccagccattatctagacaaaatagagaaagaaacagagaaaagccacgatatcggatatcgaccaacttcaaactggcaaagctgcaatcaacccccgacgttgggcttgctctagaatccgcccagctggctgaggaagcgaattccttctcctcggcctccgttatacttccttttacgtaccgtgatattgtgatagacagacgcctccaaaaaggaacatcacaacaaagtatcgccaagaatcctcatccgcaagtacacagggggaaacaacaaaacaagcttccgactcctcgactccagtggggggcatcccagccagtcaatgataaacacacaatcaaacagagcacgatacagagagaagaagcacctcaagccgccgtcagtttcaccccccctttaaaagagatttgaacccgaaaagggccgctcgcatattcaagcctttcgccaatgagatcccccatccatcctctcacatcccgcaccctccacaccaaatgcaaaacccccaataaattctgtcgacgggagaaaaataagatatgcagagaggagctcactcagctgtggccacgtagaaagcctcggcccgttcgcaacccacagcctgtatcaagtcaaaaccatagaagggccagcgccatgcccagccggaataacgtcatgcattgcttgaatatgcctcttgtgcgtcttataccatcagtatgagccaccattttcttgcatctagtcgtatatcttgccgtgtccgtgtcgcagcctcggcagcctcagtttcaacatctgaagaagaaggggaggaaaaaaaaaggaggctggataggtagttctgcagccgtcatagtgcaaaatatccctcc

SEQ ID NO: 4093 - DNA, 484 bp, Trichoderma harzianum
cccacgcgtccgcggacgcgtgggaatgattctcatcaaagaacaaacgcatcgttcaagatgagagccaaatggaggaagaagcgcgttcgtcgccttaagcgcaagagaagaaagatgagggctcgctccaaataaacgactcgctctaccacttgacttgacacatctttcacattttgaatgagttcacgataaaacacgacaagcaaagctgctgcaccacggtaccactctatgaccgattacagccatcaagttggaatcagcatattggtgcgcctctccaattcagctacgggagtcaatggacgaacgcgagagatgaggactggacaatttcagtcaggtggagacatcgttttgaggacgcgaaggccatgaagcaaaacgctgctgcaagaagcacgcttaggatcgatacgttgcttgacaaagatcaaaggcagaatttacttcatttccaaaccaaaaaaaaaaaaaa

SEQ ID NO: 4094 - DNA, 544 bp, Trichoderma harzianum
ccactcggcacatcatgagttcaggatacggcatgcatggcggcgtcggccgttgctttcctttctggcaggaggtcatggcctgctatgtcgtcaacacatccgccgcagacgactcaggcaagaagaagtgctcgcccgtactagaggattactacgagtgtctgcaccacaagaaggagcatgcgagagcgctggccctacaagccgcatatgcccgagctcaatcggcaaccgcacgagacgatgcgccaagtgccagccagatccggaatctaggactgctagggaagacggaggacacaaaagcggtgcttggacagggaaactgaggcaatagacgtggcggagttcgatttcttctgcgcgaatacaacccccttggcgcgcatagatagcgcagcaagttcaatataggaaaagcagacagaactggagagccttttcggatgctgattgtgaattggcggctaattctgtcagtttggaggctgtaattctgtacaaattcgacgtacattttcatccaccaaaaaaaaaaaaa

SEQ ID NO: 4095 - DNA, 452 bp, Trichoderma harzianum
agtgacggcacttttcgacgacgaattgacgagcaattgatcgatacacgcggttcccgctgccagaacaagtcaagatggtttctcagactcccttccgcgctgcggaattcaagagcgcctacggccccaagtacgctttccagcccaactaccgcggcatcaccgtccagactgccacccgatatggcttccgagctgccaccatcggcggtggtctcggcgttgctctgatgctcttcgcctccagcctgccccgtgtccgttctgacatcctcgtaaaaatccccttggttggcggcttctgggagaagcaggaggttcaccctgccgacaaccctttctaaatgcacttgttggatggtgtttgtaaaattgtaacaaggctttgcgcagcttgcctttgtataagagatacacaatagacttttcctaaaccgaaaaaaaaaaaa

SEQ ID NO: 4096 - DNA, 628 bp, Trichoderma harzianum
cccacgcgtccgcccacgcgtccgatccctcaccatggcgtcgtctctccccaccgagctcggcagcaccatccaggccggccatatcagaagacatcccgaccctcgacaagacattgcgccatcaaccgccgccgacaagaggcagctggtggatttccacagcgcgagacgcggtgatatcgacaacgacgacgacgatatcccgtacagcgtcttgcgtcctccaaagaagcactacaacctcccaccccttccagacctgcgattcgagcagagctatctccacagcatcgcctcagccgatacgtggtggaaagtattactcattacagctagggatcaggtattgatgcccttggctcagggtgtcctcctcaacttggccttggttgggtggcagcattggaacaagaatgccagagtacacggtgactcaataggcattcgcttgaggaggtggtggtatggggtgaataattggaaactgcccgcccctactaagagacgggtgtagagaatgatggcggttggtttcaaaataaatgtaaacactccagtcgtgagtatgtattactactatcttgccggataagaaaagaatctgtcctttcgaaaaaaaaaaaaa

SEQ ID NO: 4097 - DNA, 550 bp, Trichoderma harzianum
ggaaattgccctccaaccgcaaccatgtcgaccctccccaggactctgggcaacctgcgcaagattggcatcaaggaatacttccgccagatgctgtacatcggtgacaccaagtacggtactctcatcggccaggatcgcttcggcaacaaatactacgagaacctcgaggaactgcccctccgaacccgctgggtcgactacgccaagcacgactacgatgcctcccacatcgagcccggctggcacgcctggatcagctactccgtcgacaagcccccgacccaggacagcctcatcgccacgggcaccagacactttgagcccgcccttcccaagcccaactttaccggaacgcgaggcgcttacaagccgtataacacagtgaaatcgaagcttaatgcttgggagccggtggccaaggatcgggtatgagtggtttttacgttttcttttttaaaccgtgggaaaatatggtgtacatattgaaatcgcgcaacaaacgcaaacaaatcaaacaatagacacagacatgtgaaaaaaaaaaaaa

SEQ ID NO: 4098 - DNA, 771 bp, Trichoderma harzianum
ggaagatacgcaattccacaatcgccatggcgaagccgtatgtgccgcatgacgtccttgacgagacggccaagacttcattggtcggcctgggcagcggcttcttcattgccgccatccagaatgccctgtcgaagcgcaacgtgggcgctatgagcgtctttacgcggggagctcccatcattggcatttgcgctgccggtcccggtgcctacgccttcttctcccggacgatgatgaacctgcgggagaaggatgatgcttgggccgccgcctttggaggcttcatgtgcggcagtgtcctcggacttcctttccgacgcacacccatcgtgctggctcttggtgctttcgttggcactgcccagggccttttccacgtcaccggaggaaaactggacagcttctacaaggaggaggatgagtttgagcgcaaggagactgttagacggacaacccggttgcccgttgagcagactattgccgagctgggcgagggacgaggcatccgtcctcctggatatgaggagagaagacgagagcgcatcaaggaaaagtatggcttcgaagttaaccctgtgagcgccaccgctgagggtagccaataaaatgatatcaaaaaaaaatatgaaagaattaaagtcagctgccagagatttttgaggtgagttctgcgggcagcttgtacatatatcccatcgcattccagtgcggaagagatgcgatgctagataatcggattttttttttgtttcaaaaaaaaaaaaaaaa

SEQ ID NO: 4099 - DNA, 619 bp, Trichoderma harzianum
ggaggagtggccgccttggtagcgggcaaggatggcgatgaaacgtcaatcgtgcttgacccggtagctttggagcatgagtctgttcttgctgcctgctgcgttgcatatctacccaacagagatgagatcacaaatctgtggttcaaaggtcggctgccctcaacagcatctcacaatcatcagtcacttgtctcaagggcagtgcacgcgagtaaaggaacacatgggttgatatcggcggctctcagcgaagttattggcaattctcaaaactaaaagtacaccgcgttgagtaataatgacgataataacgataatctggatcatgtatgcgcattgcatacattcgacattcgcgtaggccaggtgggtgtgctccagaggggcatctcgaacatctggtgagcgaagagaggtcagcaccgctgtaagtgcaaccaatcaaattcattacgaataccattggctattgatggagacaatcaccaatgttaggtggtatgaggcattgctataaaatgctacttgttcgttaccacaatcagagaaatatcaagtatatttattaagatctatctaaagccttcatttccataccatatcaaaaaaaaaaaaa

SEQ ID NO: 4100 - DNA, 424 bp, Trichoderma harzianum
cacgcgcatcattatgccggcatgggcccggggtctgaccctcaccatttccgagaccagagcgtgccgcatttcgacaaggcgggccatacgcggacgcacgagcgggaggatcaccggcggtggcagcggcagagaagggctgtgggggatgatggcatagagtttgagccgcagacgagcctggccgggcactttttgattgtggcggggatattggcggcgacgctgtttgtgccggcggtgtatttgcagtttatgcgcctggggaggcagaagaaggagaaggagtcgtgaggcgggtatggcgtctggagtgtgatagggaaggctgtacaaagaatagagcagacttatatagaaataggcaatgggggggcatgagcgaacaatgccgattttaacgttacgaaaaaaaaaaaaa

SEQ ID NO: 4101 - DNA, 512 bp, Trichoderma harzianum
ggggattcattcagctggtcaatatttcactatagagagaggggttgatttcaattcaattcaattacaggaggggtattcgtgggaccacctcggcagataccagtagaggcaaagggaatcccgcaactcaactcaaaacccgaagcctctccgctcccttatctagggcggcgaattctgacgttgctgatccgatatccgtcgcgcggcacggcagtcagggacgggatgcggcaaagatttggcaattcgtctgggttgctgttgcagccttcttcactagaaatggaatctcgcggatcaaaagggaagtgtgggaagctctcgcgcggtacttggtgcgagttggagcgaaagcgaagggagccgcggaaagggttcggggccgtgattccggggcaagcggccagataccgacctgggtccgagttcgccgggtcgtagatcacgaggctggtccttagactcaaaatcccaagggtttggttatggtgtgaaaaaaaaaaaaa

SEQ ID NO: 4102 - DNA, 1114 bp, Trichoderma harzianum
cggacgcgtgggggggacgatgcggcgcatgtaccaggtgtgcaagctggtgcacgccgatctgagcgagtacaacatcctctaccacgacggcaagctgtacatcatcgacgtttcgcagagcgtggagccggaccacccgcggtcgctcgagttcttgcgcatggatatcaagaacgtgggcgacttcttccggcgcaagggcgtcgacacgctgcctgaccgggccattttcaacttcatcaccgtgcctgaggggccggtcgaggagcctgagctggcggaggcgattgccaagttatacgagacgagacttcctgctgcgaacgaggaggaggctgctgctgaggaggtggacacggaggttttccggaaccagtacatcccgcagacgctggagcaggtgtatgacattgaaaaggatgtcaagaagctcggtcttggagagggcaatgagttggtgtacagcaagttgctggctgaccaggttgttgcgcccaaggcagacggcgaaggagaggatgaggatgaggaagattcggacgatgagtcgggcgagggagcttcccttggcagtgatgattctgaagatgatgagagtcggtttgacaagggacggccgagaggtcgcaagtttgaggacaaggacgagaaaaagcaacataagttggccgtcaaggaggccaagcgagagaagcgaaaggataagatgcccaagcatctaaagaagaagctcgtttcaagcacgtccaggagaacgaaaaaataaacaacgaaaaaaaaaattagaaacatgtaattttcagaatttctttttgtcttgttcatttttgtaatacccgtgcttctgctattactccatatcttggtgataaatgcatagttagacagggagacatgttggatgatgagcactgattgtcgcgatgaaggccaaggatggcggtttaacatctgaggatgggtaaccctgttcatggactttatttgcgatctgaatttgcgcgaggggtgaccccgcgagaatctggatgatcaaagagagcgctgacaacatgtctcctggccgttgacggtgtgcttgcttgctatacacggttgaatacatgatatg

SEQ ID NO: 4103 - DNA, 688 bp, Trichoderma harzianum
aaatcttcaagcttcactacaatcaaaatgcagttctcccttgccatcgccgcctccgtgctggctgccaccgcctcggctgctcctgcaaccgtctccggcacaaacaccaacggctccatcttcatgttcggagacccagctcccgctcgcaaccttctcaaccaatttggtgcttgcggcctcaccacctacttcgtcggccaggtccccgacgacatgcccctggttgctatgcccgccaacatcttcgaccaattcggctctgctcagcacaacactctctgtgccaagatcatcaccctcacccgaaacggcgttactcgccaggctgctattgcggaccgcaacctcagcaacaccaactccattgacatgactcttgatctgtgggaggcctttggtggacacgacaacgacggcagcatcattcctggcttcagctggtccattgccaactaaggagttggtggaagtggcctgcggttgagtagactgcgacctgtacatatttctactctctttctgatgtatatatttatgacttttgagccctctcagcaggagattcttgtatatatatgatcctgcatgggagggcagatgtttatatgaaggcaaatctataaatggtcatccatttaagttttgtgtaaatatacgctgtttctacaaaaaaaaaaaaaaa

SEQ ID NO: 4104 - DNA, 1065 bp, Trichoderma harzianum
gttggaagtatagaacttagccggctacaaacttaaagagcgttgcccaaaatgaagccctatccattccaattcaacagcacatcctcgtcaaaagatgaaccaaccagggatacggagcccagtcatctttgtagggggcgaataccttctgtccaagcatcgcagcttcgggctatgattcgcgaagcatactcggacccaagcaagattctcgctacatgctgctctgacgatggactaggatcacgtctggtggaagaagctaggttcccgtacatatttttgggtggattcatggtcgcgtctagctttggattaccagacactggatacattgccttccaagaaatggtcagccgcattcaagaagttaaacgacaaactacgattcctatcattgcagatggagatactggatacggttctcccgtaaatgttaggcgcacagtccaaggtttcgccatggcgggtgcagcgggtatcatgatcgaagatcagacttggccgaagcgatgtggccatactaaagggaaatctgtagtgtccagggaggaggccttcgcacgaatccaagcagctgtggatgcccgcaatgaaggagtcgatattgttatcaacgctcgcacggattcttttatcctcggatgggatgaagcaatttatcgagcaaagaagttcgttgagattggagcagacatggttttcctagaggctctcccagatagggagatgatgaagaagacaattgacgcccttaatttccccgtcatggctaacattattgaaggcggcttgacagataacctctcagctgaggagcttggcaaaattggtttctcgatagttgtatatccctttacaatggtggcagctagagtcaaggctgtgagggaggcattggagtctttgaaagtgagtttcacatctggggcacctccaagtatcatgtctgccggagaggtctgtgaggctgttggcttcaacaagtactgggagctggaagagaagtataaatattagtggtatcaattttagtggtctaaatgataaaagggctagttc

SEQ ID NO: 4105 - DNA, 334 bp, Trichoderma harzianum
ggcaaagggatatgtgaatttggcggtatacttttctgtctgaaggtctaggaggcggaagccctggtcattgcttgcaatggcggcggcaggactgtcagacctcctgggtttgtatatcttgatgtggttggtaatcccgctaacgtcgttggatatctgtccctccgagtagctcttcttatcctcggcagtcaatgactgcaggaagtagtcgccattgaaggtgccggccatcaagacaccgcagccggcatcaagggttgatatggcgggagacgccattccagcaaaagcacgcagattcatcgctaggtaaaaaaaaaaaaaaaaa

SEQ ID NO: 4106 - DNA, 844 bp, Trichoderma harzianum
cttacatattacaaactgtcctcttacatattacaaatatccaacatagacagtagacagtatcaacgccatgacccgaattgcagagcccacgccacttcccccctcagctcccataaacggcagtgagaaacaccaagaccaaccccgagatgagcacaaggaaaacttgggcaccttctccgtgccaaacatccagctccagatccgggacctcaagcaccccggctcaaagcgcttcctcggcgccgtcaacgcaaccgatctcctcaccacaggcactctgaacgtcctcaagctcttgtacaacactcccccaaacccggagacgaccgttccgccaaccagctccgtgacgctcgtcctcgaggatatgcccggcgtggcctacacagtcggccataacgacaataacaacatcaaggaaatccacttttcgctctcgtacattgcgcaaatcaacgcttctcgcgtggcccccgaaatcaacggcgtcgtaacccacgagctcgtccactgtttccagtacaacggcttcggagctgccccaggcgggctcattgagggtattgcagactgggtgcgtcttcactgcaaccttgcgcctcctcactggaagcaggaggtcaaaccgaattgggatgccgggtaccagcacactgcctatttcctggagtatcttgagcggctctatggtcaggggacggttcgtcgaataaacgagaaactaagggtcagcagatatgtcgaggataccttttggcctgggctttttggaagaaaggttaaagacttgtttgcagactataccaagacattgcaacatggccaaaaaaaaaaaaaa

SEQ ID NO: 4107 - DNA, 393 bp, Trichoderma harzianum
cccacgcgtccggcgatgtgaggctgatttggggtgtatgattcgtgagcgtgtaagaggaggcagcccacgactttctctctgtgtctgtgcttgctcacttgctcgcctccttggattcggcctgttgatccgaatcagaagtaaatgtgtttgagactgagacttggtctggtcgagacgatatgagatgtggcatggaattagaaacacgtgtttggtatggcgattgcgatgcgatgatccgcagaaagcaagatctcagggcgactaacacggatatacggaggttcgaccaagacacgaggaatgatggggaaagtctcagtatgtcactacggaatttatgattacgtagcaatgtatgaattatcatttcacaaaaaaaaaaaa

SEQ ID NO: 4108 - DNA, 505 bp, Trichoderma harzianum
caattgacacccaaagcttcaataacctaaccaaccctcttatccacaatgaagaaagctgcgcctgcggcaaacgctgcccgagatgccggatctcacgatcatatgctccaaggaggccatgccataatgaaagacgaccctgaagacttcaacgctcccaagctttccgagaacatgtcgaagcagactggtcttgggggatccaagcagggcagcttgcaaggcagcgccggcactggcgatagtatgaggcagcgagacactcaaagccatgtaggtcaaacatgcggtggtatacaattgtgctgactagtatgagtgatgaatacggccacgtaaaaaacgagaatgcattgccgattcgaaaagctggtatcagtgggacatgcacacgatgataggagttgacgagaatcccgagtttgaaacatgttgaaataggttgtataatatcatggcgagcaaaaccaatattgaaactatttataaaaaaaaaaaaaaa

SEQ ID NO: 4109 - DNA, 214 bp, Trichoderma harzianum
ggccctcggcgtacgagtagcaaaaagcgttcggtccatctgggtccggttggtaggattggaacgagaaagaggggaatgggattcgagaacgtggaacttgcttgtgccctggcagtcttcgggtaattggccgcggagattaacatggcgagaggaagcaagacgtcagaacggatcgaaaaaaagaagaagataaatccaaaaaaaaaaa

SEQ ID NO: 4110 - DNA, 683 bp, Trichoderma harzianum
cattgactacacacataaatacaccagcaaaacatcttctgcgatttctagtgttttttcacttacaccagcgcgaccatcgccaaagctacatacaacacaacacacaacacaatacatacacatccagacactaccgtctaacataacacaaaccgccgaaatggtcactcaaccagccaagatccccgttgccgccccaggccccctcgctagagctttcccagccgtcatcgccgtcggcgtcatctctgccgtcgcgctaaacgttcgctcccaactcaagactcattcagccactcaggaccgcttcttctcccagtacaagaaccccgagagcgaagccgtccgccaaaaggtgtttgagggcgctgtcgaggacccccgcaagagctggttcaacgtcctgggctggtgactatttgaggattaagcaggggttttgaagacacaatcgcattgctgggcgtttattttaatttttagtatcgaggagttggaaaggatatttgttggctggtgaaggcgtcgtgcattgctgtttcgatgtgaccgcctggtgtataaatggcgaaagaaggggttgttgagaggcccgagtattgataccagccttatttagatggcactttaatcttctaaagaagttcaaaaaaatcttgagtattctcaaaaaaaaaaaa

SEQ ID NO: 4111 - DNA, 525 bp, Trichoderma harzianum
caatcaatgggcgagagacggctaatcgagcagagcgtgacgaggagcgcggcaatggcgagtgcgtgaaggggtgttgattcaagactgcgcgcgtgagggtgtgggagagatgaggcagaggccagaggcagctcaaaagggttcaaagttgagaatcgacgtcaagccgctttagtggctgatgggcactaagcctcagtggtcgacgaaaaacccacagccgaggcaagcctgcagacggccagcgggaaaaattgctgcagggcgggtagcaccgcagcagagaattgatggcaaagacgccacaggtggtatgacggctgtgattggaggcagaaaatatcgagatgtcaattttgccgattgttttgtgatccaagaagagaagaggagaggaaggcaaacaaagaggaaaagcttgaaatcctctctgatgcagatctctgtgatgcagatctgcggaaatgtccgtggaagacggcaaagtgattgtgacaaagaagaaagatgaaaaaaaaaaaa

SEQ ID NO: 4112 - DNA, 455 bp, Trichoderma harzianum
catttatcgagtttcacagggcttagcaactcctgtccggggggattggcagatcttgacaactgaggaggaccggatgccgtgacgtgtagctgctaggatgaatcttggattggagatttgccagtcgatttggatggtgcctttcgggatggaggggtggagggtggagagatatgactagtgtggaggtatcacagcgtcggggggctgtggagagttcagggtaagccatttgcggctttcacgctcagtaacactcgggggtttaaaactgactgatggcccatctataccttgcagaaaaaatttaggtcctcgcaagactctccctagagccgcgtcccgtcactactgctgctttggcatcaaatagtgctcaatggctaggccgagggatttgaagacgatagcaatgtaacccatacgatctgactgaacgaaaaaaaaaaaaa

SEQ ID NO: 4113 - DNA, 1423 bp, Trichoderma harzianum
cccacgcgtccgcgaaagcatttgccatcgcacaatcgtcattcagctaccagaattccagttgttcaataaggagtcgcaatcatgggtggcggagatttaaacttgaaaaagtcgtttcatcccggtctgcggcggaaccagcaggccgtctacgaagaagaacaaaaggctctcgccgagcgcaaacgaacccagcagcgcatcaatgagatcaaggaggagcgcgcaaaggaggagatccagagacagctggaggctgcgggaggcaccaaaagggttgatcgcgtcgactggatgtaccagggccctaccgatggccaggctgggacaacagaagaaacagaggcctatttgctgggcaagcggaggatcgacaacctcatcaagggcaccgaccacaagaacctcgaaaaggccgctggacaggagagcttcattgcgctgcagaacgcgaacagcgcgcgcgacacagccgccaagatccgcgatgatcctctgctggccatcaaacgacaggaacaagccgcgtacgaggccatgatgaacgaccccatcagacgccgccagctcctctcgtccatgggcatcgacgatggcaagaagaaggaccgagatggagacggagacggacatcggcggaagcatcgcagacgtaggagcagagatcgtgacgacgaccggcattcgcgacgccgtcgccgcgaggattccagatctcgcagcccacgaagacgccatcatcgagacgatgattcagaatctggagaacgtcgccacagctaccgagaaagacgacgtgatcactcaaaagacagagattccgcacccagtcgccgaagagacgcatcacaagagcgcgatacaagaccgcatggaaacgattcataccgaagtcgtgatggtagtcgcgaccgccgataccgacactccgattccaacagcagaggagaccgtccgcgcaggcgctcgccggcaaacgctcgcccctacaaggagcgcgacgaccctaggcaagaggaacaacgagcggaagaacaggcacggaaactggctgctatgcagtcggctgcatctgagcttgaccaagatcgggagacacgactggcagctctagaggagcgagaacgtgccgccagagagtctgacgatagagctcgggagcgcggaggagaccgaggcttcgtcaatggcctgcatcggaaagcaatgaacatggacaaccgaagcagacgcggacatgtacgggatcgagattaggtgatgtaacatgatgatattggcgcaggggcatatggacgacatgattctaatctggagagaagccgcattgtactgtattaactaaagattggatgaggatattatctggcgttttggattggcaaacgggaatacaaatggcgagtcatgaatgattcct

SEQ ID NO: 4114 - DNA, 271 bp, Trichoderma harzianum
gttcgtagagaacgcagataccttcaacaggctcgaggctcccgtgtctcgtgttgctggatggagtatccacaacgctctgatattcgaaaagtttcacgtcccagatgttgcaagaatttacgacagtattaaaaagacggttcagtactaagaatgtggggagcgagtaacgtgtgactttatctttgaatttctagagcttcttcctagcataagtgtaaataatagagaataaagctttctgtaacacacaaaaaaaaaaaaaaaa

SEQ ID NO: 4115 - DNA, 522 bp, Trichoderma harzianum
ggctgcaaatccagaggcgagacattgttagaaccaactcagcgggagtccgattccatacgagtactcgtatgaggacacttgctcactgtcatatctgaagtcttgaagtgctgcagggatgtcggttcgcagtaaagaacagcagcaaaagcaatggaaaaggccccgaccttttacgagaaaacttctgtcaacaagggcctatcctggcacgtggcgaccatggtgaaagaggttgatttcaagccaagggcagcaaaacataaccatcaagaacgagactgcgttatgatcatactgattgctctcacagctccgggcgtgcggtgacctttttcgcggagcattcggaacttaccagctgcgagtacatgctgtagagtctaaacgactgagggggttgagctcgtgatgtatccacctatctcttggcgacaatatgtgtatctcaaacaaagatgtgattattccgtaactcctgaacaaagcaacactcccactcccaaaaaaaaaaaaaaa

SEQ ID NO: 4116 - DNA, 388 bp, Trichoderma harzianum
ctcgtgtggcgccttgtctcagggacaacagacgacgagcaactcaaagaccagagctaaacatggcttggctagatggcaataagcagagcacgcttcaatcgagaacagacgcgctcgacaataaaggatgtgctacggcacagccattgggacagatgatgtcgcggttcaacggtaagtcttttgatcttgttgattgagcatcataacgtgaggccggctctagttgttcaggacgataaatgccacttgcaatgaccgaagctgtttgagtctcaatacactctgtaccagatgaaagggcttctatgtctgctaggttttcatagatttgtcatagttatgactcctgaagaagtagttgtactgcgaaaaaaaaaaaaaa

SEQ ID NO: 4117 - DNA, 471 bp, Trichoderma harzianum
aacagcgggaagcaaaacaattcaatttctacttttcctttcaagtacaacattgtttgtaaaatactccaaaatcaatcgtatcaccaattctatcaactgcatcgccaaatcgccatgcctgagggacgtcaatctcctcctcccgagcgccaatccgccgcccaagtagggaacactggatccggcaaggcctcagatatcagcaagaccagccaaaaggacccaaaatcccagctcgactgtctcacatcgaaccccaagggaccgatggacgatgtgcttaaacacaagttttccagggagcctggaaactgtgagcgctaattagagcgactcggtcttccgcagttcgcgactaatgaattatcatagacactccgttgaacgcttagggagaataaatcgtcatgttgtacaatagtcattcatagcatcaattattgcatcgctatactataaaaaaaaaaa

SEQ ID NO: 4118 - DNA, 680 bp, Nicotiana benthamiana
gttcttgtcattaattaaggccattacggcctttacaatttcgcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgaggccgccttggcctcgagggg

SEQ ID NO: 4119 - DNA, 764 bp, Poppy
gtcgacgaattcaaaagaaaagaaatggcttcttcaatgatttcctctgctgcagtcgcctccgtaaggagctccgctcccgctcaagctagcatggttgcaccattcagcggcttgaaatccgtctctgcattcccagttacccgcaaatcaaacgacatcacctctgttgccagcaacggtggaagagttaactgcatgcaggtatggccaccaagtggtttgaagaagtttgagaccctctcataccttcccccattgactgtcgagcaactatcaaaggaagtcgactaccttctccgtaatggatgggttccctgtttggaattcgacgccagaggattcgtgtacagagagcacggtaacacccccggatactacgatggtcgttactggacaatgtggaagctacccatgttcggttgtaccgacgcttcccaggttatcaaggagctagaggaggccaaggctgcataccctgactctttcatcagaatcatcggattcgacaacgttcgtcaagtacaatgtgttagtttcatcgcatacaagcccgagagcaccagctacgaacagtaaaagatgaacataatccaattcatttctgtgtctttttaatttttgttttttgttttaatttgttttcctaattcggttttagcgagttatattattcgtaatctttaaatggattcgagtgtatgagcaacgataataataatatcgtctaatccgatgtttttatttgtttaaaaaaaaaaaaa

SEQ ID NO: 4120 - DNA, 968 bp, Nicotiana benthamiana
tttttttttttttaaacacaaacaaaatcgcattatattgtcaggtaactcacaacagctttacaaggccatcaaacaatcagaattttgagaatgttttaagattcactttccgggaacaaagtttgtggcgtaggcccacgcattgttgttaacggggtctgcaaggtggtcagcaaggttctccaatggaccttttccggtaacaatggcctgaacaaagaatccgaacatagagaacatggcaagtctaccattcttgatctcctttactttgagctcagcaaatgcctctgggtcatcagcaaggcctaatgggtcaaagctgccaccagggtagagtgggtcgacaacttcaccaagaggcccaccagcaacgcggtaaccctcaacggctcccatcaagataacttggcaagcccagatggccaagatgctttgtgcatggaccaagcttgggttgcccaagtagtcaagtccaccctcgctaaagatttgggatccagccttgaaccagacagcttcgccaaacttgacaccgttacgagccaagagctcagggaagacacatccaagagcaccaagcatagcccacctgcagtggatcacttcgagttcacggttcttggcaaaggtttctggatctgctgaaagtccagcagtatcccatccgtaatcacctgggaattcaccggtcaagtagcttggggcctcaccggagaatgggcccaagtacttaacacggtctgggccgtaccatgggctgctagatgcaacaggtttggtgacagtctttctcatggagacccttccatttccagtgatttctgaggcagatggggagagtttcactgcctgtccagcaaaagaaggggaagaaagagccattgaagaagcagccatggtgtatgaaaaagaaaagtgattgtttgatggtttgaaatgccgcggacgcgtgggtcgagggg

SEQ ID NO: 4121 - DNA, 543 bp, Nicotiana benthamiana
tttttttttttggttatgtaaaatataatattagtattatttattacatagtggggatcactgatcttacacaatattcaacttgtgaagctcacatagtgtgcatcacttatattcttacttatttttacatacacaacacaccttcctttatttttttcataacttatagcatatcacccttaagtgtatgttgtacgacaaacttttagtaatatggtcgtgatcgatcagttgaaattagcatcgttattattggctgtttcattggcgaacatggcggtggcacagcctttgtgacagttgctctggcagccagatccacagtagtcacaactagtgccacaccaaccaaacttgctacaacacaacttgttgggacacttgcgcttatggttttgtttaccacattgttctgcataagttgtggttagcaacaaagccaacatcacaaagacaattacaactgaaaatctcatccttttggttcttactttttttctctctatggaatattgggaaacggacgcgtgggtcgagggg

SEQ ID NO: 4122 - DNA, 440 bp, Nicotiana benthamiana
ttttttttttttttgattaaaagagactaataactggtttagataacagaataacaaactaaattaggttccattctagtaaaaaacaactataattccataacaaaaacaagaaaaaaaatcccaaattcaaaaagaagtgctagccatggttacttttaagtgatttgtttactcttcatcggcagatccaccactcttattgttgttgtgcttcctagcatatctctggttcctcaagaacttaggatccatccctttggtagatgaatggcggtgctttcttggcttcttgatgccattcctgtgggccttgtacgactggttgtgagctgtgtgatttttggacttggccatttcacaaaccaactgctgctgaaggcgctaggattttcgcccacgcgtccgcccacgcgtccgcggacgcgtgggtcgagggg

SEQ ID NO: 4123 - DNA, 717 bp, Nicotiana benthamiana
ataactagagagaaaaatggctttgagaatgtgggcttcttcaacagccaatgcattgagagtttccactgcctcaagagctaatctttcccctgcttattcactctctagatgcttttccactgttcttgatgggttgaagtatgcatcttcacatgaatgggtgaagcatgagggctcagtggcaacagttggaatcactgaccatgctcagggtcatcttggagaagtggtgtttgtggatctaccagaaactggtgctgctgtttcacaaggaagcagttttggtgctgttgaaagtgtgaaagctaccagtgacattaactgtccaatctcgggcgagatcgttgaggtcaatacaaagctcactgaaacacctggtttggttaattcgagtccatatgaagacgggtggatgattaaggtgaagccgagcagtccatccgagctagaatcattgatggggtccaaagagtacacaaaattctgtgaagaagaggatagtcattaaaacttgaaggtttttctttattcaacgtggactaactttgcctggttaaggctgatactgtgatgaaacttcctgtcacttgttaaaattctacaaaaatcaaaataacatccacttttcctggtgttttctatgccttatgcagagttgtgatgtagtttttggttattaagatcatcttgctctctgattttttaaaaaaaaaa

SEQ ID NO: 4124 - DNA, 940 bp, Nicotiana benthamiana
aattcgtggtatcaacgcagagtggccattacgccgggggtatcatcatcctagaactgctaaaatgaaggagttcatttctgatcctaatctctttggacaagtcaaagcaattcacagctcatcatcatattcacctggtccggtatttcttgaaaacaacatcagagtaaagccagacttggatgcccttggggcgctgggagatgcgggttggtactgcattggcgcaatattatgggctatgaaccaaaacctgccaacaactgtgacagcactgcctactgttgcaagaaactcggctggcgttatcttgacatgcagtgcctccctgcattgggaaaaagaggaaactgtcgctacattttactgctctttcgtttcacatgaaacgatggacttgatagtttatggctccaacggtaccttttatctctacgacttcattatccccatggacgagaactctgcttcgttcagctttacttctggtgccaagttcgtggatcgccatatcggatggaacatgaaacctcgggcagttgaagtaacttctaagtttccgcaagaggcttctatgattcaagaattttctaggctggttaaggctattgaagtttcgagaagcaaaccggaaagcaaatggccgcatattagcagagtcactcaacttgtgctggatgctgtgaacaaatctatcgaccttggtttccaaccagttcatatataaatgcttatgttcataacaattgttacctgttgcccttaagaaaacagtaaattctgttgaagttgcagttctactgtccaagtaggactacttggctgaaacagtaagtacagtaatgtattcctataattgactttaagaaattgtgtagagactctttattatctactggaatgagttttaagaaaaaaaaaaaaaaaaaaaaaaaaa

SEQ ID NO: 4125 - DNA, 1029 bp, Nicotiana benthamiana
tttttttttttgaagaatatctaagattagttattactgtggtaaaaagtaagaatacaattcaggtatgtttcaaattgaacatagtgaaacaacccaaagttgtttgcataagagctatatctagtagaaattgtcaaattccccggggcaacagcagttgctgagttattttagttctgtaaccccacgcccaatggaacgataccaacccaattacagatgtcacgtaaagttagtaaaaactatacatgtcattcctattattgggtctgcacaagaagaaaatgagcaggctcacattttgctacatgaccaaatttagatgtattgtactttctatgtaccccggttagtttccctgtcgctgctttttggtggaattccgtaatcaatctggaacactccagaagttgatcttccgagtatttagagtgcagctcgcacgtcttactccattgtttaacaccataaagtgtgcactgagctgtatagattgcagcagcagcaataaacgatggtggaaatttaagcaattcatattccacgaggcaaagttcgatcaagaagaacgaaagtagctcaagctttttatctgattgagcagctttgagaaatcttctcataaaaacatatggagttggaactgacatattaaactgcagcgtattgagcatcaatttttccatttcaagaacctccttccttgtgtatgctttatccgaaatgaccaccaaatcatccaccgcagggagagaaacttcctcatatttgcacgctagtaacatggcgacaagaccaacaagctgcagtttctttctcacaacggattgtttctccaaaaatctatctatcaaattaacagttaggaataatgtctcttccctgagatcaaacttgtggtgtacctcaatgagccagtcgattagtatagatctcatcctctcgttgacgtcaaactgttgtgccatatagtctggcgagatgcgactgcaaccctccatttttgcggacgcgtgggtcgagggg

SEQ ID NO: 4126 - DNA, 870 bp, Poppy
gtcgacgaattcaaagaaggacaaggaagggaaggagaaagatggaaaggagaagaaagaaaaaggaagctaagaaggaaaagaaagacaaagaagttaaaaaagataagaaagacaaggagaagaaaaatgaaggtctagaagatgaagaaggcgaagacaaaaagaaagagaagaagaagaaaaagaaagacaaagatggcgaagaagaactgaaggaaggggacggcgaaaagaaagaaaagaagaagaagaaagacaaggatggagaagaagaattgaaggagggggaagacgaaaagaaagaaaagaagaagaagaaaaacaaagatggccaagaagacagcaaggatgaaaagaagactaaagacaaagatgaaaaatcaaagaagaaggagaaggatgaaggcactgacatgaaagaagaaaaaaagaaggacaaggaagggaaggagaaagatggaaaggagaagaaaggaaaagaaaagaaggacaagagcaaagatgagaaagatggcagcagcaagaagaaagaaaaggatggggaatcaaaggaagagaagaaggagaagaagaacaaggatgaagataaagagaagaagaagaacaagaacaaggaaagtgaggaatagaagtgcttctgacaagccaatatagactcaccagctgctactgaaactagtgaacccaggtgattgatgatgcagttagcaatgtactgtaatcttcttggaccttttctttttttcatatttccttaagtttgtagtggttttgaggtttagtacggtttaacagcttgtatgagtaaactgtatcacggcaataccctatctgaataacatgaactttttactgaaaaaaaaaaaa

SEQ ID NO: 4127 - DNA, 920 bp, Nicotiana benthamiana
tttttttttttttgggactaaaagcaagaatagccgctgatattacaatcattttttgatgaagtaaagtagtttcattcaaaagcatcaagaaaatgtagcaaaaaactacaagaaattaaagataaacatcagctcctatataacagattacacaaactagagagcagatgcagtccaaacattacttctaagaacggtaacagttaatacaatctttagggctcctttttggcgatctgctgcctctctaaaaatttagctttgaatgtatagcggttccttttgatgcatctagttctcacctccgagctggcaggaatagtcaataactacacctcgttcgaaacaagttagcattagctggcaggaatcatcacaaatttacttttactctgtagtctcattcttgtaccctgatgctctcccacttttaccaattaaaaatggctcgggaaaattattgtcagtatgaatgtcaaggccgtgaaacgacctagctgcgaagtattctgccccagatttagctgttccattcataagagtttgcgagtccttgtcacgaacacgcagagctttctctgtgatgttcactaaagcagaaactccatcttcgacatcttcttcaacatcttgctgttcaaaatcttccacatatccaccctgaacgaaagaaaaccgcgcttctgactggtctttcacttccacaggggaagaagtaatcaaatcccgaaattctgtcacataagctccagtccattcacttcctctgccgaaagcaatcattgcttcaaaaggagtaataactggagctaagaactctttactatccaatagagcagtttgtgcacaagaaacataaatgaagacatcgcactcaggaaagttggcaagttttgccggacgcgtgggtcgagggg

SEQ ID NO: 4128 - DNA, 1106 bp, Nicotiana benthamiana
attctgcatcaagttttggcaatgtttccaatagctactaggaaacacaacttttaattttttcatctgtttgttgtttcttggcaggaaagagtcattcaattagagggcattttcttttgggaatcaaaagagaagaacgacgcgatcaacagatttacactgccgcggaaaatcctagcaaataaccagaacaaaagacaggtaaaataagaaagaaaacttctgttgctggtcgcctaactgtcggacatgccctttagcgatacatgcagaaccctctgtacatatacctgaccgcaaacataccatataatgctcgttttgagccccctttacgctggccttctaagtttggctagttcacccaagacattctcgaggggaactctcagcttgctctttttagtcttaaatgagggaacaagagaaaatacttcatcaacagattccacggcaaagttggcaatcatgcagagctccccatcggaaacaccgtgctcttttagaggtttgagtatttgtttaaccgtatcgggattatcgtaaagcctgttcctttgtgcatacatcaatcccctgtcaaatgaaataggtagttttatagctggatcttcagacaaaaccaccatttgctcttggattccttgcaaaatatcagcagcttcacagtccatcagacatgttgtattgtccggaagttcttgttcaactctaagctccaacggaccaggtgcttttgctgtttgacttttactaccactgccagctttttctcctttcccgcctttgccggaaacatctttggaagatggttgatcagcttttccattcgattttgtgagattggtatccagtgatccttcaggatcaaactgaactttccttcctcttttcgattttgctgagatatcatccttccctttggatgcaggagatttgagggcagactttccattttttggtagagaaaacccttttcctcctttttccgccattcttaatgttcactgggaaagaacagaaggcagtgaaatttggccggagaaagtgaaacttttaacagagtgtgaatgcaggaaagagcggacgcgtgggtcgagggg

SEQ ID NO: 4129 - DNA, 890 bp, Nicotiana benthamiana
aagaaaaaaaagaacgaagaaaaagagcaggcacgaaacgcagccgagcaacaactgaaagcgaggcttcttcagcttcagctcgactatgaatccaattcttcaaacgtgaagaaaataaagctgctaatcgtttcacgctttctggatataatattggaaactgaaacttgattacctaggatgaagaagcttctagaatttgggaggaaagcaatgttctatattagggttctttcaggctacgaagagcgtcgaatccgatcttatcgattacagatgcaacaacgccttaaacaggcggaggagaggaaggcagcaataaggaaggttcctgaacagatgatattgtcagaagttaggcgaatggtggaagagatgcaagctttgaagaagaagctagaggagactgaggctgctgttgatgactacttcaaaccaataaataaggaagcagaagcaatagtgaaaatgcagcttgaaggagaggagaatagaacaaaggagatgatgaatatcttgcagaaacaagcttttcttgagaagcatcagccagagaaactaataagcgcagaaaatgtggtcacagaaaaacatggccaagataaagcatctacatagattccaccagaagtaagatgcttttgtagagtataaaattgttcatgaaattgaacagtacgaattcatgttgttttgcctcttagatgtggcatggttttggcaatccaaaaaaggaggcggatctggccttccaaagcttctgataaatttggaacaagtagagaagtaggaattagtttgtttatttgccgttgccagtgatgatttctgttgtaatttatacgttgtctcaatgggattttctcgttcccagcgaaaaaaaaaaa

SEQ ID NO: 4130 - DNA, 844 bp, Nicotiana benthamiana
gaattcgtggtatcaacgcagagtggccattacggccggggaccaagcaaaaactcaaaacttcacatctttagtagtagcatcaatattcaagatggttctccaaactcaacttgggttgaacaagccccaatcctacgctcacgagcaaaattattattccgacggcagccatggcggctctatgcaaatgacaaggccatcgggctattccaccatgccatatggccagtccactcacaatcacatgatgatgggtcatggtggccaacatcatggcggacactatggtggtcatggccatggctacggcggtcatgaacatcatggggcgcatatgccccatgactccactaacttttcaagcagcaccaatatggtccatagtgatgctggctatggcagtggaatgcaacaatctacccatatgttgtcagccatgggcatgggatcgaccaattatcatggccatggttatggtggcagccaccctagtcagtacagccagagccaaaagttcaactgggctcttaaggatctggaggaataaatatatgataaattttatgctatcctgtatggtgaaagtatgtgtgtgttttggtagtggattttgctaattatatagcatgaagaaactactacctaaataagtaataatgtactaaacagtctgctgctttacttgattatcaatgcatctacttatcattactaaatgatgaataaaaaataaaagtatgtttataaaaaaaaaaaaaaaaaaaaaaaaaaaaacatgtcggccgcctcggcctctagcgaccctaggccagtagtttggtttaaacccaactgcgagggg

SEQ ID NO: 4131 - DNA, 1071 bp, Poppy
gaattcaaccccaaccaaatcaaaaacagacgatccgaattcagtcattttctcgctcgctctcttgtttcgtaaaaattttctatcttgaattaagatctaaaagatggcgggacaaaatcaaagattaacagtagtaccaacagtcacgatgcttggagtaatgaaagcacgtttaataggagcaacaagaggtcatgctttacttaagaagaaatctgatgcattaactgttcaatttcgtcagatcttaaaaaacattgtttcagctaaagaatcaatgggtgatattatgaaaacttcatcatttgctttgactgaagctaaatatgtagctggtgagaatattaaacatactgttcttgaaaatgttcataacgcttcgttaaaggtgagatcgcgtactgagaatgttgctggagttaaattacccaagtttgagtatttcactgaaggtgaaactaagaatgatttgactggattagcacgaggtggacaacaggtgcaactttgtaaggctgcttatgtcaaagcaatcgaagttcttgttgaacttgcttcgcttcaaacgtcttttttgactcttgatgaagcaattaagactactaatcgccgtgttaatgctctagagaatgttgtgaagcctaggattgagaatactattagttatatcaagggtgaattggatgaacttgaaagagaggatttctttaggttgaagaagattcaagggtataaaaggagagagatggagaggacacttgctgcgtcgaagatgtttgccgaggattaagaagctgagaaagtttcgttgcagaaagggatttcgatgaatgctgctcataacttattgtctgcggcaaaggatgaggatattgttttctgatttggtggaggttagtgataaatttatttattcaagaatttagtgtgttgtgttttatttgcttttgatgtttgggtttatccgggaaggaaggaaggaagaaacagtttttatgattttgtgaaccttgttatattgtctgaataagagttcatctctctctgtttattatcaaaaaaaaaaaa

SEQ ID NO: 4132 - DNA, 693 bp, Nicotiana benthamiana
tttttttttttttttttgctcacaaagcattcaaatttcattagaacacaacagtctaaacaaacaaacaaaaaaacaagctattttgaatcctcgaaatacaatcagccattttcatggggggaaaagatccctgataggaggcaataatgaaagttacattaaaaacatacaactcttgcttcgagtgagactcaatgccttacaaaactacttgtggtaaatattccaaacaaatcagcatagcatattttaaaaatcatgtgcaacggctctgacactgcctagtcaagccatctggtgataccatcttctccaaccgctgctagtacttcaacacgaacatccaaaacggccagaggattcctacagttcactagtcgacattcttccatagtaccttcaaatgtccagctttcccaaacatcaaaactgtgactcgcaaatacaaattccatcctcctatttatctgtaataacttcccaccagcagtaaatgatctcaacccaattgtatccttgcttctaaaaaccacaaggaactgtgctgctgggtctctttttgtaacatctgacattgtgtcgaggaaccaaccaccccctttaactctttgtctggagacatgcaaagcagggtgatgtcttgcatgtaaagctataatataaccatcctcggacgcgtgggtcgagggg

SEQ ID NO: 4133 - DNA, 614 bp, Nicotiana benthamiana
tttttttttttttcaatggtaggagaatacgagttcttttttacttgatatatatgtcatttcccattttctaattaaacaaggacaagaaatagtaattcatttgagcctatggctctaaaacttactccttgatttccttcttcttacaaaattaaactgataataacagagagaaagttgtataggaatttaaggggcggcagctgggggtggaacagcaacattaggaactccagggattggaaaagtaaatgggttattatcaccagtaccaggaattccaaaaccaggcaatcctcctgatgatccaaagtcaggaaatggaaaattgaagggtatatttggaattccatcagaaaatggtggaaaattgaatggaaaaggaaatccaccaatgtttgttgaatctggagaaggagaagccgaatcatccttttttaccttaaataacttctcattttcctccctaagcatccttttagcatcacaaacacaggaaaagtgaattaaacaaagcaaagtgacaacactaacaatcaatttgagagaaaatgtacaagtcattttcctttcttttctttgatattaaatcggacgcgtgggtcgagggg

SEQ ID NO: 4134 - DNA, 1312 bp, Nicotiana benthamiana
ccaaacgttaggtaagattgttgggtgatgaactggaacggcgttgtcaactgcagatgaattccaataacgtcgtcattacttttgtcgaccagcaaagccattagtttttatggtatttaatttgttgtttccttttcttttccatcgaataaactggccataggaatgaattcaagtaccggttggatgacatggagcccaagttcagctttcctaccaatatccatgggttctagctgtaataatagcaggatttcctgtcatacactttggaatatggcgagaaggagaagggtgtatataacggtgaataccaagaagagaagcgaaccagttttcaagccttccgttgttgaaaaagtttctttggttgatgaggctgaggatgagcttcttcttgaagatgaggacctggtggatgatgatgatggggtctttgaagagtattttgaggaagacgccgagctttgtgttggggatggatcgggaggaggagggatctctctggctgggacatcatgggacaaaagagcattagaacttgcagaagaagttgctctatcatttgatggagaattgggaatttatgcgtttaaaacattaaaaaatgccaacattcaagtacgagtggagagacttacaaataagtcaggtactcctaatatgatggatattgaagctttctcattaagatacagagaaaagcttgatgaagatgaggtggctggatctattccaaataacgtatctcttgaggtatcatcacctggtgttgagagagttattcggattccccaagatctcgaacggttcaaggatcgtcctatgtatgtaaaatatgttagtgatgaagtggctgagggtggatcatcatctgaacatgatggtgttctcaggctcgtctcctacaatttggaaactaatgcttgtatttggggcatagcagatgttagagtgaatagagaaaaagcagggaaaggtaaacctctaagcaaaaagcaaagagattggcgcttggagacatcatttacgtccttgcgtttagttcgtttatattctgaattttagaggttccaacatttatagtcactaagggtccttttagcaaagaacctcttctgctaacaaggtttacataagaagtgaaaaaaggacaatacaattcattatggtacaggttgtgaaagtttgtatgaaactggattcagaagtaactggatcataacattttgaagattttgtattacaaatttacacgtattgctactcataatacagatgtcagctgtcgctatgcccaaaaaaaaaa

SEQ ID NO: 4135 - DNA, 1322 bp, Nicotiana benthamiana
ttttttttttttccgaagtaggttcaacaaagatgcccacattttgtaataactggcaaaatactgcaacgtcagttaaacaatattcaagaccatgaagggagactcaagcacacgagtatttgttgaggcaaaaagataaaaagtaaacatagacagatacacatcaagtgcctagaaaagcaattccatagaaaggaatggacctgcaattcaaatagtagatggtatatcctccttgcacgagtccattactactattcatcatcatgacgcttcctgctcctcttctcagaacgttttttgtctctgccaactcgtgaatcatcagaatcagatgctgaggctgtcctcctgctcctacgcttgtgccgtggaggagaatcatcacttgattcatcagaactgtcagcatgtctatgacttctcctcctcctcctcttctccttcctactttttctcctcctcctacgatcttcatcctcgtctgatgagtcatcccttttcctcctcttttcctttctcctcttcctgcaatccttatcttcatcatcgtcctccgactcactgtgtcccttcttcttcccactcctcctcctctttgatctgcccctctttcttcctttttccagagtctgattctcctcctcctcatcatctgaatctttcttcttgtgcttcctagatgacttcaacttcctactcaccttcttcccatacttctcagcaattgccctctccatttcagaatcataatccgaatcagaactctcactctcctcttcttcttcgctgctctcctcattttctgcttttccctttatcttagaccccttgatcttctccaatccagacaacacagcagcctcaatcgcctccggatccttatccttgttatcatccttaacactcacaaaattcctacactggaaagtgaggtggcctacccgcccacacctcttgcacgctccacgagtttcatcagcgttggatcccgtgatccgggcaagtgcaagcaaaccttgaaagctcgcataagcattttcaggatcagctgctgacgccttctgggtagatttcttgtcgtcctccttgctaggagcatatggatcataaccaatagcactctgccagatgccgtgcgtctgtagggctgcactactgtgaacactgttgttcgcaggcatgcgaaccctacctgctgtggccggcatgttgactgtttatcaccaagaagctgtatacacctttgtgtgatgattatatcagttgttcgacgataatcggaaacctatgttcgatcggacgcgtgggtcgagggg

SEQ ID NO: 4136 - DNA, 313 bp, Nicotiana benthamiana
gttcttgtcattaattaagcggccgcgtcagccttgcacgtgacactagccgctgcctgctcgcaaacctcgcacatccatacacgttcgtggcgggcgtttcggtgcaccctcgtgtcgcagaccaagcacatgaacatgttgtctactcgacagaacacgagtgcggcgtctaagtggcaatactcgcatggttttgctactgccgccgcaccccatcctcctggaaaacaatttgcgccgcctctcaatatgcccatatttttctcttctttcttctctctggcctgttgcggacgcgtgggtcgagggg

SEQ ID NO: 4137 - DNA, 906 bp, Nicotiana benthamiana
ttttttttttttttttttttttttttttttttttccttcaagactggttcatacaatcccacaaaacttaattttgtccaggtgatatatacactgggatacatcactatgcacacataataataaacaatgacataatcacacaatgtatctaataagagaaaaaaaattccaattgcacaaactttacaaaagcattttcaatcatcgtcgatgcaggcctaatgcttgttgcttcaaaaacatccaaggagtttctttggagcagttccagtggcgcggtattttgctgccaattcctctgccttaagaagatcttctccacgtttagcttcaatcatcgctctcttttcctctgcttccttgtggagtagagcgattttgtttttcattttctcaatatattctgccttctttttctccacctgctcctccatcttttttagctcagcctccaggtttgctttcttactattctcccatgcagcaattgctgatacatttttctgagctttgttttcggcttttgatttctcactttcctcccatgctttgattagtgacagtctcttctctgttgcaactcgagcaagcacagcatctctgtcaatagatccctcctttttctcctcagcaggtttatcttcaacgacaactagtgctttagaatcatcggatttttctttgacttgttcaggaggaggcagagctggtgcaactatagctttctcatcagccacttctttaggagtttcaacaacaggttctgcttctttaacaggtgcaggagcctcaggtgcagggggagtagggtccacaactttctcagtctccactttcgtagcttctacttctgccatggctacaaacagaattcagaaaaaagcggacgcgtgggtcgagggg

SEQ ID NO: 4138 - DNA, 1469 bp, Nicotiana benthamiana
tttttttttttgatacaatctttttcttatgtaaacacctatttgagacaaacaaataaccaaaaaaaaagaaaaagaaaagaaaagcaaagattttgagcaaacacaattaagtccaacatttactcttgaatttagtatacctctctacacgtcaggcacatgataggtgacaaccggtgggtctattacttctggctgttggtgcctttcttcttcagtaggcttccaaatttatgaagcaaaggtttcttcttcttctgactttgtggctttgtaggagatgtgccaccattctcaggattttccactgaaggtaatccgtttacctggtcaaagctctctccaacatctgtcttcgactctgaatcctcttcttgtactgtctctctttgcggagagaagtctttgtcgccaatcttgcagctctcccacattttaaactcgccttctgctgaatcatcatcttccttttctttgtgttcatttcccttaagttctccatttggcttctcaacttcagctaaggtctcaacagcttcatcatgcgagatgatgttgacgactccttcagatttttcttcagcggattgctcagattgatgaggaataacttcaatcttaggcttctccagtattcctcctccattttgttcagagaattccaccacctttggaagcatatcataatctttttcactttcagaaagctcgccattttcttcagcttcctttttggccaaagcttctttgagggacttagacaactcttcaactttctttaaagattcggcttctctactacgaagctcctcattctcctgaagaatattctgcacttcattttccttgtccaacagcgactccttcaacttcatgctctcaccctttgcttcaccaagaacctctttcagataggtcacctcagattcagcttcgttcagggaattcttcaactgaactgcttcctcttcgaaagaagcttcttgctcagcctcttttagcaaatttaccaatcggtttatttctttttccattgaagagttttcttcttcagttttctttacataattcatcagataaagctccttgtcctcccactcagccttcgaaatttggtgctcattcttagattgttcgactgaattagtgagatcatcaattttctctttcgcttcatcaagcaggctttcgtacttttcattggttgctttcaatactaacttcaagtcttctatttgtgtttcgtaatgttcatgttcagcttggctagacaaccacctctctttggcttctcttgcttctgaagaaacttcatgtaatgccgatgccaaactttccatcgccttcttacttttctcttcctcctccctggagttctccaactcatttataagtttgtttttctcttccaagagggactgaacattttctgcggctagtttctcgcggacgcgtgggtcgagggg

SEQ ID NO: 4139 - DNA, 848 bp, Nicotiana benthamiana
gggcatcctgagaacaatttatttgttatgtgctcacgaacttcgtcaacaaaaactcacttgaaatctctttggaaaggccaattagaaacccctgatgcgagcagacatagtatacctatcctcgtagctaacttttcgtctgttgatcaacgcatctatgaaagaaccagtgacagtttatcagtacaggggatttggtgcaaagaagatggttgtgtttttaaaactattttctgccccttttgtgtaaattccagacattgtcttggtgtacaggtcatggcttctgatgcagctaatgtccagttactaaataaggtgctgttttattgtgattgcttggtgataaaagagcctgaagcgtcaagaaaggaattatctccgtccaccaattcaacctctgatagaggagttattaattccattgagagtttctcatttactcctcagcagcagaaccttggaggatggagaactacaaaatcaaagatgcggttaccaaagaggagcatctcatctagtgcacagactgatgtagaatgagttggagtcactaaatagatgatatacctcctgcagaagttacgatattacaagacaagcttccaagagagataacaagtcaaaatgggtcagaagttgctggcaagatgttagttgagggatactcggagttatgtgtggatgcctacaatgaactgtttgtgcagttcgttaaaagatagcagcagtcagttttcacttttctagtcggctgagtgtacatattagacagatatggggaaaattttatatgtaatttctacattattataacaaaaatgttcgaaaaaaaaaaaaaaaaa

SEQ ID NO: 4140 - DNA, 868 bp, Nicotiana benthamiana
tttttttttggaactattcaaatttaatgtaaatcaaaataagatacaaaaaccaattcccttcgtacagaaagttacttgcatttttaaaccaaaacgaacattcatatattacaggagcttgtcaatgcaatgcagcaaacggtaaggcaaacagcaccaagccataatactagggccaaaacaaatgtgttccaataaaatttccaagaagaggtttcaatccgtaaatgtaacatagatgaaccctggtgctcccgaattgcggtcagcaatgacatctttcttccttagaatcagtctgcagtccagctctgctccacaacttctctaactctgcggttgtaatcccttttattctcgctgaacatccgagctgcttccgaatttgcaggtgaattggggttgggatcgcacagcaatgactgaatggatgtaagtatagctgcaacatcatatattggactccactgattttgaagaatatccaaacatatacttccatctgcataaatgttaggatgaaacatgcgagaaacaaaccgcactgttggtggcttattggggtaatcctcagagaattgaagagtcagcttgaacgtaccaccatcccaaggagtgtcatcaggaccaaatatcacggcattccaaagcataatgttgttgtcttgaggtgcaccactaataccagcaggagggtcctgctgcaacctcttgaaatctctcatcaacctctttctagccggagtcgacattgtaaccaccaatacggaggaaacaaggcggtgagctagggttttggtttgattctgcgttgaactcctgctttgtgttggaggaggtgcccccggacgcgtgggtcgagggg

SEQ ID NO: 4141 - DNA, 740 bp, Nicotiana benthamiana
tagctctagtaatacacacattagccgcacttcccacatttttagtctgaataaaatggccaaggctactgtatcatccattgtcctcctcctcactttgaacattctcttcttcgcaatggttagttcaacttacatcccatgcccaccaaaaacaaagaatcaaccccatcccactaccccatcatccaagggttataagaagtgccaaaaggacacactaaaattgaaggtgtgtgccaatttattgaatgacttggtgcatgttgttattggaagctcatcaaagagttcatgctgctctctcattgagaatcttgctgatgttgatgctgcagtttgcctttgcactgccattaaagctaagctcttgggaactaaccttgataccgctctttccctcagcttattgctcaacaattgtggaaagactgttcctaaagacttccaatgtgcataaatggccatcttcccaccccaacttgtttggtaatgaggcgtagttgtctgtttgtggtgtttgttttctccataagattttcgtcggagatttcaactaaaaaataatcagtactgagtgtgtttgtgcacggttgcttattttctcaggaaatatgtggaattattctagtgcttagaagtactgagtgtgtttattcatggttgcttattttcaatgtgttgtatcccatatttatttgtaataagatggttatgttctcactaaggaaaaaaaaaaa

SEQ ID NO: 4142 - DNA, 604 bp, Nicotiana benthamiana
ttttttttggtaattaactttcttttattaatcaccaatgataagtcattacaaatccataatcagctagcacagctaattatcaataagaagctcctctcctactcctatactatacctccatttctaattacattgaacctgttgaaattgtaggctaaactcaatatgacttctaacatgacaaatgtaggcagtatttctaagcaattggctaacacactttgacatatttgtgaatattctggagtttctttcaagccaaacacagtagcaaacttctgcaaatatcagcttcatagcatgagctcgtgcagtccttcccttagccttggctacaacccattgtatgaatcgatcccaagattgaaatgtaggctgagtaactcctatccaacccattgcttgatgcatcatcatggtagtgaaaggacaatgatagaagagatgatttcttgattcttcccattgttgacacagaatgcacatgctgtcaatgtttgaattccattgtttcactcgaactttggtaggcagcctatcctgcagtattaaccataagttaaacactgcctttggccttgcggacgcgtgggtcgagggg

SEQ ID NO: 4143 - DNA, 771 bp, Nicotiana benthamiana
tttttttttttttttttttagaaacaaagtggatactatataatttataagcacaatgaactgtaaggtaaatacataattttatttggacatttgctcagaatagaagaaaattacatcaaaatctactctacttcacacaagcagatgcctctcatacagaaaattaacagtctgaactggcattgccatttgtgtgcatttattcagttcctgcaatcttcttcttcaattgctcaatgtcttctgccaattcttttctacttgacttgaatagaagatagcggtagacaaaccacccagtatatccaaggcccaccagctccataatttttgggagcaaaggaactgagttgatagcaccaacaacaattgaagacagccaaactgcaacaattgccccacctccatatactataactgtagacttattttcaacagcatcccacttttcttttagatctgtcaacaattcactggtatcaacagcaccggattcttctgatgaagaggctttgacctggagtagcgaagccttcttgggttcagcaaactggaaggaagtagagaacgcggtagcagaaaggcggggtggaaggtaaggcaaagcggagcagcgaacaggggcggctttggtggtggaggaaagtgggaaacgagaagcaaagacggcagtagctgccattgaagtagaagctgctgctgccatttggccgatgcttagatttttggggctggcggtgtatgcttacggacgcgtgggtcgagggg

SEQ ID NO: 4144 - DNA, 782 bp, Nicotiana benthamiana
gaccatctcaaaatcacttgcttttttcctctcattttctagagaaagaaacaacaagacgtacagaacgagagttcaagaatctgcaatgggagtggctcgagttaaccaattctggttgcatcttgtcatcctcttctccatctccgttgcttccatttctagcactgaactgaattgtgtatacacagcttatgttcggactgggacatactgggggtctggaactgactcaaaaatttccttgtctctttacgatgccaatggccatggtcttagaatcaataacctacaagcctggggtgggcttatgggcccgggttatgactactttgaaatggaccaattggatatgtttacgggccgtggtccatgtttgactggaccaatctgtaaaatgaacttgacttctgatggatcaggtgagcaccacggatggtactgtaactacgtggaagtcacgtctacagcaaaacacaaacgatgcagccaacaggtgttcaccgtggagacgtggctcagtgccggtcagtacccagatgggttgaccgccattaggaacaactgtaagcgtatttccaacgaacaacaaccaattcatgattctgatcaatcttatcatgttgtggatgtaatttaattcgagtttattggacgttgtatgatttacgaaggccatttaggccaaggcctgatatgtactctcacgagtgctacatagttggaatgaaaagttttctttacccataaaaaaaaaaaaaaagggcggccgcgtcgagggg

SEQ ID NO: 4145 - DNA, 406 bp, Nicotiana benthamiana
ttttttttttttttttgtttagagaagagaacttcaatcttttaattagaaagtcagttcatcaaagggataacaattttaaattgtacatatgatgaccacaactctcattctatcacatcattaacatccaaagaaagcttatgaaacgtacgtagttaatcctcaataattctcagctatccctctctcctcttctaacataaaattactagtactactacgtatataacaaaagaaataaaccctcttattagcttttcgatcataactaggattaaacgagaattttagtgactttacctaacgtaatagtactactaaaaatttgaaacacacatatatctattactagctagcagccaacacaacctttctccgaggatcggacgcgtgggtcgagggg

SEQ ID NO: 4146 - DNA, 631 bp, Nicotiana benthamiana
tttttttttttaaaggtaagaagattcacctttcaaaatcacaattacaaaaattacagaggaaagaatcgcgatacacttgaaactacaccagctaaattgctccaaaatcatgcattgtataaaattgccaatgatccttcggaactcatgtataccttggattttacacccaaagaaaattgtaattaaaagaaaaagatttacaaaaatatttccacggagagccacctatattctgtgcaatggagactttcactgaaatacaaacctcttaccaagtgctctgacaagaaatcatgtgttctcccactttagggagaatgcaaccggaactgcgttccaaaagaatgggaatcgaaaatatgggagatgtatgaacctgggataaccaatgcgagaaacccaaatatgtgctcaatatacgaacagatgtacaaaatcacttggcagatcatccatcttgcatgttctcttcacataaatcagtctgtgatttactgggaatgatagacggtggtgaccattgatctgggaccatgagaaaataggtggtcatggccttgcgaaacctctttttgtactgcttaggtgagattatagtgggcgaccggacgcgtgggtcgagggg

SEQ ID NO: 4147 - DNA, 1072 bp, Poppy
gaattcaatcaaatggctactgctagagttttagctgctagtatgttgcatgaatgcaacaacactcacagtgcttcatttcttttgagacaatcttctttcatcttacctattaaacatcaaagtattaatttcagtagaagagcatcttctaggagagcttttacttgcaaatctctttacaaacctgaaattcaaatcaaacaagaaggtgaacctcaaaccctagattacagagtcttctttcatgataaatctggcaaaaagctttcaccttggcatgatgtaccattgcaattgggtgatggagtgttcaattttatcgtggaaataccaaaagagacaagtgcaaagatggaagttgcaactgatgagccatatactcccattaaacaggacaccaagaagggaaaacttagattctacccctacaacatcaattggaactatggattgctcccacagacatgggaagacccaacagtagctaattctgaagttgaaggggcattcggagataatgatccagttgatgttgttgaaattggggagaggcaaggaaaaattggcgagattcttaaagtcaagcctttaggtgctttggctatgattgacgaaggagaactcgactggaaaattgttgcgatttcgttggatgacccaaaagcttcactcgtcaatgatgttggtgatgttgagaaacatttcccgggcactctcactgctataagagattggttcagagactacaagatcccagatggaaagcctgccaataagtttggacttgggaacaaagcagccaacaaggattatgctctgaaggtaataactgaaaccaacgaagcttgggctaaacttgtcaagagaactgttcctgctggggagctctcccttctgtaaattttgaatttttaaaagttgaagataagaggcactttggcccgctcctatccccctcctctctctattgttttctttcatgctggattccaaacaaacttcctccaattttttggacgaagtattgataatttctaatcattgagctccatttttcaaaaaaaaaaaa

SEQ ID NO: 4148 - DNA, 909 bp, Nicotiana benthamiana
tttttttttttgcagtttcaaaaacaaaaataaatctcttcaaagtaaataaacttcttcaaagttggaattgtacatgaacattactcaaggaaaatggtaagtgccaaattttcacattgcaataggcaagcagactataataggactctagccatagtgcttgtataattagcagctagataaaatgagctctagcccaaggaggaaaattgaacaaacttttacagcctgaatttattccttaaaaagtagacaagatacacaaacgttacaggatcagatagtactaacactatcctgcctaaaagaggcagatagtttcttctagctcaagctcgagataatacagcaaacgcttttacgaagcacgggatggcataccacggcctctgcctctaccaccataaccataaacatacccatttcctctatttccaccgtatcctccatatcctcctcttccataatacgaacctcgagaacgtccaccacgtccaggaccacggccaccgcggccacccctgtatcttgagaaatctccaaatgtctcaacgtctatcttcctttgctcagagaacctggtccttccatgacttgggtcattatcaagtgcattacttgacaaagagtcgaaaaaatcatccttgttgtaaacaggcttcacatcaatcttaggaagatcatcatcatatttattgaaagagatatcttcatcgctgccatttccatctccttctctgttacttttgccaagatgaccccacacttcgtctttcttgaacttctcattcatggccataaaatcaaaatcctcttcaaattttgtaactggtcttgaaacccccattcctcttccgccacgccctctgtagttgttgtaacgtgccggacgcgtgggtcgagggg

SEQ ID NO: 4149 - DNA, 880 bp, Nicotiana benthamiana
tcaagtatttgtcagaggtaaagcaggggagcgttttgctgtaaggaattctcttgctcaagctgttgtagaaggcactggggaccactgttgtgagtacatgacaggagggtgtgttgtggtgcttggaaaggttggtagaaatgtagctgctggtatgactgggggtttggcatacattcttgatgaggatgatacccttatatctaaggtaaacaaggagattgttaagatccagagagtggttgctccagtgggtcaaatgcagctaaagagcctaatcgaagcccatgtggaaaaaacgggcagcacgaaaggcgcaactattctcaaggagtgggacaaatatttgccactattttggcaattggttccacccagtgaagaagacactccggaggccagtgctgaatacgagcaagctgctgctgggcaggtcactttgcagtctgcagagataccattgaagtaaatctcacattagcacagccttgaccatggttctaagcaggagacagtttgtacaggaaagaatgatatcgtctccacggaaggacggtgaagtctgagagatcaaaactcttaaaggtgcaagcaactacctttgttgaacaaagggctgatctttgtgatgcttcagcagctgtacagtgatgccgtagaaactctaaattcttggtaaattatggcataatattgccgtttctactatttgcttagccgaagaacttggaaattcaggtacaatgttttggacctgttactagttcttgcccctcatttttttctttgaggcagttttcatgctcgtgcttaataagttgtaacttgtatcatgacattgacaatttcatggaatgtgtaattagcaaaaaaaaaa

SEQ ID NO: 4150 - DNA, 1489 bp, Nicotiana benthamiana
acaaaaaactgacttcttgcagctatggctggaagaaaaagaagaaaaatgaagttattagctgcaacaactccaactaatggtggtccttctactgaggagcgtgaaggatctgatgagcaaaactcattgttttgtgtaccaatggaaattctagaactgattctctcccggttaaacttgagagaaaacatccgtgcttctgctgtttgcaagcaatggcttgctgtctccatttctgtacgagttgcaaataaaccaccttggcttatgtttttcccaaaattcggtgacttggttgaattctatgacccttcggtgaggcaaacttattcagttgagttaccagagttacgtggctctaggctttgttacgcgaaggatggctggttgctgttatacaaaccgagaactttacgtgtgttgttcttcaatccttatacgaagagtgtgatcaatttgccaagactagaattaacataccagatagttgctttttctgcagctcctacatctccgaactgtatcgttttcacagttaagcatatcagccccactttggtcgcaattagcacatgtcaaccaggggcaacggaatggataactgccaattaccaaaatcgtttgccatttgttagcagcatttggaataagttagttttctgcaatggtctcttttattgtctgagtcttactggttggttgggagtctataatccagaagaacgtacttggcttgttcgtgtggttccacctccaagatgccctgaaaattttttcgtgaaaaattggtggaaaggaaaatttatggcagagcacaatggagatatctatgtgatatacacttgctctactgcaaatccggtgatatataagttagaccaaataaataaaatttgggtcgagatgcaaactttaggtggtttgacactttttgcaagttttctgtcatctcaagcaaggatagatgttcttggggtgatgagaaatagtatttatttctcgaaagttcgtttttatggaaggcgttgcatatcgtattctctcgatcatgacagatactacccgagaaagcagtgttatgattggggagaacaagatccttttgagagcatttggattgatccaccgcaggacctttcagcctttgtctgaaaaaatttgtgacaaagggctctaatacaaggtcttgtcttgaaacgacatcgtcaaccaatttaaaagctgcagatgacgctgtcgatgtatcactaaatgtcgtcaaagaagtttgggggcatgataaagagcaggtttctaatcatgttatctgtcaatttatggtactttatataagtagtcatttaagatttttcttcaatgagtaagaactgttcttcctttgtgtagaaaacttttagataacttaacgctgcagttgagtttgtagaaagtttttattcaagataatgactgaataagagcactaggtatttctaaaaaaaaaaaa

SEQ ID NO: 4151 - DNA, 569 bp, Nicotiana benthamiana
atctacttgtcaaagttatctattgcatttaattagttttgctctcagttagacagtttcttttgtagggtggtgccgctgtctggtgcatgggctttcagaaaattccgggccaaggattgacaattttaggagatcttgttctaaaagacaagattattgtttacgatttggctggacaacgggttggatgggccaattacgattgttcgcaggcggttaatgtttcagctaccacaagcagagggaaaactgagtatgtcaatgcaggacagatcggtaacaacagttcgccgtgtagcgactcttacaagctgttactaagcttcattctaacttctgtcttacatgtattagtgcgtggcacaaactcaatctcgtaacggcttaggcaaactgctcaactttttctcatttttttctcttttttttttctgtatagctgactgtcctgtagttatttatttacaggtgtcgatgaagatctgtcttcagatctggattgcaaaaattttaggtgcctttaatggtagccttagatatgttgtttgttcaaaaaaaaaaaaaaa

SEQ ID NO: 4152 - DNA, 876 bp, Nicotiana benthamiana
aagaaaaaaaagaacgaagaaaaagagcaggcacgaaacgcagccgagcaacaactgaaagcgaggcttcttcagcttcagctcgactatgaatccaattcttcaaacgtgaagaaaataaagctgctaatcgtttcacgctttctggatataatattggaaactgaaacttgattacctaggatgaagaagcttctagaatttgggaggaaagcaatgttctatattagggttctttcaggctacgaagagcgtcgaatccgatcttatcgattacagatgcaacaacgccttaaacaggcggaggagaggaaggcagcaataaggaaggttcctgaacagatgatattgtcagaagttaggcgaatggtggaagagatgcaagctttgaagaagaagctagaggagactgaggctgctgttgatgactacttcaaaccaataaataaggaagcagaagcaatagtgaaaatgcagcttgaaggagaggagaatagaacaaaggagatgatgaatatcttgcagaaacaagcttttcttgagaagcatcagccagagaaactaataagcgcagaaaatgtggtcacagaaaaacatggccaagataaagcatctacatagattccaccagaagtaagatgcttttgtagagtataaaattgttcatgaaattgaacagtacgaattcatgttgttttgcctcttagatgtggcatggttttggcaatccaaaaaaggaggcggatctggggttccaaagcttctgataaatttggaacaagtagagaagtaggaattagtttgtttatttgccgttgccagtgatgatttctgttgtaatttatacgttgtctcaatgggatttctcgttcccag

SEQ ID NO: 4153 - DNA, 720 bp, Nicotiana benthamiana
tttttttttttcgtagactgtaaatcttaattcacttcattccagagaactttgtaaatacagatccacaagtaacatcacggtaacaatctcgcggtcaaaacgaggacagtaacaggaaccaaagtaaaccataacggaacttcaaccaaacgtagaaccataaatttcaaacaaaaaaataaatctaaaggcaacggaaatctaactcctccagtttccttcagaaccaccaccgtaaccaccttcacgacgaccacctccataaccgccgccaccaccataaccaccttcacgtcggccacctccgtaaccaccaccaccaccgtatccaccttcacgacggccaccacctccgtagcctccaccgccaccaccacggtaaccgccaccaccaccaccgcctccgccgctaccgcgagactgagcttcgttgacggtgatgttacggccgtcaaggtcttgaccgttcatcccttcaatagcgtccctcatggatttctcatccttgaaggtaacaaatccaaatcctctagatctaccagtttctctgtcattgatgatcttcgagtcgagaatttcgccgaactgagaaaaagcatccccaagtgtttggtcggtggtagcccatgctagcccaccgacgaagcacctgtattcaacttctgccattcttttctgattaataagaataagaagaaacacgcgtgggtcgagggg

SEQ ID NO: 4154 - DNA, 631 bp, Artificial
  Synthetic
gaacccagttggtccagtcaccgtatcaattacctcaatggtggcaccacagctgagcttcttctcgacaaatcttcaggagctggatttcaatcaaagaaatcgtatctatttgggcactttagtatgaaaatgaagcttgttggaggtgattctgctggtgttgtctctgcattttatctgtcatcaaacaatgcagaacacgatgagatagatttcgaattcctagggaacaggacaggcgagccgtacatattacagaccaatgtgtttacaggaggtaaaggagacagggagcagaggatctatctctggtttgatccaaccaacgacttccattcatattccgttctctggaacacctttcaaattgtgatttttgtggacgacgtgccaataagagtattcaagaattcgaaagacataggtgtggcattcccattcaatcagccgatgaagatctattcaagcctgtggagtgctgacgactgggctacaagaggaggattagagaaaacagattggtcaaaagcgccattcactgcttcctacacttcattccacatagatggctgtgaggcattcaccccacaagaagtgcaagtttgtaatacaaatggcatgaaatggt

SEQ ID NO: 4155 - DNA, 386 bp, Artificial
  Synthetic
cgatcagggtgcagccggggtacaccgccggcgtcaacacggccttctacctgtcgaacacggagcagtacccggggcgccacgacgagatcgacatggagctgctggggacggtgccgggggagccgtacacgctgcagacgaacgtctacgtgcgcggctccggcgacggcaacatcgtcggccgcgagatgcgcttccacctctggttcgaccccaccgccggcttccaccactacgccatcctctggaaccccgaccaaatcttgttcttggtggacgacgtgccgatcaggaggtacgagaagaaggtggaggggacgttcccggagcgggagatgtgggcgtacggatccatctgggacgcctccgactgggccaccgac

SEQ ID NO: 4156 - DNA, 871 bp, Artificial
  Synthetic
accatcaacctgtctctgtaactgtaacgaatggagaacgaatggatggcaaaatgtacatggatcaagaagaagaagaagacgaagacgaagacgaacaagaacaagaagcaattacaaatcattcaagaactcatcaatggaggatttgttcatcatcacttgcggtagcactcggcggggaagccctgggggaagcgccagccgtcggcgcagtagttgtaggacatgtagttgcgctcggcccacgcgacggtgccgagctcggcgccgtcgagctcgcggtggatccacgccgacgtgccctcggggcacgacgacgacgaccacccgccggcggggttgttgttgacgcacgcgttggcgctgtacccgcggtacgacaccacgaacggcgcgccgctccagtcgatcttgacgtcgccgtgcctcgtcgcccagtagctgccgtcccacagcgtcgcgtgcagcctcatcggcttgctctgcgggtacgccaggtcgtcgtacttcttgaacgtcctcaccggcacatcgtccacctggaatatgatgttttggggattccagatgatcttgtaggtgtggaagtcggcggtggggtcgaaccagaggtagaactggtgctccttcttgccgtcgccattagcccagacgttggtgttcatgacgtaggggttgccgctgaggttgcccatgaactcgatgtcgatctcgtcgtggccgtcgccctcgccggaggagaggtagaaggaggtgacggtgccggcggagttgccgccgacgagcttcatctggacgctgaactcgccgaacaggtaggtgtccttggaggtgaacccggacccggagctccggtccagcgtcagcg

SEQ ID NO: 4157 - DNA, 796 bp, Artificial
  Synthetic
gcgtccgaaacccctcataaaggggcaaaaatattaagaaaatggtgaactattatcttgttattgtcatatttttctccgttgttgaattggtttatgggtcttcaagaaatttgccaattttagcgtttgatgaaggctactcccatctctttggtgataataaccttatgatccttaaagatggaaaatctgctcatatttctctagatgaaagaacaggggctggatttgtgtctcaagacctatatcttcatggattcttcagtgcttctattaagcttcctgctgattacactgctggtgtggttgttgcattttatatgtctaatgtggacatgtttgagaagaaccatgatgaaattgactttgagttcttgggaaatattagaggtaaagactggagaattcagaccaatatttatgggaatggtagcactaatgttggtagagaagaaagatatggactccggtttgacccttctgaagatttccatcagtacagtatcctttggactgagaattttatcatcttttatgtagataatgtccccataagagagatcaagaggacagaggctatgggtggggacttcccatctaagccaatgtctttgtatgctacaatatgggatggttctggttgggctaccaatggtggaaaatacaaagtcaattacaaatatgccccgtatattgccaagttctctgatttcgtcctccacggatgtgcagttgatccgattgaattatcatccaaatgtgacattgcaccaaaaactgcatcaatccctgc

SEQ ID NO: 4158 - DNA, 650 bp, Artificial
  Synthetic
aataagtatatgtttgggaaagttactgttcagattaagcttgtagaaggtgactctgctggaactgtcactgctttctacatgtcatcagagggaccaacccataatgagttcgattttgagtttctaggtaacacaactggtgaaccatactccgtacagaccaatgtttacgtaaatggtgtgggtaacagagaacaacgactgaacctttggttcgacccatccaaggaattccattcctattccatcttgtggaaccaacgccaagttgtattcttagtagacgacaccccagttcgtgtacactcaaatttggagcacaagggaattccatttccaaaggaccaagccatgggtgtgtacagttcaatatggaatgcagatgattgggctacacaaggcggaagggtcaagactgattggtcacatgcaccctttgttgcatcctacagaggatttgagattgatggctgtgaatgtccagcaactgttgcagctgctgagaattctaagcggtgcagcagcactgctgagaaaaggtattggtgggacgagccaacaatgtctgagcttagtctgcaccagagccatcagttgatttgggtcagggctaaccatatggtctatgattattgcacagacactgc

SEQ ID NO: 4159 - DNA, 725 bp, Artificial
  Synthetic
cccacgcgtccgggcaaggcgaccgccgacctgaagctcgtggcgggggattccgccggagttgtcactgctttctatctgtcgtccggcggggacaagcacaacgagttcgacttcgagttcctgggcaacgtcaccggcgagccgtacctggttcagaccaacctgtacatcgacggcgtcggcaaccgggagcagcgcatcgacctgtggttcgaccccaccgccgacttccacacctacgccgtgctctggaaccccagccaggtcgtcttcctcgtcgacgacacccccatccgcgtctacgagaacaagaacgccaccgccgttgtcaagggccaccaccgccacgccgccgccgccaatgccaccagcaacgccacgtcggcgtccgcgccgccgttcccgtcgccgcagccgatgtcggtctacagctccatctggaacgcggacgactgggcgacgcagggcgggcgcgtgaagacggactggtcgcacgcgccgttcgtggccacgttccgcgacgtccgcgtcgaggggtgcgcgtgggcggcgaacgccaccgactcggacgccggcgaggtggcgcggtgcacggggagctcgtggggcaaggaggggaggtactggtggaaggagaaggacatggaggagctcaccgtgcaccagagccaccagctcgtctgggcgcgcgcgcaccacctcgtctacgactactgcgtcga

SEQ ID NO: 4160 - DNA, 867 bp, Artificial
  Synthetic
taattttaataatcttgcagagatcacttggggcgaaggacgtggtaaaataacagaaggaggcagaggcctctctctgtcccttgacaaattttctggttcgggttttcaatccaagaatgaatatctctttggaagatttgacatgcaactcaaacttgtccctggaaattccgctggcactgtcaccactttctttttatcttcacaaggagaaggacatgatgagatcgacttcgagttcttgggtaatacgactggcgagccctacactgtccacaccaacgtgtattctcaaggaaagggaaacaaagaacaacaattccacctttggttcgacccaactgcagcatttcacacctacaccattgtgtggaacgctaaacgtatagtgttcttggtagataacatcccacttagagtatacaacaaccatgaaagcaatggcattccattcccaaagagccaaccaatgaaagtgtactgcagcttatggaatgcagatgattgggctacacaaggaggcagagtcaagactgattggacacatgctcctttcactgcttactacagaaacttcaatattgatggctgcgcagttacatccggtgcctcttcatgtaagtccactgactctgcaggcaatgctaacgcatggcaaaatcacgagcttgacgctcagggcaggaatagggttcgatgggtgcaaagtagacacatggtttacaactattgtgctgattctaagaggtttcctcaaggctattctcacgagtgcaagagctcaaggttttaattaggagatggcacttcgttatatcaactccaaaggtttaaagattgatgcatagcctggtggtttatggg

SEQ ID NO: 4161 - DNA, 657 bp, Artificial
  Synthetic
cccacgcgtccgcccacgcgtccggccacgcgtccggcaagaaggagcaccagttctacctctggttcgaccccaccgccgacttccacacctacaagatcatctggaatccccaaaacatcatattccaggtggacgacgtgccggtgaggacgttcaagaagtacgacgacctggcgtacccgcagagcaagccgatgaggctgcacgcgacgctgtgggacggcagctactgggcgacgaggcacggcgacgtcaagatcgactggagcggcgcgccgttcgtggtgtcgtaccgcgggtacagcgccaacgcgtgcgtcaacaacaatcccgccggcgggtggtcgtcgtcgtggtgccccgagggcacgtcggcgtggatccaccgcgagctcgacggcgccgagctcggcaccgtcgcgtgggccgagcgcaactacatgtcctacaactactgcgccgacggctggcgcttcccccagggcttccccgccgagtgctaccgcaagtgattttgaactcgatcgattcaaatcctcctccattgatgagttcttggcaatgatttgtaattgcttcttgttcttgttttcgtcttcgtcttcgtcttcttcttcttgatccatgtacattttgccatccattcgttctcca

SEQ ID NO: 4162 - DNA, 620 bp, Artificial
  Synthetic
gaattcaagaacgatacaacttgtggtttgatccagcccgtgattatcaccgatacagcattctatggactgccaagcacattatcttttacgtcgatgatgttccaatccgtgaagtattacgtaatgaagaaatgggtggagactacccagccaaacccatggcactatatgcaacaatatgggatgcatcaacttgggctacacagggtggaaaatacaaagttgattataagtacgctccattcgtatccgaattcaaagacttagtccttcatggttgtgcagttgatcctatccagcaagtgtcttcacaaggttgttctgaaacagaagccgatttagagagtgcagactacgctgttattactcctgaccgccgcacagccatgagtaattttagacagagatatatgtactactcatactgctatgacactttgagatactccacccctccacctgaatgtgtgatagtaccagaagagaagatcaggtttaaggacacagggaggttgaagttcagtggtggacatggtggtactcatcaccggagatcatcaaagagacgatccagggtttcgaaaatagcaaaagaaatatgattttatttaattttt

SEQ ID NO: 4163 - DNA, 694 bp, Artificial
  Synthetic
ctatcttctcagggacccacgcatgatgaaattgactttgaattcttgggaaatgttactggtgaaccttatattctccacacaaatatttatgctcaaggcaaaggaaacaaagagcagcaattctatctttggtttgatcctaccaaaaattttcacacctactcaattatttggaaaccccaacacattattttcttggtcgacaacacaccgataagagtttacaaaaatgctgaatcaattggtgtgccatttcccaagaatcagcccatgagaatttactctagcctttggaatgctgatgactgggcaacaagaggaggcctagtgaaaactgattggtctaaagcaccatttacagcctactatagaaatttcaattctcaaacttttggcagttcacagttttcaaatgaaaaatggcaaaatcaagaacttgatgctaatggtagaagaagactcagatgggttcagaggaatttcatgatttataattattgtactgattttaaaagatttcctcagggttttcctccagaatgcaaaagattctgagtgatattagtttgtttttgtgaaattcttttatgtgtttgtggttttattttgttagtttatagcgatcaaaataaatattgtatttttctcatttcattttatatgttatttgaagctagtcgttcatcttgta

SEQ ID NO: 4164 - DNA, 935 bp, Artificial
  Synthetic
cccacgcgtccggggagctcctcctcatcatcgaacataggtttccgattatcgtcgaacaactgatataatcatcacacaaaggtgtatacagcttcttggtgataaacagtcaacatgccggccacagcaggtagggttcgcatgcctgcgaacaacagggttcacagtagtgcagccctacagacgcacggcatctggcagagtgctattggttatgatccatatgctcctagcaaggaggacgacaagaaatctacccagaaggcgtcagcagctgatcctgaaaatgcttatgcgagctttcaaggtttgcttgcacttgcccggatcacgggatctaacgctgatgaaactcgtggggcgtgcaagaggtgtgggcgggtaggccacctcactttccagtgtaggaatttcgttagtgttaaggatgataacaaggataaggatccggaggtgattgaggctgccgtgttgtctggattggagaagatcaaggggtctaagatgaagggaaaagcagaaaatgaggagagcagtgaagaagaagaggagagtgagagttctgattcggattatgattctgaaatggagagggcaattgctgagaagtatgggaagaaggtaagtaggaagttgaagtcatctaggaagcacaacaagaaagattcagatgatgatgaggaggaggagtcagactctggaaaaaggaagaagaggggcagatcaaagaggaggaggagtgggaagaagaagggacacagtgattcggaggacgatgatgaagataaggatcgcaggaagaggagaaaggaaaagaggaggaaacgggatgactcatcagacgaggatgaagatcgtaggaggaggagaaaaagtaggaaggagaagaggaggaggagaagtcatagacatgctgacagttctgatgaatc

SEQ ID NO: 4165 - DNA, 590 bp, Artificial
  Synthetic
aagaggtgtgggcgggtaggccacctcactttccagtgtaggaatttcgttagtgttaaggatgataacaaggataaggatccggaggtgattgaggctgccgtgttgtctggattggagagttctgattcggattatgattctgaaatggagagggcaattgctgagaagtatgggaagaaggtaagtaggaagttgaagtcatctaggaagcacaacaagaaagattcagatgatgatgaggaggaggagtcagactctggaaaaaggaagaagaggggcagatcaaagaggaggaggagtgggaagaagaagggacacagtgattcggaggacgatgatgaagataaggatcgcaggaagaggagaaaggaaaagaggaggaaacgggatgactcatcagacgaggatgaagatcgtaggaggaggagaaaaagtaggaaggagaagaggaggaggagaagtcatagacatgctgacagttctgatgaatcaagtgatgattctcctccacggcacaagcgtaggagcaggaggacagcctcagcatctgattctgatgccagcaactctgatgattcacgagttgg

SEQ ID NO: 4166 - DNA, 556 bp, Artificial
  Synthetic
tggtatcaacgcagagtggccattacggccggggatgacctagggttcgttgttttcgtgaatttcttaacgataggttttggggttttattctaattggtgttgagaagttgtggttgacggttgggttcatttgtttggtgtcgaatatcaaatttctggtgctgaagctcgaagaatagcttcaaatttgtggagttgagtgcctgaagttgttgcgtagcatatgcacttgtcgacgcatcaggctgaaatggatagaatacaatcaacacaagaaactgaagatggcagtcaatctgttgatgtgtttgcgtccgtcatgggacctgagcatccaggacgcctaagattgtacggacgtgaggttaccaagacttccataaaaagaaaagtggtagttattggaaccttttcaagttctaccgatgagatgctgcaacaaaaaattgtggaaatggaagaaaggatgcaacaaagaatgctggacagtttcaatgcacaaaaagatgccacggaacaacaatttccatttaacatcatttcacaacatatg

SEQ ID NO: 4167 - DNA, 895 bp, Artificial; identical to SEQ ID NO: 1352
  Synthetic

SEQ ID NO: 4168 - DNA, 66 bp, Artificial
  Synthetic
ttctatcttacatatttagccaaagcatcgttaaaatggcgtacattaagcaagcttttctcttga

SEQ ID NO: 4169 - DNA, 947 bp, Artificial
  Synthetic
tgaccacaaagcacaatgatgatgagcaatatgtctgggaagcccaagctggtggttctttcactgttaccagggatacatctggtgagaaccttggtaggggtacaaaaattaccctctttctcaaggaggatcaacttgaataccttgaagaacgtaggctcaaggacctgattaagaagcactctgagttcatcagctacccaatctctttgtgggttgagaagaccacagaaaaggaaatctctgatgatgaggaggaagaggagaagaaagatgaggaaggtaaggtagaggaggttgacgaagaaaaggagaaggaagaaaagaaaaagaagaaggttaaagaagtttctaatgagtggtcattggtgaacaagcagaagcccatttggatgaggaaacctgacgagatcacgaaggaagagtatgccgctttctataagagcttgaccaatgactgggaggagcatttggctgtgaagcacttctctgtcgagggccaattggaattcaaggccattcttttgttccaaaaagggctccttttgatctcttcgacacaaggaagaagcccaataatatcaagctgtatgtacgtcgtgtgttcattatggacaactgtgaggagttgattcctgaatatttgagctttgtgaagggtattgtggattccgaggaccttcctcttaacatctccagagagatgttgcagcagaacaagatcctgaaggttattcgcaagaatttggtgaagaagtgcgttgagcttttcttcgaaattgctgagaacaaggaagactataacaagttttatgaggccttctcaaagaacctcaagcttggcatccatgaggattcccaaaacaggtctaagtttgctgaactgctgcggtaccattccaccaagagcggtgatgagatgaccagtttgaaggactatgtga

SEQ ID NO: 4170 - DNA, 520 bp, Artificial
  Synthetic
agaaggagaccgagaaggaggtccctgatggggatgctactgaggagaccgtcaccgaggagggtgatgacaagaagcccaaggtcgacgagatcgatgacgaggaggaggagaaggagaagaagcccaagaccaataagatcaaggagaccaccatcgaggaggaggagctcaacaagcagaagcccatctggactcgcaacccccaggacatcacccaggaggagtatgcttccttctacaagtccctctccaacgactgggaggaccacctcggtgtcaagcacttctccgtcgagggtcagctcgagttccgtgccatcctcttcgttcccaagcgcgctccctttgacctgttcgagaccaagaagaccaagaacaacatcgagctctacgtccgccgcgtcttcatcactgatgacgccaccgacctcatccctgagtggctcagcttcgtcaagggtgttgtcgactctgaggatctccctctcaacctgtctcgtgagactctccagcagaa

SEQ ID NO: 4171 - DNA, 581 bp, Artificial
  Synthetic
aagaagaagaaaaagaaaacaatcactgagaagtactgggattgggaattggctaatgaaacaaagcccatatggatgagaaatccaaaggaagttgagaaaactgagtacaatgaattctacaagaaggcattcaatgagtttttggatcctcttgcttacacccactttacaacagagggtgaggtggaattcaggagcgtcctctacattccaggaatggcacctcttagcaatgaggagataatgaaccctaagaccaagaatatccggctgtatgttaagagagtcttcatatcagatgacttcgatggcgagttgttccctagatacttaagctttgtaaagggtgtagtggactcaaatgatcttcctctcaatgtttcccgtgagattcttcaagaaagtcgtattgtcaggatcatgcgcaaaagacttgtcaggaagacatttgatatgattcaggagattgctgacaaagaggacaaggaggactacaaaaaattttgggagagttttggcaaatttgttaaacttggctgcattgaggacacaggaaatcacaaacgcctttctcctct

SEQ ID NO: 4172 - DNA, 630 bp, Artificial
  Synthetic
cccacgcgtccggagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagattctgaaggtgatccgcaagaaccttgtgaagaagtgcgtggagctcttctttgagatcgctgagaacaaggaagactacaacaagtcctacgaggcttcctccaagaat

SEQ ID NO: 4173 - DNA, 688 bp, Artificial
  Synthetic
gaccaaaactgagaagtactgggattgggagttgacaaatgagacaaaacctatatggatgcgtaatccaaaagaagtcgagaaagaacagtaccaggaattctacaagaaaacttttaatgagttcttggatccacttatctttcttttcacttcactacagagggtgaggtggagtttagaagtgtcctgtatatacctggaatggctcctcttaacaatgaagaagtcataaatcccaagactaagaacatacgcttgcatgtgaagcgtgtttttatttctgatgatttcgatggagagttgtttccgaggtacctgagctttgttaaaggagtggtggactcagatgaccttcctcttaacgtttcacgagaaattttgcaagagagccgaatcgttcggataatgagaaagagactagtgagaaaagcatttgacatgattcaggatctctctgaaagtgagaacaaggaggattacaaaaaattctgggagaactttggtaaatttataaagttgggatgtattgaagacactggcaatcacaagcgaataactccactactgagatttttctcttccaaaagcaaagaagagttgataagcttagatgactatattgagaacatgggcgaaaaccagaaggccatttactatttggctactgatagcttacagagtgcta

SEQ ID NO: 4174 - DNA, 917 bp, Artificial
  Synthetic
aggggtacaaaaattaggctcttcctcaaggaggatcagcttgaataccttgaagagcgaaggcttaaggatctagttaaaaagcattctgagttcatcagctacccaatctctctgtgggttgagaagaccatagaaaaggaaatctctgatgatgaggatgaagaggagaagaaagatgaggaaggaaaggtagaggaggttgatgaaaaaaaggagaaggaagaaaagaaaaagaagaagatcaaggaagtatctaatgagtggtcattggtaaataagcagaagcccatatggatgaggaaacccgaggagatcacaaaggaagagtatgctgctttctacaagagcctgactaatgactgggaagaacatttggctgtgaagcacttctctgttgagggtcagctggagttcaaggctgttctttttgttccaaagagagctccttttgacctctttgacaccaagaagaagcccaacaacatcaagctgtatgttcgccgtgtgttcatcatggataactgtgaagagttgattcctgaatatttgagctttgtgaagggtattgtggattctgaggatcttcccctcaacatctccagggagatgttgcagcagaacaagatccttaaagttattcgcaagaacttggtaaagaagtgtattgagctattctttgaaattgctgaaaacaaggaagattatgacaagttctacgaggccttctcaaagaacctcaagcttggtatccatgaggattcacagaacagatctaagtttgcagaactgctgaggtaccactccacaaagagtggtgatgagatgaccagcttgaaggactatgtaacaaggatgaaagaaggccagaatgacatttactacattactggtgagagcaagaaggctgttgagaa

SEQ ID NO: 4175 - DNA, 834 bp, Artificial
  Synthetic
gaattctaagcttggagtaatttaggtgaatcgggtcaggcatgtagcaccactatcacttattcagtttatttctcccatctctgttcttcttcatgtcaacagaatcaagttccagacatccagagattctccccactcacaaaatagaatgctgaagaaaaccagtgagggatgtatgttttccttctgactcatctgcgtcgaatactgctctatcttagtgatttgatccgtctcaggttctcatccctacccaaccagattactaggtcagcaggattcaacagttaggacttcgacacttttggattgtcatcatggatggctctaagatgcaaaataggcatcaaaaattaattatgttacagcgctcagatggaatgacaccctacatgagtatcttggaagatggttgagaatatgatagaatcaaggattttagtgaggaaaagcatgtgttggagtcatttcacatctgaaggtgatgttcagtccaaggttgctctttttgttcctccaaaggctcctcatgatctgtatgggagttactacaatgttaacaagtccaacttgaagttatacgccatacgtgtcttcatctcagatggattcgatgatcttctgccaggtacctgaactttttgattaaccaattttcccccacaagattacttatataggttcattacacatgcattttgtagcgattgtatgtgtaactaagagttacacatgcatattagatgtgtaacggctagttacacatgcgtattagatgtgtaactatcgtttacatatgtcacatgcattgttttgtattcccgggaattc

SEQ ID NO: 4176 - DNA, 657 bp, Artificial
  Synthetic
gggctggtggctctttcactgtcaccagagactcctctgaggttcttgtgacgtggaaccaaaatcactctctacctgaaggaagaccagttggagtatcttgaggagaggagactcaaggaccttgtcaagaagcactcagagttcattagctaccccatctccttgtggacagagaagaccactgagaaggaggtgagcgatgatgaggaagaagaggagaagaaagatgaggaagaggaaggcaagattgaagaagtcgatgaagagaaggaaaaggagaaagagaagaagaagaagaaggtcaaggaggtgtcccatgaatggtcgcttgtgaacaagcagaagcctatttggatgaggaagcctgaagatattgccaaggaggagtatgctgccttttacaagagcttgaccaatgactgtgaagaccatcttgctgtgaaacacttctctgttgagggacagctcgagttcaaggctgttctctttgtccctgggagagccccatttgatctctttgacactcgcaagaagatgaacaacatcaagttgtatgtccgtagggtgtttatcattggataactgcgaagaactcattcctgagtacctaggctttgtaaagggtgttgtagattctgaggatttgcccctcaa

SEQ ID NO: 4177 - DNA, 636 bp, Artificial
  Synthetic
taaatctggaacttcagcctttgttgagaagatgcagacaagtggagacctgaatctgatcggacaatttggtgttgggttttactcggtctatcttgtagctgactatgttgaggtcatcagcaagcataacgatgacaaacaatatgtctgggagtcgaaggctgatggagcatttgccatttctgaagatgtatggaatgaacctcttggtcgtggaactgaaattagattgcaccttagagatgaagcaggagaatacttggacgagtacaaactaaaggacctggtgaagaaatactctgaattcatcaacttccctatacatctttgggctagcaaagaggttgagaaggaggttcctgccgatgaagacgagtcaaatgatgaagaagaaacatctgaatccagcccttctgaagatgaagaagaagatgattctgagaaggcagaagatgagaaaaagcctaaaactaagaaagtgaaggaaaccacttatgagtgggagcttttgaatgatgtgaaagctatatggcttcggaatccaaaggaggtgacagaggaagagtatacgaaattctatcactcactggcaaaggacttcagtgatgagaagccccttgcttggagtcactt

SEQ ID NO: 4178 - DNA, 489 bp, Artificial
  Synthetic
agtggagattgaaaacaagccgaaaacaaagaaagttaacgaaacacagtgggaatgggagttgttgaatgacgtgaaagctatctggcttacaagtccaaaggatgttaccgaggaggagtactcaaagttttatcattcgatctctaaggattacaaccccgacaagccaatgtcatggagtcatttttctgcggaaggagatgttgagttcaaacccgtgttgtttatccctccaagggcaccgcacgatctctacgagaactactacaacagcaaagcgtcgttgaagctttacgtgcgacgagtgtttatatccgacgagttcgacgaacttctgcctaaatacctcaactttttgaagggccttgttgattctgatacgttgccgctgaacgtctctcgagaaatgctgcagcagcatggcagcctgaagaccatcaaaaagaaacttgttcgcaaggctctacacatgattcgcaacattgt

SEQ ID NO: 4179 - DNA, 743 bp, Artificial
  Synthetic
gacaaaacaaaatgttagacttagcatcgaaattttaaagacacatacctcatcgttgcaggatagcgcaggctggattcaaagaaggtgattttacgaaaggcaaagttatatacatccaacagcagaccagagcagtcaaacaaatgtactgggattgattgcttccttgcattaaattctgtaggattgacgcagtttgcacctcattaaaagccagtttaccaagatgatgagctatcttgaaaaagttctttcccctagggaagcaccttcatcaagtggcggtggaatcagtgaagatgggaagctcagctatggatattcaagcttgcgtggaaagagacctttcatggaggatttttatgaagcaaagatctctgaagttgaaggtcaagtagttggattgtttggtgttttcgatgggcatggtgggactcgcactgctgaatatgtgaagaatcatttgtttgacaatctaatccaacatcctcagtttcgaactgatatcaagacagccattgctgagagctacaagcagacagacatggatcacctaaaggaggaagagaaagtgtatagagatagagatgctggctcaactgcatcaacggcagtcctagttggagataaattaactgtggccaatgttggtgactccagagctgtcttatctagagaggggatggctgttgctgttacaacagatcataagcctaatcgagccgatgaacggcaacgta

SEQ ID NO: 4180 - DNA, 656 bp, Artificial
  Synthetic
agagttcccaacaaacaccaagttggccataagtgaaacatatcaacaaacagacatggacttcttagattctgaaaaagataccttccgagatgatggttccactgcttcaacagcagttctagttggtaaccatctctatgttgccaatgttggagattcgcgaactataatatcgaagggcggaaaagcaattgctctttctgaggatcataagcccaatcgaactgatgagaggaagagaattgaaagtgccggaggtgttgtgatgtgggctggtacctggagagttggtggtgtattagcaatgtcacgtgcttttggcaaccgtatgttgaagcaatttgttgtggccgaacctgagattcaggatcaagagattgatgaggaattagaactactcgtgcttgccagcgatgggctttgggatgtggtaccaaatgaggatgctatttcacttgcacaagcagaagaagaaccagaagcagctgctaggaagctaacagagactgcatttactcggggtagtgctgacaatattacctgcatagtggtgaagtttcaccacaagaaggttgaaccagaggggagccagcaaggttgaagaatttgttgatgctgcatctgccttttcctggtggaaggctgcttcaatg

SEQ ID NO: 4181 - DNA, 580 bp, Artificial
  Synthetic
ttatggtacatgttgcttactatagtaggcggctgaggagtgattgaattatatgggtaatttgtgttgcttcaattctctcttctcgcagcttgcaggaggacggtcattatgtagttcgggaaaaggaagaagcaatcaagggcctacaaagtatggtttcagcctggttaaggggaaagctagtcatcccatggaggatttccatgtcgctaagttcgtccagttgcaaggacgtgaactgggactttttgctatttatgatgggcatttgggagatagcgttcctgcctatttacagaagcatttgttttccaatatcttaaacgaggaagattttcggaatgatcctcatagggcaatcttaaaagcatatgagagaacagatcaagctattctttcacacagtcctgatcttggaagaggtggctctactgctgtgactgcaattcttataaatggtcgtaagttatgggtagcaaatgttggagattccagagcagtactttctaggaggggtcaggccatccagctatcaattgatcatgaaccaaacactgagcgaggcgacattgaaaac

SEQ ID NO: 4182 - DNA, 695 bp, Artificial
  Synthetic
atccaaagttcatcagtgatatcaagtccgctatcgctgaaacgtacaaccatacagattcagaatttctgaaagccgaaagtagtcacactagggatgctggctcaactgcctcaacagctattcttgtaggcgatcgcttgctggttgctaatgttggagattctagagcagttgtttgtagaggcggggatgcaattgcagtttcaagggatcacaaacccgaccagtcagatgagagacaaagaattgaggacgctgggggcttcgtgatgtgggctgggacgtggcgtgttggtggtgttcttgctgtttctcgagcatttggtgataagctattgaagcagtatgtagttgctgatccagagatcaaggaggagattgtcgatagctcccttgagttcctcatccttgctagcgatggactttgggatgttgtaagtaacaaggaagctgttgacatggtgaggcctattcaggatcccgaacaggcagcgaagaggcttctccaggaggcgtaccaaaggggtagcgccgataacatcaccgttgttattgtccgctttttggagggaacaacgactggtggtggaccaagtagggaggccgccagcgaccaaaactcatagtttctcccaggcagcagcatggcttgttcctgtctgtcatatctgatgctcaaggtagacgattac

SEQ ID NO: 4183 - DNA, 480 bp, Artificial
  Synthetic
gaaggaacatggcgtgttggtggtgtgcttgctgtttctcgcgcttttggtgacaaactcttaaagcagtatgtagttgtggatcctgagattcgggaggaagttattgatcactctctcgagttcctcattcttgcaagtgatgggctgggggatgtagtaaccaatgaggaggctgtcgacatgaccagatcgattcatgacccaaaagaagctgcaaagaagctcttgcaagaggcctacaagagggagagcagggacaacataacttgtgttgtcgtgcgcttcttgcatgggcaagggagtagtggatatgcttaaaaaacaactggtaaaagttacccaatgtagttgtgtaccaccatgtatacatgttttaattcaaatctcacggggttaaatggggagaaactcggagtaggatacgtgtattctgatggctgaagtaagctgaagggtgagtatgccttaggttaacaa

SEQ ID NO: 4184 - DNA, 667 bp, Artificial
  Synthetic
acgcgtcggatcgattgaatggagcagtagcgggtatgcgataaatcgatcgatccatcgactagttcttgcccttccattgataccatgatcatcagcggcagtggaagcggctcgggcatcccccattctcaagaggaaatgtcgcagccgtcggcgcaactgcgggcgaggccacagcgtggcgagagctccaaatgccggtatggggcagcgatgggggagaacttgctggcccatggattcgaggaccggcactatgcccggatcatccacaggaatgggatggagatatccatgtttggggtgtttgacgggcacaagggacccgaggtggcagattacttgcggcatcatctctttgattccattctggatcatcctctctttgctgccaatcccaagcaggcgatcaccgagtcgtacttggctctagacaagaggatcttggaaatgggaaccgtgatcaggagatctggctccacagccacgacttgcatcctcttggatggatccaggctcatcgtcgcaaacgttggagattcgcgagcggtgctgtgccgcggtggtgaggccgtggtcgtctccgtggatcacgacccgaaaaagccggaagagcgtgaaatggtggagtccaaaggtggcgaagtttgcatgacactcggtg

SEQ ID NO: 4185 - DNA, 673 bp, Artificial
  Synthetic
atgaattttcatgattgattctgagctcaacattagatctgacattttcttggcagctcaattgcaaatcttgaaatgaaagtttggatttttggtgataattaagcaattgcatatcgggtaaaatcaattcagaggagttacagtaatggggtatttgaattcagtattatcatcatcttctaatcaagttcatgctgatgatgcgcctgttagtggtggtggtctaagtcagaatgggaagttcagctatggatacgctagctccccgggaaaaaggtcctccatggaggatttctacgagacaagaattgatggtgtagaaggagaggtagttggtctctttggagtgtttgatggacatgggggtgctcgggccgcagaatatgtgaaacacaatcttttcagcaacctcataaggcatccaaagtttatatcagacaccaaatcagcaatagccgatgcatacagccatacagactctgaatttctgaaatcagaaaacaatcagcacaaagatgctggatcgactgcttccactgccattcttgtaggtgatcggttactggttgcaaatgttggtgattccagagctgttatctgcaggggaggcactgctattgctgtttctcgagaccacaagcctgaccaaacagatgagcgacagcgcatt

SEQ ID NO: 4186 - DNA, 771 bp, Artificial
  Synthetic
gagcgatgtgtctccggcgattgatccgtacaaagaccccggaagagcgcgaggttgtctatgggacatcgtgcgtcaagggcagatcctcgcatcctatggaagatttccttgtcgccgacattaaggaggtgagagaggacgatcaagtacacgatcttgggctgtttgccatctatgacggccatctagggcacaatgtgccggcgtatctccagaagaatctcttcgataacattctcaatgaaccaggattttggaatgatccaaggactgccatccggaaagcgtacgagagaactgacaagactatcttagagaagtcgatggacttggggatcggcggatccacagcagtcacagcaatactggtcgatgcttctcacctcctcgtcgccaacgtcggtgactctcgagctgttctctctcgaggaggagaagcactgcaactctcggttgatcacgagccaggacagccagccgagagacacaacatccaggagaaaggtggatttgtcctcaaacttccaggtgatgtcgctcgagtggatggccaacttgctgtggctcgagcttttggtgacaagaacctcaaggaccatttaagcgccgatccagacattaataaagtttccatcgagcccaaggacgagttcctgatacttgccagcgaaggcctctggaaggtgatgaacaaccaggaagcagtggatcttattcgcaaaattaaagatccacagcacgcgggagaaaaactgacgtcgcaagccg

SEQ ID NO: 4187 - DNA, 723 bp, Artificial
  Synthetic
cccacgcgtccgttcttgtaacaatggcaggcagagagaggctccataagatgaaggttggattatgcggatctgacacaggcagaggtaaaaccaaggtgtggaagaacatcgcacacggttatgactttgtgaaaggcaaagcgggccatccgatggaggactatgttgtgtctgagttcaagaaagtagacggccatgatttgggtttgtttgctatctttgatggtcacttagggcatgatgtagccaagtacttgcaaaccaatctctttgataacatactcaaagagaaggatttttggactgatacgaaaaacgctataaggaatgcatacatatcaaccgatgctgtgatattagagcagtcacttaaacttggcaaaggtggatcaacggctgtaacaggcattctgatagatgggaaaacgctagtgattgctaacgttggagactcacgtgcagtgatgtcaaagaacggtgttgcttctcaactctctgttgatcatgaaccaagcaaggaacaaaaggaaatagaaagccgtggtggctttgtatcaaatattccaggggatgttccaagagttgatggacaactagcggttgctagggcgtttggagataagagcttaaagatacatctgagctcagatccagacataagagacgagaatatcgatcatgagactgagtttatccttttcgcaagtgatggagtttgga

SEQ ID NO: 4188 - DNA, 522 bp, Artificial
  Synthetic
gcgttgtttgcttccccattcttcctcctctcctctttgtggaataagctgtgtggcaaggaaggagaaggaagttggacaagagacgcaatcgttgccgaggttagatcgacgccagtttgatccatttcgccctagacagctcaattttgccagaaagagagattttttgggactatgacagcctgactgaaggggaaagagaagatgaatgggccttggaaggagaattttagtggtggtgggttcagtgaagatggccgattttcgtttggatactgcgggcactgtgggaaaagagcttcaatggaagatttcattgaagccaggatagccaaagttgagggtcaagaagttgccctctttggagtgtttgatggccacggaggaccccgagctggcgaattcgtgaagaagaacctcttccagaacgtgatcagccatccgcaatttacaagcgacatcaagttcgccatttccgacacttacaagcaaacggacgacgactatctaaaagacgag

SEQ ID NO: 4189 - DNA, 632 bp, Artificial
  Synthetic
gaccggatctccaccgccatcaccctcgatgccgttgatacaacataccatcgtcgagatccccaccaccactgcctccacctccgccaccgccagcgagagatgtgcttgagactgcgccatcgggcgcccgcagattctcacgcgggcaaggggaagagcaagcagtcgaagcggaggatccagcatggtttctcctgcgtcaatggtgcaaggccagccaccccatggaagatttctatgttgccgagtaccagatgcataggaaccacgagctgggcttgttcgccatctacgacggccatctcggccacactgttcccgattacttgaagcgcaatctcttcagcaacattctaaaagagccggggttctttacgaacccgacgaatgcgatacggaaggcgtaccaggagacggatcagacaatcctggccaaggcgccggagctgggatcgggagggtcgactgcagtgactgcaattttgatagacggagtaaggttactggtggcgaatataggagactcccgcgccgtgttgagcgagggcggacgggcccggcagctctcggtggatcacgagccgagcaatgcgtcggagcacaagaacatccgggacagaggtggtttc

SEQ ID NO: 4190 - DNA, 644 bp, Artificial
  Synthetic
aaatcgattgagcgagaggagatcggtctcggcgaagcaagcgatcgatcgatcggcggcggcgaggtagggggttcgattgggcagggatttagatcgcgacgggagagtgcgctgggggatgccggttttgggtcagctgttgccaagaaatcatgcggtgcttgacggaagcgttcatcccgagtgattcgcggacgccggtcagcggcagcgggctaagcgaagatgagcgatttagctatggatattcgagcctttgtgggaagaggatgtccatggaggatttctacgatgctagaatctctaagattgatgataatgtggtgggtttgtttggagttttcgatggacatggcgggtctgaggctgctgagtatgtgaaaaagaatcttttcgacaaccttacaaggcaccctcactttgtaagcaacacaaagcttgcaattgaggaggcatataggaaaaccgatgcggattatttacacaatggtcccgatcagtgtggctccacagcttctacagctattttggttggagatagattacttgtggccaacctcggtgattcacgagctgtgctatgcaaggctggcgaagccgttcctttatccaacgatcataagccaaatcgatcggatgag

SEQ ID NO: 4191 - DNA, 651 bp, Artificial
  Synthetic
ttcttcttcctcctccgtcgttcgcgtgcatgcgtgaggtgctcctcctcggctcgttggtggttctcgccttgttgtcgctgttcccgtgctgctcctgtctctcgcagggagcggaggaggaggaggacgacggcgaggtgcgcttgatggggctcgccggagaggccgctggctcgcctggcagtggcggcgggttcagtgcaaatggtaaatttagctatggttatgcgagctctcctggaaaaagatcctccatggaggacttctatgacaccagaattgatggtgtcgatggagagaccgttggactgtttggtgtctttgatggtcatggtggagctcgagcagcagaattcgtcaagcagaacctcttcaccaatttaatcaagcacccaaagttattcagtgataccaagtctgcaattgctgaaacttacactagcacggactctgaacttctgaaagctgaaaccagccacaatcgagatgcagggtcgactgcctccactgcaattctcgtaggcgaccgtctgctcgttgcaaatgttggagattctagggctgtcatttgtagaggaggagatgctatagctgtgtcaagagaccacaagcctgatcagtcagacgagaggcagaggatagaggatg

SEQ ID NO: 4192 - DNA, 594 bp, Artificial
  Synthetic
gacaaagagcttctctctaatggataacgaagttgtccactattcgagtggggctgtaggtggatcgagctctaattgtaggtgcgagcttcagactccgcagtgtgataccgtcgggtcaaccgctgttgtctcggtggttactcctgagaaaattattgtttccaattgcggtgattctcgtgctgtcctttgtagaaatggtgttgcgattcctctttccattgatcataagcctgatcgaccagatgaattgaatcggatacaagaggctggtggtcgtgttatatattgggatggaccaagggtacttggagttttagctatgtcacgtgcaattggtgacaattatttgaaaccatatgttatatcggaaccagaagtgaccatcacagaacgaaccgatgaagacgagtgtttgatattagccagcgatggactatgggatgttgtctcaaacgagaccgcttgcggcattgctcgtatgtgcttgcagtcaaggaggccaccgtctccacagggttcgccggaaaatgacatcagtgtgaccagtgccggagagagctccgaccagttgtgttctgatgcatcaat

SEQ ID NO: 4193 - DNA, 651 bp, Artificial
  Synthetic
gatggattctgggacaatccgttagtggcgatgtcaagggcatatgagcagacggataaggctattttaacacatgctccagatttgggcatgggtggttccactgctgtcactgctattttgatcgattgtacgcatctctttgtggccaatgtgggcgactcgagaggtgttatatgccgaggtggggatgctattcagctcactgttgatcacgagcccaacatggaacgcaaaaccatccaaagaagaggtggtttcgtcactactttcccaggtgatgtgcctagagtggacgggcagctggcagtcgcacgtgcatttggcgataggaacttaaagtgccatttgagtgctgatccggacgtgcaacgtttggtggtggatggaaccgatgagttttttatcctcgcaagtgatggattatggaaggtaatggataatcaagaggcagtggagctgataaggaaggtgagggatccaaaagtagctgccaagcgattggcagatgaagcaattgcaaggcgcagcactgatgacatttcatgcattgttgttcgatttaagtagagaaaaaagagagagagagacttttaaatgggctactattgtccaaacataaatcctattttttgtacatatgtatgtatt

SEQ ID NO: 4194 - DNA, 820 bp, Artificial
  Synthetic
taaccaaaagtgaagcatggctaccgtagaggcagtaaagccctgtgatgatgtacccaaagtagagacctccctccctcctcctcctcctgtcaaagaggaggtaaagccagtagaagctgaaaaagaggcagctcccgaggtttccaagccagtagaagcttccgctgatgtcagaactccaaaggatcgcgatgtggccctagccaaggtgaatacggagaagaagctagctcagatcaaggcttgggaggagaataagaaatctaactccctcaacaaatatcaatgtgaggtttctaaaattgatgcttgggaaaactcaaaaaaggctagtgctgaggcgaagctcaagaaagctgaggaagcgttggagaataagaaggcagcctatgtggaaaggatgaagaatgagattgcagccatccacaagctggcagaggagaaaagggcagctgcagaggccaagaagggtgagaatcttgttcagacagaagaaacagctgccaaatacagggcctcgggtgagataccgaagaagatgatgtgctttggaggttgattcttcatatctctctcacatttaactatggggagggttccttcatatgcaagaatatcacattggggcattatagtcaatgggatatccacagtactagagctattgtttttgatttttcacttagattttgtgtgaatgtatttgggtagactatgatattttgctttgggtatatattcctttccatgaaagacatgattattgcgaaccatcgaatatgctttgttaggtattcaatgaatgattgtatcatgc

SEQ ID NO: 4195 - DNA, 690 bp, Artificial
  Synthetic
aattttcattaatgatggcagaagaaacagctaaggatgttgccgatgataaagccatcgttccatttgctcttccttcttctaaagaagaaaaagacaaatccaatgactcaaaacctcttgccatcgtcgaaactaaagcattagtacctgttgagaaaagaggatctattgatagagatgcaactcttgcacgatttacgacagagaagaggttgtccctaatcaaagcatgggaagaaagcgagaaatcaaaagctgaaaacaaagctcagagaaagcaatctgaaatccttgcatgggagaacagcaagaaagcaagcttggaggctgagctcaaaaagattgaggagcaattgttgaaaaagaaggcagagtacattgagaaaatgaaaaacaagattgctctactccacaagtcagcagaagaaaagagagcgataattgaagctaaacgtggagaagatcttcttatggcagaggaaacagcagcaaaacaccgtgccactgaaacttctccaaagaaacctctccttggatgtttttgaagtggcaaaatatcatatactcctatacaattattggttacaaacattgtatagtgaagtgtgcggactgggaatttctttgcattagaaacaacattgtgagattatgctcctggagataattatctgtcaatttttattg

SEQ ID NO: 4196 - DNA, 735 bp, Artificial
  Synthetic
tttttggattccttctatttatataaataaatatattcgtttaacaatatggcagaagcaattccagtacctcaagaaccagctgttgatagttctccagctgccatggctaccaaagctgatgattctaaagctctcgccactgttcctccaccaaagactgattcttcaacaaagaagagttcaaagggatccctcgatagagacattgctctcgcacaccttgaaacagagagaaggaattcttatattaaggcatgggaagaaagtgaaaaaagcaaggtggaaaacaaggccgaaaagaagctctctgcagttgggacatgggagaacaccaagaaagcaaatcttgaagctaaactgaagaaacttgaggagcaactagaagaaaagaaagcagaatatgcggagaagattaaaaatagagtagccgcagttcacaaggaggctgacgaaaagagagctatggttgaagccagaaagggagaagaacttcttaaagcagatgagatggctgccaagtatcgcgccaccggacaagcccctaagaagttgcttggatgccttggatgctaaagctgtgaaaagtttgtttctcttttgtaaattttcaggcttgttgctctttattgggtgtttcaaacatgtcgagtttcctatttgtgtatgaaaagcactcatgaaaattttaagtgttacgataattataactccacttcagatgtttctactaga

SEQ ID NO: 4197 - DNA, 680 bp, Artificial
  Synthetic
ttcctttttacatacaatacaatagaaagaataaagcactctaattctttttctccttttccttcatttttgagtattgctatagtgaatttgatttcccaattcttttgtggaaatcacctttttgtctatatatatatataattgaccaaaatggaagctacacaacagcaatagccatggccgccaacaattctaaagctgtcaccaccatgccaccacctcaaaggcccagaagaagctctctaaagttgcagcatgggaaaacagcaagaaagcacatcttgaagctaaactgaaaaaacttgaggaaagattagagaatatgcagaaaagatgaaaaatagagcagctttaattcacaaagaggcagaggagaagaaagcgatggttaaagctaaacgaggggaacaaattcttagaacggaggagatggctgctaaatatcgcgccacaggacaaactcctaagaagttacttggatgtgtgggatgattaaagcttttcccttgtatattttcatgcttgctgctttttagtgtgtgttcttttacgcatcaagttttgttgtaagcttctagtctgtaaaggatcttactagtctgcataggacaaactctcttgtgctctaaggaatccagtgtcaatgataataaatccacttgagaagttttcgcaaa

SEQ ID NO: 4198 - DNA, 908 bp, Artificial
  Synthetic
gggcggacgcgtgggcggacgcgtgggaaaagatctttcatctttcatttctgagactctgattctgttccaaatcctagaattcttcttttttctgaattctgtttgtagccatggcagaagtagaagctacgaaagtggagactgagaaagttgtggaccctactccccctgcgcctgaggctcctgcacctgttaaagaagcagaacctgttgttgaaactcctaaagaagtggctgatgagaaagctatagttgcaccagctctgcctccccctgaacaagtcaaagaaaaatctgatgattctaaagcactagttgtcgtagaagataaagcagcagaacctgctgaggagaaaaaggagggatctattgacagagatgctgtgcttgctcgagttgcaacagagaagagactctcactaatcaaagcatgggaggaaagtgagaaatcaaaagccgaaaacaaagctcagaaaaatgtatctgcaattgctgcatgggagaatagtaagaaagcaaacctggaggctgagctcaaaaagatggaggagcagctggagaaaaagaaggcagaatatattgagaaaatgagaaacaaaatcgctctactccacaaggaagctgaagaaaagagagcgatgattgaagctaaacgtggagaagatcttcttaaggcagaggaattggcagcaaaataccgcgccactggaactgctcccaagaaactccttggatgtttttgaagcagcaaacattagacctgcatcgatggtgattgaaaatgcttttgtaaagtttgtgcaattggaatttttttcttcttattagatacattgtgtgattatgtattttagaatcaatcattgtttattattatgtgtgcatagtgatgtattccattgtat

SEQ ID NO: 4199 - DNA, 647 bp, Artificial
  Synthetic
gcagcatggcggaggaacagaagatagcgttagaatcagaatctccggcgaaggttacgactcctgctccagcagatacaccggctccagctccggcagagattccggctccagctccagctccgactccggctgatgtcacgaaagacgttgcagaggagaaaattcaaaacccacctccggagcaaattttcgatgactccaaagcccttactgttgttgagaaacctgtagaagagcctgcaccggcgaaacctgcgtctgcatcgctcgatagagatgttaagctagctgatttgtcaaaggaaaagagattgtctttcgtcagagcgtgggaagaaagcgaaaagagcaaagcagagaacaaagctgagaagaagattgcagatgttcatgcttgggaaaacagcaagaaagcagctgtcgaagcgcaactcaagaaaatcgaggagcaactagagaagaagaaagcagagtatgcagagaggatgaagaataaggttgcagcgattcacaaggaagcagaagagagaagagcaatgattgaagctaagcgtggagaagacgttcttaaagcagaagaaacggctgctaaatacagagccactggaattgttccaaaggcaacttgtggatgtttctaataa

SEQ ID NO: 4200 - DNA, 603 bp, Artificial
  Synthetic
ggtgaatggcccacttttgatcctggctcgccatttatcttccccaatccacatcctcaagagctcggcttttgaagcagaatgacggaacaagcggttcccgcggcgcacgctccagtggacaagaatgtcaccgagacacccagcccgaagtcggtgattggaacgaatgccaacagccccccgtcgccgacagatgcccctgctggagaaacccacgctcatgccgctgctgctcatcctgaggctactcacgcgaagactgtcggaagtcccaccgtcagcaagaattcgctcgggtcctcattgaagaccgatggaggcggatccatggatagagattctgctctcgccaaggtccaaaacgagaggacaatgtctaacgtcaaggcctgggaagagagccgcaaagccaaagcccacaacaggtgcgctgcagtgattgcgaagatcggtgcctgggaggccgcgaagaaggccgcgtccgaagcaaaattgaagcagtcagaggaaaaactcgagaagaaaagagccgcactcgtggagaagatgcacaaccagatagcagccgcacacaagttggccgaggagcgacgagctctg

SEQ ID NO: 4201 - DNA, 1050 bp, Artificial
  Synthetic
ccccggctgttattagtacgcgccaccacgacgcccacgcacatcatccctccgcgcaaaagcctatcaacagctaagccaaacagggtcaggagccggagccgtccgggagagggaacactcgagcgatccgtccgtccgcccgcccgtcgtcgtcgcgcgccatggctgaggaggaggccaagaaggtggaggtggaggtcaccgaggcgccacccgccgctgccgctgccgcggagacggagccggctgccaaggacgtcgccgaggagaaggccgtcatccccgcccccgcgccgccggccgaggaggagaagcctcccgtcgacgactccaaggcgctggccatcgtcgagaaggttgcagatgaacctcctgccgagaaacctgctcaagggggctctaatgacagagatgttgctcttgcaagggtggaaactgagaagaggaactcattgatcaaagcatgggaggaaaatgagaagacaaaagctgagaacaaggcttcgaagaagctatctgctattctttcctgggagaacacaaagaaagcaaacatagaagctcaactgaagaagattgaggagcaactggaaaagaagaaggctgaatatgcagagaagatgaagaacaaagtcgcgatcgtccacaaggaagctgaggagaagagagcaatggtcgaggcaaagcgcggcgaggaagtcctaaaggccgaggagatggcagccaagtaccgtgccaccggccatgctcccaagaaactcatcgggtgctttggggcctaaagaaattttcgattcacaacgagcaaacgtgaaagtgttcatcagtggttgctttgcttctttcaccctcccaagtgcgtagtgtgtttgttggtgcaagaaaggtcgtgcctggtgtgtaaagtctggtgttgctgtatataacatattactcccaagacagatatgtttggtgctgtacatgtttgatgcttgacaggcaacattcttatgtgtagttaagaagccacattgttattgttattgacagtaagctgtttgttcc

SEQ ID NO: 4202 - DNA, 941 bp, Artificial
  Synthetic
cccgaacactcgagcgatccgtccgtccgcccgcccgtcgtcgtcgcgcgccatggctgaggaggaggccaagaaggtggaggtggaggtcaccgaggcgccacccgccgctgccgctgccgcggagacggagccggctgccaaggacgtcgccgaggagaaggccgtcatccccgcccccgcgccgccggccgaggaggagaagcctcccgtcgacgactccaaggcgctggccatcgtcgagaaggttgcagatgaacctcctgccgagaaacctgctcaagggggctctaatgacagagatgttgctcttgcaagggtggaaactgagaagaggaactcattgatcaaagcatgggaggaaaatgagaagacaaaagctgagaacaaggcttcgaagaagctatctgctattctttcctgggagaacacaaagaaagcaaacatagaagctcaactgaagaagattgaggagcaactggaaaagaagaaggctgaatatgcagagaagatgaagaacaaagtcgcgatcgtccacaaggaagctgaggagaagagagcaatggtcgaggcaaagcgcggcgaggaagtcctaaaggccgaggagatggcagccaagtaccgtgccaccggccatgctcccaagaaactcatcgggtgctttggggcctaaagaaattttcgattcacaacgagcaaacgtgaaagtgttcatcagtggttgctttgcttctttcaccctcccaagtgcgtagtgtgtttgttggtgcaagaaaggtcgtgcctggtgtgtaaagtctggtgttgctgtatataacatattactcccaagacagatatgtttggtgctgtacatgtttgatgcttgacaggcaacattcttatgtgtagttaagaagccacattgttattgttattgacagtaagctgtttgttctttt

SEQ ID NO: 4203 - DNA, 501 bp, Artificial
  Synthetic
cccgagttcgtgtgcttctctcatttgttccttgatatatgggctacgtcgtcagagaactcgtgcagatagcttctttggctgagttgttggagatggcggaggtggcgccgccggcgccggcgccggagccgaccaaggacatcgccgaggagagggccgccgtgccggcgccggaggagtcgaaggccatgaccgtcgtcgatgatgctgagaaagctgcagcaacaggtggctcacacgaaagagacgctctcctgacgacggtcgccacggagaagaggatatcgctgatcaaggcgtgggaggagaacgaaaaggccaaggccgacaacaaggcggccaagaagttggccgacatcgcctcatgggagaactccaaggtggccgagatcgaggccgagattaagaagtaccaagagtacctggagaggaagaaggcagagcaggtggagaagctgatgaacggcgtggcgaaggtgcacagggcggcggaggaaa

SEQ ID NO: 4204 - DNA, 982 bp, Artificial
  Synthetic
gctgtttgttttggcgataccatttgcatggcttgcccagcatcgtcgtcgtcgtcgtcgggagcaaggaggaggagagaccatcgatcttgattgatttgaagctagatggcggaggaggcgaagaaggtggaggtgaccaaggacatcgccgaagagaaggcagtggtgccgctgccgacgccgccggccaccgagcacgacgactccaaggccatcgtcctcgtcaaggaagctgaggctacaggaggttcagctgaaagagatgcttatctcgcaaaaattgtgtcggagaagagattggtactgatcaatgcctgggaggaaagcgagaaagctagagcagagaacagggcggccaagaagctgtcatacatcacttcatgggagaatgcaaagaaagcagagatggaggctgagctgaaaaggatcgagcaagaactggagaagaagaaggcggcgtacgaagagaagctgaagaacaagctggcattgctgcacaagacggcggaggagaagagggcgctcaccacggcgaagcgtggcgaggagctgatcatggcggaggagatggccgccaagtaccgtgcaaagggcgaggctccgacgaagctgttcgggctcttgaaagcctgagagaaatcatgaggagttcatcatacatatatgctgggatttggtgttgttgattagtctgtgaacttacagaaatttgtatatgtgcaatgcatggcatccgtgtttgcgtcgtgtgtatgtcgtctaattgaagggccatttggtttgtattttgtcagttgggtggtttgatttctggtgcgttttgtaaaggaattgtgtatatgcataggggagtgcaggcaggggatgatggattatgaatacgcttattctttcatgaagatttgttagtaattaaacattcgttaattgttgtatttttttcaaaataactgcttaggttgctcctttttctctgttg

SEQ ID NO: 4205 - DNA, 612 bp, Artificial
  Synthetic
tgatatatttgctacgtcgtcggagaactcgtgcagatagcttctttggctgagttgttggagatggcggaggtggcgccgccggcgccggcgccggagccgaccaaggacatcgctgaggagagggccgccgtgccggcgccggaggagtcgaaggccatgaccgtcgtcgatgatgctgagaaagctgcagcaacaggtggctcacacgaaagagacgctctcctgacgacggtcgccacggagaagaggatatcgctgatcaaggcgtgggaggagaacgaaaaggccaaggccgacaacaaggcggccaagaagttggccgacatcgcctcatgggagaactccaaggtggccgagatcgaggccgagattaagaagtaccaagagtacctggagaggaagaaggcagagcaggtggagaagctgatgaacggcgtggcgaaggtgcacagggcggcggaggagaagcgagcggcgacggaggcgcggcgaggggaggaggtggtgaaggccgaggaggccgcagcaaagtaccgcgccaagggagagccgcccaagaagttgctcttcggttgaatctcttctcggtcatctccattgatcgtcgtc

SEQ ID NO: 4206 - DNA, 1007 bp, Artificial
  Synthetic
agcaaagctggctgttgggtccaacggagcagaagaagaagaagtatgtggatcttggttgtattattgtgagtcggaagattttcaagtggactgtgggctgtattcttgccgctgcgcttttagctggattcattactatgattgttaagcttgcacctagacacaaacaccacaaccccccacctgataattataccgtcgctctccataaagccctcatgttcttcaatgcccagaaatctggaaaattgccgaagcacaacaatgtgtcatggagggggaattcatgtttaaaagatggccagtcagatgattcaactatgttcaaaaatttggttgggggatattatgatgcaggagatgcaatcaagtttaatttccctcagtcgtttgctctcaccatgttaagttggagtgtgatcgagtatagtgcaaaatatgaagctgctggtgagctcgctcatgttaaagatattattaagtggggtactgattatctcctgaagaccttcaattcctctgctgataccatagaccgcattgctgcacaggttggaaaaggggatacttccggagggagtactgatcacaatgatcactattgttgggtgcgtccagaagatattgattacgatcggcccgtgactgaatgtcacggctgctcggaccttgctgcagagatggctgctgctctggcttctgcctccattgtttttaaggacaataaggcttactcacaaaaacttgcacatggtgctaaaactctcttcaaattttctagagaccagcgtggtagatacagtatcggcaatgaagctgaaaccttctacaattctaccggttactgggatgagtttatatggggtgcagcctggctgtactatgctactggaaattcttcatatcttcagcttgctaccactcctggtcttgccaaacatgctggtgctttttggggaggccctgattatggtgtgctcagctgggataacaagctcactgga

SEQ ID NO: 4207 - DNA, 594 bp, Artificial
  Synthetic
actttcctggatctccttacaattttgagctgaaatatatatacactagtttcttttagctcaagaaatcagaaccagcaacatgtacgggagggatccatggggaggggcactggagataaacgcaacagattcagctacagatgatgataggagcaggaacttactggattttgacaaggcggctttgtcaaggaatctggatgagacacaacagagttggttgttgggtccaactgagcagaagaagaagaagtatgtcgatcttggttgtattattgtcagtcgaaaggtattcaaatggactctcggctgcattgttgctgctgctctcattgctggacttgttacgctgattgtcaagactgttcctaagcaccgacaccgtagtcccccaccggataattacactttggctcttcgcaaagcccttatgttcttcaatgcccaacgctctgggaaactacctaagcacaacaatgtatcatggagggggagttcaggtatgcaagacggcaaatctgatgattcaaccatgtttaagaatttggttggtggctattatgatgcaggagatgcaataaagtttaagac

SEQ ID NO: 4208 - DNA, 439 bp, Artificial; identical to SEQ ID NO: 1561
  Synthetic

SEQ ID NO: 4209 - DNA, 271 bp, Artificial
  Synthetic
gctgttgaaacagcgaccaaacaggttgaaacatctaaggaagtcaaggaggagaagaaaggaggagcacaggatctcaagtcaacccttttgatttcaggggctgtagtagctgtggttggagcacttgttgctattcttaagaaggtgaaagagtcagctaattgaatgtagatcctttgtatctttaacttcatgttctacattttttgtaagacgagcctaaactcttgaagggaaataaataaatttcataatgttctacttgtat

SEQ ID NO: 4210 - DNA, 652 bp, Artificial; identical to SEQ ID NO: 1598
  Synthetic

SEQ ID NO: 4211 - DNA, 611 bp, Artificial
  Synthetic
gccattacggccgggggcagaaagaacaagctaagggctagttacttaagcaaatcaagaaaatatgagatccatgcagtattgggaaccaacgtctgacgatgaattcgtcgatcatattaaaagaatggagaaagccccaaccatgcaccctgatattcctctctatccaaatgtctattctgttttcaaaaacaaagcaagctatgatcaaccacaaaaatctagcttgaatcatcagaaggacccgtccgcagaatccctgaagaaggttcagtttgctgaattcaacaagaatgaagagaagaacatcaatactcaggctgaggcatatatcaaccagaagcacaagaattttgagctacacaaatggaggaccttcaaagtatcatgttaaatggtttcaatcttgttggctgcaggcagctgtctggcactggtgctcttcaataacctacgtaatatgttactctgcgtttgtatcccacaaaaataaggggaatttttttttcaagatatcgttcatgtttatcttatatttcctatagagagtagtacatttgcactgtgatttgttctatctaataaaatgttgtctgtttacttttctg

SEQ ID NO: 4212 - DNA, 573 bp, Artificial
  Synthetic
gccattacggccggggcagagatcgggaagaaaagatgcgtagaatggtagagtatggttggcaaaacacgtcgtcgaatgagtatcttgatcatattaaacgaatggagagatcgccaacgatgcaccctgatcttcctctctacccaaatgtccactccctcttcaaaaatggaatagtgagcaacggacaagaaaagaaatgcactacactaacaccacagtcgcagaagaaagttcatttcgtggaacctaaagctgaacttaccaagaatgaaaagaagagtattgacatggaggctgatggctatataaagcagaagcacgtcaactttgagctccacaaatggagaaccttcaaagcttgttaaaaagtttccaacgtacttcatacaagatatactacatgatatcttagtataaataacatgtaatatatgtctgtcttattagcttctgtttgtactctaaagggaaagatatctcttatatgcgctgtgactatatatttcgtagatgtggtgttttgatttcaatttatctaataataaagctataagtatgtttattacg

SEQ ID NO: 4213 - DNA, 547 bp, Artificial
  Synthetic
taggaagtggaggcactgtttctggtgttggacagtatctgaaatccaaaaatcctaatgtcaaaatatatggaattgagccaacagaaagcaatgtattgaatggtggaaaaccaggtcctcaccacataactggtaatggagttggattcaagcctgatatcctagacatggatataatggaagaagttctgatggtttcaagtgaagaagcagtaaatatggctagggaactggcattaaaagaagggcttatggtcgggatatcatcaggagctaatacagtagcagcgcttagactcgccaacaaaccagaaaacagaggcaaactcattgtgactatacatccaagttttggagagaggtacttgtcatctgtcctgtatcaagagcttaggaaagaggcagagaacatgcaacctgttccagttgattaatgtccttttacagtaatatatattagtagtcaaactggtacaagcaaatatatgtactacctggaaacattcacaagcaaaaagtcataatggaaatttagttttttctg

SEQ ID NO: 4214 - DNA, 716 bp, Artificial
  Synthetic
gaattcaaagggtgttggtcgattaagacagcgggacggtggtcatgggagtcgaaatccgctaaggagtgtgtaacaacccacctgccgaatcaactagccccgaaaatggatggcgctgaagcgcgcgacccacacccggccgtcggggcaatcgttaggccccgatgagtaggagggcgcggcggtggctgcgaaacctaggccgtgaggccgggcggagcctccgtcggtgcagatcttggtggtagtagcaaatattcaaatgaaatcaagcttattgccgttgaaccagttgaaagtgctgttctatctggaggaaagcctggtccacacaagatccagggaatcggtgctggttttattcctggtgtactggaagttaatctcattgatgatgttgttcaagtgtcaagtgaggaagctattgaaactgcaaagcttcttgcggtgaaagaagggctatttgttgggatttcatctggagctgccgctgctgctgccatcaaggttgcaaagaggccagaatatgcagggaaactcattgttgtgattttccctagctttggagagcgatatctctcctctgttctgtttgaatcagtgagacgggaggcagaaaacatggttttcgagacatgataagttgcaatgccgaccagcagcgacagattgaaagagcaagagagtgcaactataccattatcttctatgct

SEQ ID NO: 4215 - DNA, 1052 bp, Artificial
  Synthetic
gcctgatcaaacctggcgagagtgtcctcattgaacctacaagtggaaacactggagtaggattggcatttatggctgctgctaaaggctacaaactcatcattacgatgccttcttcaatgagtcttgagaggagaattattttgcgtgcttttggtgctgagttggtgcttaccgatccagcaaaagggatgaaaggttctattcagaaggctgaagagattaaggccaaaacacctaactcctttattcttcagcaatttgaaaaccctgcaaacccaaaggtacactatgagacaactggtcctgagatctggaaaggctcaaacgggaaagtagatgctctcgtctctggaattggaacaggaggcacaataacaggttcaggcaagtatttaagagagcagaaccccgacataaagctctatggtgtggaaccagttgaaagtcctattctttctggaggaaatcctggtccgcataagattcaggggattggtgctggtttcattcctggtgttttggaagttggtcttattgatgaagtaattcaagtttcaagtgaagaagccatagaaaccgccaagcttctggcattgaaggaaggtttgcttgtgggcatatcatctggtgcttctgctgctgcagcaatcaaacttgctaagcgccctgaaaatgctgggaagctcattgttgttgttttcccaagcttcggggagcgatatctttcctctgtgctctttgaatctgttagacgggaagcagagaacatgaccgtggagccttgaacattttgtccttcgattagcataccatagtctcaagaggattttccaatcaaagcagaatgttcttgtctgaacctttcccttcctgtttgatcaaactgctaaaaataaggccttttcttttctttagtggcctttcaagtatatcttagtgcttttataattttactgtttctacaacacttgtgacagtggacttgtaacaggaatttcaagagctgttgctgcttgttcgtcaaagttcctctaagccttttattttct

SEQ ID NO: 4216 - DNA, 626 bp, Artificial
  Synthetic
gccattacggccggggcttcaacagttttctaatcctgcggacactcagattcattttgagacgactggtccagagatatgggaagaaacacagggtaatgtcgacatatttgtcatgggaatcggaagtggaggtactgtgtctggtgttggacaatatctgaaatccaaaaatcctaatgtcaagatatatggagttgagccaactgaaagcaacgtactgaatggtggaaaaccaggtcctcatcacataacagggaacggggttggattcaagccagatattcttgacatggatataatggaggaagtgctgatggtttctagtgaagacgccgtaaacatggctagggagttggcagtcaaggaagggctcatggttggaatatcatcgggagctaatacagtagcagctcttcaacttgctcaaaaaccagaaaacaaaggcaaactcatagtgactatacatgcaagttttggagagaggtacctgtcatcggttctgtatcaagatctgaggaaagaggccgagaatatgcaacctgtttcagttgattgatgttgcaattttacttatgaattatatagttgaaggctctgcagaaaaatgtattattttcctaaat

SEQ ID NO: 4217 - DNA, 601 bp, Artificial
  Synthetic
gagattttaaataagacacctgatgcctatatgctggaggagtttgacaaccctgccaacccaaaggtacattatgagactactgggccagaaatctgggaggattctaaagggaaggtggatgtattcattggtggaattggaacaggtggaacaatatctggtgctggccgtttcctgaaagagaaaaatcctggaattaaggttattggtattgagccttctgagagtaacatactctctggtggaaaacctggcccacataagattcaaggcattggggcaggatttgttccaaggaacttggatagtgaagttctcgatgaagtgattgagatatctagtgatgaggctgttgagacagcaaagcaattggctcttcaggaaggattactggttggaatttcatctggggcagcagcagcagctgccattaaagttgcaaaaagaccagaaaatgctggaaagttggtagtggttgtgtttccaagctttggtgagaggtacctttcatctatcctttttcagtcgataagagaagaatgtgagaagttgcaacctgaaccatgagcctaacttcagtgttcacaacatcataatt

SEQ ID NO: 4218 - DNA, 663 bp, Artificial
  Synthetic
gttcttttgaaagcttttggagctgaacttgttttaactgacccagccaaagggatgaaaggagctgtttcaaaggctgaagaaatattgaataacacaccagatgcctatatccttcaacaatttgacaatcgccgcaaaccccaagatacactatgaaacaacgggcccagagatctgggaagatacaaaaggcaagatagacatacttgttgcaggcattggaactggcggaaccatttcaggagcagggcgattcctgaaagagcaaaatccaaacattaagattattggtgtggagcccacagaaagtaatgtactatcagggggaaagcctggccctcacaaaattcaagggattggagcaggttttattccatggaacttacatcaagatgtcatggatgaagtgatagagatatcaagtgacgaagctgttgaaactgcgaagcaattatcgctacaagaagggttattggttggaatttcttccggagctgctgctcttgctgccattcaggttgggaagagacgtgagaatgaaggaaagcttattgcggttgtatttccaagctttggggaacgatacctctccactatacttttccagtctatacgggaggaatgcgagaaaatgcaaccagaatcgtgaatatcttcctt

SEQ ID NO: 4219 - DNA, 365 bp, Artificial
  Synthetic
gcagaaacgtctattttaagaaaaacaatttgcaataaatcaaagaagaggttccttgttggtcacgaaattacagaagaaaatcaaagctcgggctgcatttgctcgcactcttctcgaatcgactggaaaagctgggtcgagaggtaacgttccccgaagctcgggaacacaacggctatgagtttcccggcattttcaggtctctttgcaacctggattgcagcagcagcagcagctccagaagatataccaaccaacaagccttcctggagagctagttgcttcgaggtttcaatagcttcctcactggaaatcgctatgtattcatctacaatagccagatccaaattcttgggtacaaa

SEQ ID NO: 4220 - DNA, 646 bp, Artificial; identical to SEQ ID NO: 1775
  Synthetic

SEQ ID NO: 4221 - DNA, 1215 bp, Artificial
  Synthetic
gtttagccatttacacagttcacaacacactgatgaatacaccattgaaactctccccataaaatataaaattccaccaaaagaaaaattcctttttatattcagaatctagacaaaacatatagatacacataattctgtatctatacccttttgcttcaagaaactccatagccataaacaataaaagtatcaatttttcttcttctctttcttcaatcatcactcgtttcttgttccaatccattcaatctgtcattttcatacaatttttctaaatacccttttcaagaaatcttcctttaaaaatggcttcaataacacccttatctcaatcacaacccctttatgaaaaaacccaatttacactactaaaaacacctcaaaatcagttttgctcaatacccttttcaagattcactcaaagttcaaaactttcattgaaaaaatcaagaatggttgttgtttcagctacaactgctgctgagaaatccaataaaaggtatcctggtgaagctaaagggtttgttgaggagatgagatttgtggctatgaaattgcatactaaggatcaatctaaggaaggtgaaaaagaacctgaaggtcagcctatggctaaatgggaacctagtgttgaagggtatttgaagtttttggtggatagtaaattggtttatgatactttggaaaagattatggaaaaggctcctttttctgagtatgctgagttcaggaacacgggattagaaaggtcagaggccttagcaaaagatttggaatggtttaggctgcaaggttatgccatcccagaaccatcagctcctggtctcaactatgctcgttacctagaggagctatcagaaaaggatcctcaagcatttatttgccacttttacaacacatactttgcgcattcagctggtggtcgcatgatagggagaaaggtggctgaaaagatactcaataagaaagagctggaattctacaaatgggacggtgacctttctcagctgctgcagaatgttagagagaagctgaataaagttgcagaaaattggactagagaggagaagaatcattgtttggaagagacggagaagtcattcaagttctcaggggaaatcctccgattaatattgtcttgatgcgcggctttgcatttgtacgttggatggcctaaagctcaaattactgtgaatagtcgtgttcattttc

SEQ ID NO: 4222 - DNA, 647 bp, Artificial
  Synthetic
gcagatactttacaatttcgcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgactttgccggtgtggtccgggacgacgtgaccctgttcatcagcgcggtccgggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgatatcgcggccg

SEQ ID NO: 4223 - DNA, 663 bp, Artificial
  Synthetic
gctgcagatatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggcgaaattgtaaagatatcgcggccgcttaattatgac

SEQ ID NO: 4224 - DNA, 518 bp, Artificial
  Synthetic
acccaactactaacaggcagctgccagccatggcttcctccccgccgtttcgtctacctctcgccgttgtgctcctactcgcaataatatgtgtccttttggcttctcctagctgccatgcggacgatctccccgccaccatgacaaacgagcacgagaaagagcatcagctgatgatgatgatgatggacaggttccataggtggatggcgacgcacaaccggtcgtacgcctccgccgacgagaagctgcggcgattcgaggtataccggagcaacatggagttcatcgaggcgaccaaccggaacgggagcctcaccttcaagctcggtgaaacgccgtgcaccgacctcacccacgaggagttcctcgcgacctacaccggcgacgtacgccttccgccggagcggcgggggatgcaagacgactccgacgaggaggatgcagtgattacaaccagtgctgggtacgtcgccggcgccggcgccggtaggcgtacggctggggtgccggagtcc

SEQ ID NO: 4225 - DNA, 666 bp, Artificial
  Synthetic
tggtatcaacgcagagtggccattacggccggggcttccattcaccaaaaagcctcgtttcctccgtagacaccctcagccttctctctcttctagccttttgtcttgaagagacaaaatcaagccaattttgatctttgtttcatctttgctctacagtctttcttttttgtttgttgaataatggggggctgaaactaaggtgtttactttggctgaggtctcccagcacaacaacgccaaggattgttggttggttattagtggcaaggtatatgatgtgacaaaattcttggatgaccacccaggaggtgatgaggttttgttgtctgcaactggaaaggatgcaacagatgattttgaggacgttggccacagcagcagtgctcgagcgatgttggatgagtattacgtaggtgatattgattcagcgaccatccccaccaagaccaagtacactcctcccaatcagccacattacaaccaggacaaaacatcagagtttgtcgtcaagctcctccaattcttagttcccctgattattttgggtgttgcttttggcatccgcttctatatcaaacagtcatcagcttgaagatggagttcgtggtgaagtcataagaagtgtccagaagaaaggttgtgtgtgtgtgtgtgggggggggg

SEQ ID NO: 4226 - DNA, 767 bp, Artificial; identical to SEQ ID NO: 2282
  Synthetic

SEQ ID NO: 4227 - DNA, 506 bp, Artificial; identical to SEQ ID NO: 2283
  Synthetic

SEQ ID NO: 4228 - DNA, 363 bp, Artificial; identical to SEQ ID NO: 2292
  Synthetic

SEQ ID NO: 4229 - DNA, 369 bp, Artificial; identical to SEQ ID NO: 2293
  Synthetic

SEQ ID NO: 4230 - DNA, 674 bp, Artificial
  Synthetic
gtttccctctctttttattgaacccaacaactttctgccactccactcacctcgtttcctcctctaaaatcataatctaatttatctttcagttttatttttcttagaaaaattgtgtaataaatgggtggtcaatctaaggtctacactttagctgaggtttctaatcacaacaatgtcaaagattgttggcttattatcagtggcaaggtgtataatgtgacgaagttcttggaagatcacccaggtggggatgaggttttattgtccgcaacaggaaaggatgctactgatgattttgaggatgttggtcacagcactagtgctcgagcaatgttgaacgagtattatgtaggtgatattgattcttccaccataccaacaaaggtcaagtacactcctccaaagcaacctcattacaaccaggacaaaacaccagagttcatcgtcaagctcctccaattcttggttcctctgattattctaggtgtggcttttggcgttcgcttctacactaaacagtcagcttgaagattgattatggtgatctcataataaggatccaaattagcgcaacgttagaagaacaaaaaaaagaaaagaaaaagaaaagaaaaagagcttttactttgttaaccaggcaaattatcttgtttaagttctattctgggacc

SEQ ID NO: 4231 - DNA, 482 bp, Artificial; identical to SEQ ID NO: 2290
  Synthetic

SEQ ID NO: 4232 - DNA, 697 bp, Artificial
  Synthetic
cggacgcgtgggttgtttcagtggctcagaaattttcttcttttcgtattattgttttcctttatttaaggaaggagttgggctctctctctaagtctgaatccccacgagacgagaaacctagcaaaaatctcgtctttcgccgctctctccctcctctgattcctgctgttcttgatcttggatctcaattcccaaccaagaacacacagacagagaaaggaaggagaagaagatgtcgaacgacaacaagaaggtgtataccctggaggaggtcgccaagcacaactccaaggacgactgctggctcatcatcggcggaaaggtatacaatgtgtcgaaattccttgaggaccatccaggaggtgatgatgtcttgctatcttcaactggcaaggacgcgactgacgattttgaggatgtcgggcacagcacgactgctcgtgcgatgatggatgagtattacgttggcgacatcgacacatccacaatacccgcgaggacgaagtacgttcccccaaagcaaccacactacaaccaggacaagaccccggagttcatcatcaagatcctccagttcttggttcccctcgccatattgggcctggctgttgcaattaggatctacaccaagtcggagtccgctgcggccgcttatccgtatgatgttccggattatgccgagctctacaaacag

SEQ ID NO: 4233 - DNA, 674 bp, Artificial; identical to SEQ ID NO: 2285
  Synthetic

SEQ ID NO: 4234 - DNA, 631 bp, Artificial
  Synthetic
agatcgcgtgactcccccacactccgctccgctccccccgcggccacgcgctcctcgtcggcttccgcttcctcccaccacctcgcagcgttgcagggcgtgggcgtgggcggcggacatggccggcgagaagaaggtgttcgggttcgaggaggtggccggccacaacgtcaccaaggattgctggctcatcatcgccgggaaggtatatgatgttacttcttttatggatgagcaccctggtggcgatgaagtgttgctagcagtaactggcaaagacgcaaccaatgattttgaagacattggccacagtgaatcagcaagggagatgatggagaagtatctcattggggagattgatgcttcaaccatcccagtaaagcgtactcatgtcactccccagcaagcgcccggcaacccagacaagggcgatgacatgctcattaagatcttgcagtttcttgtccccatcttgatcttggggcttgcatttgctatccggcagtacaccaaatctgagtagatctgttattacaatgttgataatcaatatggtccatgaagctatattaggtgaaatgatttggatcaaaagaactaaataatgatatttgttgaggggaacggtatg

SEQ ID NO: 4235 - DNA, 692 bp, Artificial
  Synthetic
cctttcttctcttcactcttcaattcttgtgttagtagtcttgacacccaattcaagattcattacatctttcatttctccattccaattgaggagtaatttttttgctgtgtccataaatgggtggtgaaactaaggtttatacgttggctgaagttgcccctcacaacaataacaaagattgttggcttgttattagtggcaaggtgtacgatgtgacaaaattcttggacgaccacccaggtggcgatgaggttttgttggctgctacgggaaaggatgcaactgatgattttgaggatgtcggccacagcaccagtgctcgagcaatgttggatgagtattacgtaggcaatattgattcagcaaccatccctacaaaaaccaagtacactcctcctaatcagcctcattacaaccaggacaaaacatccgagtttgtaattaagctcctccagttcttagttcccctgataatattgggtgtagctgttggcatccgcttctacaccaaacaacaatcagcttgaagattgagtacgcgatgaattcataataagtgtccacatttccgaaatgtgacccttacccacccccaaagaaaaccccccaccaaagataagctagagaagaaaaaaaaaatgctttttatttttctatttctgtgacttcatagttacactgttcgtgtt

SEQ ID NO: 4236 - DNA, 633 bp, Artificial
  Synthetic
gcacgaacggagagagaaagagaatccgaagaaactctgtttctctctcttgtagcaggaaaagatggcatcagatgggaaacttcatggatttgaggaggttgccaaacacaacaagaccaaagattgctggcttattatcagcggaaaggtgtatgatataactccatttatggatgatcatcctggtggtgatgaagttttgctttcagcaactgggaaagatgcaaccaatgactttgaagatgttggccacagtgattctgctagagagatgatggataagtattacattggggatatcgatgtgtcaacagttcccctaaaacgttcttatgttccaccgcaacaagccccatacaatccagacaagactccagaattcattatcaaaattctacagttccttgtacccctcttgatcttgggcttggcctttgcagtacgacactacaccaaggagaagtaaattcttctggattccagtttgcatcagtccacttattcttgatttatgtagttgtttaacgaacacttggtttatcttgttttagttcattatcgagctacaacaactgaatgtgatcatcaattttgtgctgtcctttgcaactgctttgtctggtaaaaaaa

SEQ ID NO: 4237 - DNA, 646 bp, Artificial
  Synthetic
agcgtggggctgttggcagcgggcgaaagttcagaggcaagctgagtttctgttttgcaacctgattgtatccggtgatcggcgacgatgagcaaagttcatgcttttaatgaggtggcggagcataacaagaaagaggattgctggcttatcatctttggaaaggtttataatgtaacctcatttctggatgatcatcctggaggtgatgatgtcttgctgactgcaacagggaaggatgcaacagatgattttgaagatgttggtcacagtgatgatgcaagagagatgatgaagaaatactacgttggtgagattgacagttctacccttcctgttaagcacaaatatactccgcctgtaactccaccaccccctggaaaccttggttctggaaatttatctaagatattgcaattcttgttaccattgttgatattgggcgtagcgcttgccttgcgttccttttatcagaaagagtagatcaactgtcatatttcaagctgcaatggcttatggaatacaatacaactttctcataagctgcttgccattttcatatgttgtgttttagtcttacggattagtatcctttattcagcttatgtgtatttgctaccctttgttggatgttctactgggatgc

SEQ ID NO: 4238 - DNA, 698 bp, Artificial
  Synthetic
gcgagacttcacatgtacgactggataatacttctactccttgctgttatagatggactgttgaacataattgaaccttttcaccgtttcgtcgggagggacatgatgactgacttgagatatccattgaagggcaatactgttcccttctgggctgttccgctcattggaattgtattgccttgtgccatctttggtggaatttacttcaaaaagaagaatttctatgatttgcaccatggcatactggggatcctatactctgtgcttataactgcggtaatcacagatgcaattaaggatggtgtgggtcgtccacgcccagattttttctggcgctgtttcccagatggaaaggatgtttatgataatgtcactactggtgtcatatgccatggagagaagagtgtcatcaaagaaggtcacaagagctttccaagcgggcactcttcatggtcttttgctggtctaggcttccttgcatggtacttagctgggaagatcacagtttttgatcgtagaggtcatgttgcaaagctatgcatagtatttctgcctcttcttactgctgcacttgtggctgtttctcgagtggatgactactggcatcactggcaggatgtatttgcaggctctctgataggtcttacagtcgcatcattttgttatctgcaattcttcccatatccttatgacgc

SEQ ID NO: 4239 - DNA, 668 bp, Artificial
  Synthetic
gaattccagctgaccaccatggcttctagagtggacgaaactacagtcccctcatactactattacgtggatccggaaactacatatacgtaccaacaaccaaatcctctacaggacttgatatcggtgtatggcttggatgacatctccaggcaagtggcaagaacaaatttggacggcactaaagccgtgaagctaagaaaatcttacaagaaccagatagcagatctttcaggtaaattctccaccataccgaccagagaaaatggtaaaggtggtcaaatagcacatattcttttccaaaataacccagacatgatgatacaaccacctcagcagggtcaaaacatgtcagagcaacaatggcgcgaacagctgcgcaatagagacatagcattgtttcagcctccaaatttcgattgggacctttgctcttcggtactatcgcagtttgaaaggtcatatccaagcgagttcgcaaaccagaaccaagggggagcccaagcgccgtttgatatagacgacttggcgtttgatctagacggtacaggaaaaagccaatccggctcaaattcaggtaacaatagtaagaaaaggaagaacaaatctagtggaagttcgatggctacaccaacacatagtgacagtcatgaggatatgaaaagaag

SEQ ID NO: 4240 - DNA, 632 bp, Artificial
  Synthetic
gaattccagctgaccaccatgaactgtatcactattgacgttttttttactgctttttcccatccctgcaagcgaaaaaaaaagcaagctgactcttgtataaactgcaaggactcattgattaaaagtagatttacattacagactaaaggaaaaggcaaactataccggctataccacattcgttcaaaaatgccctctaccacgctactgtttccgcagaaacatattagggccattccaggcaagatatacgcgttcttcagagagctcgtcagcggagttattatatccaagccagatctaagtcatcattattcttgtgaaaatgcgacaaaggaggaaggcaaagatgcagcagatgaagaaaagactaccacaagtttgtttcccgaatcaaataatatagaccgttctttaaatggtggctgctctgtgatcccttgctccatggatgtcagcgatttgaacacgccaatatcgatcacactatctcctgagaatcgtatcaaatcagaagtaaatgccaagtcactgctcggatcaaggccagaacaagatacaggcgcccctatcaaaatgtctactggtgtcacaagctctccattaagtccatcaggctccaccccaga

SEQ ID NO: 4241 - DNA, 427 bp, Artificial
  Synthetic
ctagcgccttcagcagcagttgggttgtgaaatggccaagtccaaaaatcacacagctcacaaccagtcgtacaaggcccacaggaatggcatcaagaagccaagaaagcaccgccattcatctaccaaaggaatggatcctaagttcttgaggaaccagaggtatgccaggaagcacaacaacaataagagtgttggatctactgatgaagagtaaacaaatcccttaaagtaaccatcgctagcactgctttttgaatttgggattttttttctgtttttttgttatggaattatagtggttatttactagaatggaacctaatttagtttgttattctgttatctaaaccagttattggtctcttttgatcaatggcattgtctatgcagttttattcttattactttttaatttttaatcagc

SEQ ID NO: 4242 - DNA, 504 bp, Artificial
  Synthetic
gggactgctcgattgcgctaggcgtggaggctacagcgtctgctctttcacaggtatcatggccaagtcaaagaatcatactgctcataaccagtcctacaagacccacaagaatggcattaagaaggctaagaagcagaagtatacctcaaggaaagggatggaccccaagttcctgaggaatcagaggtatgccaagaaacacaacagaagtgcaggtggctccgagtctggagatgcagaggagtaaaagtttttttcaccatggaactttttgcactttcataatctcaccaccaccaagcaatatgcatcataactttgaatttgagacaggaaaatgttttttaattcactgaatcaatcagttagacagagatgttaccagtgatagttatgagttagaattttctatcaagatatatttattttcctaaactctaccattatgtgatctttttttgccttttgttgtgggattatatttaagatctgtttggtgtt

SEQ ID NO: 4243 - DNA, 402 bp, Artificial
  Synthetic
ggaaagtaaacctagccgagcagatctacctctctctctcagtactcagagatggccaagtcgaagaatcacacggcgcataaccagtcggcgaaagcccacaagaacggaatcaagaagccaaggagacaccgtcacaccccaaccagaggaatggaccctaagttcctgaggaaccagaggtacgcaaggaagcacaacgtcaaggccggcgagaatgctagcgctgaagaataagtgttttgattatctgtgagactttttgaagtttttttttaatgaatttaagactttcttagacaaaggaaccaatttactttgcgcttttgatcatgtttacgcaattgtggtttgtgtactctcttatcctggccttaatttaatatcagcagttttctatgc

SEQ ID NO: 4244 - DNA, 433 bp, Artificial
  Synthetic
tcgattgcgctaggcgtggaggctacagcgtctgctctttcacaggtatcatggccaagtcaaagaatcatactgctcataaccagtcctacaagacccacaagaatggcattaagaaggctaagaagcagaagtatacctcaaggaaagggatggaccccaagttcctgaggaatcagaggtatgccaagaaacacaacagaagtgcaggtggctccgagtctggagatgcagaggagtaaaagtttttttcaccatggaactttttgcactttcataatctcaccaccaccaagcaaaatgcatcataactttgaatttgagacaggaaaatgttttttaattcactgaatcaatcagttagacagagatgttaccagtgatagttatgagttagaattttctatcaagatatatttattttcctaaactc

SEQ ID NO: 4245 - DNA, 272 bp, Artificial
  Synthetic
gttttcgtagctgcggcgcgatggcgaagtcgaagaatcacaccgcccacaaccagtcgaggaaggcgcatcgtaatggcatcaagaagccccagcggcagcggtacacgtccaagaaagggatggaccccaaattcttgaggaaccagcgctactcgaggaagcgcatggaagcgaagctgcgagaacaaagatcttctgagtcttagaaaatgctaatgttccttttgctgaaaatatttctttttgaatcgaagaaaatatttctatac

SEQ ID NO: 4246 - DNA, 448 bp, Artificial
  Synthetic
cccccaaaaccctagctccgccgccgccgccgttcaaccgctcgtctcctcctccctcgcgagcgctcgtttcggattcgggggagatggccaagtcgaagaaccacacggcgcacaaccagtcgtacaaggcgcacaagaacgggatcaagaagcccaagcgccaccgccagacctccaccaaggggatggacccaaagttcctgaggaaccagagatattccaggaagcataacaagaagagtggtgaggctgaatccgaggagtaagatggaagttgtcctttcggaaaagcatgtctattttgccagttttaactcagcaaccttttagactatagtttcattaatgatggaacttctatgctattctgtatgatggaaagatcttttgttctacctgagcattgttgtgataatgctttttagctgatgctgctggatgaatt

SEQ ID NO: 4247 - DNA, 567 bp, Artificial
  Synthetic
ccgccgccgacctcctcccggggtcgcgacttctctcgacgccggtggagtgagagagagagagattggagatggccaagtcgaagaaccacacggcgcacaaccagtcgtacaaggcgcacaagaacgggatcaagaagcccaagcgccaccgccagacctccaccaaggggatggacccaaagttcctgaggaaccaaaggtattccaggaagcataacaagaagagtggtgaggctgaatccgaggagtaagatggaagttgtcctttcggaaaagcatgtctattttgccagttttaactcagcaaccttttagactatagtttcattaatgatggaacttctatgctattctgtatgatggaaagatcttttgttctacctgagcattgttgtgataatgctttttagctgatgctgctggatgaattatatgctattgagttatgtgccgtgaattgtgaatctactttaggctactaggcatgtgaggttacaatcctcgttggtgatgtcagaattaataatgcataatattggagcgatatcaatatattgggtgctg

SEQ ID NO: 4248 - DNA, 695 bp, Artificial
  Synthetic
tctaaattttggtagcgccattgaaacatattttagcgataaaacaggtcataaccaagtcgtcgaaaaagctcccgtagctttggataacattctacgaaaccttaaacttggtgaatttataacatattttgtccttaacagaaaatcattgcaagtaaatgtacctcaccacttgctgttcacaaatcaaacggattacggagagttcgctgttgaaaaaggggaacatgataatatagctggcaaatttgagacccttttgaagaaaaaggaaattttaatcagaaaattactaaatattgaacagaaaaatgaccatattctagaaaattgctgcaattcggatgctgaaatgaaaaatatcggagagctagtctgctcaatgatcactctggtatcaggcatattagattcaattactaatatgaacgcagaaaactctgttgatttggattcaaagccccttccgaacgcctattttgctcaggacagtgaagaagaattaatgtcgccaacacaaagtattacgtcaaatcttgccagtgaagaaaatacacgttgcacaaccaaagacttgatgggaactgtttctattttcatgctgccaatggtggaagaatgctataatatcattagtttgataggacccatacctaccacattaataagtttatacatccgtaatggaaata

SEQ ID NO: 4249 - DNA, 677 bp, Artificial
  Synthetic
gaattccagctgaccaccatgaattacctgcgagatagatttcctccggataatgaccaaagaccctttagatgtgaaatttgttcacgaggtttccacagacttgaacataaaaaaaggcacggaagaacgcacactggcgagaagcctcacaaatgtaccgttcagggctgtccgaaaagcttcagccgaagcgatgaactaaaaagacatttgaggacacatactaaaggcgtccaaaggcgcagaataaaatccaagggctcgcgaaaaaccgttgtgaatactgctaccgccgcccctaccaccttcaatgaaaacactggtgtttcgctcacggggataggtcaatctaaagtgccacctattcttatctccgttgctcagaattgcgatgacgtgaatatacgaaatactggaaataataatggcattgtggagacacaggcacctgcaattttagtgcctgtgataaatattccaaatgaccctcatccgattccaagtagcctctccactacttctatcacctccattgcatcagtatatccctctacttctccattccagtacctgaaaagcgggtttcctgaagatcctgcatctacaccgtatgtacattcgtccggaagttctttacccctgggtgaattgtcttcaaactcctctatattttc

SEQ ID NO: 4250 - DNA, 426 bp, Artificial
  Synthetic
gaattccagctgaccaccatgcaaagcccatatccaatgacacaagtgtctaacgttgatgatgggtcactattgaaggagagtaaaagcaagtccaaagtagctgcgaagtcagaggcgccaagaccacatgcttgtcctatctgtcatagagcttttcacagactggaacatcagacgagacacatgagaattcatacaggtgagaagcctcacgcgtgtgacttccccggatgtgtgaaaaggttcagtagaagcgatgaactgacgagacacagaagaattcatacaaactcccaccctcgaggtaaaagaggcagaaagaagaaggttgtgggctctccaataaatagtgctagttctagtgctaccagtataccagatttaaatacggcaaatttttcaccgccattaccacagcaacac

SEQ ID NO: 4251 - DNA, 156 bp, Artificial
  Synthetic
gaccaccatgaattacctgcgagataaatttcctccgggtgatgagcaaagaacctttatatgtgaaatttgttcacgaggtttccacagactcgaccataaaaaaaggcacggaagaatggacactggcgacaagcctcacaaatgtaccgttca

SEQ ID NO: 4252 - DNA, 627 bp, Artificial
  Synthetic
gaattccagctgaccaccatggaggatcaggatgctgcatttatcaaacaggctacagaagcaatagtggatgtatcattaaatatagataacatagatcctataataaaagagttattagaaagggtaaggaataggcaaaacaggttacaaaataaaaaaccagcactcataccggcagaaaatggtgttgatataaatagtcaaggcggtaacataaaggttaaaaaggaaaacgcattaccaaaaccaccgaagtccagcaaaagcaaaccccaagatcgtagaaatagtactggtgaaaaaagatttaaatgtgcgaaatgttcgttggaattttcaagatcatcagatttgagaaggcacgaaaagacacacttcgccatattgcctaacatttgtcctcaatgtggcaaaggttttgcaaggaaagatgcattgaaaagacattatgatacactgacatgtaggagaaacaggactaaattactaactgcgggtggtgagggtatcaatgaattactgaaaaaagtcaagcaatccaacatcgttcatcgtcaagataacaaccacaatggtagcagtaatggctgacatggcaattcccggggatcgcggccgcgtcga

SEQ ID NO: 4253 - DNA, 699 bp, Artificial
  Synthetic
gaattccagctgaccaccatggtcgtaattaacggggtcaaatatgcctgtgaaacgtgtatcaggggtcacagggcggcgcagtgtactcacactgatggtccgctacagatgatcagacgcaagggaagaccatcgaccacatgtggccattgtaaagagctgagaagaaccaagaacttcaacccatccggtgggtgcatgtgtgcctctgcacgacggccagctgttggcagcaaggaagatgaaacacgatgtcgttgtgatgagggtgaaccttgtaaatgtcataccaagaggaaaagcagccggaaatcaaagggagggtcatgccacagaagggcaaatgatgaagcagcgcatgtcaatggtctcggtattgcagatctggacgttcttttgggcctaaatggtcgctcgtcggatgtagacatgacaaccacattgccgagtttgaagccacctctgcaaaacggagaaattaaggccgacagcattgacaatcttgatttggcttccctcgatccgcttgagcaaagccctagtatatctatggaacctgttagtatcaatgaaacaggaagcgcatatacaactacgaacacagcactaagcgatatcgacattccattctccatcaatgagttgaacgagctatacaaacaagtatcttcgcataactcacattcacaataacat

SEQ ID NO: 4254 - DNA, 591 bp, Artificial
  Synthetic
gaattccagctgaccaccatgagtcttaaagaagacgactttggcaaggataattctagaaatatagaatcatatactggtagaatttttgacgtatatatacaaaaagattcgtattcacagtcggccttggatgatatgtttccagaagccgtagtttcaaccgccgcttgtgtgaaaaatgaagcggaggataacatcaatctcatagacacgcatcctcaattcgaactggtaaatactggactgggtgctaaatcggacgatttgaaatctccatcagcaaaggctacgttcactgacaagcagaggaagaatgaagtaccaaatatatctgtgagcaactactttcccggacaaagtagcgaaacgtcgtcaacaacggaatcttggactatcggttgtgataagtggtcagaaaaggtagaagaggcattccttgaggcacttagactgataatgaaaaatgggaccacaaaaataaaaataagaaatgccaattttggaagaaacgagctgatttcattatatatcaagcacaaaaccaacgagttcagaaccaaaaagcaaatttcttcccatattcaagtc

SEQ ID NO: 4255 - DNA, 685 bp, Artificial
  Synthetic
gaattccagctgaccaccatgatgaatgaagacatatccatcattgatggccataatagttttttaacggaaaaaagcaccgtgctattaacccaagccaagagaacactagaagacgaaaaggaaatgattactcccccgagctcaactgtgagaaaaacaatgaaggaagtaaataagaggccgtcgcatcccctctcaccggatcactcgtccccaattgctccatctaaggccaagcgccaaagatcggacacatgcgctcggtccaatggtaacctaaccttggaagaaattcttcaatctttggaaagaagaagaataaatggtgaactcgccaagaaacctccatattcgtatgcaactttgatttgcttggccattttgcaatctcaggagggaaagctaacgctatcccagatatatcattggatccacgttcacttcccttattacaagcagaaagatgctagttggcaaaattcaataagacataacttgtctttaaatgatgcgttcatcaagactgaaaagtcctgcgatggtaagggtcatttctgggaggtcagaccgggtgccgaaacaaaatttttcaaaggtgaaaatcgtggttatgaatttgtaaaggactccttacaagacattgggaagtattttgaaatagattctacacttggatgaatta

SEQ ID NO: 4256 - DNA, 629 bp, Artificial
  Synthetic
ccagctgaccaccatgggcaatatccttcggaaaggtcagcaaatatatttagcaggtgacatgaagaagcaaatgttgctaaataaagatggaacacctaagaggaaggtgggcagaccaggcagaaaaaggattgactctgaagctaagagtaggaggactgcccagaatagggcagctcaacgagcgttccgagataggaaagaagccaaaatgaagagtttgcaagagagggtagagttactagaacagaaagatgcgcagaataagactaccacggactttttactatgttctttaaaaagtttactgtcggaaattacaaaatatagagctaagaattctgatgatgaaagaatattagccttcctcgatgatctgcaagaacaacagaaaagggaaaacgaaaaaggaacaagtacagcagttagcaaggctgcaaaggaattgccatcgcctaattcagatgaaaacatgactgtgaacacaagtatagaagtacagccgcacactcaagagaatgagaaagttatgtggaacataggctcatggaacgctcccagtttaaccaattcgtgggattctccccccggaaatcgaacaggtgccgttaccatcggtgacgaaa

SEQ ID NO: 4257 - DNA, 634 bp, Artificial
  Synthetic
gaattccagctgaccaccatgagttttctttccaaactttcccaaatacgaaaatcaacgactgcatcaaaagcccaagtgcaagatccattacccaagaagaatgacgaagagtattccttgttacccaaaaattacataagagacgaagatcctgcagtaaaaagattgaaggagctgaggcggcaggaactgttaaagaatggtgctttggctaaaaaaagtggtgtaaaacggaaacgtggcacctcatctggatctgagaaaaagaaaatagaaaggaatgacgatgatgaaggtggccttggaattaggtttaagaggtctattggagcaagtcatgcgccactcaagccagttgtaaggaagaaacctgaacctatcaaaaagatgtcatttgaagagctaatgaaacaagcggaaaataatgagaaacagcccccaaaagttaagtcatcggaacccgtaactaaggaacgcccacattttaacaagccaggtttcaaaagttcaaaaagaccacaaaagaaagcatcccctggcgcaacattgcgtggagtatcttctggaggcaatagcataaaatcatcagactcacccaagcccgtcaagctcaacttgcccacaaatggat

SEQ ID NO: 4258 - DNA, 163 bp, Artificial
  Synthetic
gtgaaggaattccagctgaccaccatgagttgtctttccaaactttcccaaataggagaatcaccgactgcatcaaaagcccaagtgcaagatccacgacccaacaagaatgacgaagaggatgcctcgttacccaaaaattacataagacacgaacatcctg

SEQ ID NO: 4259 - DNA, 682 bp, Artificial
  Synthetic
gaattccagctgaccaccatgcacgttttctttcctttgcttttccgcccttcccctgttctgttcatcgcatgtgcatatatatatatagatatatatatacattgtacacggtgcacggtagtgaacataactatgagcacgaacagagtcccgaacctcgacccggacttgaatttaaacaaagaaatctgggacctgtactcgagcgcccagaaaatattgcccgattctaaccgtattttgaacctttcttggcgtttgcataaccgcacgtctttccatcgaattaaccgcataatgcaacattctaactctattatggacttctccgcctcgccctttgccagcggcgtgaacgccgctggcccaggcaacaacgacctcgatgacaccgatactgataaccagcaattcttcctttcagacatgaacctcaacggatcttctgtttttgaaaatgtgtttgacgacgatgacgatgatgatgacgtggagacgcactccattgtgcactcagacctgctcaacgacatggacagcgcttcccagcgtgcttcacataatgcttctggtttccctaattttctggacacttcctgctcgtcctccttcgatgaccactttattttcaccaataacttaccatttttaaataataatagcattaataataatcata

SEQ ID NO: 4260 - DNA, 552 bp, Artificial
  Synthetic
gaattccagctgaccaccatgtccagcagcaattttaacgagatgaacgaactaaatatgactcaaacaaattatggcagcacaaaatataccgctcagcatcatcaaggtgtaataaatgccatcatctcttcactgacagccccagatcagccaactaccgtatcattacaatattccaacgacaagaacatggcgacggaaatacaagcttatgctaaactctccggaccaaactggacctattatgtgaaggatttggaagtttctattggtagaaatactgatcccttaaacagtgcactacaggaaaattcagatggtgtaaaaaacacatatagagtgaatattgatctcggacctgccaaagtcgtttctagaaagcacgccataataaaatacaacatgaatatcggcggttgggaattgcacatattgggccgtaacggcgctaaagtaaactttcaaaggactcataatggacccaacaatcctcccattcgattatcttccggaaccctgctagacataggaggaacacaaatgatgttt

SEQ ID NO: 4261 - DNA, 683 bp, Artificial
  Synthetic
tctcttcttgtgagacaagttggagcatcgtttgatctcatcatagttgtattattcctccactccgtgtatccaacgcttcttcaagtcgttacgaaagaatggcggcagcggatacagagatggcgatggagccctcaggcgaaggatcgagctctgctgccggcaaacgcgagaagcgattcgagatcaagaaatggaacgccgttgccctctgggcctgggatattgtggttgacaactgtgccatctgtcggaatcatatcatggatctatgtattgaatgccaggcaaaccaggctagtgtaacaagtgaagaatgcacagtagcatggggtgtttgtaatcacgcttttcattttcactgcattagtcggtggctgaagactcgtcaagtttgcccattagataatagcgagtgggagttccagaagtatggcaggtgatggcggttatgatttcatgttgataatagacacatgttttcaatatggcttttgacagattttctgaatcagcagtatactgtttttcttcttcttcatctctttgttggtatgttttttttgtacttggctttatgcactcaaatatttgaatgagattgttgatatatatatgatgtcagtttggctgttagcccaactcttattttgatagtaaaagaaaaaaaactccttgac

SEQ ID NO: 4262 - DNA, 673 bp, Artificial
  Synthetic
gatctctctctccctctttctctctctgtctgtctgtttggaagcaaaacgtaggagaagaagaaggagaaggaggggaagagctaagagaatggcatcggcgatgggagtggagggtgagagagagggtcacggcgaagggtgcagcggaaagcgggagaagcgcttcgaaatcaagaaatggaacgccgtcgctctttgggcctgggatattgtagtagacaattgtgctatatgccgcaaccatatcatggatctatgcattgaatgccaagcaaatcaagctagtgcgacgagtgaagaatgcacagtagcatggggtgtttgcaatcatgcttttcattttcattgcattagtcgttggttgaagactcgtcaagtttgtcccttagataatagcgagtgggaattccagaagtatggcaggtagtttcgtctggatttctttgccctcttatattattgtggtgatctttgcaacactatatttcggaacccactgatccgggaggagggtttcatgcatccatcatgatgcagttttttcgttttttttttgatctaatcgtacaatataacaatgcaatctttaactttcttctgatatgtctaccaaggtgattgaaattttatgaagccgtgtgatatatatgtgatatatagatatatatat

SEQ ID NO: 4263 - DNA, 691 bp, Artificial
  Synthetic
aaaattccccgtctctgtaaactcgaattcaatttctcgcggtgtatattgaattccaaaggcgtgtgttatagcttccgtccaatggcatctgtcgacaccgacgtgactatggttccggccggcgatggttctaccggtgccggagcttcatcatcatcttccactaagaaggccaagcgttttgagatcaaaaagtggaacgccgtctctctatgggcttgggatattgtggttgataactgtgctatctgtaggaaccacatcatggatctctgtattgaatgtcaagctaatcaagctagtgcaacaagtgaggaatgcacagtggcctggggagtttgcaaccatgcattccacttccattgcattagcagatggctcaagactcgtcaagtctgtccacttgataacagtgagtgggagtttcagaaatatggtcactagattttgttgctcctggcaaaaaatgggatattcagaaatttgattcatctgatcagagtataccgattgagttacattccttgattgggaactctaatgaagcttttgtgcttttagttcatcgatgtgacttcactttttgttggcacttggtaattttgagacgtgatattaccatgtgaacttgtgctattttggatgtgcgttggttcttttatcaagttttttgggcttttgtttgggt

SEQ ID NO: 4264 - DNA, 731 bp, Artificial
  Synthetic
gaagaaaattgtgagatcgagaaccctagaatttggactacgatttcttgattcagcagggaaaatggatacagacgtcgagatggtttccccggtgaagaatccaacgctgcagcagcagcaacttcatcagcatctactgcttcttcttccactaagaaaccgaaatgttttgagatcaaaaaatggaatgctgtcgctctttgggcttgggatatcgttgtagacaactgtgctatttgcaggaatcatattatggatctatgcattgaatgccaagctaatcaagctagtgctacgagtgaggagtgcactgttgcttggggtgtatgtaaccatgccttccacttccactgtatcagtcgctggctcaaaacccgtcaagtgtgtccattagataatagtgagtgggaatttcagaagtatggtcactagagggattcaacaagtggcacgagaggcaattatactgcttcatcataatgtcgttaaatgtagtttgttgtagtaatacttgttccaatgccttttttctgtgttgctttacatatctgagtctgctttggccatctgataggctttactagagagctcgtactgaatcacgtgctgtgtgattctgcttactgaagtcaaacttgtccttgtcgattatgtttgggaaaaccttcaactagagccactagcaaaatctggcgccaatgttattttaccttcattactctaatatt

SEQ ID NO: 4265 - DNA, 617 bp, Artificial
  Synthetic
gggcggacgcgtgggcggacgcgtgggggaggaggaggagccctagcactggtgatggcgagcgtggacatgatggacgtggctggcccttcgggcgagggctccagcagcgccgccagtagctccaccaggcgctccaagcgctttgagatcaaaaagtggaacgctgtggcgctttgggcctgggatatcgtggtcgataactgcgccatctgccggaaccacatcatggatctgtgcatcgagtgccaggcaaaccaggccagcgccaccagcgaggagtgcaccgtcgcctggggcgtttgcaaccatgcgtttcacttccactgcatcagccgctggctcaagacccgccaagtctgccccctcgataacagcgagtgggagttccagaagtacgggcgttgacaaacagctatttggttttagcgtgtacgcggctcatgttctccttgtccgagcttcagagatttgtacttttttcttcgttgatgttccaaatttgccttggctattgaatcctaccgtcttgagcagcaaaatccttgttacaatcggttgactcttacggttgcacgtgatgaggagtacttggtggtagtattcgaggtcaagcc

SEQ ID NO: 4266 - DNA, 527 bp, Artificial
  Synthetic
atggagccctagcgctggtgatggcgagcgtggacatgatggacgtggctggcccttcgggcgagggctccagcagcgccgccagtagctccaccaggcgctccaagcgctttgagatcaaaaagtggaacgctgtggcgctttgggcctgggatatcgtggtcgataactgcgccatctgccggaaccacatcatggatctgtgcatcgagtgccaggcaaaccaggccagcgccaccagcgaggagtgcaccgtcgcctggggcgtttgcaaccatgcgtttcacttccactgcatcagccgctggctcaagacccgccaagtctgccccctcgataacagcgagtgggagttccagaagtacggccgttgagagccggagagcgaacagctattttgttttagcgtgtacgcggttcatgttctcctcgtccgagcttcatatttctccagagatttgtacttttttcttcgttgatgttccaaatttgccttggctattgaatcctaccccgtcttgagcagc

SEQ ID NO: 4267 - DNA, 404 bp, Artificial
  Synthetic
gaattccagctgaccaccatgagcaacgaagttgacaggatggatgtggatgaagatgaatcgcaaaatattgcgcaaagctcaaaccaaagtgcgccagtggaaaccaaaaagaagagatttgaaattaagaaatggaccgcagtggcgttttggtcatgggatatagctgttgacaactgtgctatttgcaggaaccatataatggaaccatgcattgaatgccagccaaaggccatgacggacactgataatgaatgtgtagcagcctggggtgtctgtaatcacgctttccatttgcactgtattaataaatggatcaagacaagagacgcatgcccattagataaccaaccttggcagttagcaagatgcggtaggtgacatggcaattcccggggatc

SEQ ID NO: 4268 - DNA, 66 bp, Artificial; identical to SEQ ID NO: 3718
  Synthetic

SEQ ID NO: 4269 - DNA, 66 bp, Artificial; identical to SEQ ID NO: 3718
  Synthetic

SEQ ID NO: 4270 - DNA, 586 bp, Artificial
  Synthetic
ctcctcctcgcgctcccctcccaccctagggttcgccatggacaagggcgacgtcgccgtggccgtgcccccctccatcgccggcgcctcctcctccggggccaagaagggcaagcgcttcgagatcaaaaagtggaacgctgtctccctctgggcctgggacatcgtcgtggacaactgcgccatctgccgcaaccacatcatggacctctgcatcgagtgccaggcgaaccaggcgagcgccaccagcgaggagtgcaccgtcgcttggggagtttgcaaccatgcattccacttccactgcatcagccgttggctcaagacccgtcaagtgtgccctctagacaacagcgagtgggagttccagaagtatggtcactagacaattctctttcgggagcaaaagcggcttcaagtttctcgtatcaagtattagcactaagtgataactaatgattacgatgggtaggctgcattgttaatgtttcagaagcttgtattttcggtagaaacatatcatgctggtagctcagcgaatctcctcaaacttattttcgctgaaatcaagcagcagttcgtatttact

SEQ ID NO: 4271 - DNA, 531 bp, Artificial
  Synthetic
cgtccgaattaacactctttgaagcttaacatttaatggcatcaccggacaccgacgtgcctatggttcccgccggcgagggttcaaccggcgttggatcgtccactaaaaatcccaagcgattcgaaatcaaaaagtggaatgctgttgctctctgggcttgggatattgtggtagataattgtgcaatctgtaggaatcacatcatggatctgtgtatcgagtgtcaagctaatcaagctagcgcgacaagtgaggaatgcacagttgcttggggtgtttgtaaccatgcattccacttccattgcattagtcggtggctcaagactcgtcaagtgtgtccacttgataacagcgagtgggagtttcagaagtatggtcactagtatttattgttggtgtacagtgaatgggagtttcaagtgttgtctgttggattgaagtccctatcctctctttgctatcatcggcgttgaaaagaatgattataacgtctacttatgttccttcaattttcgttctgcaaatatg

SEQ ID NO: 4272 - DNA, 736 bp, Artificial
  Synthetic
cccacgcgtccgcccacgcgtccgacattcgttgtctgaacactaaaccaaaaaactccaaaaaaaacaacttaatacacacccccccaacaacacttaataccgacaagatgaaggccgctttcgttgctgttgctctcgccgctctggcccaggctcagacccgcgctgatatcccatcctgcgctctgccctgcctcgacgacgccgtcaaggccaacaccaagtgctccaccaccgactacgcctgtatctgcaaggacttcaacgctgttcagggcgctgccaccggctgtgtcgttgagaagtgcggtaccgacgttgccatcaacaaggtcctccccgccactcaggctctctgcgccgccaactctggatccggctctggctcttcttctgctgccaacaccactcccgcccagcagaccacctctgccgcccagtcttcttctgctgcccagtcttcctctgctgctcagtcctctgtcgcccagcgctccccccagctctgcccccgcccagaccacctctgctgcccagaccactcccgtcattcccgttggcactggcactggcgttccccccgctggcaacaagaccaccaccggtgctcccaccgcccctaccagcggcgcttccaccatcctgcccggccttgccttcatcgccgctctctgcgcctttgccctgtaaggggtttgacaatgaacgacgacgagatgggaagggtgacgat

SEQ ID NO: 4273 - DNA, 567 bp, Artificial
  Synthetic
tttcacagtccagctacattcgttgtctgaacactaaaccaaaaaactccaaaaaaacaacttaatacacacccccccaacaacacttaataccgacaagatgaaggccgctttcgttgctgttgctctcgccgctctggcccaggctcagacccgcgctgatatcccatcctgcgctctgccctgcctcgacgacgccgtcaaggccaacaccaagtgctccaccaccgactacgcctgtatctgcaaggacttcaacgctgttcagggcgctgccaccggctgtgtcgttgagaagtgcggtaccgacgttgccatcaacaaggtcctccccgccactcaggctctctgcgccgccaactctggatccggctctggctcttcttctgctgccaacaccactcccgcccagcagaccactcccgtcattcccgttggcactggcactggcgttccccccgctggcaacaagaccaccaacggtgctcccaccgaccctaccagcggcgcttccaccatcctgcccggccttgccttcatcgccgctctctgcgcctttgccctgta

SEQ ID NO: 4274 - DNA, 582 bp, Artificial
  Synthetic
cccacgcgtccgaaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactgctgttcagaatggctctactagctgtgtcattgctgcttgtggcgtttctgtcgccattagtatgtgctcccctctcattttggtcgaggatatttacgtctcaaatgcttatgtatatttatagaccaagttctgcctgccacccaggctctttgtgccaaccagtgaactcatccatcgagagggagaaaatgacatgggagaaaatcaggtactcttgtacattgacaaacaagtacatagctgaatggtgtgaatgaataaaacgcattgctgctggacaccgctctgttcatttctgtatttcaatgagtattcatgcgatatgtagcttga

SEQ ID NO: 4275 - DNA, 484 bp, Artificial; identical to SEQ ID NO: 2316
  Synthetic

SEQ ID NO: 4276 - DNA, 79 bp, Artificial; identical to SEQ ID NO: 2317
  Synthetic

SEQ ID NO: 4277 - DNA, 659 bp, Artificial
  Synthetic
atctagataccctccccttcttcttctcttctttcccccccttcacatttgtgtcttgacgtcgtatttcgcttcagcgtcatcccccatcacacatacacacatagcaacttgccgacgtcatggctgagcaactgagatacgacggccaggtcgtggtcatcaccggagctggcggtggtctgggcaaggcctatgccactttcttcggctctcgaggcgccagcgtggtcgtcaacgacctgggcggcacgttcaagggcgagggaaactctacaaaggctgctgatgtcgtcgtcgacgagatcaaaaaggccggcggcaaggccgttgccaactacgacagcgtcgagttcggcgagcgcatcatcgagaccgccatcaaggcctttggccgcatcgacatcctcatcaacaatgccggcatcctgcgcgacattgccttcaagaacctcaaggacgaggactgggacctcatcatgaaggtccacgtcacgggcgcctacaagtgctcccgcgccgcctggcctcacttccgcaagcaaaagtacggccgagtcatcaacaccgcctcggccgccggtctgtttggcagctttggccagaccaactactctgctgccaagctcgccatggttggcttcaacgagacactggcc

SEQ ID NO: 4278 - DNA, 482 bp, Artificial
  Synthetic
gtttcggaggctgattgagtcggaggggctgccttattgcggcagaggaatagtgacgtcatgactatcaaggaccctggaggttacctaaaagaaaagcatctggacgaggtgacgtagccatcaatgcgatcgattgtttgctctatctcctcgggtcggctgttgatttagtattaaactaatggatatgaatagtgttagagtgtgcgaatggatctcattgtttgaattgatgaatctcggaagatctgagctagctgcaagatgcctcaagccatgcgcaaggcacgtgtggatggaggcaagattggatggagatttactgtaaatcttccaactttaactatagaagggaaagggggaaagaggcgatcgctataccgctggttggattcagctccagggacagatttcatcaaaacaagcgatgaactgtgtggtgacatatatatacgagtacgggtttgatcataattcgc

SEQ ID NO: 4279 - DNA, 244 bp, Artificial; identical to SEQ ID NO: 2342
  Synthetic

SEQ ID NO: 4280 - DNA, 197 bp, Artificial; identical to SEQ ID NO: 404
  Synthetic

SEQ ID NO: 4281 - DNA, 409 bp, Artificial; identical to SEQ ID NO: 2358
  Synthetic

SEQ ID NO: 4282 - DNA, 466 bp, Artificial; identical to SEQ ID NO: 3204
  Synthetic

SEQ ID NO: 4283 - DNA, 704 bp, Artificial
  Synthetic
tgtcttgtcattattactcgaccgcgtcgagccaagaaaccattgaagcacataacaaaccgttcgaaaaccgcaacaatgtctatcgtccagccacaagaataccagaccgttgacgacgtgccgtatcagcgaggccgtcctctcccaacagtcacccccgtcttccagaacaagctgcccaactcgcctggcaagacgtccatcggcctcctcgtcgacttcccgcccaactcgtcgacgcccccccacacgcacggcggcgcggccatctccgtcttcgtcatcaagggcaccgtgctcaacaagatgaacgatggcccgactcgtgtgatcccggcgggcggcacgtggttcgaggcccccggctgccaccaccggaccagcgacaacttcagcaccacggagccggcgcagattctggcgacgatggtggttgacacaaagactgttgaagagggagggatggcggctcttgttgtgctcgacccggagtatgctgatatcagacttggttaaattgatatggatgctgcagtgaagagaaccggaagctcggaaagggtgtgggtgttgtcaatatcagaagtggccagcggaggctcggattgctgttagtaaacggggcatctcagcaggaaggcaaaatgaatatgtaaagcaatcaatggcaacgaatcgttttgactaacagaaaaaaaaaa

SEQ ID NO: 4284 - DNA, 198 bp, Artificial
  Synthetic
gttgggtcgtgttgatgcctcgttttggatatgcatcgtatacttgcttggaggagatgaggtttgtgctgaagagagagagacagctttgacagtcttgctgtttgttattccgtgggggtatctcaattcgaggatgtatttatttactagatgctagcatgaatttttttttgatccttgagaaaaaaagaaaaa

SEQ ID NO: 4285 - DNA, 479 bp, Artificial; identical to SEQ ID NO: 2364
  Synthetic

SEQ ID NO: 4286 - DNA, 553 bp, Artificial; identical to SEQ ID NO: 2367
  Synthetic

SEQ ID NO: 4287 - DNA, 432 bp, Artificial; identical to SEQ ID NO: 2370
  Synthetic

SEQ ID NO: 4288 - DNA, 187 bp, Artificial; identical to SEQ ID NO: 2371
  Synthetic

SEQ ID NO: 4289 - DNA, 440 bp, Artificial
  Synthetic
cgcatcttcaccaaggcgccgtcatcgcgcggcatcatcgtcattgacttgagcttggaaagctcagcaagatgccagcaaccatggcccctccaacgcagactttcaacctcgatgttgaggcaatctcgggcatttgcggatctatctctatagcctgttgggtggtcgtgttctctccgcaaatcatacaaaatttccaacgcagcagcgccgacgctctttcgattcaattcatcattgcttggctcctaggagatgtcttcaatatcctcggagccgttttacagggagttctccccaccatgatcatcctagccatctactacaccattgccgatctcgtactgctctgccagctgttttactatcgcggatttacgtggcgcgacgagccgactccatccccgcccaagacaaatggccactcttcgacatca

SEQ ID NO: 4290 - DNA, 622 bp, Artificial
  Synthetic
acaaccacagacacgcacacgacgactcgatatggacgccgtgtacaccgcagtacaacctccaattcatggcctagactcatcagccctcagcggcattatgggatgcatttccatcgcctgctggatcattgttttcacgccccagatttatgagaatttcaaacgacaatcgtcagaaggactgtctctctccttcgtcgtcatctggctcattggagacatcttcaatgtgctcggagccatcctccaaaagatcatccccaccatgatcatcctcgccatctactacaccctggccgacattctgctgctcttgcaatgtctggtgtacacacacagaaacaagatggttgatctcaagcacctgtctcccgccacacctcttcttgaggccgatcccagccacgatgccgagccccgtcctgctcccgtgaccgaacccgtgccgcgagccaaggtcatcttctaccgtctgctgatggtggccaccgtcatcgctgccggcattctgggctacgtcttctcgtccaacaaccacaaggacggtaagcccgagaagccccacgacgatcctttggagatgaacatgctgggtcagtttttcggctggctatgtgct

SEQ ID NO: 4291 - DNA, 594 bp, Artificial; identical to SEQ ID NO: 2373
  Synthetic

SEQ ID NO: 4292 - DNA, 387 bp, Artificial; identical to SEQ ID NO: 422
  Synthetic

SEQ ID NO: 4293 - DNA, 316 bp, Artificial; identical to SEQ ID NO: 2376
  Synthetic

SEQ ID NO: 4294 - DNA, 761 bp, Artificial; identical to SEQ ID NO: 2384
  Synthetic

SEQ ID NO: 4295 - DNA, 685 bp, Artificial
  Synthetic
cccacgcgtccggcaccaattcccaattcatctatataatcttctatatcccgatcgacaccacatcacatcccgccatggccgctccgacagaagcgcagctcgcgcatatccagctcctcgaacagctcgacatccactccatccacaagaacttccgcaaccccaactggaagcccaaccagcgccgaaacaagaacctcaaggccatcgtaggcgacgcgtcgaaacgagaagcctctgcccttgcgactccacaagacgtcagcggcgatgcgaccccagccgccgacgatggcctctcgaccagcggcacctcgacgccggccacaagcaccaatgggaacccgccgccgccgaatcttgcgcaggcttcgcgtagtttgtcgaagctcgtgctggaaaagacgttgaagccgcctgtgggaggggctggagctgtgtcggcaccaaacgcgacgtacacaaatattgagtcggcgccttcattagcacattcgaagcactactgcgatattacgggccttccggcgccttacttggatcccaagaccaggctgcggtatcacaacaaggaagtgtttgggttgatcagagcattgccccagagctctgcggagcagttcctggctgctcgtggcgcgcatacggtgctgaagtgagcgcgctggtggatgattatacg

SEQ ID NO: 4296 - DNA, 600 bp, Artificial; identical to SEQ ID NO: 2385
  Synthetic

SEQ ID NO: 4297 - DNA, 236 bp, Artificial; identical to SEQ ID NO: 2386
  Synthetic

SEQ ID NO: 4298 - DNA, 561 bp, Artificial
  Synthetic
ggtttggcttgcagtaagaccggcttatgagaaagaccattgtgagagatgtaaggctgatccggagctctacgtcatctgagacatgacattggcatgatgagggtccagtaactacctgatgattggggtaatcgaaagagatgcagagagaaacacgcaactctgagaaagcgtcccgttacacacggaacacactgcctccggacagcggcttgtggctcattgcttgagtcccttaatcagcaatccccaggttctcttgacagctcagcggtgcagttttgcgggcacagctgatccacccgtcaacggggcgggacgccgggaagccgggactccggggctaaaatgacatcgccatgacatccgcaccgtccgaccagaactgctactactcaagacggtaagcaagtgctagcaaaagtgagttttacgaggtaagcaagtaggaacgtggcttataaagccacagctagcttgaggcgaaggctgctagtaggaactaaagtcagcttatactatttataagctcactgcatgggctagtaataatagctc

SEQ ID NO: 4299 - DNA, 615 bp, Artificial
  Synthetic
tactcgagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgt

SEQ ID NO: 4300 - DNA, 608 bp, Artificial; identical to SEQ ID NO: 2393
  Synthetic

SEQ ID NO: 4301 - DNA, 636 bp, Artificial
  Synthetic
ttactcgagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgcggccgcgtcgaggggtag

SEQ ID NO: 4302 - DNA, 632 bp, Artificial
  Synthetic
gtcgacgagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgcgcggccgctcagct

SEQ ID NO: 4303 - DNA, 585 bp, Artificial
  Synthetic
gcagatactttacaatttcgcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgt

SEQ ID NO: 4304 - DNA, 618 bp, Artificial
  Synthetic
gctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgcggccgcgt

SEQ ID NO: 4305 - DNA, 643 bp, Artificial
  Synthetic
ctcatctcagtcgtgtcttgtcattattactcgagctgatttaacaaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtg

SEQ ID NO: 4306 - DNA, 618 bp, Artificial; identical to SEQ ID NO: 4304
  Synthetic

SEQ ID NO: 4307 - DNA, 608 bp, Artificial; identical to SEQ ID NO: 2393
  Synthetic

SEQ ID NO: 4308 - DNA, 442 bp, Artificial
  Synthetic
gcggacgcgtgggcggacgcgtgggcggacgcgtgggcggacgcgtgggaaggaatcagccaaagctcgcgcgttaccccgggggtttggttctccatctgactgctttgtactgctactactgcccggagtgcgagtaacacccgctcgtattatcgcgacgcctttacacttttgattactcgagttggtccctccgatcttcagggaccgtttaatgcggctattctcccaagcggagcttcgtggtcttaacggttgttgcgttgccgagccagtctgtgtattagttgtgtcccgagcttattgaacctgctgcacgcacttaatccgcttctttgcccttgatacctacatgcctgcatttggcagcacacgccacctggtacgttgtatttagttactcttagtctatgcagacaacaacttctctctcccaacc

SEQ ID NO: 4309 - DNA, 640 bp, Artificial; identical to SEQ ID NO: 2404
  Synthetic

SEQ ID NO: 4310 - DNA, 418 bp, Artificial; identical to SEQ ID NO: 2405
  Synthetic

SEQ ID NO: 4311 - DNA, 656 bp, Artificial
  Synthetic
acaatacatctcatgttcacagagcagatacatcttcaaccctctcccaagagatatctgggcttcaactctcaattcatatttacaataaaagtaataaagattgaaaccgccagcaactccaagtcacaaccacatacatcatgcctgcgcaaactacatctccccacctggccaacctcgagcgcgacggcttcgtcgtcatcaaatccatcgtctccccctcgaagctcgaggccctccgcaccgccagccttaaagcagagcagctcgcccgcagcggccaatggcctcacgtgcggaccgtgggcaaacagttcccgccgtggaaccacgaggaggcgcaggagaagggcatctggggcgtgcagcacctgatgaagccttcgatgcccggccacgagacgtttacggcgctgtacttttccgaagagatcttgagcattgtgagggagttgctgcagtgtgaggatgaggagctggtgatggagctgtttaacatgctggtgaggccggataaagactttgagctgcggtggcatcgggatgatatctcggcggaggcgtcggcggaggaggagatggagaggcttgggcggccggcgtttcacgcgcagtataattttgcgctgtgggaggatgagtcgcttgttttg

SEQ ID NO: 4312 - DNA, 321 bp, Artificial; identical to SEQ ID NO: 2432
  Synthetic

SEQ ID NO: 4313 - DNA, 531 bp, Artificial; identical to SEQ ID NO: 2439
  Synthetic

SEQ ID NO: 4314 - DNA, 486 bp, Artificial
  Synthetic
ggaagaaagaagcttttcatttcatttcattggccaaaatgaaattcaatcccagagtgagcagctcccgacggaagtcgcgtcgagcgcattttacggccccttcaagcgagagacgcattttgatgagttctactctctcatcagagctcaagaacaaatacaatgtgcgaagtgtcccagtacgtaaagacgatgaggtgcaagtagtgcgagggacattcaagggaagagaggggaaggttgtgcaggtgtatcgacgcaaatgggttattcacatcgagcgcatcacccgcgacaaagttaacggagctagcgttaatgtcggaattgatccctcaaaggtgataattacaaagctgaagctggataaggacaggaaggccctccttgacagaaagggaaagggaagagcagccgacaagggaaaaggaaagttctctgcagaggatgtagcagcacctcttcaagatatcgattaagtga

SEQ ID NO: 4315 - DNA, 446 bp, Artificial
  Synthetic
cccctggcccaccaaaaccctagccgcgccgccgccgccgacgaccaggtaaggaaggagatccgccgccggcgccgccatgaagcgcaacccacgcgtgacgagctcccggaggaagtgccgcaaggcgcacttcacggcgccgtcgtccgtccgccgcgtgctcatgtcggcggcgctgtcgtcggagctccgccacaagtacaacgtgcggtccatcccgatccgcaaggacgacgaggtgcaggtggtgagggggagctacaaggggcgcgaggggaaggtggtgcaggtgtaccgccgtcgctgggtcatccacgtcgagcggatcaccagggagaaggtgaacggctccaccgtcaacgtcggcatccacccctccaaggtcgtcgtcaccaagctcaagctcgacaaggaccgcaaggccatcctcgaccgcaaggcgc

SEQ ID NO: 4316 - DNA, 530 bp, Artificial
  Synthetic
aggcgtaggtgtagttgtaggaggaggaggcgaggagccgaggaggagcaggagttcaaggtccgtcgcccaccatgaagtacaatcccagagtgagcagctcaaggcgtaagtcacgccgggctcattttactgccccttcaagtgagaggcgtcttttgatgagctctgccctttcatcagagctgaagaacaagtacagtgtgcgatgtgccccaatccgaaaggatgatgaggtccaggttgtccgaggtacttacaagggcagagagggcaaggttgtccaggtgtaccgacgcaagtgggttatccatatagagcgcatcactcgcgagaaagtcaatggagctaccgtcaatgtggggattcacccttcaaaggttattatcacaaagctaaaattggacaaggacaggaagtctctcctagaaaggaagggcaagggaagagcggccgacaagggcaagggcaagttctctgctgaggatgtagctgcacctcttcaagacgtggattaacttttttgctct

SEQ ID NO: 4317 - DNA, 601 bp, Artificial
  Synthetic
ggagaaccctaggcggcggcgagaggtaggcggcagcaatgaagtccaatccggcggtgagcagctcgcggcgcaagtcgaggaaggcgcatttctcggcgccatcgagcctgcgccgggtgctgatgagcgcatcgctgtcgtcggatctacggaacaaatacaatgttcgatctgttcctgtccgcaaggacgacgaggtccagatcgttcgcggctcgttcaagggtcgggagggcaaggtcacccaagtctaccgcaagaagtgggtgattcacgtcgagcgcatcacgcgcgagaaagtgaacggtgctactgtgaacgttggtgttcatccgtccaaggttgtgatcaccaagttgaagctggacaaggacagaaaggcgctgctggacaggaagggcaagggacgtgcggcagagaaaggcaaggggaagttcacgaccgaggatgtggctccggcgctccaagaagtggattgattgtttctttctactcttatctagtcttcttactcaaaaatgcgaactctccaggattttggctgtccaacttgatgttaagtgaaaacgttttttattgtttgatccatcacaaaaaa

SEQ ID NO: 4318 - DNA, 586 bp, Artificial
  Synthetic
ttcttttttttttttctctctcccttctctctctctacaaatctggggctcccagtatagcttaggttgatttaattatggttaacctctcacagtaatccgggtgagaggtgggaagccaaagtgggagaagcaaatattctcagggcaggtaaggtaagcgaaggcgagaagagaagagacgagaagagaagagagagaaggtaaactagtctctcttgtacatggtggcttcccttcccttcccttctcttcccatctctctctcctctggttttctcctaccttttcttttgggggaaaaaataatattaattaaggcgcgcgtgcgcgccgccgccgccatgaagcgcaacccacgcgtgacgagctcccggcggaagtgccggaaggcgcacttcacggcgccgtcctccgtccgccgcgtcctcatgtccgccgccctctccaccgagctccgccacaagtacaacgtccgctccatccccatccgcaaggacgacaaggtgcaggtggtgagggggagctacaagggccgcgaggggaaggtggtgcaggtctaccgccgccggtgggtgatccacgt

SEQ ID NO: 4319 - DNA, 548 bp, Artificial
  Synthetic
gtctcgcatcttcgcgaagaaaaagcagaaaggcgcacttcggtgccggctcgactcagcgccgcaacatcatgagcgctcctcttagcaaggagctccgtgagaagcacggtgtcaagtcgctcccagttcgcaaggaggatgaggtctcagtcatccgtggctctaacaagggtcgtgagggcaaggtttcgtcggtttactttttgaagtatgttatccacgtcgaccgtctcgtccgcgagaagtccaacggccagtctgttcccatcggcgttgcaccatcgaaagtcgtcatcaccaagctcaagctcgacaagaaccgcgagtctatcctggagaggttgaagctgggtcgcgagacgaaggcaaagtcgatgaaggagaaggcatagaggaacgccgacacgaaggacgcgggagagatcatttgcattaggcgttcatgattctgtggttataagagcacccatggatgggacggcatggcattttcacggcacagtcaaaattcaatgtgtattgaagagcagacatccaaatgtgaa

SEQ ID NO: 4320 - DNA, 687 bp, Artificial
  Synthetic
gctcaaccgacaaaacaggatctcctcgtcgtccaaatccaaccgtcaagatggtcaaggttaacaagaacatttcctcctccaggagcaagagccgtgccgctcacttcaaggccggctccggccagcgccgtgtcatcatgagcgctccccttagcaaggagctgcgcgagaagtacaacgtccgcagcatccccatccgcaaggacgacgaggtcaccattgtccgtggctccaacaagggccgtgagggcaaggtcacctccgtctaccgtctcaagtacgtgatccacgtcgagcgtgtcacccgcgacaaggccagcggccagagcgtccccctgggcatccacccctccaacgtcgtcatcaccaagctcaagctcgacaaggaccgtgagagcatcctgtctcgctccaaggtcggccgtgagctccgtgtccccaacaagatctctgcttaaattcataagcaaatcttaacaattgggtgagacgaggagatgaatcttttttttttcaacttaacagtttttccatgtgatgcatccatggcacaatgatgggcaaggaatgggcatatatactccggcgttttagcgatacccgagacccctgcaggtccggctttctcagcagggtagatgaatcgagaattttacaattctcaatggccgtttcaccaacttg

SEQ ID NO: 4321 - DNA, 402 bp, Artificial
  Synthetic
ctagctccccccgcgccgccgccgccgccgccgccatgaagcgcaacccacgcgtgacgagctcccggcggaagtgccggaaggcgcacttcacggcgccgtcctccgtccgccgcgtcctcatgtccgccgccctctccaccgagctccgccacaagtacaacgtccgctccatccccatccgcaaggacgacgaggtgcaggtggtgagggggagctacaagggccgcgaggggaaggtggtgcaggtctaccgccgccggtgggtgatccacgtcgagcgcatcacgagggagaaggtgaacgggtccaccgtcaacgtcgggatccacccctccaaggtggtcgtcaccaagctcaagctcgacaaggaccgcaaggccatcctcgaccgcaaggcga

SEQ ID NO: 4322 - DNA, 697 bp, Artificial
  Synthetic
aaaccctagagctcatcttcttcaccggctgcccattggcgaagaagcagagcagaccagaaatcagcaaaaatgaagtacaatccaagagtatcctcctcccgccgtaagagtagaaaagcccatttcacggcgccttcaagcgagcgcagggtgataatgagcgcgccgttatccaccgaattacgttcaaagtacaacgtaagatctatgccggtgaggaaagacgacgaagtccaagtcgttcgtgggacctacaaggggcgtgagggaaaagtcgtccaagtgtaccgtaagaaatgggtgattcacattgaacgtataactagagagaaggtcaatggatctactgttaacgttggtattcatccttctaaggttattgttacgaaactcaggcttgacaaggacaggaaatcgctacttgatcgtaaggccaagggacgcgcagctgctgataaggacaagggtactaagtttactgctgaggatatcatgcagaccgtcgattgattttttcaatcgtatctttctgtctggtattgttttttagctaaagagaggattttagtgcttttaagacattgaattttgttcgagtttctgttatttaaatcaatgatgatgatacttctgaatcttatacactatatttgctcagccattggtgcatacttggtgattaaagttctaaagc

SEQ ID NO: 4323 - DNA, 603 bp, Artificial
  Synthetic
tttatcagccgcatttgcagtctgtgtgtttgaatcagattttgcaaagatgaagtacaatccaagagtttcctcctcccgccggaaaagccgaaaggcccatttcacggccccatcaagcgtccgccgagtgttaatgagcgcacccttatcctccgaattacgcaccaagtacaacgtaagatctatgccggtaagaaaagacgacgaggttcaagtcgtacgaggaacatacaaggggcgtgagggtaaagttgtccaagtttatcgcaagaaatgggtgattcacattgagcggataacacgtgagaaggttaatggatccactgttaatgttggtattcacccatctaagactgttattactaagctcagacttgataaggaccgtaaatctttgattgatcgtaaggctaagggacgtgctgctgctgataaagacaagggtactaagttcactactgaggatattatgcagaccgttgattaaattttgaacctgtttgtcgctgttacagagttctattgggtagctgaacgagaggttatattactaatttagtacgttttgtgttgttaagatttttgggatctttaattcta

SEQ ID NO: 4324 - DNA, 701 bp, Artificial
  Synthetic
ttttagagggagcaggcgtaggtgtagttgtaggaggaggaggcgaggagccgaggaggagcaggagttcaaggtccatcgcccaccatgaagtacaatcccagagtgagcagctcaaggcgtaagtcacgccgggctcattttactgccccttcaagtgagaggcgtcttttgatgagctctgccctttcatcagagctgaagaacaagtacagtgtgcgatgtgccccaatccgaaaggatgatgaggtccaggttgtccgaggtacttacaagggcagagagggcaaggttgtccaggtgtaccgacgcaagtgggttatccatatagagcgcatcactcgcgagaaagtcaatggagctaccgtcaacgtggggattcacccttcaaaggttattatcacaaagctaaaattggacaaggacaggaagtctctcctagaaaggaagggcaagggaagagcggccgagaagggcaagggcaagttctctgctgaggatgtagctgcacctcttcaagacgtggattaacttttttgctctagtaaaacggtattccgtggttgatgaacatatgccgaaggtgggagtggttaaatgcctacccacctcagttttagtggagagaactgttagctgtcatttttatctggctagtttctgcaatgatactagagatatatctttttttggtaaccttg

SEQ ID NO: 4325 - DNA, 648 bp, Artificial
  Synthetic
cggcagagatagtgagagagagcgacagagaaatcggcgaagatgaagtacaatccaagagtatcctcgtcccgccgcaagagcaggaaggctcatttcacagctccttccagcgttcgtcgcgtgttgatgagcgcatctttgtcatccgaattgcgaaccaagtacaacgttaggtctatgccggtgaggaaggacgacgaggttcaggttgttcgtgggacctacaagggccgtgagggcaaagttgttcaagtttaccgtaagaagtgggtgattcacattgagcgcattaccagagagaaagttaacggatctaccgttaacgttggaattcacccttccaaggttgtcgtcaccaagctcaggctcgacaaggaccgtaagtctcttcttgaccgtaaagctaagggtcgtgctgctgctgataaagataagggtactaagttcaccgccgaggatatcatgcagaccgttgattagtttttctgctacctctagtgtttttgtcttgttatattttgttgctgttagtacttgatgcttgttgggatagctgaagagagtgtttctgaagctatgaatttttgttgcagtatttatgataacagtatgcaatttttgctataatcaaatgtctttctcgtt

SEQ ID NO: 4326 - DNA, 736 bp, Artificial
  Synthetic
ggacctataagacaagctgtggcttttttaatccttaatccttactttcaattccattccagtgttgctaccttttcttgggaataactcagctacaaagacaattttgaacctacaacatcatcatcaaattatcattattcaaaatgaagttcacaaccatcgtcaccgctgctgtctcttcagccattgccgtctccggcactcccatccacaagcgcgagatcggcggcgtatgtcttctccctctcctctcccttgcatcttctccattcctatcactcgtctgattcaatatcatctctaactattggtcaatccctcacaggtcctcttgtgcaccggcgtcaatgcaaccggcacctgcagctacaacgtctacgaactcaagacgtgccaccagcttcccgcgcctttccaccaaaacaccagcacgtttgcccccgacggcgaagactttgagtgcttccctcgtattggcgactgcggttctatttgcaccagcccgacgggatgtacctttggcagcgtcgactttaactacaagaacaagttcaatctgggggctattaagtgtaacaccttgatttccagctttgactgttcgctgaagacgacgacgacttcaactgagtaaaaaggaaaaaagacaaaattatgttttacaaagtgttggaggatcgcatcttgttttgtttaatgtacgacttataccaacgatgaggatccatctcat

SEQ ID NO: 4327 - DNA, 214 bp, Artificial; identical to SEQ ID NO: 2443
  Synthetic

SEQ ID NO: 4328 - DNA, 355 bp, Artificial; identical to SEQ ID NO: 2455
  Synthetic

SEQ ID NO: 4329 - DNA, 574 bp, Artificial; identical to SEQ ID NO: 2456
  Synthetic

SEQ ID NO: 4330 - DNA, 711 bp, Artificial
  Synthetic
agcgaacaagctcagttgatgcctcgagacagcggcagaaaccgacaaccacgaaccccaaactcgaattcgagcgcaaaccagagcacaggaagagggcaaatgtcgaacccaaacaactggcaggaggaggcgatgcggcgtctgcgccagatgcagacgcggggcgggtatcccggacgaggaggaccgcagatgcccagaggagcaaacggcgccttgattggaggaatcttgctggcgggcggcgcttggttgctgtcgaactcgctgttcaacgtggacggtggtcaccgagcgatcaagtaccagcgattaagaggcgtgagcaaggagatttacagcgaaggaacacacatcaacattccttggttcgagacacccatcatctacgatgtacgagcgaagccgcgcaatgttgcttcgctgactggcaccaaagacttgcagatggtcaacatcacctgccgtgttctgtcaagaccgaatgtcgaagctctgcctcagatttaccgaacacttggaaccgactacgatgagcgagtgctgccatcaattgtgaacgaggtcctgaagagcgtagtcgctcaattcaatgccagtcagctcattacacagcgagagatggttgcccgattagtacgggagaatctgtctcgtcgagctgcgcgattcaatatcctgatcgatgatgtgtctctgacgcatctt

SEQ ID NO: 4331 - DNA, 573 bp, Artificial; identical to SEQ ID NO: 2457
  Synthetic

SEQ ID NO: 4332 - DNA, 132 bp, Artificial
  Synthetic
agaggacaaaagggaaatgatgttccctctccttaaacagtcgaaccttgtgtcaggggggggggggaagtgaagagggtttgtattcatgaaaggagatttgcgcctaagctcaagcgcaaaatgaatcct

SEQ ID NO: 4333 - DNA, 482 bp, Artificial; identical to SEQ ID NO: 2459
  Synthetic

SEQ ID NO: 4334 - DNA, 642 bp, Artificial; identical to SEQ ID NO: 2460
  Synthetic

SEQ ID NO: 4335 - DNA, 557 bp, Artificial
  Synthetic
ccgttatttattatgcatcttgactacccctcgaccacgcgtccgggccgcttaattaatgacaagaacacgaactgagatggagtagtgatactgtaagatctatttaaaacgaatccgattcggcgacagtagcctccgaatcatcatcgattaaattattctttttaaaactcattcctccaaaatccttaacatttctatagttcttgttcggcactgaccgatcactactactatttttccctttgcggacatcactcttttttccggttcgagatcgaaactttgcaagcctgatcgacatagggacatcttccatgaactcatcaacgacttcttctgtaagttccatgggccctccgtctctcacgtttgtaatcttctctctcaaacctaattttatattatttctataaacaatacacaccgacacaaactccagagaaagcggacagaaacccgctgacatcttcacatttctaatattaactaaaacttgccagacgtttctcatcgcgtcctgggtggttatagcataattgggaacgaccttg

SEQ ID NO: 4336 - DNA, 1187 bp, Artificial
  Synthetic
ggaacttgcctgacaattgcagaggaggtgtgagcgtgtgtctggtggacaaaaggatggaaagagccgacgaggccactctcggatcttactacacagcagctgcaaagaaaagatttcagttcaaggtcgttcccaattatgctataaccacccaggacgcgatgaaaaacgtctggcaagttttagttaatattagaaatgtgaagatgtcagcgggtttctgtccgctttctctggagtttgtgtcggtgtgtattgtttatagaaataatataaaattaggtttgagagagaagattacaaacgtgagagacggagggcccatggaacttacagaagaagtcgttgatgagttcatggaagatgtccctatgtcgatcaggcttgcaaagtttcgatctcgaaccggaaaaaagagtgatgtccgcaaagggaaaaatagtagtagtgatcggtcagtgccgaacaagaactatagaaatgttaaggattttggaggaatgagttttaaaaagaataatttaatcgatgatgattcggaggctactgtcgccgaatcggattcgttttaaatagatcttacagtatcactactccatctcagttcgtgttcttgtcattaattaaatggctagcaaaggagaagaacttttcactggagttgtcccaattcttgttgaattagatggtgatgttaatgggcacaaattttctgtcagtggagagggtgaaggtgatgctacatacggaaagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaa

SEQ ID NO: 4337 - DNA, 572 bp, Artificial; identical to SEQ ID NO: 2462
  Synthetic

SEQ ID NO: 4338 - DNA, 233 bp, Artificial; identical to SEQ ID NO: 2463
  Synthetic

SEQ ID NO: 4339 - DNA, 742 bp, Artificial
  Synthetic
gagccccaactcttttttgttttctgtatttctctctctcactttcactctctcttctctcttgtttcttctccttctttctcttggttacccagctaagtgaagctcaacaaccgcaaacatggctgccccctcgagcaagaccaccaagaacctcaatggcaaatggaccatgaacaagacgctctccgactcctcggagccggtgctctccctgcagggcgttggctacctgatccgcaagggcatcagcctggccaccatcaccctcgaggtcgagcagtacgagggcccgcccaagccgcccaacaccgccgccgacgtcgtcacgcacatcgacatcaagcagtccgcgtcgggcctgtcgagcacgcaggagaaccgctgcttcgacaacttcccgcgcgaccacaccgactggctgtttggcaccgtgacgggccgcagccgctgggtgagcctggacgaggtcaccgacgagttcctcaagaagggctgggaggtcgagggtgagggtcagagcttcatcaccaacattgctgagaacaaggagaagggctgggttgccgagcaggtctggggattccagattgttgatggcgagcgcagatactgcagacatattgttgtgaccaagggagcggagcgggctcagatccgactcgtctacgacttcaacgaagagtaaggggggggtttgtgtgacaggtgctcattttgatatcatatagaagagctgacg

SEQ ID NO: 4340 - DNA, 301 bp, Artificial; identical to SEQ ID NO: 2466
  Synthetic

SEQ ID NO: 4341 - DNA, 854 bp, Artificial
  Synthetic
gggcaatcttaacggaatgaagctttcctggtcgccatgagagacatatgcggagaaaccgaaatgtgcaattgtccagcaattgcttttattctagggtctacgagagcctgggtcaacgccaccgtcaggatttgtggcggcgcctcagcagttacgaaccagtcttctgctcatgctcccgcctggggtcgcccttcacaactgcagtagcattggcgtccggatagagcatcaaatctttcgcgagacaagatcgacggatacacaaacatgagctacgaagatactttaattcgatcgagaataacgggtttatcctatataaccaggagaaattccacgagtgacacatcaacaggaggcaccagtcatgactacgtccccataattgttatgactgttattgtcgtggcgatcgttctggtactccttatccttgctcaatacacaaaggtgcttgatcggaaaaagccagccaacggatttgatgatccagaaagcgcacagaatgccggcaaaatcgagaaactgaaccaaaaagctccgactcaatcctacaagagctggaaggagaagagcgaggaagcgactggttccgttaaacaaagtactactcatgtcgtatgtgcaatatgtttggagaccctacaagaagacgatacaattcgcctgctatcatgcgcgcacattttccactctctttgtttggcaaaatggtttttgaagaggcataatacttgtccgctttgtaaggcgtgcttcatgtcttcgtcggagaaatcctcgatacctgtacaggttccagaaagaacacatgcccgatgagaaatctcaaacaataatatatttga

SEQ ID NO: 4342 - DNA, 542 bp, Artificial
  Synthetic
aaaacattgaagacgggaaagccgctggaggttggtacttcctttgatatagtcgcttttttttttcgctgtaaatctttcggattacactatatcatcatgaagtttcacgcaactgcccttacacttgcatatttggcaaactatgcttcggcagcagtggcccagccgaggagtgaagcaaacgagtctgctactcccgaaggcaagacgttctccatctctcaagtatataacgaacagtacaaagcaaccaatgtccccgccacctacattgcagctctggcaaaatatagcccccagctcccagagcacatcaaacatgtgatcatggccaatccggatctgcaccgcagatttggctctcttcttgatgctggtaatcagacgggcactgccgttgccacaccatctccgggagccgattcggaatatgttattcccatcaagattggcacaccccctcaaaccgtgccaataaaccttgataccggttcatcagacctttgggtcttctcgacagacacgtatccgtcccaagt

SEQ ID NO: 4343 - DNA, 571 bp, Artificial
  Synthetic
atgagatgcaagcagtttctgttaagagccaattgcaacagattgcaaggccaatgtacagcaacccacctgttcatggtgcactggttgtctccataatccttaatgatccagaattaaagagtttatggttgaaagaggtcaagggtatggctgatcgaatcattggaatgcggaaggcactccgggaaaatctcgaaggcctaggttcaccattgtcatgggatcacatcaccaatcagattggaatgttctgctacagtgggataacacctgaacaggtggatcgcttaaccaatgaataccatatttacatgacccgtaatggcagaataagcatggctggtgtaacaacaggaaatgtggcgtatttggctaatgctattcatgaggtcactaaaacgaaatgaagctacttcctcttccctcttcggccaatgaaatgaggcttgcaagcggcggcgttttttttttggggggtggtctattgacctttaagatggttgtactacagaaataatccagtgaacatgctggtgtttctccaacttcggattttccctgtatggag

SEQ ID NO: 4344 - DNA, 636 bp, Artificial
  Synthetic
gcaaaataacaattgttggtggcaaattaaagtaaccaatattttcttagaaacggtagatctcagtgtcacaatcctcactttggttttggttcaaccatctttagtcaaaagacatgaggaaacatatggtaccatcagaaaaaaaccatagtatataagccaacaaaaacggtgttctttttttttgtcccattttatttgtagaaacagcaaaaaaatgtatggtcgctagtttagccgaggcgggtcactgcagcatgcatagcatcggcaaggtgaggcactgtcttcgaacttagacctgccatgcttattctcccatcagaggtcatgtaaatgtggaactctttggtcatgaattcaacttgctccttgttcaatccagtaaatgtaaacatcccaatctgtttgataatatgactccagtcaccaggtgtacctctagcttgtatagcttcaaataactgttggcgcatgctctttatacggtcagccatttctttcagctcgatggtccagttgttgtacatatcactgctttttagaatggtggcaacaattgatgctccatgaataggggggctcgaatacatgggccgcacaacaagcttcacctggctctcaaccttacta

SEQ ID NO: 4345 - DNA, 520 bp, Artificial
  Synthetic
ggccgtcattatccgagagaagaagcacttccccttctttgactgtgcctaccagggctttgcctctggcgaccttgctcgagacgccgccgctgtgcgttactttgtcgagcaaggcttcgagctcgtagttgcccagagcttcgccaagaactttggtctttatggagagcgagctggctgcttccacgttgtggctgctcctgccgctgatgccaccaccacaatcacccgcattgcatctcagcttgccattctgcaacgatcagagatttccaaccctcctttgtatggcgccagaatcgctagcaccgttctgaatgacgcccagctcttcgccgagtgggaggagaatctgaagaccatgtccggccgcatcatcgacatgcgcaaagctctccgttccaagcttgaagagttggagactccaggaacctggaaccacatcacagaccagatcggcatgttcagctttactggcctatcagaaccccaagttctcaagctccgcgaggagtat

SEQ ID NO: 4346 - DNA, 236 bp, Artificial
  Synthetic
ggccatccgaaaagtcgttggtgagactcgggaatttgtatgataatggtttgatagatgggcttcgaggacgtgacgataattatcaccgccgctggccaggaacttgcgtggtttcgattagtgttcttttttcctttgtattcgatagcacatgggtgtgtgggcatagatgcagctagacaaatagcaaatacgggtttgagggcctcggggagtttcatcccttgacaacg

SEQ ID NO: 4347 - DNA, 231 bp, Artificial
  Synthetic
atgtggccacgggaatgacgcaaaaggcgccgagagcggaaatggagagaaaaaaaacccaattgcacctcgtgatgatgccactcaaatgtctgtggtcgagccactggcttctacctacgcttacattacctaacaaggaacgaaacattttgcggcaaggagaattggatcattgacttggcgaatgggctaatgaatgtcgtcaattgcaggcctcgtggtttggcg

SEQ ID NO: 4348 - DNA, 248 bp, Artificial; identical to SEQ ID NO: 2470
  Synthetic

SEQ ID NO: 4349 - DNA, 525 bp, Artificial
  Synthetic
aaagaaaatagagaagggggagaaaagaagagagcctcttagaggatgatgctgaatgacgctgtggatggtgaaatgtgagatgagcaaggtttgtgttacatgtatattaagaggattttttctttttgtggacggttttttatatgtgatattatggagaaactagcaaggatggagaaaagggggagaaaaggaacgataagtttatctctgtttgggcatgtatgggtgttaatatgattgacttgtcatatgtgaatgatgagtagatgatgtgatcaacacttggatgagagactcacaaccagatttacgagtcattcatctatacagacataaacgctgagaacgtcatcggaggtattgcttcacttcacatcttgatgctatatgtagctggccgcatttcgtttgctggaaagaggtgcacggattaagatgcaagtagcacatgtacggttgagaaactcaggaacacaaaagatgtacattaaactcccattctagagaacctatttacag

SEQ ID NO: 4350 - DNA, 652 bp, Artificial
  Synthetic
ggcgtctcctacaagaaatcgttcgtttccctctgtcattgcgagcctgttgagcaacacaacaaaaaggcgtcaacacacaaagatccaatcgccagatctaaagcctctgtgctactcagtccaacaattgcacaaagcgacacaacataccgaaatctgcaaacaatgtgtttccgcgtggagccaaaggccaaatactactaccaggaggaaatcattccctcacggccgtaccgccatcaccatcaccatcaccattcttcccaccactcgccgcgagcgagctactcggcggttgagcgctacagcccgcgggtcagcaccagcagctacagacgcagcgtgccgtcgagggtcgtgtatgaggagacaacgcggagtcggtactgaatgggcttttgattaggaccaggaatatcctgtgattttcttactctttgtttttttaacgactctatggtactggttatgggaaatgagacacatgttagaggctagaataatgggcggattgggatggaaactcgaggcaggcgatggtttcatgaggatatgagaacctggaatgcggtgacggcgttggtaacatatatttcgcctttacgatttgaatgaatgagatacataaaacacattctagatgtctcgc

SEQ ID NO: 4351 - DNA, 495 bp, Artificial; identical to SEQ ID NO: 2477
  Synthetic

SEQ ID NO: 4352 - DNA, 319 bp, Artificial; identical to SEQ ID NO: 2508
  Synthetic

SEQ ID NO: 4353 - DNA, 654 bp, Artificial; identical to SEQ ID NO: 2513
  Synthetic

SEQ ID NO: 4354 - DNA, 593 bp, Artificial
  Synthetic
gtagagcaagtgagacgggagattgtggatcagcgttgagggaagtgcttactcgtgaaattctcgtggcctgttttcgccctcatttctttggcccgcctgttggcagacaaataatttccaccaaagtcatgccccgtggatatatcgggtatataagcacgtctgatccaccgacggaaacatcgcgcatattgattgaaatctagatctgagagtcggatgaattgtccgtctccgggcatttctcaatggcgcttacttcaggacgtgattggttcagccctaaggacaagccatgatacattgcaacctttgagttgggcaaatgacagatcatttcaacatctagatggatatacagcaagtgaaggaagtcggaaagagagtaacctctaagaaactggatctttattcttcattcttttcaccaggtggattatgacctaccaagctccggctgaccgaagacattgccgcccgagttagaatgaagaacaatccaagtcgaataaattagttgttatagctatcgtaaaattatctcaaaattaaatacaagttggattatcttgacggtatgaaaacctctc

SEQ ID NO: 4355 - DNA, 734 bp, Artificial; identical to SEQ ID NO: 2995
  Synthetic

SEQ ID NO: 4356 - DNA, 573 bp, Artificial
  Synthetic
gaagcaaccaagaatctgcacctcactcgataataaaaagaaatcggtactcaaggtttataactcattcaaaatgcgttatactgctgtcctcgctgtcctcggcttctccggagtcatggccaacaaaaacttcggacccttcggatttttcggaccctggttcgatggcgacttaactatcgatgacctcgctgactttcagtttcctgagaacccttgtgagttcattggtggtacttgcgagatcgccacttcccttacattctgcgctggtcggggcgacttcagcgttgatttgccttgtggcgttggcctcggctgctgctggcaccaggacaccagcaatgtttggtttgagcaatggaaggagtggctcgagctacacagccgcatcaactaaagccgctttaatgtcttgacgctttgatggcttgacgcttctatggcttgacgcttctatggcttgatgctttaatggcttgacggagtcttcaattggcacggtagtgggtgatggagaaattagccgtactgaactcaatgagagattgttaaccccgattaagtagt

SEQ ID NO: 4357 - DNA, 1050 bp, Artificial; identical to SEQ ID NO: 2521
  Synthetic

SEQ ID NO: 4358 - DNA, 563 bp, Artificial; identical to SEQ ID NO: 2524
  Synthetic

SEQ ID NO: 4359 - DNA, 428 bp, Artificial; identical to SEQ ID NO: 941
  Synthetic

SEQ ID NO: 4360 - DNA, 397 bp, Artificial; identical to SEQ ID NO: 2527
  Synthetic

SEQ ID NO: 4361 - DNA, 483 bp, Artificial; identical to SEQ ID NO: 2937
  Synthetic

SEQ ID NO: 4362 - DNA, 365 bp, Artificial; identical to SEQ ID NO: 2530
  Synthetic

SEQ ID NO: 4363 - DNA, 578 bp, Artificial
  Synthetic
tgaagagtgaagagagacacggccctggttccccccttcacaagagagagtgccctggccaaggttcaacgggccgaggatctatggaacaccagggaccccgaaaaggtggcccaggcctacgctcccgattccatctggcgtaaccgcaacgagttcttccaaggcagagcggcaattgttgagttcttgaggcgtaaatgggacgaggagaaggagtaccgtctgaagaaacgtctcttttgcttcgaggcaaataagattgcggtggaattcgaatacgagtttgttgatggaagcggggtgcaatggtggagagcttatggccttgaacattggaccttcgacgataatggcttgatgaccaatcgtgacatgtctgctaataatgtgcccatcaaggaggaggataggttgttcaagtgagattattttatccttgcaagtgcaatactcccaggcactaggaccacttttttttatttcatcttttttttcttttcaaacttttgttgttgtttttgtaaaaaggaagctttcttttattaaataaaggatcaatgttgcatagggcaaaa

SEQ ID NO: 4364 - DNA, 604 bp, Artificial; identical to SEQ ID NO: 2532
  Synthetic

SEQ ID NO: 4365 - DNA, 214 bp, Artificial; identical to SEQ ID NO: 2533
  Synthetic

SEQ ID NO: 4366 - DNA, 572 bp, Artificial
  Synthetic
gtcgcaatcgatcaaacaaacaccagcacaaaccggcaaagaaataccctgcagtcctcgagactcgcgatagagcagaagtacatcagtcttatttactagcgagcaagacagtcaaaatgtcgtgggcgggattcaagaagaatgtgaaccgcgcgacgacgcaggtgatgatgaagacggggcatgtggaaaagacaaacgatcgcgattacgaggtcgaagagagacggttcaagacgatggaaacagctgcactgcggctgcagaaagaatcaaagggctaccttgactctttgagagccatgacagcttcacagatgcgaatcgccgagacgatagatgcgttttacggcgactccggtgcgaaggatggcgtgagcaggagctacaagcaggccgtcgaagatctcgacgccgaaaccatcaaggccctcgacgggccttaccgaatgacggtgctcgaccccattggccggttctgcgcctacttccccgacgtcaacgaatgcatcaagaagcgctcgcacaagcttctcgactacgatgctctccgagctaaagtgaagaag

SEQ ID NO: 4367 - DNA, 313 bp, Artificial; identical to SEQ ID NO: 2556
  Synthetic

SEQ ID NO: 4368 - DNA, 317 bp, Artificial; identical to SEQ ID NO: 2557
  Synthetic

SEQ ID NO: 4369 - DNA, 1472 bp, Artificial
  Synthetic
gttgtttttttgtttttcatctttcttctttgtcacaatcactttgccgtcttccacggacatttccgcagatctgcatcacagagatctgcatcagagaggatttcaagcttttcctctttgtttgccttcctctcctcttctcttcttggatcacaaaacaatcggcaaaattgacatctcgatattttctgcctccaatcacagccgtcataccacctgtggcgtctttgccatcaattctctgctgcggtgctacccgccctgcagcaatttttcccgctggccgtctgcaggcttgcctcggctgtgggtttttcgtcgaccactgaggcttagtgcccatcagccactaaagcggcttgacgtcgattctcaactttgaacccttttgagctgcctctggcctctgcctcatctctcccacaccctcacgcgcgcagtcttgaatcaacaccccttcacgcactcgccattgccgcgctcctcgtcacgctctgctcgattagccgtctctcgcccattgattgaacctgctctcggcctctgcagccaccctcacgcaacctacgcctgacatcctctgcgtcgctcggctgtctcccggttttatccatcagctgaaccttcaccttcgccttcgctctcaagagggaatccgagggcccggccgttctctgccatctattgttattgccattaacgctgctgctgctgccactgtctcctctactcctgtttcgccctcatatgtctcagccgcctcgccggatgcctctactatcacaccctaaacaccgtattagcatacttgatcttaccaaactgccgttgcagtaacgccggcttcatcttcttgacaatgccgtcgaaaactaacaatggtgtgggagttcaggtcgaggacacaaagatatgcgttgtcatggttggtctcccggcccgcgggaagagctacattgcccagttagcccagagatacctgcaatggctgtcgattccggcagcgactttcaatgtcggcaactatcggcgcaatgacgctccacagccgactgccgacttctttgattttaacaatcccgaaggagagcggaagcgccgtgcggctgccgaggccgccgttgctgacatgcttgcctggttccgcaccggcggcgtcgtcggcatccttgacgcgaccaattctacaaaggagcgccgtaaatgggtcatggacacgtgcaccgctcacggcattgaagtgctctttgtcgagagcaaatgcgatgatgaagaggtcatcatggccaatatccgtgacgtcaagctaacgagccccgactatcgaggccaagatcccgaggccgcggcgcaagactttcgcaatcgcatcagccactacgagaaagtttacaagaccatcaacgccgacgaggatgaggacaactacacctacctaaagctgatgaacgtcggcaagcaagtcatca

SEQ ID NO: 4370 - DNA, 710 bp, Artificial; identical to SEQ ID NO: 2568
  Synthetic

SEQ ID NO: 4371 - DNA, 668 bp, Artificial; identical to SEQ ID NO: 2570
  Synthetic

SEQ ID NO: 4372 - DNA, 470 bp, Artificial; identical to SEQ ID NO: 2580
  Synthetic

SEQ ID NO: 4373 - DNA, 624 bp, Artificial
  Synthetic
gctccatcgatccatccaccgatcgatcgagctctacatcctgcgcaagaacacacgatggtagaggagctcaccgaggagcagattgcagagtttaaggaggcattcagcctcttcgacaaggacggcgatggctgcattaccaccaaagagctcggaacggtgatgcgatcgctgggacagaacccgacggaggcagagctccaagacatgatcaatgagatcgatgccgacggcagcggcacggtcgatttcccagagttcttaaacctcatggccaggaagatgaaagacaccgactccgaggaagagctcaaggaggcgttccgagtcttcgacaaggaacagaacggcttcatctccgcggcggagctgcggcacgtcatgaccaacctcggcgagaagctcaccgacgacgaggttgacgagatgatccgcgaggcaaacgtcgacggcgatggacagatcaactacgaagactttgtaaagatgatgatgtccaagtgatccagggaagtcgccattgattgctctgctcgctctatagatcaagggaatgcgaccacgatgtattgctctgtctctattgtgcaattccttgccacctctgtcttgtatggaata

SEQ ID NO: 4374 - DNA, 542 bp, Artificial; identical to SEQ ID NO: 2575
  Synthetic

SEQ ID NO: 4375 - DNA, 595 bp, Artificial; identical to SEQ ID NO: 2574
  Synthetic

SEQ ID NO: 4376 - DNA, 784 bp, Artificial
  Synthetic
agccattctctccgcgacggtctcgtcttccccacccctcgcctcctcgcgcgctcggtgagagaagcgaagaagaagaagaagaggaggaggaagaagccaggctaagcccagcggcatggcggaccagctcaccgacgaccagatcgccgagttcaaggaggccttcagcctcttcgacaaggacggcgatggttgcatcacaaccaaggagctgggaaccgtgatgcgttcgctggggcagaacccaacggaggccgagctccaggacatgatcaacgaggtcgacgcggacggcaacggcaccatcgacttcccggagttcctcaacctgatggcacgcaagatgaaggacaccgactcggaggaggagctcaaggaggcgttcagggtgttcgacaaagaccagaacggcttcatctccgccgccgagctccgccacgtcatgaccaacctcggcgagaagctgaccgacgaggaggtcgacgagatgatccgcgaagccgacgtcgacggtgacggccagatcaactacgaggagttcgtcaaggtcatgatggccaagtgaggcaccacttcccctgccgatgatggcatagtaccctgggaggaggaaaccgtgcattgccgtattagtaaggggatgcaaacactggtttcagtcgtcttccctgatgaagaaaaccgaaccgtactagttgtagttgctgaacatttttctatctctccagtctctccggtgtgccatggaacttcttgcttgatttttctgtgtgaatctgtt

SEQ ID NO: 4377 - DNA, 611 bp, Artificial
  Synthetic
gaattcacaacagagactcggccatcataattccgcgttctctaaaatttaccttttagagatcccatcttcctcttgttcttcgttgatattatatcacacagggaagaaacaaaatcatggctgatcaattaactgacgaccagatctctgagttcaaggaagctttcagcttattcgacaaggatggagatggttgcatcacaaccaaggaactgggaactgtcatgcgttcactaggtcagaacccaacagaagcagagctccaggacatgataaacgaggttgacgctgatggaaatggaacaattgattttccagagttcctcaaccttatggcacgtaaaatgaaggatactgactcagaggaggaactaaaagaggcttttagggtattcgacaaggaccagaatggtttcatttctgcagctgagttgcgccatgtcatgaccaacctaggggagaagcttacagacgaggaagttgatgagatgattcgtgaagctgatgtagatggtgatggtcaaatcaactatgaggaatttgtcaaagtcatgatggccaagtaaggagactcatccccttaccactaaaaagggaaaagagaaaca

SEQ ID NO: 4378 - DNA, 725 bp, Artificial; identical to SEQ ID NO: 2578
  Synthetic

SEQ ID NO: 4379 - DNA, 617 bp, Artificial
  Synthetic
gttttggagagacggggagctgagatggccgaccagctgacggaggatcagatcgcagagttcaaagaagccttcagtctttttgataaggatggagatggttgcatcacaacgaaggaactggggactgtgatgaggtctctgggccagaatccaacggaaggagagctacaggacatgatcaatgaagtggatgcagacggaagtggaaccattgacttccccgagttcctcaacctcatggcccgcaagatgaaggacaccgactctgaggaggagttgaaagaggccttccgtgtgtttgacaaggaccagaatggatatatctctgccgaagagcttcgtcatgtcatgactaacttgggagagaagctgaccgacgaagaagttgatgagatgatacgggaggcggacgtggacggcgatggccaaatcaattacgaggaatttgtgaagataatgctgtccaagtgaggagaccgaacgggaatacttgggttgtgtgtgaggggactttctcttactcgtagcaattctttcagtatgaaattgagcaactattgccctagtctcttgtaggccttgcattgacttgccttgccttgcaaatcagtaat

SEQ ID NO: 4380 - DNA, 695 bp, Artificial
  Synthetic
cccggaaatgaattgaaaagacgattattttgtctgaaattccagaacaatcttctctcttaagttttctctgttgttgaattgaagaagaaaatggcagatcagttaaccgatgaccaggtctctgagttcaaggaggccttcagcctattcgataaggacggagatggttgcatcacgactaaggagcttgggactgtgatgaggtcgctcggacagaaccccaccgaagcagagctccaagacatgataaacgaggtggatgcagatggtaacggaaccattgacttccctgagtttctaaacctcatggcccggaaaatgaaggatactgactccgaggaggaactgaaggaggcgttcagagtgttcgacaaggatcaaaatggcttcatctccgctgctgagcttcgtcatgtgatgactaaccttggggagaagcttactgatgaagaagttgatgagatgattagggaagcagatgtcgatggtgatggtcaaattaactatgaggagtttgttaaggtcatgatggctaagtaatttcaccatctcttattgaagttgaagtttagacttgttaaaaatgtgaaaattccaaaaatatttcattggataggatttgcctagtgtaatgtgttccgttgtaccatcttggatgtattggacctggaatgaatgtaatgctttattgt

SEQ ID NO: 4381 - DNA, 723 bp, Artificial; identical to SEQ ID NO: 2581
  Synthetic

SEQ ID NO: 4382 - DNA, 593 bp, Artificial; identical to SEQ ID NO: 2584
  Synthetic

SEQ ID NO: 4383 - DNA, 796 bp, Artificial
  Synthetic
tttctttaaaaacggtcaaagtgccaaaaacgaaatcaaaaggcataaaacttgcgcatagggttctttgaaatcgtgaaaagagagagagagagagaaatggcagagcagctaacggaggagcagatcgctgagttcaaggaggcctttagccttttcgacaaggacggcgatggctgtattactaccaaggaattgggaacagtgatgagatcacttggtcagaatcccactgaagctgaactacaggatatgatcagcgaggttgatgctgatcagaatggaaccattgattttccagagttcttgaatctgatggcacgtaagatgaaggacactgattctgaggaagaactcaaagaagctttcaaggttttcgataaagatcagaatggctttatttctgcagctgagcttcgtcatgtaatgacaaaccttggagagaagctgactgatgaagaggttgatgagatgatccgagaagcagatattgatggcgatgggcaagttaattacgaggagtttgtccgcatgatgcttgccaagtgactttagattctcgtgtattttgcgacggccacttagttacctataacttctagctgtcagtttatattctgtgttgctgttaagacaaacaaatgtgccctatgcttttactagtatctagactcctttcagtttatatgttttaacttccgggctaatggtgtatacagctatagtcccttgcccattcagagggtaaaagaaaaggagaaattagatagtggcattggtaatatcttgttagttg

SEQ ID NO: 4384 - DNA, 624 bp, Artificial; identical to SEQ ID NO: 2586
  Synthetic

SEQ ID NO: 4385 - DNA, 654 bp, Artificial; identical to SEQ ID NO: 2587
  Synthetic

SEQ ID NO: 4386 - DNA, 521 bp, Artificial; identical to SEQ ID NO: 2582
  Synthetic

SEQ ID NO: 4387 - DNA, 631 bp, Artificial
  Synthetic
gtctctcctcctcccatctccgcttcccttcttcttcttcttcgttgatccactcacccgccgcgcgcagaggaggccatggcggatcagctcaccgacgaccagatcgccgagttcaaggaggccttcagcctcttcgacaaggacggcgatggttgcatcacaaccaaggagttgggaactgtcatgcgttcactagggcagaacccaacggaagctgagctccaggacatgatcaacgaggttgatgctgatggcaatggaaccattgattttcctgagtttctcaatctgatggctcgcaagatgaaggacactgattcagaggaagaactcaaggaggccttccgggtgtttgacaaggaccaaaatggcttcatctccgctgctgagctccgccatgtgatgacaaatcttggcgagaagctaactgacgaggaggtggatgagatgatccgtgaggctgatgttgatggtgatggtcagataaactatgaggagtttgtgaaggtcatgatggccaagtgagccatggaaccatactctaaggcagaggagattgtgtgttgcatagtcctagttaagatgcaacacttgttttatcaatttccagtgaagcatcctactagct

SEQ ID NO: 4388 - DNA, 526 bp, Artificial; identical to SEQ ID NO: 2572
  Synthetic

SEQ ID NO: 4389 - DNA, 620 bp, Artificial
  Synthetic
cgccactcgttccccttccttcctctcctcctctcgcggaaccttctcgaagcttccacacccccaacctcgcctccaccaccaaccccccatggcggaccagctcaccgacgagcagatcgccgagttcaaggaggcgttcagcctcttcgacaaggacggcgacggttgcatcactactaaggagcttggaaccgtgatgcggtcccttggtcagaacccaactgaggcggagctgcaggacatgatcaacgaggttgatgctgatggcaatgggaccattgacttcccagagttcctgaacctgatggcgaagaagatgaaggataccgactctgaggaggagctcaaggaggccttccgtgtgtttgacaaggaccagaacggtttcatctcggctgctgagctccgccacgtcatgaccaaccttggtgagaagctgaccgacgaggaagtcgacgagatgatccgtgaggctgacgtcgatggcgatggccagatcaactacgaggagttcgttaaggtcatgatggccaagtgaggagggttcccattaaataagttctgtctgaagtgaactaaaactgtcagggcctacaacaaagctgtactttgtgatg

SEQ ID NO: 4390 - DNA, 701 bp, Artificial
  Synthetic
ctctccgcgacggtctgggcttccccacccctcgcctcctcgcgcgctcggtgagagaagcgaagaagaagaagaagaggaggaggaagaagccaggctaagccccgcggcatggcggaccagctcaccgacgaccagatcgccgagttcaaggaggccttcagcctcttcgacaaggacggcgatggttgcatcacaaccaaggagttgggaactgtcatgcgttcactagggcagaacccaacggaagctgagctccaggacatgatcaacgaggttgatgctgatggcaatggaaccattgattttcctgagtttctcaatctgatggctcgcaagatgaaggacactgattcagaggaagaactcaaggaggccttccgggttttgacaaggaccaaaatggcttcatctccgctgctgagctccgccatgtgatgacaaatcttggcgagaagctaactgacgaggaggtggatgagatgatccgtgaggctgatgttgatggtgatggtcagataaactatgaggagtttgtgaaggtcatgatggccaagtgagccatggaaccatactctaaagcagaggagattgtgtgttgcatagtcctagctaagatgcaacacttgttttatcaatttccagtgaagcatcctactagctgtagtcgctaaaaaggattttcctgctatgttcctctg

SEQ ID NO: 4391 - DNA, 681 bp, Artificial
  Synthetic
gttccacgtgcttttctgctctcttttggtttcacgactgcccaactcaacctgcccagcgctctctctctctctctctctctcttcctggtttgggtttctatggccgcagtgatggtcgagcagcccctgacagaggagcaaatagccgaatttaaggaggcctttagtctttttgatagagatggagatgggtgcatcacaacaaaggagttgggcacggtgatgaggtcgttagggcagaaccccactgaggccgagatccaagacatgatcaatgaagtggatgcagacggcaatgggatcatcgacttcatggagtttgtgggcctcatgtctaggaagatgaaggatactgactcagaagaggagctcaaagaggccttcaaggtctttgacaaggatcaaaatggcttcatctcagcccttgagctccgccacgtcatgaccaacctcggtgagaagctcagtaacgaagaggttgacgagatgatccgagaagccgatgtggacggggatggccagattaactatgaagaatttgtcttaattatgatgagtagtaagtaagtaggacccccatatagaagcctcttaaacccttctctaagtcttgtgtgtactcatgaaaggaaacatccccagactgagccctttggtgtactaaagcatcaccaaagc

SEQ ID NO: 4392 - DNA, 532 bp, Artificial; identical to SEQ ID NO: 2589
  Synthetic

SEQ ID NO: 4393 - DNA, 292 bp, Artificial; identical to SEQ ID NO: 2594
  Synthetic

SEQ ID NO: 4394 - DNA, 1202 bp, Artificial
  Synthetic
  misc_feature (735)..(736): The residues at these positions can be any nucleotide.
  misc_feature (741)..(741): The residue at this position can be any nucleotide.
cttcaggaagctagcaaaggcggcggcaggtgcacccgtcgcgtgcattcagtagagaaggccattattccaagtctaattttgctaaccctagcttcccctttggagctattgctgccgttgctggttgtgtttcctactattactgctcttcttctcctcatttggtgtacttagagcaaatcaatgaagattctggtcaaaaagttgctttaaatcctgataaatggattgaatttaagctgcaagatcgagcaccagttagccacaatagtcatctgttcaggttttcattcgatccttcttcaaacttaggtcttgatattgcatcttgcattcttacgagggcaccgatgggagaaaatgctgaaggaaaaccaaattatgtcattcgaccttatactcctatatctgatccagattccgagggatactttgatttgttaattaaggtttatcctgaagggaaaatgagccagcattttgcaagcttaaagccaggcgatgtacttgaagtgaaagggcccattgagaaattgcgttatagtacaaacatgaagaaacatataggcatgattgcagggggcagtggcatcactccaatgctccaggtgatagaggccattcttaaaaaccctgatgataatactcaggtctcattgatttatgctaatgtgtcacctgatgacatattgctaaagaagaagcttgatgtacttgcggcaactcacctcnnattcncaaggtattttacactgtagatagtccaaccaatgattggagaggcggcatcggttacgtatcaaaggacatgattgtgaaaggactacctccgcccagtgatgatacacttatactcgtatgtggtcctcctgggatgatgaaacatttatctggcgaaaagccaaaacctcgtgagcaaggcgagctaactgggctactcaaggatgtgggctttacagaaaacatggtttacaaattttagttagtccgttaactttactttcccttatcctttattgaataaaatttttttgaagaaacacaatatcctacaccacataatccgagcgtttggacgagcattcaggatgtttactaaaggccatgttacagattgtgttaagtgaggaattctttttgaaacatctagacaacacttattttagggggaaaataaaaaagcttgatatacctgtaag

SEQ ID NO: 4395 - DNA, 637 bp, Artificial
  Synthetic
acttctcatttctgagtcctgactgtgtccctcttgaagaagaaggtgtgtgagagagagagagagatgggagagatggtgcaggtcctgctggaagatcccataacccgagctggcatcgccatcgccgtcgtcgctgtcgtcgccggagccgcttacctcgcccttgcttccaagaagcccaaaggatcgatagatccagagaacttcaggaaattcaaattagtgaagagaactcaagtcagtcacaatgttgtccggttcaaatttgcattgccaacaccaaattcggtgcttggtttgcccattggtcagcacatcagctgcgggggtaaagatagtgaaggtgctgatgtgattaagccttacactccgacaacattagattctgatcttggtatttttgatctggttattaagatatatccccaaggtagaatgtcgcaccattttagtaagcttcaagtcggtgattacttggatgttaagggtcctaagggtagattcaagtataagccaggccaagtgagagcatttggaatgcttgcaggtggtacgggcatcactcccatgtttcaggtgactcgggctattttagagaatccgaatgacaagaccaaaatccatctaatctatg

SEQ ID NO: 4396 - DNA, 682 bp, Artificial
  Synthetic
tgatcaagacaaagggaggagagaatggtgagccaggaggtggcgaatccaacgtttccagtgctaagcatcggcatcgcactactctccgtcgtcgccgccgccttcttcttgtggatttccggccgccgccgccccaagaaggctttggatccggagaaatggatagagtttaagctggtgaaaaggctccaagtgagccccaatgtcacaaagtttcgctttgcgttgcagacccctaccacgattttgggacttccagttggtcagcatatgacttgccgtggtaaggatagagatggagctgaagtaatcaagccttacacaccgacaacacttgattccgatgttggatactttgaactcgtcgtcaagatttactcgctgggaagaatgtcgtatcattttgccgatctcaaggagggagatttcctatcctgtaaaggacccaagggccgcttttcttacaagccaaacagttataaggctttcggtatgcttgccggtggttccggcttgactccaatgtatcaggtgagtcgggcgattttggagaaccccgaggacaaaacaaagattttcctcatttacgggaacgtcatgtatgacgatatactgctcaaggaagagctggacagcatggtgaagaaataccgggtcgcttcggtgtctactacgtgct

SEQ ID NO: 4397 - DNA, 705 bp, Artificial
  Synthetic
gatctgctattgtgtccaagccctgggcccccattgctgccacctctgtagttgccgccgccgcctcttcctactacttctccaacatggccatctccaacgacgctaagaccgccaccctcaagggcgacgaccagtgggttgatctcaagctcaagtcctccaaggacctgtcccacaacaccaaggccctcatcttcgagctccctacccccgactccaccctcggtcttaccaccgcttccgctctcctcaccaagtacgtgacccctaagggctccaacgttgtccgaccttacacccctgtttccgaccctgactccaagggcgagtttgagctcgtcgtcaagtcctaccccgagggtaagatgtccaagcacatccacgagctcaaggagggtgacactctgtccttcaagggtcccatcatcaagtatcagtggcagcccaacctccacaaggagatcaccctgattggtgccggaaccggcatcacccctctgtaccagctcatctctgccatcaacaagaaccccgaggataagaccaaggtgaacctcttttacggtaacgccactgagggtgacattctcctcaaggacgagattgacgccatcgccaaggccaagccccagcagttcaacgtccactacttcctcgacaagccttccgacaactggaagggtgagaacggatttatctccg

SEQ ID NO: 4398 - DNA, 714 bp, Artificial
  Synthetic
aaaagggaaagcaagctttagatttcagagttgtttcatccgcaaactctgttaaacagccctagtagtccaccatatgcaaataataacaatctttcctcagctataaatgacagcattctcgatggagcttaaatatcaatgaaaggataaaaattaaaaaaaatgcaaagaagaaaaggaagttaaaactggaattgcatctctggggtgtatccaagggcttcaagatgagcagccatagccttgttcattggaggtggaccacacctcagtatctgaatgtcagatgccggggcaggacaatgattctgaatcatttccttggacacaaatccaacaccaccgctccatacttcaggaggctgattcagtacgtaataaattttgaaacggtcaggatagttagcagcaaggccatccaactgttcctttaaaagtatgtcttcataggtaacattagcatatatcaagtgcacttttgtcttgtcatttggattttcgagaatagctctagcaacctgaaacattggggtaatgccagagcctccagcaagcattccaaatgctctcacttggccaggctggtacttaaagcggcccttaggtcccttcacagccatataatcaccctcacgcatttctcggaaatgatgagacatccttccttgaggatacatcttaataactagttcaaaatatccaacatctgag

SEQ ID NO: 4399 - DNA, 430 bp, Artificial
  Synthetic
tcgaccattaccatcatacagccaacctctacataagcacaaataccattcaaaatgtcttacggcggtgacaacaacgacaactacggctctcgccgtaatgacgacaactttggctccggaggagattctttcggctctggtggaaaccagcaatatggctccggaggagactcatttggctctgggggagattcatacggctctggtggaaatcaattcggctccggcaaccgccgtaacgatgacagctcatttggtaccagtggccagggcgagttcggctctggaggtaactatggcagctctggcggtgactcctatgggtctggaggaaacacctatggctccggcggcaatgacaactttggctctgggggcaatgatacgtacggctcgtcccgtaaccaagagtcttcttttggatcca

SEQ ID NO: 4400 - DNA, 466 bp, Artificial; identical to SEQ ID NO: 2599
  Synthetic

SEQ ID NO: 4401 - DNA, 639 bp, Artificial; identical to SEQ ID NO: 2603
  Synthetic

SEQ ID NO: 4402 - DNA, 688 bp, Artificial; identical to SEQ ID NO: 2608
  Synthetic

SEQ ID NO: 4403 - DNA, 571 bp, Artificial; identical to SEQ ID NO: 2609
  Synthetic

SEQ ID NO: 4404 - DNA, 272 bp, Artificial; identical to SEQ ID NO: 2610
  Synthetic

SEQ ID NO: 4405 - DNA, 334 bp, Artificial; identical to SEQ ID NO: 2611
  Synthetic

SEQ ID NO: 4406 - DNA, 698 bp, Artificial; identical to SEQ ID NO: 2614
  Synthetic

SEQ ID NO: 4407 - DNA, 257 bp, Artificial; identical to SEQ ID NO: 2617
  Synthetic

SEQ ID NO: 4408 - DNA, 533 bp, Artificial; identical to SEQ ID NO: 2621
  Synthetic

SEQ ID NO: 4409 - DNA, 656 bp, Artificial; identical to SEQ ID NO: 2623
  Synthetic

SEQ ID NO: 4410 - DNA, 781 bp, Artificial; identical to SEQ ID NO: 2625
  Synthetic

SEQ ID NO: 4411 - DNA, 191 bp, Artificial; identical to SEQ ID NO: 2626
  Synthetic

SEQ ID NO: 4412 - DNA, 211 bp, Artificial; identical to SEQ ID NO: 2638
  Synthetic

SEQ ID NO: 4413 - DNA, 505 bp, Artificial; identical to SEQ ID NO: 2643
  Synthetic

SEQ ID NO: 4414 - DNA, 97 bp, Artificial
  Synthetic
ctgccagatttgcccaagtgcagctggggggggaggttgttagcatgtcgtctcggtgccaatcacccggtatgtaccaaagggagatagcctcttt

SEQ ID NO: 4415 - DNA, 581 bp, Artificial; identical to SEQ ID NO: 2657
  Synthetic

SEQ ID NO: 4416 - DNA, 137 bp, Artificial; identical to SEQ ID NO: 2658
  Synthetic

SEQ ID NO: 4417 - DNA, 82 bp, Artificial
  Synthetic
acggtgtccatgccaggcggaggggcgggaccagaggggtaagctccgcgccaccatgcctttacaaaaagtatcattgatg

SEQ ID NO: 4418 - DNA, 505 bp, Artificial; identical to SEQ ID NO: 2660
  Synthetic

SEQ ID NO: 4419 - DNA, 471 bp, Artificial; identical to SEQ ID NO: 2677
  Synthetic

SEQ ID NO: 4420 - DNA, 475 bp, Artificial; identical to SEQ ID NO: 2679
  Synthetic

SEQ ID NO: 4421 - DNA, 539 bp, Artificial; identical to SEQ ID NO: 2683
  Synthetic

SEQ ID NO: 4422 - DNA, 501 bp, Artificial; identical to SEQ ID NO: 2684
  Synthetic

SEQ ID NO: 4423 - DNA, 817 bp, Artificial; identical to SEQ ID NO: 2685
  Synthetic

SEQ ID NO: 4424 - DNA, 353 bp, Artificial; identical to SEQ ID NO: 2686
  Synthetic

SEQ ID NO: 4425 - DNA, 418 bp, Artificial; identical to SEQ ID NO: 2687
  Synthetic
  misc_feature (183)..(183): The residue at this position can be any nucleotide.

SEQ ID NO: 4426 - DNA, 329 bp, Artificial; identical to SEQ ID NO: 2688
  Synthetic

SEQ ID NO: 4427 - DNA, 89 bp, Artificial; identical to SEQ ID NO: 2704
  Synthetic

SEQ ID NO: 4428 - DNA, 408 bp, Artificial; identical to SEQ ID NO: 2710
  Synthetic

SEQ ID NO: 4429 - DNA, 613 bp, Artificial; identical to SEQ ID NO: 2722
  Synthetic

SEQ ID NO: 4430 - DNA, 623 bp, Artificial; identical to SEQ ID NO: 2736
  Synthetic
  misc_feature (430)..(430): The residue at this position can be any nucleotide.

SEQ ID NO: 4431 - DNA, 626 bp, Artificial; identical to SEQ ID NO: 2741
  Synthetic

SEQ ID NO: 4432 - DNA, 452 bp, Artificial; identical to SEQ ID NO: 2742
  Synthetic

SEQ ID NO: 4433 - DNA, 518 bp, Artificial
  Synthetic
gaaaaaggattaatcgcaactccgagatcctgctgaatcacaatgagacctactcaggttcgtctgggcggcggcgcccctcaacccaagactggccactggctcggtgactggggctcctttggtggtgccaagcagaagggcattatcgactacggcctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatgttgaattatgggtgtccaggggacacagtgtatatcagcgtctagattaggagaaaacaatagaaacgtttgactctacgagatatttgattctgttcttcgtcaagagattgatacactaatttgacgaaaacacaaaagaaa

SEQ ID NO: 4434 - DNA, 657 bp, Artificial; identical to SEQ ID NO: 2558
  Synthetic

SEQ ID NO: 4435 - DNA, 409 bp, Artificial
  Synthetic
cccacgcgtccgcacaactcaaccacactttcaactctcaactacaccacaacttacaatctcatctcgcgaccaaccaactttcacaatggagactgtcaagcaagccgtcaactacgtcgctgagtccgtccagggcgctgcctctggtatcagcaaggagaccaacaaggagattgccaaggacagcaacgtcgacgtttccactcgtttgtccgctggcaaggacgcccttggtgacaagatcgacgagactggccacaacaacaaggccgaggctcacaagcagctggctgagcacaactagattggcataaggagcttcgattgcttcacaggcgttgaaccggatcagagcgaagggaatatatagcctcactaggcaggaattgatgatttgaattcgcac

SEQ ID NO: 4436 - DNA, 422 bp, Artificial
  Synthetic
tcgacccacgcgtccgaaacaatctcagatcttcatctcaactttcaatcttccacacaagcaaataaccaaccaaccaaccaatcacaatggattccatcaagcagggcgccaactacgtcggtgagaaggttcagcaggccacctctggtgcctccaaggagaccaacaagcaggtcgccaaggactccgatgcctctgtcggcactcgtgcctccgctgccaaggacgctctcggtgacaagatggacgagtccaagcacgacgccaagggcgaggcccacaagcaggccatctaaatggactgagtgagagggaacgatgacaacacttttgcttctaccccgtcttgagagacaaatagtcgatacccctatgagaactcaataatacaactttttcagccgaaaaaaaaaagaaaa

SEQ ID NO: 4437 - DNA, 762 bp, Artificial; identical to SEQ ID NO: 2850
  Synthetic

SEQ ID NO: 4438 - DNA, 668 bp, Artificial
  Synthetic
tcagctcacactctccaggctcacacaaaactcactacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacctggtccgttggcagcgccatctccaacccaacaacccttgctcaaggcggttcctatggcgagaccttctcacgagaccccgtaaccggcggtcgtgccatcaaggtcaccgtccagcccgatggcctctacactggcaagccccagaccaacttcgccatcaaccttgagggcaacaccatctggtacgatctttcagatgtctttggcgatgccttcaacggccacaaggtcgttgtttccagcgccaacactgcttgcccccagattgtttggggcagcggaatccctcctgccggaagccaggtcaagaactgcggtgcggataaggatgtgactttgactctgtgtgcttagagttaagggaggacggaatcatgtcaagggaaaggtttaaatcaagtttatgatagaatttcaagtcctagctatgtttaagacttatgacagtatgaattgatgagtttactgc

SEQ ID NO: 4439 - DNA, 711 bp, Artificial; identical to SEQ ID NO: 2908
  Synthetic

SEQ ID NO: 4440 - DNA, 551 bp, Artificial
  Synthetic
tggataattgaccgttgatactgattattcgcctgagtaacaaattctacctacatttactgcctgccctctcctatttcgccatcgaaaaggcccgtctgttgtcgccgccgaagcagttagcaggggggtcatacgctaaaccacccctcctcctctttaacgaccacctcctctcttctctcactctcacctcctcctcctctccatcaaacatctcgactccctacagccaaaagcttctctcatgtccgactacgctcctcccacagggcctccgccgcccaaggcccccgaagttcccgctggctgggccgcccggtggaacgaccaatacaaagaatggttctacgtaaatatctacaccaaaaagtcccaatgggacaagcccaccagtcctgtcttccctgacggagacgccccgccttccgggcctcccccaggctatgacggccacaacgctccccgcacgtccgatgccaagacgaacccctatggcgatcagagcaacaactttggaggctcatcatcaaggcagacgcaggaagacg

SEQ ID NO: 4441 - DNA, 374 bp, Artificial; identical to SEQ ID NO: 2910
  Synthetic

SEQ ID NO: 4442 - DNA, 643 bp, Artificial; identical to SEQ ID NO: 2911
  Synthetic

SEQ ID NO: 4443 - DNA, 524 bp, Artificial; identical to SEQ ID NO: 2423
  Synthetic

SEQ ID NO: 4444 - DNA, 92 bp, Artificial
  Synthetic
tactcttgccttcccaacgacagcggtgggcaagtgtgcagcactgtcggtcagtgggtgttggctggcacctgccctcccaagactgtgtg

SEQ ID NO: 4445 - DNA, 653 bp, Artificial
  Synthetic
atcgcactgagactcccccatcgctgacgcaagatggcttctcaggcggcagcaaaggctgctggaggcgttgtttccattgcaaagaaacaaaccctccagtccaccggcttgtgggagaccttccgcaaggccttcgccctcgaccccaatcgctccaacggcgtccccctgaacccttacttccgaaacccgacgcccggagccttggaccccctcagcttcgacgaccccgtcactcttcccgctggcgacattgccgacaacgcctactggaagcgtgatgtccgtcgcgcgtacccgcagctcagcgtcgttacgcagggcgacgccgtgtcgttgttgacggttggaagcgccgcacagcccaaggtcgagctgattggcgaggccggcgagaaggctctcgttgcggcgcagaaggagggcgagacgacgggcctggccaagttcctggagaaggcgcccaaggatgtggcaaaggacgtgttcgtcaatggattgcctccgctgccgagcggacaggccctggaggctggaggatgggatgtgcacaagtacgagctcaatgaggatcagacatatggtgaaggctatcctaccaggacgttcaaataagacgggcaatagggtcgacttgtgtaaatacagat

SEQ ID NO: 4446 - DNA, 732 bp, Artificial
  Synthetic
acagcagccatgaggtacattcactctcaggagatcctggaaattccagagggcgtcaaggtcaacatcaagacccgtatcgtcaccgttgagggtccccgaggcaagctcaccaagaacctcggtcacttggctgtcaacttcggtcaccccaagaagaacaccatctccatcgagatccaccacggcaaccgtaagaatgtcgccactctccgtaccgtccgctccatcatcgagaacttgatcaccggtgtcaccaagggcttcaagtacaagatgcgatacgtctacgcccattttcccatcaacgtcaacctggacaagaacaaggagaccggtctgttcgaggtggagatccgaaacttcatcggcgagaagatcgtccgacgggttaccatgcacgagggtgtcgatgttgagatctccaaggcccagaaggatgagctcatcctgaccggcaactcactcgagaacgtttcccagagcgccgcagatatccagcagatctgccgggtgcgcaacaaggatatccgaaagttcttggacggtctgtacgtttccgagaagggcaacgttgttgaggaggcttaaatgtaccggacaaggatctctgtttcttttgcgtttctgggactccggagtggcgaaggttcatcattgcatgtcacgtagcaacggggctactcttttacaaaaaatacattaaaaagtattttgtaacaaaaaaaaaaa

SEQ ID NO: 4447 - DNA, 306 bp, Artificial; identical to SEQ ID NO: 2942
  Synthetic

SEQ ID NO: 4448 - DNA, 783 bp, Artificial
  Synthetic
gttgccgccgtcaagggagccctgcggtctggccgtcaggtcctggccattgtccgcaaccaggcctctgctgataagctctacaagcacgtcgggtcatcccagggcatccaggttgtcgaggccagtgtcgtgtctgacacgggggtcaagggcgtcgtcgaccaggttaaggccgggaagctgccagccttccagcacgtttacacctgcgttggtggcgagtataccgacgttccacttaaggacatcaccaccgagaggctccgcaagaacattaacatggcctttgagtccaacttcttcgcttaccgtgacaccatcgagtatctttataagcagaaccaccctaacagcacatggactatctgtactggctcccagggtgatgaggctatgtttgccctacctgccatgggccaaggccctctcttctccatggccactgccgccgcccgtgagaacgagaagaccaacgtccgcgtaaacgaggtgtatctgatgttccgcgttgaggttgacgaggctgccaaggagcatggcgtctcaagcagctccgaattcgcctccgtctacgaaggatttctgaacaaccctgagatccgcagctcgcgcgttcgtgttgcctcgcctgctgacttcaccgacctgaagtgggctaagaagttctaaaaagactgatgcgtcttttttaaaccttcgtgtttctctccattaagcattttgagaaatcatctccctgttgctggctgattacacatggttcagtagttgacaatactg

SEQ ID NO: 4449 - DNA, 196 bp, Artificial; identical to SEQ ID NO: 2944
  Synthetic

SEQ ID NO: 4450 - DNA, 479 bp, Artificial
  Synthetic
cccacgcgtccgcccacgcgtccgcccacgcgtccgcatcaaagaacaaacgcatcgttcaagatgagagccaaatggaggaagaagcgcgttcgtcgccttaagcgcaagagaagaaagatgagggctcgctccaaataaacgactcgctctaccacttgacttgacacatctttcacattttgaatgagttcacgataaaacacgacaagcaaagctgctgcaccacggtaccactctatgaccgattacagccatcaagttggaatcagcatattggtgcgcctctccaattcagctacgggagtcaatggacgaacgcgagagatgaggactggacaatttcagtcaggtggagacatcgttttgaggacgcgaaggccatgaagcaaaacgctgctgcaagaagcacgcttaggatcgatacgttgcttgacaaagatcaaaggcagaatttacttcatttccaaaccaaaaag

SEQ ID NO: 4451 - DNA, 413 bp, Artificial; identical to SEQ ID NO: 2947
  Synthetic

SEQ ID NO: 4452 - DNA, 523 bp, Artificial; identical to SEQ ID NO: 2950
  Synthetic

SEQ ID NO: 4453 - DNA, 551 bp, Artificial; identical to SEQ ID NO: 2951
  Synthetic

SEQ ID NO: 4454 - DNA, 531 bp, Artificial
  Synthetic
tggacaagctgattcatgtgttgtgacaagaagcaacttcaaccacttatattggacaattactcaacaactagcacaccatactatcaatggttgcaacctaaggcctggggacctgtttggaactggaactatcagtggaccagaaccagaatcctatggatgcttgcttgaattgacatggaatggacaaaaacctctgtcttttggtggaactacccgtacattcttagaagatggagatgaagtaactttctttggttattgtcagggcaatggatacaaagttggttttggaagatgctctgggaagattgtcccggctccacaatgagcatgacttactacattgccctgcccatgagcaatggggaaatgttgcctgttgtatacaataattccaagcttggtttctgatcaaaattaggagtagaatcagaagaaatcgtggaaaactcttggctaggacaagtgagagcattatgtattctacattattttactgcaaacaagtaccaattcatgttgaaa

SEQ ID NO: 4455 - DNA, 500 bp, Artificial; identical to SEQ ID NO: 2952
  Synthetic

SEQ ID NO: 4456 - DNA, 627 bp, Artificial; identical to SEQ ID NO: 2953
  Synthetic

SEQ ID NO: 4457 - DNA, 79 bp, Artificial
  Synthetic
cccagcagcgtcactatctcctgaccatgcggccacttttgttttattacccgagagagcaaaagtcgtcccatcccat

SEQ ID NO: 4458 - DNA, 333 bp, Artificial; identical to SEQ ID NO: 2954
  Synthetic

SEQ ID NO: 4459 - DNA, 493 bp, Artificial; identical to SEQ ID NO: 2312
  Synthetic

SEQ ID NO: 4460 - DNA, 623 bp, Artificial; identical to SEQ ID NO: 2960
  Synthetic

SEQ ID NO: 4461 - DNA, 519 bp, Artificial; identical to SEQ ID NO: 2961
  Synthetic

SEQ ID NO: 4462 - DNA, 408 bp, Artificial; identical to SEQ ID NO: 2962
  Synthetic

SEQ ID NO: 4463 - DNA, 508 bp, Artificial; identical to SEQ ID NO: 2966
  Synthetic

SEQ ID NO: 4464 - DNA, 183 bp, Artificial; identical to SEQ ID NO: 2967
  Synthetic

SEQ ID NO: 4465 - DNA, 621 bp, Artificial; identical to SEQ ID NO: 2968
  Synthetic

SEQ ID NO: 4466 - DNA, 78 bp, Artificial
  Synthetic
gcccacgcgtcgatcaattgggagcttcataccaccactgagctcgttccggcttgctcgggcttcttcttctcgcca

SEQ ID NO: 4467 - DNA, 433 bp, Artificial; identical to SEQ ID NO: 2970
  Synthetic

SEQ ID NO: 4468 - DNA, 599 bp, Artificial
  Synthetic
aacatcacaaacacaacaaccaccaccaccaccactcaacctacaaacaacgtcacaatggccgccaagctctccgccgatctcctcttccagatggccaaggtccgccgctccatctatcccttgaacaagactctccccatctcaacctctcgcatccacgagatcgtcaaggaggccaccctccacactccctcctcctttaacgtccagaccaaccgtgccgtcgtcctcttcggcgccgagcacgagaagctctgggacatcacctccgagaccctcaaggccattgtccccgaggaccagttcaagtccaccgccgacaagctcgccctcttcaagggcggcgccggcaccgtcctcttctacgaggacaccgacgccaccaaggccctccaggccaagttccccatctacgccgaccgcttccctccctgggccgttcagtccctcggcatggagcagctgctcatttggactgccctcgaggttgagggcctgggcgccaacctccagcactacaaccccctgattgacctcaaggttgctgagacctggggcgttcccgctcactggagactcgatgcccagcttgtctt

SEQ ID NO: 4469 - DNA, 403 bp, Artificial; identical to SEQ ID NO: 2983
  Synthetic

SEQ ID NO: 4470 - DNA, 578 bp, Artificial; identical to SEQ ID NO: 2984
  Synthetic
  misc_feature (237)..(237): The residue at this position can be any nucleotide.
  misc_feature (250)..(250): The residue at this position can be any nucleotide.

SEQ ID NO: 4471 - DNA, 253 bp, Artificial; identical to SEQ ID NO: 3002
  Synthetic

SEQ ID NO: 4472 - DNA, 519 bp, Artificial; identical to SEQ ID NO: 3006
  Synthetic

SEQ ID NO: 4473 - DNA, 748 bp, Artificial
  Synthetic
tggtatcaacgcagagtggccattacggccgggggttacataggaataagtaatatatttattgttttccccttcgtccaaactataggctcaaataccttatccaagctcagcagatctccgttttcacctaattcaatcaatcgcctcgcatcttctagggcttggatttgaaggtatacgagctaatctatggcgtcgaagcgtatattgaaggagctcaaggatttgcagaaggatcctccgacatcatgcagcgctggtccagttgctgaggatatgttccactggcaagcaactatcatgggtcctacggatagcccttatgcaggaggcgtatttttggtttcgattcatttccctcctgattatcctttcaagcctccaaaggttgcatttagaactaaggttttccaccccaacatcaatagcaatggaagtatatgtttggatattcttaaagaacagtggagtccagctttgaccatatccaaggtcttgttgtccatctgttctctgttgactgatccaaatccagacgatccacttgtaccagaaattgctcatatgtacaagactgacagggccaagtacgaggccactgctcgtagctggacacagaaatatgctatgggatgatgcggaaagtgtccttggacgtgcctgagacacttttaattgcaacagtttcattgtgctttcacccttaagtgcaatgtctttgtgcttggatgaaagtaaaatattg

SEQ ID NO: 4474 - DNA, 594 bp, Artificial
  Synthetic
tactgtcaaatcagatctcttcaatttgctagggttttggtttcttctccctctctgatggcttcgaaacggatattgaaggagcttaaggatctccagaaagatcctcctacctcttgcagtgccggccccgttggagaggacatgtttcactggcaagctacaataatgggccctccagatagcccctacaccgggggtgtatttttagtcactatccattttcctcctgattatccatttaaacctcctaaggttgcttttaggacaaaagttttgcatccaaatattaatagcaatggtagtatatgcttggacatattgaaggagcaatggagccctgccttgactatttctaaggttttgctttcaatatgctcacttttgacggatccaaatcctgatgaccccttggtgcctgagattgctcatatgtacaagacggacagggcaaaatacgaaacaaccgcccggagttggacccagaagtatgccatgggttaaaccgttacctatggcacttgaatttatgtaaaaagaaagaatgcatctgtcctctactttccatacaagaagtatagaatagcattgaac

SEQ ID NO: 4475 - DNA, 846 bp, Artificial
  Synthetic
cagtttaagagagaaatataggacttcttccaacgtactggggtactattattggcccaaaatcctcttccagctctgcaatctccgtctccgtcaattttcagtcaaccgaaatccaccatctttcattgttcatcaccttcaggttagggtttggatttgaaggtacaaggggctaattgatggcgtcgaagaggatattgaaggagctcaaggatctgcagaaggatcctcctacatcatgcagtgctggtccagtggcagaggatatgttccattggcaagcaactatcatggggcctacagatagcccttatgccggaggtgtatttttggtttcaattcatttccctccggattatcctttcaagcctccaaaggttgcctttagaactaaggttttccaccctaacatcaatagcaatggaagtatttgtctggatattctaaaagagcagtggagtccagcgttaaccatatctaaggtcctgctctccatctgctccctattgactgacccaaatccagatgatccacttgtaccagaaattgcccacatgtataagactgaaaggtctaaatacgagaccactgctcgtagctggactcagaaatatgctatgggataatggcaaaggtgtcaccaggcatgtctgagactttgtaactgcaatgtcttattgtgcttgtagtgaatgaataaattcggctaaagaacttagtttacttcttaatctcccttaaagtgggttgtcaacagacatttcttttcaatttgtgaatatctatttggtgactattagtaagggagacacttcagtgtaattttacttcgtttgccagttt

SEQ ID NO: 4476 - DNA, 554 bp, Artificial
  Synthetic
gtgtagtcatgtcttcgaagcggattctgaaggagctgaaagacttgcaaagggatccaccaacctcatgcagcgcaggacctgttggggaggatctttttcattggcaagcaacaatcatagggcctgatgatagtccttatgttggtggggtgttcatggtcacggttcattttccccaggactatcccttcaagcctcccaaggttgctttcaggacaaaagtatttcacccaaatgtgagcagcaatgggagcatttgcctagatatcttaaaagagcaatggagtccagctcttacaatatcgaaggtcttgctttcgatttcttcacttcttacggatccgaaccctgatgatcccttggttccggagattgcccacatgtacaagaccaacacggccaagtatgaagccacggccaggagttggacacaaaagtatgccatggggtgagaggcttttcctttgaaagagaaaatggcctttatatattgtttatgtttaaaacctccgttcaaaccttgtattttttttctcaaaatgctacttttt

SEQ ID NO: 4477 - DNA, 648 bp, Artificial
  Synthetic
gggtgccttccttgcgtatcgggaggagaacggaagaatggcttcgaagcggatcctgaaggaactgaaggatttgcaaagggatcctcccacttcctgcagtgcaggtcctgttggggaagatatgtttcattggcaggcaactatcatggggccaactgatagtccttatgccggtggcgtcttcatggtcactattcatttccccccggactaccccttcaagcctcccaaggttgctttccggacgaaagtgttccacccaaatatcaacagcaatgggagcatctgccttgatatattaaaagagcaatggagtccagcccttacaatatcgaaggtcttgctttcgatttgttcacttctcactgatccgaatcccgatgacccccttgtgccggagattgcacacatgtataagacggatcgagccaaatacgaaggtactgcaaggagttggacacagaagtatgcaatgggttgagttgagtctttcttcactcaattgctactcgctcttaatatatcccccccccttgatgtaataaatatatgttggcagacaagttaaaatatcggcatacaaaaagccgtgtttctgaatgatcttgtttcaaaactgaatgaatgcaagcaatgtgtttttat

SEQ ID NO: 4478 - DNA, 643 bp, Artificial
  Synthetic
ggttaaagcttagagagacatctgcccttgcaagtgaagaggatcaatcgatcgatcagccatggcagcgagggtaagactattcaaggaatacaaggaagcaatgaaagacaaggctgttgactcagatattgtacttacttgtgatgatacaaacatatacaggtggacaggacacatcaagggtccagaagatacaccataccaagaaggtgtttttcagctagccataaatgttccagatcagtaccctctggtgccaccccaaatacggtttgtgaccaagatttttcacccaaacgttcactttaagacaggggagatatgcctagatattttgaaggcggcttggagcccagcatggacattgcaatctgtttgccgtgctataatagccctaatggctcatcctgaggcagatagtcctttaaattgcgattccggcaatctactaagatcgggtgataaccgtggattttattcgatggctcgtatgtacacccgattggcggcggcgccaaagccttgattctcttcacatcttttcaaaaaatatcaaggatttctcatagctactaagatgctttccatgtgaagaattatatattcgggcacaaatgatttggacacgtgggttttagag

SEQ ID NO: 4479 - DNA, 510 bp, Artificial
  Synthetic
taagagtatctgcgttgaattgaagcgaaaggactttaaggaatggcatcctctgctcagcttcgattgatgtccgatctgaaggccattagccatgagccacctgagggatgcagtgccagcccttatagcgatgcggacctttttgtttgggacgccacaatatttggtcccgaagatactccatgggaatgtggcattttctgcctccgtttggtctttggagagcattaccctgccaaaccacctcgtgtcaggtttacttccgagatatttcaccccaatgtgtacaatgatggcaccttatgcatggacattatacaagatgcttggtctccttgccacaacatctgtacaattctaacatctgttcagtcattgctaacagatccgaatcccgcaagcccagctaactcggaagctgcacatttatatcaaactgatattcaagcatataacaggcgagttcggcgttgtgtgaggaagtctttggaaagcacatagtatact

SEQ ID NO: 4480 - DNA, 707 bp, Artificial
  Synthetic
ttcatatatatatatatagagggaggaaggcttcgtgttggaccttccttttttgttttcctttttgccgccatcgccgtctttccttccttccttcgatcgatccatccctcctcctcttcgcgatcaagcttctcctcctccccccccccccaatggcctccaaacggatcctcaaagagctcaaggacctacagaaggacccccccacctcgtgtagcgccggccctgttgcggaagacatgttccattggcaggcaacgatcatgggacctgttgatagcccttacgccggaggtgtgttcatgttgacaatccactttcccccagactaccctttcaaacctcccaaggttgctttcaagacaaaagtatttcatccaaacatcaatagcaatgggagtatttgcttggatattttgaaagagcaatggagcccagctttgacaatctccaaggttttgctttcgatttgttctcttctcactgacccaaaccccgatgatcctctggttcctgagatagcacacatgtacaagatagacagagccaagtacgaatctactgcaaggaattgggcacagaagtatgctatgggctaatagttattataatggacatcccattgcaatggtagacaggccgagggattgattacactttcctgttcttgttttcaaaccatggggggttggatgtatcttgtg

SEQ ID NO: 4481 - DNA, 758 bp, Artificial
  Synthetic
tgcgaactccaggggcacctcctccaacacaaagcaggagttcaacgcagaatcaaaccaaaaccctagctcaccgccttgtttcctccgtattggtggttacaatgtcgactccggctagaaagaggttgatgagagatttcaagaggttgcagcaggaccctcctgctggtattagtggtgcacctcaagacaacaacattatgctttggaatgccgtgatatttggtcctgatgacactccttgggatggtggtacgttcaagctgactcttcaattctctgaggattaccccaataagccaccaacagtgcggtttgtttctcgcatgtttcatcctaacatttatgcagatggaagtatatgtttggatattcttcaaaatcagtggagtccaatatatgatgttgcagctatacttacatccattcagtcattgctgtgcgatcccaaccccaattcacctgcaaattcggaagcagctcggatgttcagcgagaataaaagggattacaaccgcagagttagagaagttgtggagcagagctggactgcagactgattctaaggaagaaagatgtcattgctgaccgcaattcgggagcaccagggttcatctatgttacatttacggattgaaacctcttcttggaaattttattggaacacatttgttttggccctagtattatggcttggtgctgtttgccttaccgtttgctgcattgcattgacaagctcctgtaatatatgaatg

SEQ ID NO: 4482 - DNA, 671 bp, Artificial
  Synthetic
aaatcccccgtcacccccaacaaaataaaaagagccaaaaaggtcaggaaaaaatcatgtcttcaccaagcaaacggagagaaatggacttgatgaagctgatgatgagtgattacaaggtggaaatgatcaatgacggcatgcaagaattttatgtgcatttccatggacctgctgaaagtccttatcatggtggagtttggaaaatgaaagttgaacttcccgatgcctacccttataaatctccgtcaattggctttgttaataaaatctatcatccaaatgttgatgagatgtcaggctcagtttgtttagatgttatcaatcagacttggagtcccatgtttgatttgacaaacgtgtttgaagtgtttcttccacaacttctcttgtatcctaacccgtcggaccctttgaatggggaagcagctgccttgatgatgcgagaccgaactgcgtatgaacaaagagttaaagaatattgtcaaaaatatgccaaaccagaagatgttggagctgcaccagaggagaagtcaagtgatgaggagttaagtgaagctgaatatgactcggatgatgaggaaatggcaggccccgttgatccataataattccttctatttccattactatctttatatgtaaatgatgttatttatcctgtttaaaat

SEQ ID NO: 4483 - DNA, 679 bp, Artificial
  Synthetic
cccacgcgtccgcccacgcgtccgcccacgcgtccgcccacgcgtccggctcagcatctctaggcttcagcactgcaatcttcgtctttctgcaaactcaattaatcccctctaccactctgccaccttcagatttgagcttgggtttgaaggtaaggaagtaacatatggcgtcaaagcgcatattgaaggagctgaaggatctgcagaaggaccctcccacgtcatgcagcgctggtcctgtggctgaggacatgttccattggcaagcaacaatcatgggccctacagatagcccttatgcagggggtgtattcttggtttctattcattttcctcctgattatccgttcaagccacctaaggttgcatttcgaactaaggttttccaccctaacatcaatagcaatggaagcatttgtctggatattcttaaagagcagtggagtccagcattgaccatatctaaggtcctgttgtccatctgctctctattgacagacccaaatccagacgatcctcttgtaccagaaattgctcatatgtacaagactgacaggtccaaatatgaggccactgctcgtagctggacacagaaatatgccatgggataatagcaaaagtgtcaccgggcatgtcagagactttgtagctgcaccgtcttaattgtgcttgggtg

SEQ ID NO: 4484 - DNA, 722 bp, Artificial
  Synthetic
cccacgcgtccgatctcttctattcataagttgtaaattcttattattgggattttttccctttttaattcaatccaagaattgagtaggactaatggcatccaggagaattcacaaggaactaagggagttgcaaagagaccctcctacttcatgcagtgcaggtccggtggcacaggatatgttccattggcaagcaaccattataggtccaaatgacagcccttatgcaggtggtgttttccaagtggccatccattttcctcctgattaccctttcaaacctcccaaggtggctttcaagaccaaagttttccatccaaatataaataataatggaaatatttgtttggacattcttaaggatcaatggagtcctgccctcaccatatcaaaggttttgctttccatatgttcactactaacagatccaaatccagatgatccactggttccagagattgctcatatgtgcaagagtgatcggaacaagtatgaatcaatggctcgtagttggactcaaaagtatgctatgaactgagtctgaatacattaagaaaaaactctagtttgtgacaaatatgaatttcttggtatcgagcaatatataaaatgttcaggaaaactggcactcttatgaaaaatgagatgagtgacagttggatgtatttaaatctcgggatttgttttaaataaaagggtgattttactgtcttcttatt

SEQ ID NO: 4485 - DNA, 343 bp, Artificial
  Synthetic
cttctctctaatacgagacagaaaaaggcgaaaacctcgccaatccgattacgcgaaaaatcaaaggtttttggatatggcgtcgaagcggatcttgaaggaattgaaggatctccagaaggatccacctacatcatgtagcgcaggtcctgttgctgaagacatgtttcactggcaggcaacgataatgggtccttcagagagtccttatgctggaggtgttttccttgtaaccatccatttccctccggattacccattcaagcctcctaaggtggcctttaggaccaaggtgttccatcccaacattaacagcaacggtagcatttgcctcgacatcttg

SEQ ID NO: 4486 - DNA, 320 bp, Artificial; identical to SEQ ID NO: 3641
  Synthetic

SEQ ID NO: 4487 - DNA, 522 bp, Artificial
  Synthetic
ggataataaagaggtgaagtaatgtttttgtttgagattaaagaggtttcaaacaaagagatgataaaacataggaatctaacttatttcatggaagatccctatgtgaagaagtcctctctctttctctctctctctctattaaaaccgagtctgtgagggatcaaaggacacaaactttcatcccattgcatatttctgagtccagcttctcgcagtagactcatactttgctctatcggttttgtacatgtgagcaatctctggaaccaatggatcatctgggtttgggtccgttaacaatgaacatatcgaaagcaaaaccttcgatatggtgagtgcaggactccattgttctttcaaaatgtcaaggcaaatgcttccattgctgttgacattagggtggaacacttttgtcctgaatgcaacctttggtggtttgaaaggataatccggagggaagtgaatggttacgagaaagacaccgcctgaataaggactatcaaatggacccattattgg

SEQ ID NO: 4488 - DNA, 541 bp, Artificial
  Synthetic
ttgaatggagatcaaataatttcttactgatcctgtcttcacaaattttataagacagacaagtctataaaagatcattacatagaaataagaagagtttaattattagggctcttccttaaggacagtatttgtgtcagcccatggcatacttttgggtccaggtccgagcagtggactcgtacttgttcttgtctgtcttgtacatgtgagctatctcagggaccaaaggatcatctgggtttggatccgttaacaaagaacagatcgatagcagcaccttggaaattgtgagagcaggactccactgctccttcaagatgtcgaggcagatgcttccattgctgttaatgtttggatggaacaccttcgtcctaaaagccaccttaggaggcttaaatgggtaatctggagggaaatggatggttacaagaaaaactcctccagaataagggctatccgatggacccattatagtggcctgccaatgaaacatgtcttccgcaacgggtcctgcgctacatgaagtaggaggatcctt

SEQ ID NO: 4489 - DNA, 428 bp, Artificial
  Synthetic
cccgggacgacccacgggggcgggatattgaaagaattgacggatttgctaagagaccctcctgttgggggaccaatcaaaaccagaccacaagatatgtgccactggcaagctactataatgggtccgaatgaaagtccttactccggaggtgtcttccttgtcaatattcatttccctgctgattatccttttacacctcccaaggttgtattcacaaccagagtgtttcacgcaaacatcaacattcttggaaacatatgtttggacattctcaaagaccaatggagccctgcccttaccatttctaaggtttgaaattctatatatgtatttagttatttgcatgtcgcctgttaaggcttctttggacagagctccaggtttgtcaatcttgtccccaagaacgagaagagggataccattag

SEQ ID NO: 4490 - DNA, 611 bp, Artificial
  Synthetic
atgcttatattcaggtccgagttttatttgcagtctcgttccaactcttctctctcccacaaagtgaagtcggtctgagattcgtaatggcttcaaagaggattcagaaggaactgaaggacttgcagaaagacccccctgcttcttgcagtgcaggtcctgttggtgaggatatgttccactggcaagctacaattatgggtccatctgacagcccattttctgggggtgttttccttgtgtctatccatttcccccctgattatccattcaagcccccaaaggtttcctttaaaaccaaagtattccatccaaacatcaacagtaatggtagtatttgtctggacatcttaaaagaacaatggagccctgcccttactgtatccaaggtgctgctttccatttgctccttgcttactgatccaaatccagatgatccgttagtgccagagattgctcacatgtacaagactgatagagtgaagtatgagagtactgctagatcttggacccagaaatatgccatgggatgaaaacatttggcttactcccatgaacatcgggcctttatgctatagtagtaaataaaaataggcgcggaacacaatttc

SEQ ID NO: 4491 - DNA, 627 bp, Artificial
  Synthetic
agaaatcgagtaggaggatctctgagggatatggcatccaagagaattctgaaagagctcaaggatctgcagaaagatcctcccacctcttgtagcgctggcccagttgctgaagatatgtttcactggcaagcaacacttatgggtccatctgacagtccttatgctggcggagtgtttcttgttaccattcattttccacctgattatccatttaagcctccaaaggtagcttttaggacaaaagtttttcacccaaacatcaacagcaatggtagcatttgcctcgacattttgaaggaacagtggagcccggcactcacaatatctaaggtgttgctgtccatctgttctcttctaacagacccaaatcctgatgatcctttggtgcctgagattgctcatatgtacaagactgataaaagcaagtacgaagccactgctcggagctggactcaaaaatatgccatgggttagttgctgaaacacaaatatttggcttttatctatgatgtattaagaaattgtgttatgcataattaactcaagggaaaggttgaattgtggccctctgtaaaacacttaattttcctcatgtttgtaagattaaatggttttgaaattctg

SEQ ID NO: 4492 - DNA, 692 bp, Artificial
  Synthetic
gaatttcaattctcgctaatcaggctaagactcagatttcttcgattgtttggtttttaatggcttcgaaacgaatattgaaggagctgaaggatctccaaaaagatcctcctacctcatgcagcgccggtcctgttggagaggacatgtttcactggcaggctacaataatggggccctctgacagcccttacgctgggggtgtatttttagtcactatccattttcctccagattatccattcaaacctcctaaggttgcttttaggacaaaagttttccatccaaatatcaacagtaatgggagcatatgcttggacatactgaaggagcagtggagccccgccttaactatttccaaggttttgctttcaatctgctcacttttgacggatccaaaccctgatgacccccttgttcctgagattgctcacatgtacaagacagacaaggccaaatatgaagcaaccgccaggagttggacccagaagtacgccatgggctaactattgcctatggcggcttgaattgatataaagaaaaacaaatttcaatgtctttcttctctgttctctccattaacaagttgtacaatagcattaagcattgccctctgcaggaagaattatgatgctttaaattttgtttatatggattctaatatttgatgtggggaagcatatatttatctg

SEQ ID NO: 4493 - DNA, 764 bp, Artificial; identical to SEQ ID NO: 3130
  Synthetic

SEQ ID NO: 4494 - DNA, 474 bp, Artificial; identical to SEQ ID NO: 3129
  Synthetic

SEQ ID NO: 4495 - DNA, 250 bp, Artificial
  Synthetic
aatctccagtgccttttaagccggcgacgaacataaggccgccgcctatcatttaacctcccgtcgacgtctatcattcaattctcgccgctttttgctcgtaggtcaacaattccgtatttcttatgcggtgaggatgtcgacaccggcgaggaagagactgatgagggattttaagcgattacagcaggatcccccggccggcatcagcggagctccgtgtgacaacaatataatgctatggaatgca

SEQ ID NO: 4496 - DNA, 625 bp, Artificial
  Synthetic
gaaaccaccgtccaccctacccaccctccgcagacctcttctcttgcgccgcgacccaaagaacaagaggatagctgaagaacccgaaaagaatgcagatggaagcccagaatgccgacccctttgctgaaaaccccgccaagctgcaaatgtcgggatccaactcaaacgacggccactcggtcaccaagcgcctgcaaaacgagctgatgcaactcatgatgtccgacacgcccggaatctcggcgttccccgtgtccgacgcagatctgctcaactggaccggcaccctgaccggcccggagggaacggtctacgaggacctgacgttcaaaatctcgctggccttcccccaaaactacccctacaccgcacccacaatcaagttcatcagccccatgtggcatcccaacgtggacatgtccggcaacatctgcctggacattctcaaggaaaagtggtctgccgtgtacaacgtgcagacaattctcttgtccctgcagtcgctgtttggcgagcccaacaacaagtcgcctctcaacgcccaggccgcccagctgtgggacacggacatggatgagtacaagcggctgctgatgcagcggtacgaggcccctgacgatga

SEQ ID NO: 4497 - DNA, 692 bp, Artificial
  Synthetic
  misc_feature (413)..(413): The residue at this position can be any nucleotide.
acgcgtcggagaccaccccattctctctctctctctctctctctaccctgttttctcccgccctgtggttttaacacccctcgaaggctggtctttagcctgtgtgtgtgtgtgtgtgtctccctcctctcctttttctgttttgcagcgagttcgaattgaggagcagcaagttcgaattgcttagatggcgtccaagcggatcctgaaggagctcaaggatctgcagagggacccccccacctcttgcagcgctggacctgtagcagaggacatgttctactggcaggctacaataatgggccctgacgacagcccttatgctggaggtgtcttcctggtgaccattcatttccccccggattacccattcaaacccccaaaggttgcttttaggactaaaggttttccancccaaacgtcaacagcaatggaagtatctgcttggacatcttgaaagaacaatggagtcctgcattaaccatttcacaggttctgctctcaattcgctcattgttgaccgacccaaacccagatgaccccctagttccagaaattgctcacatgtataaagcggaacagggcgaaatatgaagccactgcaaggagctggactcaaaaatatgccatgggctaatgctaccccttatatatatataaggcgatgggtggtgagtctgtttccacatctt

SEQ ID NO: 4498 - DNA, 679 bp, Artificial; identical to SEQ ID NO: 3640
  Synthetic

SEQ ID NO: 4499 - DNA, 569 bp, Artificial
  Synthetic
actgtgtctgtctcccttccgtcgagatctgtggatcttatagcctagccctaaaggggaacagcaagctttggactttccatggcctccaaacggatcctgaaggagctcaaggatctgcagagggatcctcccacatcatgcagcgcaggacctgttggggaagatatgtttcactggcaggcaacaatcatgggaccgaatgatagtccatatgctggcggtgtgtttatggtgaccattcatttcccaccggattaccccttcaagccgccaaaggttgctttcaggactaaagtttttcaccctaacatcaacagcaatgggagcatttgcttggatatattaaaagagcaatggagtcctgctcttacaatatcgaaggtcctgctgtcaatttgttcgctcctgacggatccaaaccccgatgatccccttgttcctgagattgcgcatatgtacaagacagacagagccaaatatgaaggcactgcaaggagttggacgcagaagtatgcaatgggctgaatctctgacctctctcgcccctttgtaataatcaaaagata

SEQ ID NO: 4500 - DNA, 876 bp, Artificial
  Synthetic
ggacagtatgtctactccatccaggaagcgcttgatgcgagatttcaagcgcctccagcatgatccacccgccgggatcagcggcgcgccgcaggacaacaacatcatgctgtggaatgcggtgattttcgggtaagagaggccgcttctagggtttagagtttctaaaggacttttttcgtggtttgctgcaggcctgacgatactccctgggatggagggacattcaagctgacattgcagtttacggaggactaccccaacaaacctcccactgtgagatttgtttcaaagatgttccatcccaatatttatgctgacggaagtatttgcctcgacatcctgcaaaatcaatggagtccaatctacgatgtcgcggccattcttacttccatacagtcattgctttgtgatcctaacccgaactcgccggccaactccgaggcagctcggatgtacagcgaaaaccgccgagagtacaacaggagagttcgcgacatagtcgagcagagttggacggcggagtagctccccttggttcaagagcttgtaagagtggccatcacagagagatgtgtgctgctccgagcacacataaagaatcttgtcaaaaaacaatccggaaagctgtcgcctctacagaccagcgttgaaggtcgaccatcgaactcgtttgcttctgttggaaccagggccagtgttctggtactcaccatagaacagggtgctgagagcgaagtccccgttccattccaaccatccacggggttgaattatgtcactgatgaacgacttcatgaacaccgtccgcgagtagagcttccacggccttccgagtttatgaaagacagccccgtgttctgtcgcttatcgacg

SEQ ID NO: 4501 - DNA, 651 bp, Artificial; identical to SEQ ID NO: 3127
  Synthetic

SEQ ID NO: 4502 - DNA, 724 bp, Artificial
  Synthetic
gatcgcatgcacacggcagggaaggggaagtggaggaagggttgcgatctcgcggctggatcgtccaggatagggcgccgcatcgactcgccgcctacgccgccgctgccgccgccgccgctatggccgtgaccctgggtttgtagggattttccatccagatttcgaggagatcgctgcgcgtttctcgttcatggctgagaacttacccccaaaggtgattcgagcgcttgcaaaggagctcaagagcttggacgagagccctccagaggacattcgcgttcatgtaaatgacgacaacttctcgagcattttcgcggacattgagggaccacccggaacaccgtacgaaagtggcgtcttccggatcaggcttttgcttagtcccgatttcccgcaaacgccaccgaaaggttatttcgtcaccaagatcttccatccaaacatcgcaaagaatggagagatttgcgtgaacgttttgaagaaggattggaagccgacgctcggcctgaggcatgttcttcttgtcgtacggtgcttgctcatagagccgtttccagaatcggcacttaacgaggacgctggaaagatgttgatggaggattacgatggatacgcaaagcacgccagattgatgacaaacatccacgcgatgaagccaaagccaaagaccacgaaagtcgccatagccgagtcaacggtggtgaacagcaacgcggaggag

SEQ ID NO: 4503 - DNA, 705 bp, Artificial
  Synthetic
cgcgattgtagatgctatagatccaggtcgcctcgtcgtcgtcccgtggcgccgctgtagatagggtttgattcatcgcgcagcagcggcagcggcgatgtctacgccggcgaggaagcggctgatgcgggatttcaagcggctgcagcacgatccaccggcgggcatcagcggcgctccacaggacaacaacatcatgctgtggaatgcggtcatctttgggccggatgatacgccatgggatggaggaacattcaagctcaccttgcagttcacagaggattatccaaacaagccaccaaatgtgcggtttgtttcgaagatgttccatcccaatatttatgcggacggaagcatttgcctggacattctccaaaaccagtggagcccgatctacgatgttgctgcaatattgacatcgatccagtctctactatgcgatccaaacccgaactctcctgctaattccgaagccgcacggatgtacaacgagaacaggcgagagtacaacaagaaagttcgccaagtcgtggagcagagctggacagcgaacgactgaaaccgagagttctgctcggctgctcgacatgctggtacgcgattttctggcgatcacggacggaattctactaaccagcaggagcactgtatatcctctgtactcggattttttttcttaggtgatgtggttgcaactaagaaagt

SEQ ID NO: 4504 - DNA, 668 bp, Artificial
  Synthetic
ggaaatatttgctacagggtagatgcttccccatttttaggtctaaagcttctttctcctccctcgattcgattcgatccatcggcggcggcggcgatgaacatgaacggcggcgtcgatgcgatcgcgcagcagcaagcgacgaacaatccggcgggtagcaagcagagcaaacccaatttgcagccggtggacagccattccgtcgcccggaggttgcagtcggagctcatggccttgatgacttgcggggacccgggaatctcagcgttcccagacggcgacaacatctttacgtggattggaaccatcaaagggagcgacgcgacggtgtacgaaggtctctccttcaagctctcgttgcgcttcccgaccgactatccattcaagccgccactggtcaagtttgagacgtcgtgtttccatcccaatgtcgatcagcatggcaacatttgcctcgacatcttgcaggataaatggtcctcggcctacgatgttagaaccgtgttgctgtccatccaaagcttgctaggagaaccaaacaacgatagtcctctcaacagctatgcggcagcattgtggccaaaccaagaagagtacaagaaagtgatgaacaggcagtgccgcgacggatctggtcgatgagaaagggtcgatcgacaagagag

SEQ ID NO: 4505 - DNA, 690 bp, Artificial
  Synthetic
atcataagtggggcaaaaaaagggttcatggcgaaggcgcacgaatccactgcggcactcctcttcttgatcgattaggtcagatcgaagtaggtcgatcgattgatagatagattggaaaaggattggcgaagatgctcgatgtgtcccgcgtccagaaggagctggtggagatcgagcgcgacaagaagctgtcgggcgtgagcattcaagtcttcgacgatgggttgagtcgaatgcgaggaacaatcacggggcctgttggcaccccctacgagggcggaatcttcaccatcgatattcagttaccttctgcttatcctttcgaaccaccaaagatgcaattcatgactaaagtctggcatccaaacatcagcagccaaaacggagctatctgcctggacattctaaaggatcagtggagtccagcgctgacgctaaagactgcgctactgtcgctacaagcgctgctttcgacgccggagccgggggaccctcaagacgcggtcgtcgcaaagcagtacctgagtgagtatccggttttcgagagcactgcgagatactggaccgaaacgtttgcaaagagatcgtcccttggcatggaagaaaaggtagcgaagctagtcgagatgggatttacggatgaggttgcgaccgctgctctagagtgctgtggcggcgacgagaatg

SEQ ID NO: 4506 - DNA, 653 bp, Artificial
  Synthetic
gggaacgcgggaaggggcggcaacggcgatggcgctggcgtcggcggcggccttgtgacagtcaaccacagcatgctcgttgcggctgccgccactgccactacagcgtcgatcgaattcttgtattcctgcaagctagggtggggcgagaatgctgtcgtcggcccagttgcggctcatgtccgacctcaaggcgattcaacaggagccgccagagggatgtagtgctagtccacaaggcgaagagaatctctttgtgtggggagccactgtgtttgggccggatgaaacaccatgggaaggggcgatcttgcctcttcgtctcacctttggcgagcactacccggcgaagccaccgcgcgtgagattcacgtccgaagtgttccatccaaatgtctacagtgacggcgcactgtgcatggatatcatccaggatgcatggtctccttgccacaacgtcagcaccattctcacctcgattcagtctctcctgactgatccaaatccagcgagtccagcgaatcccgaagccgcgcatatgtatcaaaacgatctccaagcatacaacaggagagtgcgccagtgtgtgaggaagtccctagatatataaaactccaaagttttatttatctatctatcatagtgattatcta

SEQ ID NO: 4507 - DNA, 621 bp, Artificial
  Synthetic
gcgagagagagcaggaaggcgatcgatcagctcccggcggcgctgtcggaatccggatcttggagccgctgccatggccagtaccatcgccaacagcaatctcccgcggcggatcatcaaggaaacgcagcgattactgaccgagccagccgaaggcatcaaagcttcgcctgccgaagataatttgcgatacttcaatgtgatgatccttggccccgcacagtcaccctatgaaggtggtgcttttaaactggagctttttcttccggaagaatatccaatggctgctccaaagaactgcaataggttcgcttcttgacgaaaatttaccatccaaacatcgacaagctgggccggatttgcttagacattctaaaagacaaatggagtcctgctctccagattcgaacagtgcttttgagtattcaagctcttttgagtgctcccaatcctgaggatcccctggacgagaacatcgcgaagcactggaagacagaccaaggaggagccatcgcgactgcaagagagtggactcaactctacgcgacccataattaaatcaaaatgcggaccattcgtcatcttggttcgtttagttttttctgctttggtcatatttgt

SEQ ID NO: 4508 - DNA, 557 bp, Artificial
  Synthetic
tactccatccaggaagcgcttgatgcgagatttcaagcgcctccagcatgatccacccgccgggatcagcggcgcgccgcaggacaacaacatcatgctgtggaatgcggtgattttcgggcctgacgatactccctgggatggagggacgttcaagctgacattgcagtttacggaggactaccccaacaaacctcccactgtgagatttgtttcaaagatgttccaccccaatatttatgctgacggaagtatttgccttgacatcctgcaaaatcaatggagtccaatctacgatgtcgcggccattcttacttccatacagtcattgctttgtgatcctaacccgaactcgccggccaactccgaggcagctcggatgtacagcgaaaaccgccgagagtacaacaggagagttcgcgacatagtggagcagagttggacggcggagtagctccccttggatttgtgggtaagacagcatttatgggtgatcttttgcaatatatatgttgcattggttagatcacagcactggcttcttgagtatgtatatg

SEQ ID NO: 4509 - DNA, 570 bp, Artificial
  Synthetic
acgacaccaattttaaaaaatggctttgaagcgaatcaacaaggaactcagtgatcttggacgtgatcccccctcctcttgctctgctggtcctgttggccaggatctgttccactggcaggctactatcatgggaccctcagactctccttactccggaggtgttttctttctgtctatccacttccccactgactaccccttcaagccaccaaaggtgaccttcactacccgaatctaccaccccaacgtcaacaccaacggatccatctgtctggatattctcaaggagaactggtctcccgcactcaccatctccaaggtgctgctgtccatctgctccatgctcacagaccccaaccctgacgatcctctcgtgcccgacattggccacctgtacaagaacgaccgagcacgatacgacgccactgccaaggagtggaccaagaagtatgccgtctaggatgtatatagggagcaggcatgagcctatgcaagcgaatggctgtgacgatacaactagccaatgttagatttatggatggtaaaacaatgtgtgtcgaggaaaaa

SEQ ID NO: 4510 - DNA, 284 bp, Artificial
  Synthetic
atgaagatatattttcaagacctgcgataggttttgatatcaaaacggaagcttgctatggggtacgaacattattatgggaggagttgagagattattcttttcttccattttctttggcttggttgcaaatattttagaaggctcaaatttgtttcgagatgagccgcaagcgttactgtccgcgcttctatggtgtatgtcttagatagtacaagtggtcttgcagcagatataccactggcgcaatacatcatcacattacacacaaaaaaaaaaaccaa

SEQ ID NO: 4511 - DNA, 992 bp, Artificial
  Synthetic
acaggaccgccatcagggactctgcacccccgatcagataaagcctctacctagcgctcaggacttgcagacggtcgccttgcatcgtctccaacgtccgcctaggatcttttgattctttctttgcctcctcgatccgagatcgatcttccaccacccttttagataccacataccctcatcacaatggccctgaagcgcatcaacaaggagctcaaggacctcggcactgacccgccatcatcctgctccgctggtcctgttggagaagatctgtttcactggcaagctacaatcatgggacccggtgattcaccatactcaggaggcgtcttcttcctgaagatccagttccctacggattaccccttcaagcccccgaaagtcaacttctccaccagaatctaccaccccaacatcaacagcaacggcagcatctgcctcgatattcttcgagaccagtggagccctgctctgaccatttccaaagttctcctttccatctgctctatgctgacagacccgaaccccgatgatccccttgtgcctgagattgcgcacgtgtacaagaccgaccggccccggtacgaggcgactgctagggaatggacccgcaagtacgccgtctaggcaataccaaacggtttcttttaaggggttttgatggcgctgggtgtttgacgtcctctatcacgcaatgacggtgcggcatgtttggcgagcctctacgttataagcgggtgcggggatgatattcgaaggcggacagtgcaagttttttctttcttctccttgctgttctcatcatctcttcgggtgcaccgcatttatgatgctgggggtgagacgacgcatggccggcggacaggtggcagactagacagaaatatccgctattcaagggcttatgcggctggacttgactttgggtttgcatcaacaacgtgtactctgcatccaacaacaggcatctgatttaacgcgtctatacg

SEQ ID NO: 4512 - DNA, 764 bp, Artificial
  Synthetic
gcttttatcacttttgagaaccactcattcatccatctccgcaagatcgtctgtttttgtttacaatggattataccgaggataaccagaattctgctcctggcagcgtccaggcttccaagctcaatgccgctcgcaagggtcccgattcgcagagcgtcactaaacgactccagaccgagctgatgactctcatgacatctccagcacccggtatctccgcattcccctctgccgacggcaaccttatgtcgtggaccgccaccatcgagggccccgaggatacaccttattccggactcacgttcaagctgagcttcgcgtttccttcaaactatccttatgccgcgccgacggtcctcttcaagacgcccatctaccaccccaacgtcgacttctctggccgcatctgccttgacattctcaaggacaagtggacagccgcctacaacattcagaccgttctgctgagtctgcagagcttactcggcgagcccaataacgcatctccattaaacggcgaggcagcagagttgtgggacaaggatatggaagagttcaagaagaaggtgttgggacgccatcgcgacatcgaggaggagtaatgggattcatagcgtgcagatttttatgattttacgtttacgggtatttggagtctttggggcacgaatcggtcgtttttgaaagggtatttgggtgtattttgcatttccacagccagagctgggaaaggagggctacctgccccttccacaagcgca

SEQ ID NO: 4513 - DNA, 752 bp, Artificial; identical to SEQ ID NO: 3119
  Synthetic

SEQ ID NO: 4514 - DNA, 616 bp, Artificial
  Synthetic
gccagtacgaacgaacattcagccttgtgcaggggaagcagaagatcatatagagcatttatcaagcgaataacagaccctgagacactgaatcagagaagctttagaagctcttcttctctctgtctccgcgcctcttatcgcaaacagcccctctactgctgctgctgcctttgtcaggcctgtcttttcagtgtcgcatgccccgcctcatctttctaccttgcacaactcagcctttgcgctaatcaacgacatctgcgatctgtgtcggcagcagaagagtcccagatcactggtctctcttttattctccttcttctaaacagatctgtgttgcccccaaagcaagcgagaatacgtcaagatggctcttccgaaacgcatcatcaaagaaaccgaacgccttatggcggaaccagttcccggaatcagcgccgtgcctcacgaagataacctgcgatactttgacgtcgagatccacggccctgcatcgtcaccatacgaaggcggcattttcaagcttgagctcttcctcccagatgactatcccatgactccgcccaaagattcgattccttactaagattttccacccaaacgttgacaagctggg

SEQ ID NO: 4515 - DNA, 573 bp, Artificial
  Synthetic
ctcacctggcgcgccgaagcttctctcctctctctcaactccggcgagaggaggaggcggcggtggggcgttcgtcgggagagagaccagggccggggggctagggttcggccgttcagagaggcggcggctgaggaggaggaggaggaggaggagggggtgaggagagatgtcgacgccggcgaggaagcggctgatgcgggacttcaagcggctgcagcaggacccgcccgccggaatcagcggcgcgccgcacgacaacaacatcatgctctggaacgccgtcatattcggaccggatgacacgccgtgggatggaggcacgttcaagctgacactacaatttacagaagattatcccaacaaaccaccagttgttcggtttgtctcaaggatgtttcacccaaatatttatgcagatggaagtatctgcttggatatcctacaaaatcaatggagccctatatatgatgttgctgcgatattgacctctatccagtccctgctctgtgatccaaacccaaactcccctgcaaactccgaagcagccagactgttcagcgagaacaagcg

SEQ ID NO: 4516 - DNA, 666 bp, Artificial; identical to SEQ ID NO: 3120
  Synthetic

SEQ ID NO: 4517 - DNA, 552 bp, Artificial; identical to SEQ ID NO: 3121
  Synthetic

SEQ ID NO: 4518 - DNA, 707 bp, Artificial; identical to SEQ ID NO: 3122
  Synthetic

SEQ ID NO: 4519 - DNA, 641 bp, Artificial
  Synthetic
tcgacccacgcgtccgaacaatccccagcctcaccaaaaaggacacaaaataacgacattcactctctctctctctctctcttcctcttttctccattctctcgcggggtcatccgcccaccatggcccaatccaccgcccaccgccgcctccttcaagaataccgcgccctcacaaacaacccgcccgaaggcatcaccgccggccccgtctccgaggacgacctgctgcactgggaatgcctcatccaggggcctgagggaactccctttgagggcggcgtctttcccgcagagctcaagtttcccaaggactatccgctggcgccgccgacgatgaagtttctcgctgacatgtggcatccgaacgtctaccccagcggcctcgtctgcatctccatcctccaccctcccggcgacgaccccaaccactacgagcacgcctccgagcgctggtcccccatccagtccgtcgaaaagatcctcatctctgttatgagcatgctagctgagcccaacgacgagagccccgccaacgtcgaggccgccaagatgtggcgcgagcgtcgggatgagtacgaaaagacggtccgcgacggtgttcggcgcatgttgggtttgtaacagcgcatgttgggtttg

SEQ ID NO: 4520 - DNA, 599 bp, Artificial; identical to SEQ ID NO: 3123
  Synthetic

SEQ ID NO: 4521 - DNA, 483 bp, Artificial
  Synthetic
gtcctcgtcctcgcgtaggcgcggcggccgaggaacaagtccgtcacgcgaaccttccagaaccccctcctcacacgtcacgcaacctcctcctcctcctcctcctcctctttattacgactacccccccccccccggcgccccctccttttttcagattcggagagacctactcgtcgttagaccgccatggcgtccaagcggatcctcaaggagctcaaggacctgcagaaggatcccccaacctcctgcagcgccggccctgtggctgaagatatgttccactggcaggcaacactgatgggtccatcagatagcccttatgctggaggcgtgtttttggttaccattcattttcctccagattatccattcaaaccgcctaagggggcattcaagacaaaggtgttccacccaaacattaatagcaacggaagcatatgccttgatatcttgaaggagcagtggagtcctgcattgact

SEQ ID NO: 4522 - DNA, 614 bp, Artificial
  Synthetic
ctctctaggaaggcggaatactccttctcttctcttctctctctcataccgaggtattagggttccacaggcggagagaagagagagagagagagagcgtctttcttcctctaccgctgctactactactgctacgaccatgtcggggatcgccaatgctaacctaccgcggcggatcatcaaggaaactcaacggttattgagcgagccagcccctggcataagtgcatcaccttctgaggataacttacggtatttcaatgttatgattcttggcccaactcaatctccctatgaaggcggggttttcaaattggaattgtttctacccgaagaatacccaatggcggctccaaaggtccgattcctgacaaaaatttatcatccgaatattgacaagctggggcgcatctgcctcgacattttgaaagacaagtggagccctgcactccaaattcggacagtccttctaagtattcaggcccttttgagtgcaccgaatcctgacgatccactttctgagaacattgcgaagcattggaagactaacgaggcagaagctatgcaaacagcaaaggagtggaccaggatgtatgcctgtggggcctgaaaac

SEQ ID NO: 4523 - DNA, 656 bp, Artificial
  Synthetic
gcacgaaactcaaagcatccccggcgccgcagctccccggaggaggaagcccccgcgccccgccccgaccagatccgatggccaacagcaacctcccccggcgaatcatcaaggagacgcagcgactcctcagcgagccagcgccgggaatcagcgcgtctccgtcggaggagaacatgcgctacttcaacgtcatgatccttggcccggcacagtccccctatgaaggtggagtttttaagcttgaactctttttacccgaggaatatcctatggctgctccaaaggttaggttcctgaccaaaatataccaccccaacattgacaagcttggtaggatatgccttgacattctcaaggacaaatggagcccagcccttcagattcggacagttcttttgagtatccaggcactcctaagtgcaccaaaccctgatgatcctctctctgataacattgcaaagcactggaaagccaatgaagcagaagctgttgaaacagcaaaggagtggactcgcctgtatgccagcggtgcataaaacccaatgcctctcgtgatgtaataacccgtcatgctttagccttaatcaaatgccatttgcttgataagaacaaactggagatattggcagtggaagggagtttaaatgactacc

SEQ ID NO: 4524 - DNA, 712 bp, Artificial
  Synthetic
caaattcttaaaactatctccactatctctttctctctctagacaaattaagaacccttagcgtaaactctgcgaccgaagaaccccacccacccaggcagccttcaattcaattccaatggcgaacagcaatcttcctcgccgaattatcaaggaaactcaacggcttctcagcgaacctgcaccaggaataagtgcatctccatcggaagataatatgcgatactttaatgtcatgattcttggtcctacacagtctccttatgaaggaggcgtcttcaagctcgaactctttttgcctgaagagtacccgatggctgctcctaaggttcgattcctcaccaaaatctaccatccgaacattgataagcttggaaggatatgtcttgatattcttaaagacaagtggagtcctgcacttcagatccgtactgtacttttgagcattcaagcacttttgagtgctccaaatccggatgatccactctctgagaatatcgcaaagcactggaagtcaaatgaggctgaagctgttgaaacggctaaggagtggacacgcctatatgcaagtggtgcatgaaggcattagcaacgaaatatttaaaaataacaaaaattatggactgtatcctattgacttgcttatcaatatggatggctgttaatgcctggactcttccgattgcctcccataattgcttccctgtccttg

SEQ ID NO: 4525 - DNA, 529 bp, Artificial; identical to SEQ ID NO: 3632
  Synthetic

SEQ ID NO: 4526 - DNA, 605 bp, Artificial
  Synthetic
gagaagaactgtggtgggtggggggccataataataagaagaggtattattattattattattattattagtattataatgagcttgcagagaggagggcaggagggtagcttggctatggcggatggaaagcactctggtgcccccgttgatacacattccgtcgctcgtagattgcagtcggagctcatggcattgatgacctgtgggggggacccaggtgtatctgcttttcctgacggagacaacatcttctcttggcttggaaccatcaaaggaagcaccgcaactgtctatgagggtctctcgttcaagctttctttgcgctttccaaatgagtaccctttcaagcctcccactgtgaaattcgataccccttgcttccaccccaacgttgatcagtatggcaacatttgccttgacatcttgcaggataagtggtcatctgcttatgacgtccgcaccattctcttgtctattcaaagtctacttggagagcccaataatgctagtccattgaacagttatgcggcaactctatggtgcaatcaagaagagttcaagaaggcgatgcaaaaacatcacaaagatgctactggacttac

SEQ ID NO: 4527 - DNA, 361 bp, Artificial; identical to SEQ ID NO: 3631
  Synthetic
  misc_feature (234)..(234): The residue at this position can be any nucleotide.

SEQ ID NO: 4528 - DNA, 663 bp, Artificial
  Synthetic
tataacggcggtggctatttaagaactccaagtagcagaagttatagttgaagagggatctggatctgaatctgaatctgtgtcatggctagcaagaggattttaaaggaactcaaggatctgcaaagggatcccccaacctcatgtagtgctggtcctattgcaaatgatatgttccattggcaagccactatcatgggtccctttgatagtccatatgctggaggagtttttctggttaccattcatttccccccagactacccatttaagcctcctaaggtgtccttcaaaaccaaagtcttccatccaaatgtcaatagtaatggaagcatttgccttgacatcttgaaggaacaatggagtcctgctctaacaatagcaaaggtcctactctcgatatgctctcttttgactgatcccaatcctgatgaccctctcgttccagaaatagcccacatgtataaaacagacagggcaaagtacgagacaactgcaaggagttggaccttgaagtatgctatgccctaaataaagctcacctcttgccttgcatatagttgaggtatatatattatatatatacacacacgttattacatatgcaactactattgcattgctataatctttgctagaatctccaataagatatgtaatatg

SEQ ID NO: 4529 - DNA, 577 bp, Artificial
  Synthetic
agaaaaggattgagatcggcaaaagacagaaggatttcgcattcctgggtttgttgtgtgaccgaaactggatggataagcctctttaaccccaacaagggcagcgtttaatcactttcaacaagtccggggggttggttgcatacaatccaacataagctttcactttcttccaaaggcgatcaatctcttgccacaatgtccacgccgtcaaggaagcgtttgatgcgtgatttcaagcggcttcaacatgacccccctgctggtattagtggtgctccgcaggacaacaatatcatgctttggaatgctgtcatatttgggccggacgacacaccttgggatggaggcactttcaaattgaccttgcaattctcggaagactaccccaataaacctccaacagttcgttttgtgtcaaggatgttccatccaaacatctatgcagatggaagtatctgcttggacattctgcaaaatcaatggagccccatatatgacgttgcagcgatacttacatctattcagtctttgctttgcgatccgaacccgaattctcctgcgaattcggaggcag

SEQ ID NO: 4530 - DNA, 609 bp, Artificial; identical to SEQ ID NO: 3113
  Synthetic

SEQ ID NO: 4531 - DNA, 761 bp, Artificial
  Synthetic
tgtttttagtgagacaaagagtgtgaaactctcttacaatttctactttctctctctagaaaaaaagagacccttagcgtaaattttctgcgatcaaaaaaagaattcgattcaattcaatggccaacagcaatcttcctcgaagaattattaaggaaactcaacgtcttctcagtgaacccgcgccgggaataagtgcgtctccttcggaagaaaatatgcgatacttcaatgtcatgattcttggtccaacacaatctccttatgaaggaggtgttttcaaactggaactctttttgcctgaagagtacccaatggctgctccgaaggttcgatttctcaccaaaatataccatcccaacattgataagcttggtaggatatgccttgatattctcaaggacaagtggagtcctgctcttcagattcgcaccgttcttttgagcattcaagcacttctgagtgcaccaaatccagatgatccactctcagagaacattgcgaagcattggaagtcgaatgaggctgaagctgttgaaacggctaaagaatggacacgcctgtatgcaaccggtgcctgaaacggcatgactaagtgattttgaaaagaaaaagaaaaaagatgtggaatgtaatttatccactgtctaatcaggggacatgggaggactgaaagctaaattaccatctataatattttccctacccttgaaattgtatagtcaaatattgcacctttttattccaagttgaagaaactt

SEQ ID NO: 4532 - DNA, 783 bp, Artificial
  Synthetic
aaaataaaaccccctttttcccattccgatcaaattgaatcaattgatttaaggttcttctgagctgtgaagtgcttgttctgattataaaggattgaataaggatgcaggcttcaagggcaaggcttttcaaagagtacaaagaagtacagagagagaaatctgctgatccagatattcaattagtttgtgatgattctaatatctttaaatggacggctcttattaaagggccatctgaaactccttatgatggcggagttttccagcttgctttctcagttccggagcagtatcctttgcaacctcctcaagtgcggttcctgaccaaaatatttcacccaaatgttcattttaagactggagagatttgccttgatattttgaagaatgcatggagcccagcatggacactccagtctgtttgtcgagctataattgctttgatggctcaccccgaagctgatagtccactaaactgtgactcaggcaatcttcttcgatctggtgatatcagaggatatcagtcaatggcaaggatgtacactagacttgcagcaatgcccaagaaaggctaaaacaatgagctacaacctcgttcgcacagcttgtaataatggcattaacaaaagttgaattgttgcatatccgtgtttagtgttttctaacagcagtgcatgacctattgtttattaatccttttgttttttcgcatatttctgatacagctcatctcatttagcaggtttcttgtgtgcctttagcaagtggaatatgtataaa

SEQ ID NO: 4533 - DNA, 713 bp, Artificial; identical to SEQ ID NO: 3633
  Synthetic

SEQ ID NO: 4534 - DNA, 612 bp, Artificial
  Synthetic
gaacggctgcgcgtcttcccgttcgtcctcctgtccggtccgagcccctctgacgacgcgactttccccacgccgggatcgagctccggggaggggagctgcgagctgaaacactttgtcatatcagtcaacagtagagaggagaccagatgcaggcatctagagctaggctctttaaggagtataaggaggtgcagcgagaaaagtcagctgatccagatatccagttaatctgcgatgattcaaacatattcaagtggactgctcttatcaagggcccttcggagacaccttttgaaggtggtgtatttcaacttgcattctctattcctgagcaataccctctccttcctccgcaagttcgcttcttgaccaaaattttccacccgaatgtgcatttcaagacaggtgagatttgcctggatatcttgaagaatgcgtggagcccagcatggacactacaatccgtttgtagagccataattgcattgatggcccatcctgaaccagacagtccacttaactgtgactcaggcaacctcctgcgctcaggcgacatcagaggctatcaatccatggcaagaatgtatactaggttggctgccatgccaa

SEQ ID NO: 4535 - DNA, 666 bp, Artificial
  Synthetic
gccattacggccgggaatcaaaatctatctcaacccttctgtcttcttcttccccttcagtttctcaaaaattctcaagaagaagaagaaagaaagaaaaaaatcgtctccttttctgttcaaaaaaaatatatcttgaaattaaaaattcagatggctacaatgaacagtggaaacaacagcaatactcaagcaactgctcaggttatgccttcacctaaacagagtttgcctactgcaaaaactgttgatacccagtctgttcttaaaaggttgcagtctgaattgatggctctaatgatgagcggtgattctgggatatctgcatttcctgaagaagacaacatatttgtttggaaagggacaataactggtagcaaagatactgtttttgaaggaacagaatacaagctctctctttcatttcctgctgattaccctttcaaaccaccaaaggttaaatttgagactggttgctttcatcccaatgttgatgtctatggcaacatatgcttagacattcttcaggataagtggtcatctgcttatgatgtgaggactatactgatttccattcagagtctgcttggagagccaaacataagctcacctctaaacactcaagctgctgctctttggtgcaatcaagaagaatacagaaagatg

SEQ ID NO: 4536 - DNA, 711 bp, Artificial
  Synthetic
ggcgtcgattctctttgacactcgtgccgcttcatcactcaggcggtcagggatgtcgacgccagcgaggaaaagattgatgagggattttaagaggttacagcaggatcctcctgccggcatcagtggtgctccgtatgacaacaatattatgctctggaatgccgttatattcggtcctgatgacacaccttgggatggaggtacgttcaagctcacccttcagtttacggaggactaccccaacaagcctccaactgtgcggtttatttccaggatgttccatccaaatatttacgccgatggaagtatatgcttggacatactgcaaaatcagtggagtcctatatatgacgtagctgctatacttacttcaatccagtctttgctctgtgatccaaacccaaactcgccagcaaattcagaagcagcacgcatgtttagtgagaataagcgcgagtacaacaggaaggtgcgtgagattgttgagcagagctggacagcagactaacatctctcaggctgaatctgttttgggagattttcctggtaccgcctgtgtcgagctgaaaacttttcagtgccgttgctacattaaaaacaaatgtagcaggaaattgtacttttatgtgttgtaggaaactctgattgcctttatcttcatgttctgctactcgactatgagacgttgtacatatgatgatctcttgt

SEQ ID NO: 4537 - DNA, 664 bp, Artificial
  Synthetic
agaaatcaaatcgaccccttactcctctaaatccccacacccatctctctctctctctctctcctcaatcgaaggatccgacaataaaagttgattgtcttcaacatctgtctaccagcaaaaactacttgcgtgcagtcgccaactgatcctaggattatacttacatttggctatggcaactaatgaaaatctcccaccaaacgtgataaaacaattggcaaaggaattgaaaaatcttgatgaaactcctcctgaaggcatcaaagtaggtgtcaacgatgatgatttttcaaccatatatgctgatatcgaggggccagctgggactccttacgagaatggggttttccgcatgaagttgattttgacgcatgatttccctcattccccacccaaaggttattttctgaccaagatttttcatcccaacatcgcttccattggcgaaatttgtgtcaatgctctgaaaaaagattggaatcctagtttgggcctacgacatgttctcatggtggtaaggtgtttgctgatcgagccatttccagaatctgcgttaaatgagcaagctggtaaaatgctgcttgataattatgatgagtatgctagacatgcaaggctttataccagtattcatgctaaaccaaagactaagttaaaaaca

SEQ ID NO: 4538 - DNA, 584 bp, Artificial
  Synthetic
atttgatcggagggtgaatatgtcgacgccagcaaggaagaggttgatgagggatttcaaacgactgatgcaggatcctccagctggcataagtggggccccacaggacaacaatataatgctttggaatgctgtaatttttggccctgatgatactccttgggatggaggtacgttcaagctgacacttcagtttactgaagattatcctaacaagccacctacagtgcgatttgtttctcggatgtttcatcctaacatttatgctgatgggagcatatgcttagatatactacaaaaccagtggagccccatatatgatgtagctgctatactcacatccatccagtcgctgctttgcgatccaaacccaaattcacctgccaactctgaagctgcccgcctattcagtgagaacaagcgggaatacaaccgaaaagttcgtgagatagtggagcagagctggaccgcggactgatccactccatctaaccatatgatgcctgatacttaaaacgctcatcttttcagtgtgtcgtgtaccaaactgcttgtaattaaaatgctaaaacagtaaaacgtgc

SEQ ID NO: 4539 - DNA, 636 bp, Artificial
  Synthetic
cggacgcgtgggcgcaaacggcgaagcagaagggggaagagagagagagagagagagagagagagaggggactcagcgagcggtgggcgagagggggagatcgaaaccctagctagggtttgcgcgcggcggcggcggggatgtcgacgccggcgaggaagcggctgatgcgggacttcaagcggctgcagcaggacccgcccgcggggatcagcggcgcgccgcacgacaacaacatcatgctctggaacgccgtcatcttcgggccggatgatacgccgtgggacggaggcacgttcaagcttaccttgcagtttacagaagattatcccaacaagccgccgactgttcggtttgtttctaggatgttccacccaaatatttatgcagatggaagcatctgcttggatattctacagaaccagtggagccctatatatgatgttgctgccatattgacttcaattcagtctttgctgtgtgatccaaaccccaactctccagcaaactcagaagctgccagactgtttagtgagaacaagcgagagtacaaccgcaaggttcgtgagatcgtggagcagagctggacagctgactagggcatgcagcagggcaacgggtggtatccaccatgcc

SEQ ID NO: 4540 - DNA, 619 bp, Artificial
  Synthetic
atggcttccaaaaggattcagaaggagctgaaagacttgcagaaggacccccccacatcatgcagtgcaggtcctgttgcggaagatatgtttcactggcaggcaacaattatgggaccagatgacagtccttatagtggtggtgtgtttttggtgacgattcatttccccccagattatcccttcaagccccccaaggttgcttttaggaccaaggttttccacccaaacatcaacagcaatgggagcatttgcctggatatattaaaagagcaatggagtccagctctgacaatatctaaggtcttgctttcaatctgctcacttctcactgatccaaaccccgatgatcctctggtacctgagattgcacacatgtacaagatagacagagcaaaatatgaaggtattgcaaggagttggacacagaagtatgcaatgggttgagccttttttttcggcaaaagataacaacttttatcagtctatctcatatctaaaaagaatcggtttacaactttctgtttctgcatcttgttggtccaaagctcaaatcacacgtgtatctttactttcatagccaaggagttgatatagaagtagtgcaaggaacaggtac

SEQ ID NO: 4541 - DNA, 707 bp, Artificial
  Synthetic
  misc_feature (190)..(190): The residue at this position can be any nucleotide.
tccgctcactcacttactcactcactgcttacagatttagggattccagaaagcaagctgtgcgagcggtccttcatggctctgctgatctagttgaagattacctgacctgacttcgttcctccatggcaacaaatgaaaatttaccacctaaagtcataagggagctggctcgggagctaaaggcatnggatgagagccctccggcggatatcagagtgctagttaatgaggacaatttgtccatcatatatgcagatattgaaggaccatctggcacaccatatgagggaggcgtcttccgcttgaagttggtcttaagtcaagattttccgaatacacctcccaagggatatttcatcacaaagatttttcatccaaatgtagccaacaatggggaaatatgtgtgaatgtcctaaaaaaggattggaagcctgtgttggggttgcgacacattcttttggtaatcagatgtttactcatcgagccattccctgaatctgccttgaatgaggaagcggggaaaatgcttatggaagattatgagggctatgcgaaacatgccaggctaatgacgagtatccatgcaaacaaattgagggcaaagactagcaatagcatgaatgcgggtggtccaggtccaactgaactggtaagctctatgactactaacaatagcattttaactccaagctcagatgcgggt

SEQ ID NO: 4542 - DNA, 546 bp, Artificial
  Synthetic
cggtagtagtagtggaggaagaacatggccgtcgacgacgtcggtgtctagttccggtaagagaatacagaaggaaatggctgaactaagcatagaggcgccaccagattgtgcagctgggcctaaaggcgataatctttaccattgggttgccaccctcttcggcccacctggaacaccttatgagggtggaatatattttgtcgatataaccttcccttctgattatccatttaaacctccaaaggttgtattcaaaactcgcatatatcattgcaatgtcgagccttctggaaatgttagcttggacatcctaacagataactggagtccagcattaacaatctcgaaagtactacttgctctgagatcaatgttcaccactccagaaacctataagccagttgttcctggtattgcacacttatactttgaagataaagccaaacatgatgaaatagctacacaatggacactgcgatttgcaaggtgaaaaaaatgaattcaatgtggaattttcttaaccaagttctggtcagccccctg

SEQ ID NO: 4543 - DNA, 556 bp, Artificial
  Synthetic
cccacgcgtccgttcagtttggggtgagtttgaggggtcagtagtagtagcagtagcaggggaaaggggaagggagagcggtatggcttccaagcggatcctgaaggagctcaaggacctccagaaggacccccccacctcttgcagcgcaggtcctgtagccgaggatatgttttattggcaagcaacaataatgggtccacctgatagtccatattctgggggggtgtttttggtcaccattcatttccctcctgattatcccttcaagcctccaaaggttgctttcaaaactaaagtcttccacccgaatgtcaatagcaatgggagtatctgcttggatatactgaaggaacagtggagtccggctcttaccatctccaaggttcttctgtcaatatcctctttgcttaccgaccccaatccagacgatcccctcgttccggagattgcacacatgtacaaaacggacaggatgaagtatgaaacaactgcaagaaattggaccaggaagtatgccatgggataaaagacaggatctcgtttcttctcatac

SEQ ID NO: 4544 - DNA, 548 bp, Artificial
  Synthetic
tctgtttttctgtgaatccctcgcagagagtatctccactactagcgcgccagagattttctgccatcctgtcgttgcgggaattgttattataaagaaaatgagcttgaacagagcctcaggcgtggtgatgaacggggtgatgggtgaccctgctgcccctgtccctgctgcagctgctggaaagcagtctgcccctgcctcccatcccgtcgaaactcactccgtctctcgcagattgcagtcggagctcatggcattaatgacaagcggagacccaggcgtgtcggccttcccggacggagacaatattttctcatggatgggaaccatcaaggggggaaccggaactgtctacgagggaatgtctttcaagctctctttacgcttccccaacgagtacccattcaagcctcccactgtgaagttcgacggtgcatgcttccacccgaatgtcgaccagtttggcaacatctggctcgacatcctccaagacaagtggtcatctgcttacgatgtgcgtacagtccttctctccattcaaagtc

SEQ ID NO: 4545 - DNA, 689 bp, Artificial
  Synthetic
gagcgcatctcaaaagccccaagcctagggcctgtcttccccttggaacaaaagcaccccccacccatagccattagccattagccattatgtcagaaactcaggctagccttctccttggcaaacaacttagagagcttttaaaatctccagtggaaggtttctcagcagggctggtggatgattctaacctctttgaatggaatgtgaccattattggtcctcctgatacattatatgaaggtggtttcttcaatgccattatgagctttcccaaaaattatccaaatagtcctccaacagtcaggttcacctctgagatgtggcacccaaatgtgtatccggatggccgtgtttgtatttccattcttcatgccccgggggatgatccaaatggatacgaacatgctagcgagcggtggtcaccagtgcacacggtggaaaccattctattgagcatcattgcaatgctttccagtccgaacgacgagtctccggcaaatatagatgcagcaaaggaatggagagagaacagggcggagtttaagaagaaagtgcgtcgcattgtacggcgatctcaagagtgtctctgaatttggcaatataccagggtatgtatcctcattgagaaacccttgaaacttctctgaattgatagaaaaaaggaagggacatacatatatatcaga

SEQ ID NO: 4546 - DNA, 665 bp, Artificial
  Synthetic
tgcttacaggcgttagaagagaagacggagagagagagagagaagggaagtccaggcgtctctatctttcttactctgcccttctcagcattcccactgccatgtccacccctgcacggaagcgcttgatgcgcgacttcaagcggcttcaccatgatccccctgctggcataagtggtgctcctcaggacaacaacattatgctttggaatgctgtcatctttgggccggatgacacaccatgggatggaggtacgttcaagctgacattacaattttctgaggactatccaaataagcctccgacggtccgttttgtgtcgaggatgttccacccaaacatttatgccgatggaagtatctgcctggatattctgcagaaccaatggagcccaatctatgatgtcgcagcaatacttacatccattcagtctttgctctgcgatccaaacccgaactctccggcaaattccgaagcagcacgaatgtatagcgaaaaccggcgagactacaaccggaaagtgcgcgaaatagtggagcaaagctggacggctgaatgatggatgaactgtctacctctagtgatatacaagtgtgtcgaaacagttgcatgaggttgaactaattctctccttttacaagtttggcactttcgtaaaaattct

SEQ ID NO: 4547 - DNA, 716 bp, Artificial
  Synthetic
cccacgcgtccggtcgttgcttaattactgttcattcacaggaggatcctaatctctttcaggagtcgctatggcttcaaagcggatcttgaaggagctcaaagatcttcaaaaggatcctcctacttcgtgtagtgctggacctgttgctgaggacatgtttcattggcaagcaacgataatgggtcctccagatagtcctttttctggtggtgtttttctggtgacgattcattttcctccagattatccattcaagccacctaaggttgctttcaggacaaaagttttccacccaaacataaacagcaatgggagcatatgccttgacattttaaaggaacagtggagccctgccctaacgatttccaaggtgttgctttcaatatgttctcttttgacggacgccaatcctgatgatcctttggtcccagagattgcacacatgtacaagacagacaggaacaagtatgagacaactgcaaggagctggacccagaagtatgccatgggctaaacgtacctttgtatcatggggtcaagggcattttactttcagatacttcactatttacattcaatgtactaatctgttctttgagttgtaacatggagtccatgtcttaagaggaaaggaaaatcatggacgctgctcctaaaagtttgtatgtgcaaattgatctttgaaagaaaccaattaattagacttttctttc

SEQ ID NO: 4548 - DNA, 1067 bp, Artificial; identical to SEQ ID NO: 3013
  Synthetic

SEQ ID NO: 4549 - DNA, 666 bp, Artificial; identical to SEQ ID NO: 3020
  Synthetic

SEQ ID NO: 4550 - DNA, 696 bp, Artificial; identical to SEQ ID NO: 3025
  Synthetic

SEQ ID NO: 4551 - DNA, 487 bp, Artificial; identical to SEQ ID NO: 3026
  Synthetic

SEQ ID NO: 4552 - DNA, 549 bp, Artificial
  Synthetic
gtgcatctcacattcacttcctgaggccgcatctcattcagcttttaccccaccatctcacagcccatcatctatctcatccaacctctcaccacaacagcacctacatctacaagagagaacacttccctcttgaaaaagtaaacctaaataaacacatcaaatcaaaatcctccatcatggccgacaaagaccgcatcacctgccacgtcctcgacaccaccgccggccgccccgcaaagggcatccgcgtccgcctcgaaggccccgtccccagctctcccaacgcccacactgccgtcaacaccttcgagtccctcaccaacgacgacggccgcatcaccgtctggctgccctactcctcagagtcctcggccggcgaggtgcccgtctacactctcgaggacgtcctgggcgctatcaaggggccttcccggtggacgctgcgtttcgacactgccggctactttggcgaggaaaaaacattcttcccagaagccaccattgtgtttcgtgttgaagagggccagcattaccatgtgccgctgc

SEQ ID NO: 4553 - DNA, 391 bp, Artificial; identical to SEQ ID NO: 3062
  Synthetic

SEQ ID NO: 4554 - DNA, 956 bp, Artificial
  Synthetic
tggtatcaacgcagagtgccattacgccggggactcacaacagaaatagctactaaacaaacagcaaaagataaccagaaaagatggcgactttccctgttgttgatttggggttgcttcaaactgggaaaagggctgaaacattggataaaatcaaagatgcatgtgaaaactggggtttctttgagcttgtgaatcatgggatttcccatgaagtgttggacacagttgagaagcttactaaggagcattacaagaaatgcatggagcaaaggttcaaggaaatggtggaaagtaaaggtcttgaggctgtccaaactgagattgatgatctggattgggaaagcactttttacttgaaacacctccctgtttccactgtgtatgaagttccagacttagaggataaatacagaaatgttatgaaagacttcgcgttgagtctagagaaactagctgaagatcttcttgatttgctgtgtgaaaatctcgggctcgagcaaggttatttgaagaaagcattttatggttcaaagggtccaacttttggtaccaaagttagcaactatcctccttgccccaaaccagaactgatcaaaggcctacgtgctcacactgatgctggtggcctaatcctgcttttccaagatgacaaagtcagtggtcttcagttactgaaagacggtaattggattgatgtcccacctatgaaacactcgattgttatcaaccttggcgaccagctggaggtcataacaaatggaaagtacaagagtattgagcacagagttattgcacaacaagatggcactagaatgtcaattgcttcattttataatccaggaagtgatgctgtgatatttccagcaccagaattggttgaaaaggcagaagaagagaacaagttgaagtatcccaaatttgtgtttgaagattacatgaagctgtatgcaggt

SEQ ID NO: 4555 - DNA, 646 bp, Artificial
  Synthetic
gtatattgccgaggagggcgctgtcagagattggagggactacctttacctccaccttgaccctccctccactagagattataaccattggcctgtggatgcaagttttagggagaccgttgacaaatatagcaaggagaccctaaaggttgggaaaaagttgttaagcctcttatctgaaaatttgggtcttcatccatcttgttttgaggagcatctagtaaaaattcaccaaaagatgctcattaactactaccctccatgcccagagcctgagttgaccgcaggatttcacaaacattccgattttggagccataacattagtgatgcaagaagttggtgtagttggcttgcaagtccacaaagatggagagtggattccaatcatcccagaaaaaggtgcttatgtggtgaatattgcagatcaagtggagattttaagcaatggacgatacaagagtatagagcatcgtgtagtcacaaatccctacaagtctcgaatatctgtacctgttttccatgatgcagctcttgatgctgttatttctcctattaacaatatcttgaaaaatgaaaatgattgccaatacaagaaatgcagatttgaggaccatgagataacattctattcctatggagcaaat

SEQ ID NO: 4556 - DNA, 635 bp, Artificial
  Synthetic
aattgttggagatcctctgcaaagaactgggattggacgaaaactacataactcaacacttggacaatggaagcaactcggtgtttcgcttcaatttctaccccccttgcccaaagccttccatgatgatgggattgggagcccattctgaccctcacattctgacaatcctacatcaagatcaaattggcgggctccaggtctttaaagactctaaatggatcggggtgcgacctcaggccaactcgttaatcattaatgttggcgacgctctccaagtgtggagcaacggaatctacaagagcatcgaacatcgagtcgtgtgtaacaatatgagtggccggttgtctatggctttttttctcaatccaggggaggacacacagataacacctgccccgaaactatttaacagtgactatgagcactgtagcaaatacaagagctttacatggaaagaatatcgccaatccatgtacgcttacagactgaaggggaaaagcaacctccaacgcttcaccctccattagcattattaataggctaaaaaaatgcaaggctcttctaccttgcttgggaaactctcaatgtccttagttggcattagaaaatttgatgtagttacaaaataaact

SEQ ID NO: 4557 - DNA, 251 bp, Artificial; identical to SEQ ID NO: 3079
  Synthetic

SEQ ID NO: 4558 - DNA, 655 bp, Artificial; identical to SEQ ID NO: 3081
  Synthetic

SEQ ID NO: 4559 - DNA, 676 bp, Artificial; identical to SEQ ID NO: 3074
  Synthetic

SEQ ID NO: 4560 - DNA, 681 bp, Artificial
  Synthetic
gtccgggagattccggtgattgacttagtaagcttgacggcgaggagagaagtgcaaccatggcacttctccatacgcttgtgagaaatggggcttctttatgatagagaaccatggaattgacactaacctgatggacaatgtgaagcagctcgtgattcagcactatgaagccaatatgaagaaacggttctatgaatcagagctacctatgagcttagagaagaaagaaaaactcagcaacacagactgggaaagcaccttctttctttggcatcgtccaagttctaacatctatgagattgaaggtctctcaaaggatctttgcaacgcagtagatggatacattgatcagctgattaatcttgctgaaaatctttcagaactaatgtgtgagaaccttggcctagagaagagttacattaaggaagcattttcaggaagcaagggtccttctgttggaacaaaagtggcaatatatcctcaatgtacgcgccctgaattagtcaggggattgcgtgagcacacagatgctggtggtatcattctcttactccaagatgaacaagttcctggtctggaattctttaaagatggacattgggtgaaaattccaccttccaagaacaacagaatttttgtaaacactggtgatcaaatcgaaattttaagcaatgggat

SEQ ID NO: 4561 - DNA, 883 bp, Artificial
  Synthetic
gcgtccggaacaatgccgactcagggagtgaaggagctagtggagaattctcaagatcatataccagataagtatatcaagcccgagcgtgcccgtgttagatacaacagttccacagcagggattcccctcattgacctcgctgaaatccatggacaaggaagaagtgatgttcttcgtgccataagagatgcggcaggagagtggggattcttccaggtgatcaatcacagcgttccaccagctttgatggaggctatgatgaaggctgctcgtgagttcttcgacctgcctctagaggaaaaaatggcatatttttctgaagattttgaggagagaattcgtttctgcaccagctttgttccttcaacggaagaacgctgggactggcaagacaacctctcgcatacttttccaccttacggagacgatcacccctggccaaagaagccacacttgtacgaggaagttgcgaaggagtatctccaccaggttttggagctggggaacgcaatcgcaggtgcaatctctgaaagcttgggcttagaaaaagactttctcctaaaggcgttcggagagggcaggcacaacatgcgtctaaactattatgcaccttgtccaagacccgatcttgcagtgggcttcagtcctcactccgacttcggaggttttaccatcctgatgcaagaccaagtaggagggcttcaggtgaaaaaggacgaggactggtactttgtcaaaccagtcaagcactccttcgtggtcaatatcagtgatcaactcgagatatttagcaacggtaggctccggagtgccgaacaccgagctacggtgaactcaagctccgaaaggatttcaattggctacttgctttgagccttct

SEQ ID NO: 4562 - DNA, 507 bp, Artificial; identical to SEQ ID NO: 3072
  Synthetic

SEQ ID NO: 4563 - DNA, 575 bp, Artificial
  Synthetic
cacaacccagctggtgaaagagaggaacttgagagttagctagcatggcggcagcattgtcgttcccgatcatcgacatgagtctgctcgacggggcagagaggcccgcggcgatggggctgctccgcgacgcatgcgagagctggggcttctttgagatcctgaaccacggcatctcgacggagctgatggacgaggtggagaaaatgaccaaggaccactacaagcgtgtgcgcgagcagaggttcctcgagttcgcgagcaagacgctcaaggaaggctgcgacgacgtgaataaggcggagaagctggactgggagagcaccttcttcgtccgccacctcccggagtccaacatcgccgacatacccgacctcgacgacgactacaggcgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtc

SEQ ID NO: 4564 - DNA, 642 bp, Artificial; identical to SEQ ID NO: 3077
  Synthetic

SEQ ID NO: 4565 - DNA, 681 bp, Artificial
  Synthetic
aaaaagataggatctgtctgctattattatctaagtctgtttaggttttgtgttttttattactacaacaacataatgactattccggtgattgatttctcaaagcttgatggagaggaaagagcccaaactttggttcagatttccaaaggttgtgaagaatggggattttttcagttggtgaatcatgggataccagtggagctgcttgagagggtgaagaaagtgtgtgcagaatgctttaagctggaaagagaagaggctttcaagaattcaacaccagtcaagttgcttaatgagctagcggagagcaagaagagtggcaattataaggttgaaaatgtggattgggaagatgtcttccttctcactgatgacaatcaatggccctccaacactcctcaattcaaggagacaatgaaagaatatagatcagaactgaagaagctagcagagagtgtgatggaagtaatggatgaaaacttaggcttacaaaaagggtcaatcaagaaagccttcaatgaaggagaaggtgacaataatgctttttttggaacaaaagtgagtcactacccaccttgccctcatccagaaatggtgaatggcctaagagctcacactgatgctggaggtgtgattctactcttccaagatgatcaagttgatggccttcaaatcctc

SEQ ID NO: 4566 - DNA, 1191 bp, Artificial
  Synthetic
aaaatacatagaaagatggagagtttcccagtggttaacatggagttgcttaacactgaacaaagggctgcaacaatggagaaaattaaggatgcttgtgagaactggggcttctttgaggtggtaaatcatgggatctgtcatgagcttctggacacagtggagaagttgacaaagggacactacaagaagtgtatggaacaaaggtttaaggaaatggttgcaagtaaagggcttgaagctgttgagactgaaataaaggatttggattgggaaagtactttcttcttgaaacaccttcctgtttcaaatatctcagaagttcctgatcttgaagatgaatacaggaatgtagggaaaatcatgaaggagtttgctgaaaagctagagaaattagctgagcaacttttggacttgctctgtgaaaatctaggactggagcaaggttacctgaagaaagccttttatggttcaaatggtcctacttttggcaccaaagttagcaactatccaccatgtcccaagcctgatttgattaaaggccttagggctcacactgatgctggtggaatcatccttctattccaagatgacaaagtcagtggtctccaactactcaaagacgacaaatggatcgacgttccaccaatgcgccactccatcgtcattaacctcggagaccaactcgaggtgattactaatggaaagtacaagagtgtggagcatagggtgattgctcagcctgatggaaacagaatgtccctagcttcattctataacccggggagtgatgctgtcatctatccagcaccagaattgttggagaaagagaacaaagtcatttatcctaagtttgtatttgaggactatatgaaattatatgcaggtcttaagttccaggctaaagagccaaggtttgaagcaatgaaggctgtggaaactactgtcaactctgccccaatagctactgtttgagactttgatggagtattaattagaaaactgattaatgagaagaaaatggcttagtattaagattatgatgatgtattgatgatttgtttatattgattagttggggtgttttccttgttttatgccacttgggtttttcatgtactgttgtctggtagtctaagaggaatttattgttatgttctcaaaagaagttccttttaacttgaaaaaaag

SEQ ID NO: 4567 - DNA, 688 bp, Artificial
  Synthetic
aagaaagccttttatggttcaaagggtcctacttttggcaccaaagttagcaactatccaccatgtcccaagcctgatttgattaaaggcctcagggctcacaccgatgctggtggaatcatccttctattccaagatgacaaagtcagtggcctccaactgctcaaagacgacaaatggatcgacgttccaccaatgcgccactccattgtcatcaaactcggtgaccaacttgaggtgattactaatggaaagtacaagagtgtggagcatagggtgattgctcagcctgatggaaacagaatgtccctagcttcgttctataacccggggagtgatgctgtcatctatccagcaccagaattgttggagaaagagaacaaagtcatttatcctaagtttgtttttgaggactatatgaaattatatgcaggtcttaaattccaggctaaggagccaaggttcgaggcaatgaaggctgtggaaaatactgtcaacgctgccccaatagctactgtttgagacttttcatggagtattaattagaaaactgattaatgagaataaaatggcatagtattaagattatgatgatgtaataatgatttgtttatgttgattagtggggggtgtttttcttgttttgtgccactttgggttttttcatgtactgttttctggtagtcta

SEQ ID NO: 4568 - DNA, 654 bp, Artificial
  Synthetic
gaaatcatactagaggctatgtcaataacacttgggctcaacccaggaacgttaaaagaagcatttggaggcgataaaaattgcagcttaagtcaacgtattaatttctacccttcttgccctcaacctgacctcaccttagggttatctcctcactcggaccccgggggtctaactgtccttcttcaagatgaccaagtcagtggcttgcaagtgcactacgagggggaatgggttgatgtcaaacccattcctggtgcatttgtcgtaaatctcgctgatcaaatccaaataatgaccaatgggaggtacaagagcgtggagcacagagtggcagtcaattgcgatcaaagcaggctatccatagctaccttttgcaatcctagcaatgaacttctgataagccctttgaaagagttggtgggtgaatctagtgagcttcagtacaaccccatgacctttagagagtacaggtccttcataaggaggataggaacaaaaggcaaatatttccttaactatgtgcaatcacctaaacactctgtattgccatccccatagcacatcttcttctaattatcatctcctctaccttgtaaaacaacccattttgttaaaaaacgtagaatgtgtgtgtgtgtgtgtgtacatata

SEQ ID NO: 4569 - DNA, 584 bp, Artificial
  Synthetic
aaaaaacacaccaagcacaaagaagaaaattcacccatccaggtcgctgctccgttgcaaaaatctctcatgatggagactggccatgagacattggatgttttgcgttccggtttgtcgtgcccttggctgcaaggcagaatccccctttgaacctgattgtcagacacagtcaagacgaggacggagacagagcttctgttgtcagccatggccagcttacagcttccaacggcctgctactgaatgctgtcgatgccatggtgatctcgaccgtacatgagaacccgcgagctcacgttgcgcagcctgcttcccctcacgtcatccgccctggtcgccgtgaggtgagaccaggctgcgtcacgacacccgccttgcgaaaaagatcgcacaaaaaggacaagctcttcctcctccatcgccgacttctatacatcttatcacgcgaattggatggcgcacgaagcaatatttctctctggtcaaaaccggttcgaggtttcgtatgatttttttttctttacttcattgctcccgttgggggggcttcttcctcttctaatcctaaagcaccgacccca

SEQ ID NO: 4570 - DNA, 923 bp, Artificial; identical to SEQ ID NO: 2422
  Synthetic

SEQ ID NO: 4571 - DNA, 640 bp, Artificial
  Synthetic
cccacgcgtccgcccacgcgtccggaaacacaaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacagggcaaggcattgctgatggtgaatgcacaacacgcgtggcagactggccgaaaattgatgatttactgatgggcgactttggacttgaaatggggcatgccggatgggttacttgacagtatttacaccatttctattcaacaataaatg

SEQ ID NO: 4572 - DNA, 702 bp, Artificial; identical to SEQ ID NO: 3103
  Synthetic

SEQ ID NO: 4573 - DNA, 397 bp, Artificial; identical to SEQ ID NO: 3159
  Synthetic

SEQ ID NO: 4574 - DNA, 133 bp, Artificial; identical to SEQ ID NO: 3166
  Synthetic

SEQ ID NO: 4575 - DNA, 242 bp, Artificial; identical to SEQ ID NO: 960
  Synthetic

SEQ ID NO: 4576 - DNA, 738 bp, Artificial; identical to SEQ ID NO: 2619
  Synthetic

SEQ ID NO: 4577 - DNA, 472 bp, Artificial
  Synthetic
atctcttattcattacacaaaaacaacaatgtctctcaaggtcgacggcttcacttcttctatcatcttcgacgtcatccgtgacggtcttaacgacccctctcaggccaagcagaaggctgagtccatcaagaaggccaacgccatcattgtcttcaacctcaagaacaaggctggcaagaccgagtcttggtaccttgacctcaagaacgacggtgacgtcggcaagggcaacaagtcccccaagggtgatgctgacatccagctcactctctctgacgaccacttccagcagctcgttgagggtaaggctaacgcccagcgactcttcatgaccggcaagctcaaggttaagggcaacgtcatgaaggctgccgccattgagggtatcctcaagaacgctcagaacaacctctaagcgcatcatttattgattaattgatgatttactatattgaaaaaaaagaaaaaa

SEQ ID NO: 4578 - DNA, 456 bp, Artificial; identical to SEQ ID NO: 3189
  Synthetic

SEQ ID NO: 4579 - DNA, 512 bp, Artificial; identical to SEQ ID NO: 3196
  Synthetic

SEQ ID NO: 4580 - DNA, 324 bp, Artificial; identical to SEQ ID NO: 974
  Synthetic

SEQ ID NO: 4581 - DNA, 760 bp, Artificial
  Synthetic
ggataagctttcttccctcctggccggaaaagtagggttgcattctctttgctctctctctctctctcttttcgtttcatcgttcgcagggaaatcagtcgtcggatcgaatcccgtcccggccgtgcctaggaacgtgcagaatctgagaataggaagaatcaggaagaagaaagaatggagaaagttcgctccagacagcaggttttactggaccatctccgtccatgcagcactcctcggatctccactgaacttgtgagatctgtctgtttagctggagatagtgcagcttatgaaagaagaaccgactctagcgatgatgtggtgattgtggcagcttaccgcagcgctctctgcaaagccaaaagaggaggcttcaaggatacctaccctgaggacttgctggcaccggtgctcaaggctttggtagagagaactggcgtgaatccggcagaaattggagatatcgtggtaggaactgttctggctccaggatctcagcgtgcttccgagtgtagaatggctgctttctatgcaggtttcccagagagtgttcctgtaagaactgtgaataggcaatgtgcatctggcttgcaagctgtggctgacgttgtttcagcaataaaggcaggattttacgacataggaatcggagctggtttggagtcaatgacagcgaatcctatgagttgggaaggttctgtgaatccaaaggttgaaatgaatcaatgcgctcaggattgtcttcttccaatgg

SEQ ID NO: 4582 - DNA, 707 bp, Artificial
  Synthetic
ttgttgtgggtactgttttggcacctggatctcagagagccagtgaatgcaggatggctgcgttctatgctggtttccctgaaaccgtggctgtcagaactgtgaatagacagtgctcatctgggcttcaggctgttgctgatgtagccgctgccattaaagcgggattttatgacattggtatcggggctggtttggagtccatgactaccaatccaatggcatgggaagggtcagtcaacccagcggtgaagaagtttgcacaagcgcagaattgtcttcttcctatgggtgttacgtcagaaaatgtagcacaacgctttggtgtctcaaggcaggagcaagatcaagctgctgttgactcgcacagaaaggcagctgctgctactgctgctggtaaattcaaggatgagatcattcctgttaagaccaagcttgttgacccgaagactggtgattagaaacccattacagtttctgttgatgatggtatccgaccaaccacaactcttgcttctcttgggaagctgaagccagtgtttaagaaggatggcaccactactgctggaaattccagccaagtaagtgatggtgcaggagcggttctcctaatgaagagaagtgttgcaatgcaaaaaggacttcccgttcttggtgtattcaggacatttgctgcagttggtgttgaccctgcaatcatgggtatc

SEQ ID NO: 4583 - DNA, 391 bp, Artificial
  Synthetic
cccacgcgtccgcttttaggcactgttagccaggtcagtgatggtgcggctgcagtgcttcttatgaagagaagtgtagctatgcagaagggacttcctattcttggcgtattcaggagctttgctgccgttggtgtggatcctgctgtaatgggaattgggccagctgttgctataccagctgctgttaagtctgctggtcttgagcttgacaatattgacctgtttgaaataaatgaggcatttgcatcccagtttgtgtattgccgcaagaaactcaatcttgactccgaaaaggttaatgtgaatggaggggcaatggctcttgggcatcctctgggtgctacaggtgcacgttgcgtggcaactctgcttcatgagatgaaacgtc

SEQ ID NO: 4584 - DNA, 639 bp, Artificial
  Synthetic
aaatacaagagaggagcaggatgactatgcagttcaaagttttgaacgtggcattgctgctcaggaagctggtgcttttgcatgggagattgtgccggttgaggtgcctggaggaagaggaaaaccatccattattgttgataaggatgacggtctaggaaagtttgatggtgcaaaattgagaaaactccgaccaagttttaaggaaaaagatggtactgtgactgctggtaacgcttctagcataagtgatggagctgctgcattggtcttagtaagtggagagaaggcaataaaacttggactaaatgtgattggaaagatcagtggctatgctgacgctgctcaggcacctgaattattcacaactgcacctgctctagcaattccaaaagctatcaaaagtgctagcttagaggcttctcaaattgacttctatgaaattaatgaagcttttgctgtggtatctcttgcaaatcagaagctgcttggtcttaatccagaaaaagttaatgtacatggtggagctgtatctttagggcatcctcttggatgcagtggagctcgtattttggttacacttctcggggtattgagacagaaaaacggcaaatatggcgctgctggtgtttgcaatgg

SEQ ID NO: 4585 - DNA, 1509 bp, Artificial
  Synthetic
atttgtactaaaaaaataatcttgagatcaaatggagaaagcaattgagagacaaagagttcttcttcaacaccttcgtccttctcaaacttcttcttccttggaaaatattgaatcatccattgctgcatctgtatgctcttctggagacagtgctgcttaccaaaggacctctgtctttggagatgatgtcgtcatagttgctgcatataggactcctctttgcaaagcaaagagaggaggcttcaaggatacttatcctgatgatctacttgctccagttctaaaggcgttgatggaaaagactaatgtgagccctagtgaagttggggatatcgttgtcggcaccgtgttggccccaggttctcagagagcaagcgagtgcaggatggctgcgttttatgctggttttcctgaaactgtgccagttagaactgtaaaccggcaatgttcatcaggccttcaagcagttgctgatgtagctgcagctattaaagctggattttatgacatcggtattggtgctggattggagtctatgaccacaaacccaatggcctgggaaggatcagtcaacccaaaagttaagatgatggcacaagctcaagactgtcttcttcctatgggtattacttctgagaatgtagcacatcgttttggtgtgacaaggcaggaacaagaccaggctgcagttgattcgcatcgtaaggctgctgcagcctccgcttccggaaaattcaaagatgaaataattcctgtacccacaaagattgttgatccaaaaaccggagatgagacaccggtaacgatctctgttgatgatggtatacggccaaatgcctctgtttcagacttggcaaagttaaagccagtgttcaagaagagtggaactactactgctgggaactctagccaagtcactgatggtgctggagctgtacttcttatgaaaagaagtcttgcaatgcaaaagggacttcctatccttggtgtattcaggacctttgctgccgtgggtgtagaccctgctattatgggaattggtccagctgttgcaattcctgctgctgtcaagtccgcaggccttgaacttgaagatattgatctctttgagataaatgaggcattcgcatcacaatatgtctattgccgtaagaagctggaacttgacccggagaagatcaacgttaacggaggtgcaatggcccttgggcatcctttgggtgctacaggagctcgatgcgttgcaactctgctgcacgagatgaaacgtcgtgggaaggactgccgatttggtgtggtgtccatgtgcataggcactggaatgggggcagctgctgtctttgaaagaggagactcctgtgatgagctatgcaacgcgcgaaaaattggaagccacaatcttttatccaaagatgctctataaacagtagggatactcaattaataatatttacagagaagaagaacaataaatcatagtaagctttgagacattttcttggaaaa

SEQ ID NO: 4586 - DNA, 1822 bp, Artificial
  Synthetic
ctttttttttttagacaagttggtctatcctttcaccggaatcccgcgtcatatgcatcaggcttcacaacattttctgatacaaatagacaatcatctgataactttcgaaagcaaaaggtaatcagatgaacaggctgacaagggacaacttttgagttattatgcatgaatttcctaattaacaaggattctccaactagccaagttcagagctggatgagattacagatacacaagcgttttattccctactcttgtgttgatatttcaaacaatagtggcagttgcacaatttttatgacatatatatatagttctagttacatggcgtccttcgaaagccggttatgggtcgggatgcaccgagcattagtgagctcatccactgcatccccacgctcaaagacagcagcagcccccatgccagaacctatgcacatggaaatcacaccaaatcgacagtctttgccccgtcgcttcatttcgttgagaagggtactgacagaccgtgcacctgtagcacccaatggatgcccaagagccattgcacctccgttaacgttaacttttgcaggatcaagtcccaacttcttgcagcagtatacgtactgtgatgcaaaggcctcattaatctcgaaaaggtaaacatcatctatttgaagaccagcagctttcactgccgcagggatggcaacagcaggaccaacacccattatagctggatcaactccaactgctgcaaagctcctgaagacgccaactattggaagacccttttgcatagcaatgtcacgtctcattagtaagactgctccagcaccatcgcttacttggctagcgtttccagcagtagtggtgccatctttagagaatgctggtttgagttttgacaggactgccaatgaagtgcctggtcggattccatcatctgccgagaccactatctccttttcctcaccagtttttggatccacaatcttcgtgtgaactggaacaatttcttccttgaatttaccagaagcagctgcagccgcagccttcctgtgggactcaacagcagcctggtcttgctccattcgtgttatgccaaatcgttttgcaacattctcggacgtgaggcccattgggagaaggcaatcgcgtgcttgagaaaacagctcaactttggggttcacttgcccatcaaggcgaacttggttcactgtcatggactctaggccagcagcaataccaatgtcataaagtcctgctttaatgttagaagcaacatttgcaactgcttgaagcccagacgaacattgcctgtttacagtcataagaggaacggtatcagggaatccagcataaaatgcagccattctgcattcaattgccctttgggacccaggagctaaaacagtaccaacaacaatatcaccaacttcacttgggttcaacttcgttttatctatcaaagccttgaatactggaaccaagaggtcctctgcgggagtatccttgaaaccacctctcttggacttgcaaattgctgtcctataggcagcgacgatgacgacgtcgtctgcgaagcacgccccgcggtggtacgcggcgctgtcccccgcggcgcacgcgctcgcggtgatggccggcgcggcggcggcgggactcgcggcgggctccaggtgggcgagaagcaccctctgcctgttgatcgccttctccatgcttaattaaagttccaatctcttatttcttgtttcagaatatacatgctttcgctcacatctcttaccacagtaagtacttgtagtaaggtaccacaacacacacaagagaa

SEQ ID NO: 4587 - DNA, 1426 bp, Artificial
  Synthetic
agtacagagagagcgatcgatcgaggagagatggaggcggagaggaaattgaggatgcgccagcaagtgctgctggatcatctccggccgtcggcggcgcctcgccctgtcaatctcgtgacctccatttgctctgctggggattccgcggcgtatcctagaacgactgatttctccgacgatgttgtggttgtagctgcttataggactcctatttgtaaagccaagcgtggtggtttcaaggacacctaccccgaggacttgctgactccggttctaaaggctgttgtggagaaagttggtttgaatcctgcggaagttggagacatcgttgttggaagtgtgcttgctcctggatcgcagcgtgcgaatgagtgccggatgtcggcattttatgctggatttccagaaaccgtccctgtgcgcacggtgaacaggcaatgctcttctggtcttcaagctgtggctgatgttgcagctgcgatcaaggcgggtttttacgatattggcattggtgctggtctggagtctatgtcggtgaacgggatggtctgggaaggctcagtaaatccaaaggttgagatgaaccaaaaggctcaagactgcttgctaccgatgggcattacctctgaaaatgttgctgagaggtatggagtgactaggcaggagcaagatgaagtggctgttacctctcatcgtcgtgccgcggctgcaactgcaagtggaaggtttaaggatgagatcattcctattccaacaaagcttgtcgatccgaaatctggggaagagaagcaagttgtgatttctgctgatgacggctttcgcccgaatgcaaaggtcgctgatcttgcgaagctgaagccggcgttcaagaaaggaggcaccactactgctggaaactcaagccaagtcagtgatggtgcgggtgctgtgttgctgatgaaacggagtaccgccattcaacgaggactgcctatccttggagtcttcaggagtttcgctgccgtcggcgtcgaccccgcggtcatgggtatcggaccagctgttgcgatacccaaagccgtgagtgacgccggtttggagataagcgacattgacttgttcgaactaaacgaggcttttgcatcacaattcacttacagctgcaagaagctcgaccttgatatggagaaagtgaatgtgaacggtggtgctattgctcttggtcatcctctaggcgcaacaggagctcgctgtgttgctactttactccatgagatggcgaaacgaggaaaagactgtagatttggagttgtatcgatgtgtatcggtagtggaatgggagccgctgcagtgtttgagagaggaaacacggtcgacgtcttaagcaatgttcgtccagtccaggcaaataaccagctgtcgaaggatgctcgatagatccccg

SEQ ID NO: 4588 - DNA, 668 bp, Artificial
  Synthetic
gatcgttcgcaggaaatcagtcgtcggatcgaatccgtcccggccggcctaggaacgaatctgagaataggaagaatcaggaagaagaaagaatggagaaagttcgctccagacagcaggttttactggaccatctccgtccatgcagcactcctcggatctccactgaacttgtgagatctgtctgtttagctggagatagtgcagcttatgaaagaagaaccgactctagcgatgatgtggtgattgtggcagcttaccgcagcgctctctgcaaagccaaaagaggacgcttcaaggatacctaccctgaggacttgctggcaccggtgctcaaggctttggtagagagaactggcgtgaatccggcagaaattggagatatcgtggtaggaactgttctggctccaggatctcagcgtgcttccgagtgtagaatggctgctttctatgcaggtttcccagagagtgttcctgtaagaactgtgaataggcaatgtgcatctggcttgcaagctgtggctgacgttgtttcagcaataaaggcaggattttacgacataggaatcggagctggtttggagtcaatgacagcgaatcctatgagttgggaaggttctgtgaatccaaaggttgaaatgactcaatgcgctcaggattgtcttctt

SEQ ID NO: 4589 - DNA, 625 bp, Artificial
  Synthetic
gatgatgatgacaacgagaaggaggttaccgtcaacaaggacgacggtatccgacctggtgtcaccgccgagaagctcggcaagctcaagcctgctttctccgccgagggaaccacccacgctggtaacgcctctcagatctccgacggtgccggagccgttctcctcatgcgacgatctgttgccgagaagcttggccagcccatccttgccaagtttgtccactgcaagaccgtcggtgttccccccgagctcatgggaattggccccgcttacgccattcctgctgtccttgaggaccttggtctgaccgtcaacgacgttgacgttttcgagatcaacgaggctttcgcttcccaggctctgttctccatccagcattgtggaatcgacgagtccaaggtcaacccccgaggtggtgccattgctattggccaccctctgggagccaccggtgctcgacagtttgccactctgctctccgagcttaaggagtctggcaagaaggtcggtgtcacctccatgtgcattggtaccggtatgggtgccgcttctctggttgttgccgagtaaatgtacatacaagattatttatagaaatgaatcgcgatcgaacaaaaaaaaa

SEQ ID NO: 4590 - DNA, 640 bp, Artificial
  Synthetic
acaagacacacaaaaatggaccgacttaacaacctcgccacccagctcgagcagaaccccgccaagggcctcgacgctatcacctccaagaaccccgatgacgttgtcatcaccgccgcctaccgaactgcccacaccaagggaggcaagggtctgttcaaggacacctcttcttccgagctgctcgcctctctgctggagggcctcgtcaaggagtccaagatcgaccccaagctcatcggtgatgtcgtctgcggaaacgttctcgctgccggtgccggtgccactgagcaccgagctgcctgccttgttgccggcatccccgagaccgttcccttcgtcgctctcaaccgacagtgctcctctggtctgatggccgtcaacgacgttgccaacaagatccgagccggccagattgacattggtatcggctgtggtgtcgagtccatgtccaaccagtacggtcccaactccgtcacccccttctccaacaagttccagaacaacgaggaggctaagaagtgcctgatccccatgggtatcacttccgagaacgttgccgccaagtacaacgtgtcccgaaaggcccaggacgcctttgctgccaagtcctacgagaaggccgccgctgcccaggccg

SEQ ID NO: 4591 - DNA, 516 bp, Artificial
  Synthetic
agctcggccagaccatcctcggcaagtacgtcgccggcgccatcgtcggcgtcgcgcccctgctcatgggtcagggtccctggaaggccatccccaaggccctgcaaaaggcaggcatctccaaggacgacgtcgacatcttcgagatcaacgaggcgtttgccagccagtgcctgtggtgcgccaaccagctgggcatcccccacgagaagatcaaccccaagggcggtgccattgcctttggccaccccctgggctgcactggtgctcggcaggtttcgacgctgctgtatgagcttaagaggacgggtaagaaggttggcaacacatccatgtgcattggcactggtatgggcatgagcgccgtctgggttgccgagtaaagtggatgatgattaataggtgcgggtatatatgggatgaatgtgtacgaatagaaaacgagtctcttgtttatgttctcgtaaaatgcagagaacaatctagcatagaaatattgaatacctgatgttaata

SEQ ID NO: 4592 - DNA, 619 bp, Artificial
  Synthetic
gcaaagtgataccgtctttacgtcgaattgtttcttagatcttgcggatacagtacatcacatcgcaccatggctgtcgaacgaattggctccatcatcaagcacctggcccccgggtcatcgctgaacaacatccagtccaagaaccccgacgacatcgtcatcacctatgccgctcgaacaccgctcaccaaggctggcaagggaggcttcaaggacaccagcctagagtacatggtctatgctctgctggagaaggttcgcgagagaagcggtgttgaccctgctctcgttgaggacatctgcctcggcaacgtgaccgatgctcaagccgcctacaaggtccgaactgctgccctcgctgccggctaccccaacaccgccggtgccagctccgtcaaccgcttctgctcctccggtctcaaggctatcgcagacattgcccactctatctccaatgattccatcgctgtgggcattgccatgggcgccgagagcatgtcgcacggtcgccctactgaggagtttgatgaggccgtgttgaagaagagccaggaggccgacgacgccgttcagcccatgggctggaccagcgagaacgtcagcaaggactttggca

SEQ ID NO: 4593 - DNA, 554 bp, Artificial; identical to SEQ ID NO: 348
  Synthetic

SEQ ID NO: 4594 - DNA, 522 bp, Artificial
  Synthetic
cagttgatgatggaattaggccacggaccacagcatctggattggcaaagcttaaaccagttttccggaaggatggtaccacaactgcaggcaactctagtcaagtgagcgatggtgctggagctgttcttctcatgaggagggacgtagcgatgaagaagggacttcctattcttggtgttttcaggagctttgctgctgttggagtagatcctgctgttatgggtgttggtcctgcagtagcaataccagctgcagtgaagtctgctggactccagattgaagacattgatctgtttgaattgaatgaggccttcgcttcgcagttcgtgtattgctgcaacaagctgggactggacaggtcaaaagtaaacgtgaatggaggcgcaatcgccctaggacatcctcttggtgcaacaggtgcccggtgcgtcgcaactcttctgaatgaaatgaagcgccggggcagggactgcagattcggtgttgtcaccatgtgcattggatctggcatgggggcag

SEQ ID NO: 4595 - DNA, 673 bp, Artificial; identical to SEQ ID NO: 3200
  Synthetic

SEQ ID NO: 4596 - DNA, 614 bp, Artificial
  Synthetic
gaattcggaaccggagaaaaagagtccaattcttatcaaaatcaaatcatcatcatctctcatcgctttgatctgaattttcattttatagagagaaatggagaaagctattaacagacaaagagttctgttagaacatcttcgtccatcgtcttcccagagaagcgaatctgtgatctctccgtctatttgtttggctggagacagtgctgcatatcaaagaactgctgcttttggtgacgatgttgtgattgttgctgcgtaccgaactgccctatgcaagtcaaaacgtggaggtttcaaagatacccttcctgatgacatacttgcacctgttctcagggctgtgatggaaaaaactaatgttaacccggctgaggttggagatattgttgttggaacagtcttggcaccaggctcccagagagcaagtgaatgccgtatggcagcattttatgctggtttccctgacactgtgcccattagaactgtgaacaggcaatgctcatctggtctacaggcagttgctgatgtacctgctgccataaaagccggattttatgatgttggaattggagctggcctggagtcgatgtcagtaaatcccatggcct

SEQ ID NO: 4597 - DNA, 597 bp, Artificial; identical to SEQ ID NO: 3198
  Synthetic

SEQ ID NO: 4598 - DNA, 648 bp, Artificial
  Synthetic
ccccaagtaatcggcgctttcgcgagagagagcgatacgaacaagagaaaatcttctccagacaccgcggcgggcttccccaccccatcggaaggaagaagacgaccagctcgcgcgctcggatctcagccatggagaaggcgatcgatcgccagcgcgtcctcctcgcccacctcctcccctcctcctcctccgaccaatcgctcctctccgcgtcggcgtgcgccgccggggacagcgccgcctaccagaggacttccgcctacggggacgacgtcgtcgtcgtcgctgcctacaggacacccatatgcaaggccaagcgaggaggtttcaaggatacatacccagaggaccttcttactgttgttctaaaggctgttctggacaacactaagatcaaccctggtgaaattggtgacattgtagttggcacggtgctaggtccaggctcgcagcgtgcaatcgagtgcagggctgcggctttctatgctggagttcccgaaaacgttcctgttagaactgtcaaccggcaatgttcctctggattacaggcagtggctgatgttgccgcgggccattaaagctgggttctacgacatagggattggtgcaggcctggaatccatgtcagtaaatgctatgggttgg

SEQ ID NO: 4599 - DNA, 477 bp, Artificial
  Synthetic
gttcttctggcctccaggccgttgctgctgtagctgcatcaataaaagcaggattctatgatatacgcattggtgctggactagagttaatgacggttgacaatattggaagagttcaacaagttaatccgaaagtagatgcatttgcacaagcgcgtgactgccttcttcctatgggcattacttctgagaatgtcgcccaacgttttggagtgacacggctagaacaagaccaggctgctgttgtttctcaccagcgagctgctgcagctactgcatctggaaagttcaaagatgagattatcccagtattgacaaagatcgtggacccacaaactcgaagggagaagcccattgtgatttctgtagatgatggcattcggccaaacacaaatttgacaaacctggaaaagctgaaaccagcattcaaaagtgacggaaccacaactgcaggcactgctagccaggtcagtgatg

SEQ ID NO: 4600 - DNA, 157 bp, Artificial; identical to SEQ ID NO: 408
  Synthetic

SEQ ID NO: 4601 - DNA, 157 bp, Artificial
  Synthetic
ggacaggggaagggggtgttagttgcgatagccgatgtttgcatgtgaaggccactactttaccaaaagaggatgctgggatggctgttgccggtcgagtaattaatatgcataatagtatccgcaggtgatgaggtgattttaatgtataattgct

SEQ ID NO: 4602 - DNA, 623 bp, Artificial; identical to SEQ ID NO: 151
  Synthetic

SEQ ID NO: 4603 - DNA, 781 bp, Artificial
  Synthetic
aatacctcaaactgagacaacatccaatcctactcttctactactactactactttttactctcttaagtatatcagtgatcaagaataatggatatatttagaagctattactcggacccacttgctgaatgttcatcaatttctgacaatggtggcagctcctgtaatagagctaacctttctgatgaggaagttatattagcttcgaataaccccaagaggcgagcagggagaaagaagtttcgagaaactcgacacccagtatacaggggagtgaggaagaggaattcagacaagtgggtttgtgaagtgagagaaccaaacaagaaatcaagaatatggctgggaacttttcctagtgcagaaatggcggctagagctcatgatgtggcggctattgcattaaggggccgttctgcttgtttgaactttgctgactctgcttggaggttacctatccctgcttcctccgacgccaaggatattcagaaggcggcggctgaggcagccgaggctttccggtcgtctgaggctgaaaatatgccggagtactcaggcgaaaattcaaaggaagttaacactcctgaaacgccagaaaatatgttttatatggatgaggaggcgctattctgcatgccgggattaattgcgaatatggcagaaggactaatgttacctccacctcagttcccaaattggagatcatatggaattagctgatgtttacatgcctttgtggagttattctatttaaatataactctggttatcacttacca

SEQ ID NO: 4604 - DNA, 724 bp, Artificial
  Synthetic
gcagcatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaa

SEQ ID NO: 4605 - DNA, 656 bp, Artificial; identical to SEQ ID NO: 3446
  Synthetic

SEQ ID NO: 4606 - DNA, 662 bp, Artificial
  Synthetic
gcagcatgatagcttcagagagtaccaagagctgggaagctagcgcagtcagacaagagaatgaagaagagaagaagaaaccggttaaagattccggtaagcatccggtttatcggggtgtccgaaagaggaactggggaaaatgggtgtccgagatacgtgaacctaggaaaaaatcccgaatatggctaggaacgtttccttccccggagatggcggcgcgtgcacacgacgtagccgctcttagcatcaaaggagcctccgctatactcaatttccctgacctagccggctctttcccacgccctagctcgcttagccctcgagacatccaggtcgcggctctcaaagccgcacacatggagacctcacagtctttttcttcttcttcttctttaacgttttcatcttcacagtcttcttcttcgctagagtctctcgtgtcttcctccgcgaccggctccgaggagctaggggagattgtagagctcccaagtttgggatcgagctatgatggtttgactcagctaggtaacgagtttatattctctgactccgcagacttatggccttatccaccgcaatggtcagaaggtgattaccaaatgattcctgcctcgttatcacaagattgggatcttcaaggactgtataattattaa

SEQ ID NO: 4607 - DNA, 548 bp, Artificial; identical to SEQ ID NO: 1013
  Synthetic

SEQ ID NO: 4608 - DNA, 648 bp, Artificial
  Synthetic
gcagcaatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgatacgacgaccacgaatcatggcctggacatggaggagacgatggtggaagctatttatacaccggaacagagcgaaggtgcgttttatatggatgaggagacaatgtttgggatgccgactttgttggataatatggctgaaggcatgcttttaccgccgccgtctgttcaatggaatcataattatgacggcgaaggagatggtgacgtgtcgctttggagttactaa

SEQ ID NO: 4609 - DNA, 781 bp, Artificial
  Synthetic
ttgcagcatgggaaaacaaatcaacatagagagtagtgctactcatcatcaagacaatattgtttccgttataacagccacgatatcctcctcctccgtcgtaacgtcttcgtcagactcttggtctacctccaaaagatcgttagtgcaagacaatgactccggagggaaacggcggaagagcaacgttagtgatgataacaagaatccgacgtcgtatagaggagtgaggatgaggagttggggaaaatgggtgtcggagattagagagccgaggaagaaatcaagaatatggcttggcacttatccaacggcagagatggcagctcgtgctcatgatgtggcggctttagctattaaaggcaactccggttttcttaatttccctgaattatccggtttgcttcctcgtccggttagctgctctcctaaggatatacaagctgcagctaccaaagccgccgaagcaaccacgtggcacaaaccggttatcgataagaaattagctgatgagctaagccactctgagttgttgtctaccgctcagtcttcgacttctagtagtttcgtgttttcttcggacacgtcggagacttctagtacggacaaggaaagcaacgaagagacggtgtttgatttgccggaccttttcacggacgggcttatgaacccaaacgatgcgttttgtttatgcaacggcacctttacgtggcagctttacggagaggaggatgtagggttcaggtttgaagagccgtttaattggcaaaatgactaataa

SEQ ID NO: 4610 - DNA, 661 bp, Artificial
  Synthetic
atgcagcaatgaactcattttctgccttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctattataa

SEQ ID NO: 4611 - DNA, 665 bp, Artificial
  Synthetic
gcagcatggtctccgctctcagccgtgccatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataataagcggccgcgtcgaggggt

SEQ ID NO: 4612 - DNA, 395 bp, Artificial; identical to SEQ ID NO: 1111
  Synthetic

SEQ ID NO: 4613 - DNA, 385 bp, Artificial
  Synthetic
gcagcatgcccctctcgtcaccaaggccaagggccgtaaactcacggctgaggaactctggtcagagctcgatgcttccgccgccgacgacttctggggtttctattccacctccaaactccatcccaccaaccaagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagattgcaccatcctcctcccctaa

SEQ ID NO: 4614 - DNA, 420 bp, Artificial
  Synthetic
gaaaaatatctcaacagcagtcaaaagcttacctgatcgatcacacattgaagctgccgccgcatgggacagagtgagtggagacgagaggcagcagtccaatcccatctgggagcggagagcaaagcgccgcgctgccgacgggctcgatgaatccacttcggcggaggagaccgactcgagtccgaattacaagggagttcgtcgccgcagctgggggaagtgggtgtcggagattcgagagccccgaaagcgtaccagaatatggctaggttctttagccacgccggagatggctgccaaggcctacgactacgccgtctactgcctgagaggcccctccgcaatgctcaatttaccagactcgccgacagcaatctctcctggtaagaagctcacttcctctaaagagattcaagc

SEQ ID NO: 4615 - DNA, 652 bp, Artificial
  Synthetic
aagagatttggagaggaggaattcacagctttcaatcgagcaatccatcaatcaatcaatcaactcaagttcgaaagcaatccccggtcaatcgatcaaggtttgggtctctgctttagctctctagatcccgcattggtcgctagcaaaatagcgcggatcaaggcagcatcgtcgccgccaatgacggcggccaggaggtacaagggggtgaggatgaggagttgggggaaatgggtgacagagatcagggagccgaagaagagatcgcgcatttggctgggatcgtacgccacggcggagatcgcagccagggcgtacgacgcggcgctcatgtgtctccgcggcccgtccgcccaattcaacttcccggccttggctccacggcatctcccctacaacccgcagtgctccccggcattcgtccagcaggcggcggcggaggcggcggcggaggcagcggaggcgctggggacatccagccccgaggaggaacactccaattcgtcgtcgcatccttcttcattcgagacgagctcgatatccacatccggcgagaacaattgctcgtcgatatcgtcggacgaggaggtgagcactgccaaggggggatcgaccgcgatccagcagcagggatcactggcgtacgagg

SEQ ID NO: 4616 - DNA, 481 bp, Artificial
  Synthetic
gatagatcttgccagaccttctgtcaggcgtgaattggcggtggacaggaccaccaacgagcgttctaagtctccactttgatgagaacggcaagaagagatatctacctcgatttgcagccatggtcgagaagctcttccagcacagattgtctaggatcgaagatggaagctacttccgtcgaacaggcggcaacagcggcagcagcagcgggagtagcggcaacggatcatgtggaagacgagatcacggattgcttcttcccaggaccaagtacaaaggagtacgaaagcggagctgggggaactatgtatcggagatccgggagccgagcaagcggtctcgaatctggctcggctcgttcgagacgccggagatggcgggccgagcttacgacgccgccgttctgtgcctgagaggtccacactccagcttcaacttcccagagttcgtccccggcttgcctcgtcctttaccgac

SEQ ID NO: 4617 - DNA, 567 bp, Artificial; identical to SEQ ID NO: 3439
  Synthetic

SEQ ID NO: 4618 - DNA, 647 bp, Artificial
  Synthetic
taagattctccttccccatctcccccttttttcttccttttgtgtagggtagattttcatcaatacttatagaggttccttttttgggaaagagaaaaccaaaaggaggattctattttgttgtttgtttgatggtttcgatgatggaaggagaaaagagaaagcaaaggcaacaccaacaagataagccatatagaggtataaggatgaggaagtggggtaaatgggttgctgaaattagagaaccaaataaaaggtctcgaatttggcttggttcttactcttcccctgtcgccgccgctcgagcttatgacaccgccgtattttatctcagaggtcctacggctaggcttaatttccctgaatgtatagtcaatgatgaccgtgaacttcacgatttatctgctgcttctattcgcaaaaaagctactgaagttggtgctagagttgatgctttgcaaactgccgcccttcataataattcttctgcaggttttactgaatccaacagtaattcaaatattaacccgagaagggttactattaaaccggatttgaatgaatatcctagccctgaaagttgcgacgaagataactgaaatctgcagcttttaattagttcgatctccaagattttactggcgaaa

SEQ ID NO: 4619 - DNA, 626 bp, Artificial
  Synthetic
agtgaacattaagaatggcggaaaaaggaggaaaagggttttctctaccaaaaaatggaaagtctgccctcaaatctcctgcatccaaagggaaggatgatatctcagcaaaatcgaaaagaggaaggaaagttcagtttgatcctgaaggatcactggataccaatctcacaaaatcgaatggaaaagctgatcaaccatcttccaaagatgtttccggcaaaggcgggaaaggagaaaaagctggcagtggtagtaaaagtcaaacagcaaaagcacctggtccgttggagcttagagttgaacaagaacttccggacaatacaacatgtctgatggactgtgaagctgctgatattttgcaaggaatccaagagcaaatggtggttttgtctgaagatccagctataaaactacctatttcatttgacaggggattgatgtatgcacaaaggaacaggctttacgataatcccgatacggttaaacaaatactcaaacctctaaaagagcacggtgtttccgatggggagctctgcatgattgccaactttgccgtggaatctgttgatgaagtattttctcttgttccctcatttaagactaaaaagagcaagctgagagtt

SEQ ID NO: 4620 - DNA, 560 bp, Artificial; identical to SEQ ID NO: 3505
  Synthetic

SEQ ID NO: 4621 - DNA, 633 bp, Artificial
  Synthetic
ggagcttcatctgatgaattgtgtaaagaaaactgaagaaggaaactcttcaatggaaaaagaaataaacagattggtaaatttgctaaaagaggctgagcaagaagtttctttcaaagaggaagcagttcagttgaagaattccctgcatgaagctgaatctgaggtgacctatctgaaagaggttcttggtgaagcaaagggcgagagcatgaaattgaaggagtcgctgttggacaaggaaaatgaagtgcagaatattcttcaggagaatgaggagcttcgtagtagagaagccgaatctttaaagaaagttgaagagttgtccaactccctcaaagaagctctggccaaaaaggaaactgaagaaaatggcgagctttctgaaagtgaaaaagattatgatatgcttccaaaggtggtggaattctctgaacgaaatggaggaggaatactggagaagcctaagattgaagttattcctcatcaatctgagcaatctgctgaagaaaaatctgaaagagtcgtcaacatcatctcgcatgatgaagctgttgagaccttaactgaagttgagaagccaaatggcgaactgaagggaaatgagcacaaagaaaaggaagatgatgattc

SEQ ID NO: 4622 - DNA, 624 bp, Artificial
  Synthetic
aatccctcagttttttccaagaaaagcacaaaaatccaacatggagtattacaatgataatggctttttagaagaactattatctctaagaaatgactcatgggatactactacaacacttgttcctatggaaatgacagatttttacaactttgaatctttaaactctcttgatattccacttccttgtgcttctactactattactacctctaattcctttgaagactactcatatgatttgccatttgaccaaagtctaataaattcttcattttatggtgatgaattgtctcctcttgagctaactgataatacgtcctcattccctaattcccatgaagatttttcctcaatcttggaagatgtagttgggaactatagttttcagaatttggaaatggggaataatattccttgtaaattggagcaaattcaagtatgtgaagcagcagcaccttcctgtttcaatgatggtttgtgtccagaaagaaagacaaaatccaagaaattagatgggcaaccttctaagaacttaatggccgagagaaggagaaggaaaagactcaatgatagactctctatgcttagatcagtagttcccaagattagtaagatggacag

SEQ ID NO: 4623 - DNA, 337 bp, Artificial
  Synthetic
cgagaaactagccgcagaaaatgttcagtccctcttggaagagaaaaacaaacttataaatgagttggagaactccacggaggaggaagagaaaagtaagaaggcgatggaaagtttggcatcggcattacatgaagtttcttcagaagcaagagaagccaaagagaggtggttgtctagccaagctgaacatgaacattacgaaacacaaatagaagacttgaagttagtattgaaagcaaccaatgaaaagtacgaaagcctgcttgatgaagcgaaagagaaaattgatgatctcactaattcagtcgaacaatctaagaatgagcaccaaatt

SEQ ID NO: 4624 - DNA, 127 bp, Artificial
  Synthetic
gccattaccgccggggaatacagtttggattttctttctttgtatgggggagagccaaggcaatggaagggaacactatgttcaagttatctcatgtaactgctttcttgctccttgcatcactttt

SEQ ID NO: 4625 - DNA, 603 bp, Artificial; identical to SEQ ID NO: 3526
  Synthetic

SEQ ID NO: 4626 - DNA, 774 bp, Artificial
  Synthetic
ttgtcattaattaaggccattacggccggggaaaacaatacagtttggattttctttctttgtatttttcaaagcaaaggcaatggaagggaagactatgttcaagttatctcatgtagttgctttcttgctccttgcatcgctttttcaacctcttacggcaagagatctagtattcgaagtaagtgacggaatagaagtcttgcaattcccaatggcaaaagaaaaccaagtggaaacacttgatgatccctctctctcaataatttgcccaggaaagcaatcatggcctgaacttgtgggaaagccagcggcgactgctaagagaataattgagaaagaaaatcccatagccaaagttcagtttttgttccctggtatggttaggccacttaattatgtttgtggtcgagtttttgttgttgttaactggaaactcattgttcgagatactcccagcatgggttaattaaatagttctatgggactattatggaagattcagaataagttgccccaagaattaataaatagagtactggtgttctatagtgtactcttcatgtactgtactatttcaatataataaataaaataagtgtggctttttaaatttgtattataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4627 - DNA, 746 bp, Artificial
  Synthetic
tgaagtagcccatcacaagaagcattgaattttgttgcgcgcttgacattgcttaagtggctctttaacaaaggcatcatggcggcatggcgctaagggaactatggcttcaaaactacctatagtgaaagcaaaggctgttgaagtttcaaaattcttgaccaagcatggatgtgcatactacaagcagacgttggaacagaacaagcaatatattcaagagccacctactgtggagaaatgccagcatttggcaaaacaagtattctacactcgcttagctagtattccttgccgctatcaagcattctggaaggaacttgatgatgtcaagcacttgtggaagcacaaacaggagctgaaaatcgaggatgctggcattgctgctctttttggccttgaatgttttgcttggttttgtgctggggagatcataggacgagggttcacgattactggttattatgtctgaatgtctccaagtattaggttcgaaaggaatgacttatgtcactgttgatgaaaggtcattgtcaatctctactttgagcgggataacacgtatcagcgagatacagattttcaattttcatgtttagcaagtacaatgtacgcagaggatgagccttctgctaaagatttcaaaggctgagttaggagtaatatacgtgcttcaataaggcggcatcaagcatgtattgcgcgattattgttgcttctatatgtttattttcctctggaatcaa

SEQ ID NO: 4628 - DNA, 502 bp, Artificial; identical to SEQ ID NO: 3530
  Synthetic

SEQ ID NO: 4629 - DNA, 668 bp, Artificial
  Synthetic
ggcccacgcgtccgaaaccaagaggcgcaggcagcaaagtctcgcccatcgtctttccttaacacctatccgtaggttcattcatttgcagagctcaaagggaattgatggcatccaaaattcagcaactacaatctaaggcatgccaagcttcacaattcctcaccaagcatggtactacctactacaaacagtttctggagcagaacaaacagtatattgttgagccacccaccattgagaagtgcaatgaattgtcaaagcagttgttccatactcgtcttgccagcatccctggacgttatgagtcattccagaaagaacttgattctgtgaagcacatgtggcagaatagaaaggatttgaaggtcgaagatgccggtattgctgttttgtttggcttggaatgctttgcatggtattgtgctggtgagatagtaggaagaggatttacattcaccggttactgcgtctgagatcttcagtttcataaaatttgttcgcacgattgacactgctgtaaggtctgtctcatattacggtgtgactgggagtctatacaagagtttatgtacaccaaaagcttttaaagctgagaaatcagcgcttaaaattgtttcacaataatatgcccatttcgttcttttcccactccagtgaagtggctt

SEQ ID NO: 4630 - DNA, 324 bp, Artificial; identical to SEQ ID NO: 3533
  Synthetic

SEQ ID NO: 4631 - DNA, 450 bp, Artificial
  Synthetic
aaacatcgcccatagtattactgcaaattgttgacgaaaggactttcttggtattgatggcatccaagattcagcaactgcaatctaaggcatgtcaagcttcacagtttcttgctaagcatggtactggctactacaaacagatgctggagcagaacaaacagtatattgtggagccacccagtgttgagaaatgcaatgaattgtccaagcagttgctctacactcgtcttgccagcatccctgcccgttatgagtcattttggaaggaagtcgattccgtcaagcacatctggaggaatagaaaggaattgaaggttgaagatgcaggtattgctgctttgttcggcttggagtgctttgcatggtattgtgctggtgagatagtaggaagaggatttacattcactggttactatgtctgagatatcagttcccaaaaatttgttt

SEQ ID NO: 4632 - DNA, 598 bp, Artificial
  Synthetic
accttggttgaatattctccatcgacggggagagacaacaacaggcatggcctcactactgaagcaactgcaaggcaaagcatgcgtggcctcccagttcgtgtcgaaacacggatcgtcctactacaaatccctgatggagagcaacaagcagtacatcgcctccgagcccaccgttgagaagtgtcaggaactttccaaacaactcttttacacccgtcttgccagcttgcccgctcgatatgaacacttttggaaagagctggatctcgtgaagcagaaaatcaagaacaggcaagacttgaaggtggaggaggttgggattgctacattattttcattggagtgctatgcatggtattgtgttggagaaattgccggaagaggtttcactctcacaggctattatccttgacctttttcaagcttccatttaaaagtctaatagggaaccaaggagagagctgtttcagacaaaccttcctaataatgtcacctgtgtgaatttacatgactgcaatttttgcaattatccgactgagtcatggtcctttgtctccttttcagtctttttaaagatatttgttatatcatggca

SEQ ID NO: 4633 - DNA, 534 bp, Artificial
  Synthetic
gctggcgcagctacggtccaaggcggcgcaggcgtcggagctcgtgtcgaagcacgggtgcgcctactacaaggaggtgatggagaagaacaagcagcacgtggtgcagccacccaccgtggagaagtgccaggagctctccaagcagctcttctacacccgcctcgccagtttgccaggccgctatgaggcattttggaaggaatttgatggtgtcaagcaggtatggaagaatagaaaggagctcaaggtagaggaccttggaattgtgacattatttggagttgagctttatgcgtggttctgcgtaggcgagattgttggcagaggattcaccataaccggctataaggtctagaagagttctgattaagacctggtttataaaatacactgttagctgatgcttgtcgaaatgacaaagatacctcctgccttttcacaattttgtttatggaaagtctttctagtgctggatgtcagccaagacgagcacatcgttgcaacactgcttcaataatttgctcgatctct

SEQ ID NO: 4634 - DNA, 613 bp, Artificial
  Synthetic
accttggttgaatattctccatcgacggggagagacaacaacaggcatggcctcactactgaagcaactgcaaggcaaagcatgcgtggcctcccagttcgtgtcgaaacacggatcgtcctactacaaatccctgatggagagcaacaagcagtacatcgcctccgagcccaccgttgagaagtgtcaggaactttccaaacaactcttttacacccgtcttgccagcttgcccgctcgatatgaacacttttggaaagagctggatctcgtgaagcagaaaatcaagaacaggcaagacttgaaggtggaggaggttgggattgctacattattttcattggagtgctatgcatggtattgtgttggagaaattgccggaagaggtttcactctcacaggctattatccttgacctttttcaagcttccatttaaaagtctaatagggaaccaaggagagagctgtttcagacaaaccttcctaataatgtcacctgtgtgaatttacatgactgcaatttttgcaattatccgactgagtcatggtcctttgtctccttttcagtctttttaaagatatttgttatatcatggcagttatgttaggaaaa

SEQ ID NO: 4635 - DNA, 693 bp, Artificial
  Synthetic
cccacgcgtccgctgccttttagcttcttttgaggtcaaggggttcgagtcgacagcggtcaccaaaaggcgatttttatctcagctgttcaatcgatttcagtatcttgatctatgggaaagaggaagtcaaagtcaaagccacctccaaagaagaggatggacaaacttgatactgttttcagctgtcctttctgtagtcatggcaccagcgtggaatgtcgcattgatatgaaaaacttgattggcgaggcgaattgcaggatctgccaagagagcttcagcaccacagtcactgcactaacagagcctattgatatatacagtgaatggattgacgagtgtgaacgagtcaacaactatgaagaagatgatgtttcctacaagttagatcctaacgaatgatctgcttcaagattgtgcagcttgttgagtagccagaaatgatttaaagctaccttaagcttgacttcaattttggcaattattcgtcacactgcctaagaagaacctaaacttatccaggcctctggagtccaataagtagctccatttaagaggctttctatgtccaaatagtttgaaacagagtcagttgctatcttgtttatgttatgcccctgcaattatagcttgcttatatgagactggcttaatgatgtgaacctaatgttaagtaggtttatttctccc

SEQ ID NO: 4636 - DNA, 555 bp, Artificial
  Synthetic
aaaactcacatttaagtttacaagatgacgagagcaagaatttcagctggtgtaggttcatctcaggcggatgttgttgttgacctgggacatccacttttaaatagaacattcgatggatttgttaaaattggagggattggtgctgcccattctgctgcacaagaggctttccacagcttgaaaaagggcagtatttcaaaaaacgaccttgaacacacggtgaaacgtatgggcaaggaaggtttacaatggggtgttgttgctggagtttatagtggcatgcaatatggaatggaacgagtccgaggaaagcaagactggaagaatgcaatgctcgggggggcagtaacaggagcccttcttgcatgtggagagaagggctcgagcagagacaaagtcatccagaatgcaatcactggggcagcagttgccaccgcggtcgaattcttgcgctacgtgatctagatgtcagtgctaaaagaaccccacctcccttttgctttatgacttacgaaacttttcatgttctataagaaaataataaaaaataaa

SEQ ID NO: 4637 - DNA, 500 bp, Artificial
  Synthetic
cccacgcgtccgaaaatatcccaaaaccaaaaacagaggaagaaagaagaagaaaagatgccttcaagcacattctccgggactgttagcacgccgaagctgtcggtggcagtggacatgggaaacccttttctcaatctcaccgttgatgccttcctcaagatcggagctgttggagtcactaaatctcttgcagaagacacttacaaggccatcgagaaagggagtctctccaagagcactttggagcatgcgcttaagaagttgtgtaaagaaggtgtttactggggagctgctggtggagtgtacattggaacagaatacggaatcgaacgtatccgtggcagcagagattggaaaaacgcaatgttagcaggcgcggcgacaggagcagtgctctcagcggttggtaagaaaggcaaagacactattgtgatcgatgccattcttggtggcgcgcttgcaaccgcttctcagttcgttaacaatcattatttcta

SEQ ID NO: 4638 - DNA, 672 bp, Artificial
  Synthetic
tgctctcgtcacctctgggaattttttttgctttgtaacctccctacctttggctgattgatcgatttcttcttgccgctagaggaaaaatgccgcaaggtcgcgtcaacaccagcttcgatggacccagtgtggatgttctcatcgacatgggacatcctctcctcaaccgaatcgtggatggattcatcaaagtcggcggggccggtgtcctccatgccgcggcccaagaatccttccgctacatgtcgcaagagagcaccaacaagagatctctcgagaaatcggtgaaccaaatggggaaggagtgtctgcaatggggaatggtggctggagtctattgcgggatgacttatacgatgcaggaagctcgaggcgtccacgactggaagaacgcactgcttggtggagcattgacgggcgcggcattatcgctgacggactcgtctgtgacccacgagcgcgtcatctcgagcgccatcaccggcggagcgattgcgaccgctgccgagttcctccgcaatctgacctgaaaattattctcaaatctccggcagctccgccatggatgggaataatagtggtatacttgtcgatgatcatctatctacatatgtgtgcaagagcctggtttttctactgtgacgactcttggcattttaaaatctatga

SEQ ID NO: 4639 - DNA, 639 bp, Artificial
  Synthetic
cacgcgtcgggcgtaacgaggctttcatttcttactggcagctcaagcaaacttgttttagaggttgtaacacaaacgaatgtcctcgctgtgccagatccggcacgatctagaaaaaaaacttttgtagcacctttcaaccatatagtttgatagtgtcttcttttctttttcttttctcctttcgatttcaagcaaaatgccgaaggggagggtctctgccagcatgaattctccaactgtggatgtcataattgacatggggaatccattcctgaacaggactgtggatggattcttcaagattggagctgtcagtgcaggacatgcagcgggccaagaagcttttaaatctctcaagaatcaaactgttaccaaacgtgatctcgagcatacgctcaagcgcatgggaagagaaggcttacattggggaactatagctggagtttacactggaatggagtatggcattgagcgagttcgtggaaagcatgactggaaaaatgcaatgcttgggggtgctgtcacaggagcactcgtgagcttcgctgaacctcactacagccgagacaagatgtttcagaacgccatcgctggggccgcgattgccacggcctcggagttcctgcgtcagcttac

SEQ ID NO: 4640 - DNA, 569 bp, Artificial
  Synthetic
  misc_feature (514)..(514): The residue at this position can be any nucleotide.
gattcatcgatcgagaagtcgaggtagtacatacgttggattggattggaggaggagaatgcctcgcggtgggttctcggggtcgataagctcgcccaggatcgacgtcgccatcgacatggggaaccccttcctcaaccgcaccgtcgacggcttcctcaagatcggcgccgtcggggcgtgcaaggtcgccgccgaggacacattcgactgcctccacagaggggatgtttcaaagcacaagcttgagcatatgctgaagaaaatgtgcaaggagggtgcctattggggtactgttgctggggtgtatgtgggcatggagtacggagtggagaggattcgtggtcgccatgactggaagaatgctatgattggaggtgctttaagtggtgctctgatctctgctgccagcaacaaccacaaagacaagatcatcaaggacgccatcaccggaggcgctgttgcaacagctgtcgagttcatcaactacctcacttagtcatgtaactgcgtntttgcagtggcttttgttggacagcaagaataagagcttcttcactgaagccatg

SEQ ID NO: 4641 - DNA, 583 bp, Artificial
  Synthetic
gcagattttcagcatcattagcttctccaaaggtggatttggttattgatatgggcaacccacttctcaaccaaactgttgatgctttcttgaaaatcggcactgttgctgtcaccaaaactgctgctgaagaaacttatcacatcgtcaaaaaaggcagtgtgtcgagtcacaactttgagaattcgttgaagaaaatgtgtaaagagggtgcttattgggggactgtggctggggtatatgctggaatggagtatggagcagagaggatccgtggaaccagagattggaagaatgcgatgattgggggtgcattgactggggctctcatatctgctgcaagcaacaacaatcgcgacaagattgtgatggatgccattacaggaggtgctgttgcaactgctgctgagtttcttaattatctcacatgaatttcttaccaactacttaagaacattgcttagcatttgctctatttctcgaattgtatccatttgaaattactagcttatgacatgaatcttagactatttgaatatgtttaagtgaatctataaattagctatctttttcaaaaaaaaaa

SEQ ID NO: 4642 - DNA, 591 bp, Artificial
  Synthetic
ttcatcagtcttaagagagatggcgtcagtgaactcgaaggtgtcctctgtcgatgttttggttgatacaggtcacccccttgtcaataggcttctcgatgctttccttaaatctgcaggggtaggagctgcacacgccgcatcccaggacatctccaaaatggttcttcaaggggattcgaacaagaaatctgtcgaaaatatggttcagcggatgggcaaggaagcagttcaatggggactggtaactggagtctacactggcatcacatatggcatgcaggaggccagaggaagacatgattggaagaatgcaatgttgggaggagctctaaccggcgcagctctgtcgttaacagagtctaatagctcccatgaacgcataatccaaaatgcaatcaccggtggagccattgctacggccatcgaattcctccgtagcctcacttaaaaaccttggaaccacattagtttgggatgtaggcctagatggactcatctcatctagcatcagacaataagaaaacctttttctgtgctatttttttcaagattaatgaacaaatatataataatctatgctctacccta

SEQ ID NO: 4643 - DNA, 717 bp, Artificial
  Synthetic
cctttttcgagcaccaaaatatcaatatcaacttcatcagaataatctaaaaacttttttagcctaccaaagtggaaagccaaagaaaaaaatgtcatctgagattttcaaagcaaccaatgacttaccggaaacagaaatctccggcctcaatttcaaggaaactgagctcagcctcggcttacccggcgaatcacgaaagcaaatctccggcacaaaacgtggaatctccgacgctatggaattaagcctagggagctctaactctgaagattatcactctaaaaatgaaatctctactggaaccaaacctccagcaaaggcacaagtagtgggatggccacctgtgaggtcatacaggaaaaacatgatagacaagtgcaagtacgtgaaagtggcagtagatggagctccctacttgagaaaagtagatttggagttgtacgacagttaccagaagctgttaaatgctctacaaaacatgtttacttgcctaactatctgtaattttcaaagcgaaagcaagcttatggatattacaaatggtgtggaatatgtaccaacctatgaagataaagatggagattggatgcttgttggagatgttccttggaaaatgtttgttgatgcttgtaagagaatcaggttgatgaagagctcggaagcaattggattagctccaaggacacccgtgaaatgctcgagtacaagctaaac

SEQ ID NO: 4644 - DNA, 863 bp, Artificial
  Synthetic
ctcaacttattaagaaaaataccaaagaaacaaacaagagaagaaaagaaaaaaggattttttattaattatattttgaagaaggattttttaaattaaaatcttgacagaattcagatgacgagtgtgataggagttgagtgtgacaaaattcgattggattatgaagcggagacggagcttaggctagggttgcctatagccattaatggaaatgaaggtgaaatgacgtcaaagaataatgggaagagagtcttttcagaaactgttgatttgaaactaaatctttcttcaaagaattctagggttgataacattaaggagaagaaaaatattgctcccactgatcctgctaagccaccagccaaggcacaagttgtgggttggccaccagtgagatcattcagaaagaatgtactaaccgtccaaaagaacagcaccggcaacggcgaaagctccggcggcggcgcagcctttgtgaaagttagcgtggacggagctccatacttacgtaaagtggacttaaagatgtacaaaagctaccaacaactctctgatgcccttggcaaaatgttcagctctttcaccattggaaattgtgggactcatggatttaaggatttcatgaatgagagcaaattgatagacctcttaaatggctcagactatgtacctacttacgaagacaaggatggagactggatgcttgttggagatgtaccttgggagatgtttgttgattcatgcaaacgcttgaggataatgaaaggatcagaggccattggactagcaccaagagcagtggagaaatgcaagaacagaagctgaaattgatgatccaattacttgttcattgtattttt

SEQ ID NO: 4645 - DNA, 628 bp, Artificial; identical to SEQ ID NO: 3329
  Synthetic

SEQ ID NO: 4646 - DNA, 922 bp, Artificial
  Synthetic
ctctctctaaaattttgcaaagttgtcattttgttaacaagaagtggaagaaaaataagaagaagagataatttcatggatctgaaagaaactgagctgtgtttggggttgcctggtggtggagaaagagataaaatcaaagggaaaagagggttttctgaaactgttgatttgaaacttaattttcataccaatgattcttcttctcctatggatctcaaggagaaaatcaagactcctactactaaagaaattgctaattgtaacaaggattcagtcaagccacctgccaaggcacaagtggtgggttggccaccagtgagatcttttaggaaaaatgtaatggcacagaaaaacaacactgaagaaactgaaaagagtaatgcaactgctgctgcatttgtgaaggtttgcatggatggcgcaccttatctacgtaaggtagatttgaagatgtacaaaagttaccagcaactttctgatgctttggccaagatgttcagctcttttactatgggaaattatggggcccaaggaatgatagattttatgaatgaaagcaagctgatggatcttctcaatagttctgaatatgtacccacctatgaagataaagatggagactggatgctcgtgggggatgtaccttgggagatgtttgttgattcatgcaagcgtttacgcataatgaaaggatcagaagctattggacttgcaccaagagctatggagaaatgcaagcgcaggatttgaaaactccatagaaggctataaacaatatgttgaagaagcagcttttgtgattgttgtttccatttgtctgtatttttattttatagtatatagtttttaattaaaagaagtgatctttaatttggacagttgtaatagagaagaagcaataaactcaaaaaccccccct

SEQ ID NO: 4647 - DNA, 791 bp, Artificial
  Synthetic
aggcgcaggcgccggcggcgaaggcacaggtggtaggatggccaccaatccgcagctacaggaagaacaccatggcgatgagccagcctgctctgaaaggcaaagacgacggcgaggcgaagcaggctccggcatccggttgcctctatgtcaaggtgagcatggatggtgctccttacctcaggaaggtggacctcaagatgtacaagaactacaaggagctctctttggctctggagaagatgttcagctgctttaccgtcggtcatggtgaatcaaatgggaagtcagggagagatggattatctgattgccgcctgatggatcttaaaaatggaacagaacttgtgctcacttatgaggacaaggatgaagattggatgcttgttggtgatgttccgtggcgaatgttcacagacagctgtaggaggctgaggattatgaaggggtcagatgcagtgggccttgctccaagagccactgacaagagcaaaaatcggaactgagcaaaagatgaacccaatatgaatatccgacccctacaatcacatcacttttacttgtaaggtcccattctctaaaccacaagggtaatggtctaagttgcgagaaggggattacttatacctatgtgtcaccctcttttttttttggttttatttgtaccaattatgttagattttaagcgtaagttgtgtaagttcctgtaagttgtctacttaaccttgcttgtagtttcttctgtaaattgttgtgctgtatgatgcaaactatttttgggattttacttg

SEQ ID NO: 4648 - DNA, 452 bp, Artificial
  Synthetic
aactgggaacaatatgaatgaggtgaatggctctgatgctgttacaacttatgaagacaaggatggtgactggatgcttgttggagatgtcccgtggcagatgtttgtcgagtcatgcaaacgcttgaggatcatgaagggttccgaagccattggtcttgcaccaagagcaaaggacaagtacaagaacaagagctgaaaatgttgcagtattaagatgctgagcatggtgccataagaatggtgttcttgcagtgtgttatggtttccttagaaatataaggttttacttgtttagctggattaaaagaaggaagagttgtcatgtttaatttgtttatggaccagaagcaataatctatttgtgtgtagctggattggtgttatgtgatgtcccctaccgtgtgtcccaagatctacttgatgattttattccaatgttgttaatttag

SEQ ID NO: 4649 - DNA, 808 bp, Artificial; identical to SEQ ID NO: 3332
  Synthetic

SEQ ID NO: 4650 - DNA, 875 bp, Artificial
  Synthetic
cctcatcaccttcccaagaagaagacccccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttgaagtcaaattaaaaggataagtggtatcgattatatatttgattaacacattgattggtgttaattgctcttttttttcttacgatgaaatacattgttcagtttcttttgattgtctgtgttttgatcaaaaaa

SEQ ID NO: 4651 - DNA, 1275 bp, Artificial
  Synthetic
cgttatttattatgcatcttgactacccctcgaccacgcgtccgcaatttccacctcatcagaggacaataatgcctgtggattaaatctcaaggcaactgagctcaggctcgggctccctgggtctctctctcccgaaaggggcatagagacttgccctttggcctcgaacgagaagctgctttttcccttgcaccctgccaaagatagtgctttggccgtatcacagaaaacagttgttaccggcaacaaacgtggattttcagatgctatggatggattctcagagggaaagtttatgccaaattcaggtgtgaaagcaggcgaaacaaaggagacctcacatgttcaaccaccaaaattgaaagaggcaactaatcagaacacagttccagagaggacttctgctgtgaatgaggcttcaaaccgtgtaggcagcagtgcccctgctaccaaggcacaggttgttggttggccacccattcgatcttttagaaagaatacattagcctctacctcaaagaacaaggaagaggtggatggaaaagctggatcaccagctcttttcattaaggtcagcatggacggtgctccttatttgaggaaagtggacctcagaaactattctgcatatcaggagctctcttctgctctcgagaagatgtttagctgttttactattggtcaatacggatctcatggagctcctgggaaggagatgttaagtgaaagcaaattgaaggatttgcttcatggatctgaatatgtactcacttatgaggataaagatggtgactggatgcttgttggtgatgtcccttgggagatgtttattgatacctgtaaaaggctgagaatcatgaaaggttcagatgccattggcctggccccaagggctatggaaaagtgtcggagcaggaattagcctatctacacatgattaaagctatccatccagcagtactggtatgaaaggaaatggagaaagggtgaagagactcaaaaacttgaatcctttttaaagcattaacaatggctggttgttggtcctggacagcacagcatgggtagatggatggtttgcttagttaacattggcgtttctcatattcgcgtaattaatgtcgtcttaagctctttatcttgtctattaaaaaacccatttgatatttgagtttgtctgcgaactaatgtgtggtgaactgagagttcttctagaggtaatttagtatgttaagtgtattgcttgttgaagtttctttaagtgtgtactta

SEQ ID NO: 4652 - DNA, 715 bp, Artificial
  Synthetic
gcagcatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcggaagcaatcggacttgctccaagggcattagaaaagtgaagaacagaagttga

SEQ ID NO: 4653 - DNA, 676 bp, Artificial; identical to SEQ ID NO: 3330
  Synthetic

SEQ ID NO: 4654 - DNA, 673 bp, Artificial
  Synthetic
ctttggacgacgaggtcagtgtcgcagcgacgaacgccgacgagctagctctctctctcgatcgatggccatggcggcggagagcatcgacgcggagctgcgcctcgggctgcccggcagcggcggcggtgacggcgtggcggcgaagaagcggcggtcggcgtcgtcgacggtgaagagcgaggcctccggcacggcctgctgcggcggcgccggcgcccgggacgtcgaagacggcgcctcgccggcgtccaaagtgcaggtggtggggtggccgccggtggggtcgtacaggaggagcacgttccagtcttcgtcgtcgtcgacggcggcggcggcgaaggggaagggcggcggcgagacggatcaagggaggaagaataagggaggagggctgtacgtgaaggtgagcatggacggggcgccatacctccgcaaggtcgacctccggatgtacggcggctacagggagctcagggacgctctcgacgcgctcttcggctgcttctccgccgacgcctccgcctccgccgcccacttcgccgtcgcctatgaggacaaggacggcgacctcatgctcgccggcgacgtgccctgggacatgttcatctcttcttgcaagaagctgcggataatgcgaggatctgaggcgaaatgatatatatcgaaatcg

SEQ ID NO: 4655 - DNA, 893 bp, Artificial
  Synthetic
tgtggcaccaagagagctgctgatcctatttcacctccccgttctaatgtcagtcaggttgttggatggcctcctgtaagaacttataggatgaataccctagttaaccagacaaaatcaccaccctcagaagaattttgcgggacaattgagaaatgcagaagcaaacatattatcactaatgcgagtagcagcaagagcaacagttttgccaaggagaaagggctgctcatcaagacttccatgtttgtggaggtcaatatggatggagttgcaattggaaggaaggtagatctgaatgctcatagtagctatgagaacttggaacagactttagatgggatgttcttaaaacccagcacaacagtttgtgcaagaccgtcaaatgcacaagagctaagtgtcatgtcagaaacgtcatcttcaagattattagatggatcatcagaatttgtgctgacttatgaagacaaagaaggagactggatgcttgttggagatgttccatgggagatgtttgtcaacactgtgaaaaggctaagaatcatgaggacttgtgaggctaacggacttgctccaagaatccctcagaaacaggagagacaaaaaggaaaaccaatctaatttgctttggtgcaaggaaaatgcatgaaatcatagtttggaaggaaaaaaaagtaaaacagaaatagggaagtgttaaaagagttaatggatcttgttactttttcatggttgcatttttgttttgcaccatttttctcttcatttttttcttttttttttctttttggttgtgtttaggtctcaagcccctcatatagctgatacaccaatgttttgcccaaacctactttttctcataatgtaaatatgggaatccaaattttctc

SEQ ID NO: 4656 - DNA, 820 bp, Artificial
  Synthetic
agggcggcggaggaggagggacggatgcggctccgctgacgctcgagctgctgcccaagggcggggccaagcgcgggttcgcggacgccatcgttgggggtcccgccggccagcggcgggaggcggccgggggcaaggcggcggcggcggcggcggcggcggaggccgaggaggaggaggagaagaagaaggcgcaggcgccggcggcgaaggcacaggtggtaggatggccaccaatccgcagctacaggaagaacaccatggcgatgagccagcctgctctgaaaggcaaagacgacggcgaggcgaagcaggctccggcatccggttgcctctatgtcaaggtgagcatggatggtgctccttacctcaggaaggtggacctcaagatgtacaagaactacaaggagctctctttggctctggagaagatgttcagctgctttaccgtcggtcatggtgaatcaaatgggaagtcagggagagatggattatctgattgccgcctgatggatcttaaaaatggaacagaacttgtgctcacttatgaggacaaggatgaagattggatgcttgttggtgatgttccgtggcgaatgttcacagacagctgtaggaggctgaggattatgaaggggtcagatgcagtgggccttgctccaagagccactgacaagagcaaaaatcggacctgagcaaaagatgaacccaatatgaatatccgacccctacaatcacatcacttttacttgtaaggtcccattctctaaaccacaagggtaatggtctaagttgcgagaaggggattacttatacctat

SEQ ID NO: 4657 - DNA, 901 bp, Artificial
  Synthetic
gccaagggcgccaagcgcggggtctccgacgaggcgcgtccgctgccggcgtccgccgccgccgccgccgccgccgggaagggcaagaaggcggcggccggcgaggaggatgaggatgcggaggaggaggacaagaaggtcgccgccgcgccgcaggcgcctgctgccaaggctcaggtggttggatggccaccaattcgcagctaccgcaagaacacgatggctactaaccagctgaagagcagcaaggaggatgctgaagcgaagcagggccaggggttcctgtacgtcaaggtcagcatggatggtgccccctacctcaggaaggtggacctcaagacctacaagaactacaaggacctgtcaactgcgcttgagaagatgttcattggcttcacaactggcaaggatggcttatctgagagccgcaaggatggtgaatatgtgctgacttatgaagacaaggatggagactggatgcttgttggcgatgttccatgggagatgtttgccaactcttgtcgcagactcaggatcatgaaaggttcagatgcaattggacttgctccaagggcagttgataagtccaaaaaccgcaactagaatggtttctgccccacagtcaaaagcaagatggagatcaaatgactgtagggaattttctgaaaaccaagaagtctaacagttttaagatggagtctgccttatggtctgtactacatggtttgctattgtgaaagttaaaaaaaaaaggtgtcttgttatgttagcttcgccaaatctcctagggacataaactctatttgattgtgcccaagtctttgtacgtgtgttaatgctattcgtgtaaatggtttggtacaccatgtgctactgctatgattgagcacccctacctact

SEQ ID NO: 4658 - DNA, 724 bp, Artificial
  Synthetic
cacgcgtcgcttgtcactgacgggaccgataaccatttggttctgtgggatcttcggcctttggattaacaggaaacaaatacgagaaagtttgtgagctgtgccatattactctcaacaaaaatgctgtgtttggagatagtggtgcttcggctcctggaggagtgagaattggtacgccggctatgacttcaagaggctgtgtcgaggtcgactttgaggttgtagcggagtttcttatgatggctcttcaaatctcagtgaagatacaaagggagcacggaaagcatttaaaagactattggaaagctctgcataataataaggagatcgaggacatcagaaacaacgtcgagaaatttgcttcagtcttcgagatgccagggtttgatactgcaactatgaagtacaatcaatagcctttgtgttgaactgtgcactccttgttttattaatacaaatttccatagaatttaggcaattttcatttccaaatgtaggcacacagattgccaaatacaccactaaaaccgtgactggttttgatgccacctggagatttttacatgtacttgctattgaagaggtagctctcatatgctaagaaatgattgtgctctacatgtacctttgactgttaggacagttctatcatggagccttggcataatggcaagtgccattctgagaatgatgtattttataattaaagttaacaggttat

SEQ ID NO: 4659 - DNA, 846 bp, Artificial
  Synthetic
gcccacgcgtcgcccatggctactacaccgcgggcgggaagaagatctccgcgacgtcgatctacttcgagagcctcccctacaaggtgagcgccgccacggggtacatcgactacgagaagctggaggagaaggcgctcgacttccgccccaagctcatcatctgcggcggcagcgcgtacccgagggactgggactacgccaagctcagggccgtcgccgacaaggtcggggcgctgctcctctgcgacatggcgcacatcagcggcctcgtcgccgcgcaggaagctgcaaatccttttgagtactgtgatgtggttaccaccaccacgcacaagtccctccgaggaccaagagctggcatgatcttctacaggaagggccctaagcctcccaagaagggccagcctgagggtgctgtctatgactacgaggacaagatcaacttcgcagtgttcccgtcactgcaaggtggtcctcacaaccaccagattgcagcccttgctgttgctctgcagcaaaccatgacacctggattcaaggcctacgcaaagcaggtcaaggccaacgctgtcgccattggcaagtatcttatgagcaagggctacaaaatggtgactgatggaactgagaaccaccttgttctctgggatcttcgccctcttggcttgactggcaacaaggttgagaagatgtgtgacctttgcagcattacacttaacaagaatgctgtctttggtgacagcagtgcattggctcctggcggtgtccgcattggtactcctgcgatgacatccaggggtcttgtcgagaaggactttgagcagatcggcgagttcctccacc

SEQ ID NO: 4660 - DNA, 1322 bp, Artificial
  Synthetic
  misc_feature (1257)..(1257): The residue at this position can be any nucleotide.
cggacgcgtgggctgatacaaagaagatatctgccgtctctatattttttgagaccatgccatacagactgaatgagagcactggctacatcgactatgaccagcttgagaaaagtgccacactctttaggccaaagttaattgtcgctggtgctagtgcttatgcacgtctttacgactatgcacgtatccgaaaggtttgtgacaaacagaaggctatcatgttggcagatatggctcatattagtgggttagttgcagctggagtcatcccatcaccatttgattatgcagatgttgtgactaccacaacccacaaatcccttcgcgggcctcgtggtgccatgattttcttccggaagggtgtgaaggaggttaacaagcaaggaaaggaggtgttgtacgactatgaagataaaattaaccaggcagtctttcctggacttcaaggtggtcctcacaatcatacaattactggcttggcagttgctttgaaacaggcaatgactccagaatacaaagcttaccaagagcaatgccttagcaactgctcaaaatttgcccaggcgttagcgggaatgggttatgaacttgtttctggtggaacagagaatcacttggtcttggtgaacttgaaaaacaagggtattgatggttctagggttgaaaaagttttggaagcggtacatattgcagccaataagaacactgttcctggagatgtatctgccatggtccctggtggcatcagaatggggactcctgcactcacatcaaggggatttattgaggaagattttgtgaaagttgctgaattctttgatgctgctgtgaagatagcagtgaaaataaagggtgaggctcaaggaacaaagttgaaagactttgtgacaacactacagtctagtgcttccatccagtcggagattgcaaaactccgccatggtgtggaggagtatgcaaagcagttccctacaattgggtttgagaaggaaaccatgaagtacaaaaactgagagctcgactgagtatatacacaaggaccaatatccaatttcttgaaggtgtatgggatgcacattcaaactgcagtttgctctcaaggataggattttcatcttataatattatgtaaaatccagcagtacttggttcccaactttgcactttgtatattaacgattgtaaatcatctcaggtccttgaaagcaataaactcctcttatctcagtaaaaaagaaagaagaaaaacattgncctgtattgcttaatattttccttttattaatgagagtaccatgtgttgtgttggaaaaaaaatg

SEQ ID NO: 4661 - DNA, 637 bp, Artificial
  Synthetic
tagcttctcatttcaccattttcttaacatcccctacatggcaattagttttttatatgactatttggtatataattatatcaaaattataagcacggggctagtcagcactagcaatggctcatattaagatgttgatatgggcatgttgcttggcgctattgactagttttgcctatggtattggtgttaattggggtacacaagctgcacaaactttgcatcccacaacaattgttcaaatgctaaaggataataagattgataagatcaaattatttgattctgatcattggactgttaagtactttgctggtactggtattgaggttatccttggaattccaaacaatcagttgggcaaatttgcagatgattatgactttgccaaggaatgggtgaaaaaaaatgtcagcacacatttgtatgatggaggtgttattattaagtacattgctgttggaaatgaaccattcttgaaatcatacaatggttcattcatgaaatcaatatttccagcgttacagaatgttcaaaaagctcttgattctgctggacttggagacaaaatcaaagctacaatcccgcaaaattccgatgtttatgaatctggtaattcaggtccatcacatggcga

SEQ ID NO: 4662 - DNA, 600 bp, Artificial
  Synthetic
cccacgcgtccgtcttttcaggccaaaattgattgttgctggtgcaagtgcttatgctagattgtatgactatgcccgcatcagaaaggtctgtaacaagcaaaaagctgtaatgctagcagatatggcacacatcagtggtttggttgctgctaatgtaatcccttcaccgttcgactatgctgatgttgtaaccaccacaactcacaagtcacttcgtggaccccgtggagccatgattttcttcagaaagggtgttaaggaaattaacaagcaagggaaagaggttttgtatgattttgaagacaagatcaaccaagctgtcttccctggtcttcaaggtggtccacacaaccacactatcacaggactagctgttgctttgaaacaggcaactacttcagagtacaaagcataccaagaacaagtcctgagtaacagtgcaaagttcgctcagactctaatggagagaggatatgaacttgtttctggtggaactgacaaccatctggttctagtgaatctaaagcccaagggaattgatggatctacaattgataaagtgttggaagctgtttacattgcatccaacaaaaacac

SEQ ID NO: 4663 - DNA, 621 bp, Artificial
  Synthetic
gccattacggccggggcatattgcagccaataaaaacactgtgcctggtgatgtatccgccatggtgcctggtggcattcgcatgggaaccccagctctgacttctaggggatttattgaggaggattttgtgaaagtggctgaattttttgatgctgctgtgaagttggcccttaaggtcaaggctgagacccaaggaacaaagttgaaggactttgtggaaactttgagttcagactccaaaattcaatctgagattgccaggctaaggcaggacgttgaggactatgcaaaacaatttcctactgttggtttcgagaaagaaacaatgaaatacaaggattgagctgggatctagtattcagatggaatcggaaggcatttttctccaatgaagttagaacttgtctttagaagtcttctggaagtcacttgcaggcgaggaaaacagttgcacggatcacatttgtataattttctaaatcaaagtcatgatcagatgtaattttcaagctgtaaaacaactgttccaaaattcaatttgtctcactcttggtttagagaaggacgagaaagccaacaatggtttacggaaagtcctttgtggaatactcgcaaagg

SEQ ID NO: 4664 - DNA, 670 bp, Artificial
  Synthetic
attaattgttgctggtgctagtgcctatgcacgtctttacgactatgaacgaatccggaaggtctgcgacaaacagaaagctattttattagcagatatggcacacattagtggattggttgcagctggagtcatcccatcaccatttgattatgctgatgttgtcactaccacaacccacaaatcccttcgtggtcctcgtggtgctatgattttcttcaggaagggtgttaaagaggttaacaagcaaggcaaggaggttttgtacgactatgaagacaaaatcaatcaggcagtctttcctggacttcaaggcggtcctcacaatcacaccattactggcttggcagttgccttgaaacaggcaatcactccagaatacaaagcataccaagagcaggtcctcaacaactgctcaaaatttgcccaggctttaatggagaatggttatgagcttgtctctggaggaacggagaatcacttggttttggtgaacctgaaaaacaagggtattgatggttctagggttgagaaaatcttggaagctgtacatattgcagccaacaagaacactgttcctggggatgtatctgccatgggccccggaggcatcaggatgggaactcctgcgctcacttatcgtggattaggtgaagaagattatgcgaaa

SEQ ID NO: 4665 - DNA, 690 bp, Artificial
  Synthetic
gagcgggctcgtggctgctggtcaacttgctaatcctttcgagtactgtgatgtggttacaaccactactcacaagtctttaagaggtcctcgtggaggaatgatatttttccggaaagatccagttctgggactggacttggaaacagctataaacaatgcagtattccccggtctgcagggaggacctcacaatcacacaattgctggactggccgtgtgcctgaagcacgcagtaaccgaagaattcaagcagtatcaaaagcaggtgattgcgaactgtcaagcgcttgcagacaagctggtggagttgggattcacgctggtgtctggcggaaccgaaaatcacctggtccttgttgatctgcgtcctttgggaattgacggtgccagaactgaaaaggtgctggatcgtgcttccatcacgctcaacaagaactcagtaccaggtgacaagagtgcgttagttccgggaggtgtacgcatcggcacacctgcattgacaacgagaggactcaaggaagaggacttcgtcaaagtagcagagttcattcacgaaggcgtccaaatcgccagacagctcaaggaaacagtccggcaagggaaaatgaaagagtacgtccaggcactcgaatctccagactctccagtccagacgagcatcgccgatctacggaacagagtcgaagc

SEQ ID NO: 4666 - DNA, 1363 bp, Artificial
  Synthetic
gaattcggagagagagacacacagtgagagaggtatggcacttgaccttccacatggtgggcatctttctcatgggtatcagactgacaccaaaaaaatatctgctgtatctatattttttgagacaatgccataccgattggatgagagcactggttacattgattacgaccagttggagaagagcgctacactcttcaggccgaaactgattgttgctggtgcaagtgcttattcacgattctacgattatgcacgcattcgccaggtgtgcgacaagcaaaaagctatattgttggcagatatggctcacatcagtgggcttgttgctgctggtgtcatcccatctccatttgagtatgccgatgtggtgaccactacaacacataaatcccttcgtggaccacgtggggcgatgatattttacagaaagggattgaaggaagtcaacaaacaaggcaaagagatcatgtatgactacgaggacaaaattaatcaagccgtgtttcctgggcttcaaggaggtccacacaatcacacaattactggattagcagttgcactgaaacaggcaactaccccagaatacaaggcttatcaagaacaagtgctcaaaaattgctcacagtttgccaaaaccttgaacgcattgggatatgaccttgtttccggtggtactgaaaaccatttagtcttggtcaatttgaaaaacaagggtattgatggctcaagagttgagaaagtaatggaattggttcatatcgctgctaacaagaacactgttcccggggatgtctctgccatggttcctggtggcattcgaatgggaacacctgctctcacttcaaggggattccttgaggaagatttcgctaaagtagcagagttctttgatgctgctgtgaatttggccttgaaagccaaagctgaatgcaaaaaaggtgcaaaattgaaggactttatggccgcggttgaaaacagtgctagcattcagtctgaaattaaacagctccgtcatgacgttgaggaatatgcaaagcaattccctacaatcgggttctgcaaaacaacaatgaaatacaagcaataaactccactattataagtgggcatatatgcttcggtagtgcagtggagtatctacaaaggcgaatgagatggacacgggaagggagcaaactgccttttaatgtagggaatatatgaatgctttcaatcagtgaatgggatatattgttgacactacagggttctaagcatgaagagagtaccatttggttcaaatttcattcttcattcaagaattgaattatatgtatattattaaacttgatcaattataatgcaacaatataaagcttgt

SEQ ID NO: 4667 - DNA, 655 bp, Artificial
  Synthetic
cccccccgctttattgagaagaaattgcagactggttactggagggactgacaatcacatgatactgtgggatctgagaaatcttgggttaacaggtaagaattttgaaaaggtttgcgagttgtgtcacatcactctcaataaagtaatggtcttcgatgataatggaagtattactcctggaggtgtgaggataggtacccctgctatgacatcaagaggctgtatagagaatgattttgagacgataacagatttcctcctcaaggcagcacagattacaaattcagtacagagagaacatggaaagctcgcaaaggcttttctgaaaggccttgaaaacaacaaagatgttattgagttaagaacacgcgttgaaagttttgcatcactgtttgcaatgcctggatttgaagtataatctagctggaaatctcgttctggtggatgaattctttttttattcgttgaccaaccttttttgtggattgggagaacaatggtgcacccaactcttggttagtaattgactaggcttgatatgatttttaagtgtcaattgagctcaaagcctggattaacttatgattgccacgttggagtattttgtgtccttattgactgtgaaggttggctggaggtgccaaaataaatc

SEQ ID NO: 4668 - DNA, 903 bp, Artificial
  Synthetic
aaatttctgctacttcgatttattttgagagtttgccttataaggtgaattcaacaaatggatatattgattatgataggttggaagagaaggctttggattttaggcctaaattgattatttgtggaggtagtgcttatcctagagattgggattataagagatttagagaaattgctgataaatgtggagcccttttgctttgtgatatggctcacattagtggccttgttgctgctcaggaagccgccgatccctttgaatattgtgacttggtcactaccaccactcacaagagcttgaggggtccaagggccggtatgatcttctaccgcaagggccctaagccaccaaagaagggacagcctgaggatgcggtctatgactttgaagacaagattaactttgctgttttcccctcgctccagggtggtcctcacaaccaccaaattggtgctcttgctgttgccctaaaacaggccgcaactcctggttttaaggcttatgctaagcaagttaaggccaatgcagttgctctcggcaactacctcatgagcaaaggatacaaactcgtaactggtgggactgagaaccatcttgtcctttgggatcttagacctcttggtttgactggtaacaaggttgagaagctttgtgaccttgccaacattactgttaacaagaatgctgtttttggtgacagcagtgctttggccccaggaggtgttcgtattggtactcctgcaatgacatcaaggggattggttgagaaggacttcgagcagattgccgagttcctccacagggctgttaccatcaccttgaacatccagaaggagtacggaaagcttttgaaggatttcaacaaggggtcttgtcaataacaaggaaattgaagaactc

SEQ ID NO: 4669 - DNA, 961 bp, Artificial
  Synthetic
gggcacttgaggcttttcgcttggacccggcaaagtggggagtgaatgtgcagccatgtcgggttcaccagcgaacttccatgtttacactgctctcttgaaaccacatgacagaattatggctcttgatcttcctcatggtggccacctttcccatggataccagactgatactaagaagatatcggctgtttcaatatactttgagacgatgccataccgactgaacgaaaccacaggcttcatcgactatgatcagcttgaaaaatctgctactctattcaggcccaaattaattgttgctggagccagtgcttattcccggcactatgactatgcgcgcatgcgtaaggtctgtgacaagcaaaaggctgtgctcttggcggatatggcgcatatcagtggacttgtagctggtggtgtggttcccactcccttcgactttgcagatgttgttacaactactactcacaagtctttgcggggccctcgcggggccatgatattctataggaaggggctcaaggaggtcaacaaacaaggacaagaagttatgtatgattatgaagacaaaatcaatgccgctgtgtttcctggtctccaaggaggaccacacaatcacacgattactggccttgccgtggccctaaaacaggcagcctcatctgaattcaaagcttatcaggagcaagttctgagtaattgtgctcatttcgcaaaatctcttatgtcgaagggctatgagcttgtgtctgggggaactgataatcaccttgtgctcgtgaatcttaagaacaagggaattgatggatcaagggtggaacgtatcttggaactggctcacattgctgcaaacaagaacaccgtccctggggatgtgtcttgcctgattccaggaggcatccgaatgggaactcctgctttgacatcgagaggatttacagaggagaatttcgagaag

SEQ ID NO: 4670 - DNA, 639 bp, Artificial
  Synthetic
tgtttctggtggaacagagaatcacttggtcttggtgaacttgaaaaacaagggtattgatggctctagggttgaaaaagttttggaagcggtacatattgcagccaataagaacactgttcctggagatgtatctgccatggtccctggtggcatcagaatggggactcctgcactcacatcaaggggatttattgaggaagattttgtgaaagttgctgaattctttgatgctgctgtgaagatagcagtgaaaataaagggtgaagctcaaggaacaaagttgaaagactttgtgacaacactgcagtctagtgcttccatccagtcggagattgcaaaactccgccatggtgtggaggagtatgcaaagcagttccctacaattgggtttgagaaggaaaccatgaagtacaaaaaatgagagctcgactgagtgtatacacaaggaccaatatccaacttcttgaaggtgtatgggatagactttcaactgcagtttgctctcaaggataggattctcatcttataataatatgtaaaatccagcagtacttggttccagactttgcactttgtatattaacgagtgtaaatcaactgaggtccttgaaagcaataaactcctcttatctcagt

SEQ ID NO: 4671 - DNA, 622 bp, Artificial; identical to SEQ ID NO: 3646
  Synthetic

SEQ ID NO: 4672 - DNA, 339 bp, Artificial; identical to SEQ ID NO: 3645
  Synthetic

SEQ ID NO: 4673 - DNA, 589 bp, Artificial; identical to SEQ ID NO: 3647
  Synthetic

SEQ ID NO: 4674 - DNA, 761 bp, Artificial
  Synthetic
cttccattttccaccgttcgggcaagataataaaaactacaagtatatagcagtaacgtttcttcttcttcttcttcctttgtgaagcaagaaatacttaatagtagaagagtatggctctgagaatgtgggtttcttcaacagccaacgcactaagaatctccagaaccaatctaattgccccctctttttctttctccagatgcttttcaactgttcttgatgggctgaagtatgcatcttcacatgaatgggtgaagcatgacggttcagttgccactgttggcatcactgatcatgctcaggaccatcttggagaagtagtgtttgtggatctgccagaaacaggtggttctgtttcccaaggaagcagctttggagctgttgagagtgtcaaagccaccagtgacattaactgtcctatctcgggtgagattgttgaggtcaacacaaagcttactgaaacgcctggcttggtaaattcaagcccatatgaagatggatggatgattaaagtgaagccaagcagtccatcagaattggagtctttgatgggttccaaagagtacacaaaattctgtgaagaagaggatagtcattgacacctgaatgtacttcttggtccaatttggattaactggggtgcttaaggttgctattgttatagaaatttccagtcaataaataaaattgttcaagcataaaaaattatcttccacttgtctcataacatctttgcctatgcagttctgtgatttgat

SEQ ID NO: 4675 - DNA, 730 bp, Artificial
  Synthetic
acctgactaaagaacggccaccagtcaggttctaggaagagagagagagagagagcctagccagccagccagccagaaaacggtagttatggcccttcgttcatttgctgcgcaggctgtctctcgcctccgttgcagttgccgtagtagcggcaacttcgcacctgccgtcgcttcttccttccttcgccatttcagctctgcctatccatcggacttgaagtacgccaaatcgcacgaatgggtgcgagccgaggattccaaggcgaccatgggcattaccgactttgccttggagcaactgggagatgtggtttatgtggaattgcctagcgttggacaggaggtagctcaaggcgagtctgtttgcacggtggagagtgtcaaagcagccagtcaggtctatgcccccatcagcgggaaagtagttgaggtcaacaccgagatcacaacgaaacctgaaacgatgaaggatgatccctatggaacaagctggttggtgaaatttgatatcagcaaacctgatgagctcaaggcactcttggacgcagatgcttacaagacccaagttgagagtgaagaacatcactgattttagtaatcctgaaccttattcttgttgtaagcagttgaatgccagttatctttattgaaatcaaatatgatccaaatcagatcaatatgtggagggactatgggctagtgagttgttgtcttgtctcgttcttga

SEQ ID NO: 4676 - DNA, 683 bp, Artificial
  Synthetic
aaaacacagaacaagaattagaaagaagggagagaaagcaaaaatggcgctaagaatgtgggcttcttctacagcaaacgctctcaagctttcttcttctgtttccaagtctcatctctctcctttctccttctctagatgcttctccacagttttggagggtttgaagtatgcaaattcacatgagtgggttaaacatgaaggctctgttgccaccattggcatcactgcccatgctcaggaccatttaggtgaagtggtgtttgttgaactgccagaggacaatacttcagtgagcaaagagaaaagctttggagcagtggagagtgtgaaggcaacaagtgagatcttatcaccaatctcaggtgaaatcattgaggttaacaagaagctcacagaatcacctggcttgatcaactcaagcccctatgaagatggttggatgatcaaagtgaaaccaagtagccccgcggagttggaatctttgatgggtccaaaggaatacaccaagttctgcgaggaggaagatgctgctcactaggagggtttctctctgtcttttatgttcgaagttctatcaattctcatgcttgttttctaaatttgcatacactctatgaccaacttcacaaaataagagttcaagaagatgaaacagagacctaacaaacacattaagattt

SEQ ID NO: 4677 - DNA, 675 bp, Artificial
  Synthetic
aagcttttgtggccgcaaggctgcgctccagtgcttgtggaaggaacattctctgccctaataatctgtcttgctgcttactacgatggctctacgcaccatggcgacgcaagctgcgacgctgctgagaattcggtgccagccgaactacctcgcgcaggcgctggcaattcgtggatttgcaactgaagccgcagctaccgttccaattccccaagatttgaagttcctcgagtcgcatgaatgggtgaaagtggaggatggaactggcaccgtaggaatcagtgaccatgctcagcatgagcttggagacgttgtgtttgcggacttgcccgaggtggggtcgtcggtgagcaaaggcaagaactttggcgtggtggagagcgtcaaggcttgcagcgacatctacagccccgtctctggcgaagtcgtcgaagtgaacgaagaggtcaaggcaacgccagctctggtgaacaagagtgcattcggcgatggatggctcatcaaagtaaagctgtccagcgtgtcggacctcgacggcctaatggattcagcagcatacgaagagcacgtcaagagtgaggctcactagccgagcacaaagcgcaaagcacaaatcacagtatgtttcgaaaagctctactagcaagaaggataattttctttccaaagtcc

SEQ ID NO: 4678 - DNA, 613 bp, Artificial
  Synthetic
agctaactaggagaaggaaaaaagaagaacgcagatactttggtaacaagcaagaaattggcacagaaatggctctgaggctgtgggctagctcagctgccaatgccctcaagatctcatgcagtggagccaccagggctgcacctgcctactcaatctccagatacttctccactgttcttgatgggttgaagtacagctcctctcatgagtgggtcaagaatgatggctctgtggccacaattggaattacagaccatgctcagggccatctgggagaggtggtgttcgtggagctgccggaggcgggggcgaaggtgagccagggaggtgcattcggcaacgtggagagtgtgaaggccaccagcgacatcaactcccccatctccggtgaggtcgtcgaggttaacgacaagctctctgagacacccggcctgattaactcaagcccgtacgaggacgggtggatgatcaaggtgaagccgagcagcccgtcggagctggacgccctgctggacccggccaagtacaccaagcactgcgaggaggaagacgctcactaggctcttcctctctgtgttttttctctcccattttgtcactccgacctaat

SEQ ID NO: 4679 - DNA, 587 bp, Artificial
  Synthetic
ggaagagctcggcggtggaacagctcgctcgatcatggccgccgccgccgccgcctcaagggcgctctgggcttgccgcaccgcctcctaccttcggatctcctccttccccagggctttctccaccgtccttaaagatctaaaatatgctgatactcatgagtgggtgaaggttgagggtgattcagcaaccataggggtcacagaccatgctcaggaccatttgggtgatgttgtgtatgttgagcttccacaagttggttccacagtatcacaaggaacgaactttggtgcggttgaaagtgtgaaagcaaccagtgatatcaatgcaccagtatctggagagattattcaagtaaatgatgaactaagtgaaaaaccaggatttataaatggaagtccatatgagaagggatggatcatcaaggttaagataagtgatccaagtgagttaaactcgctgatggatgatgagaagtacaagaagttttgtgaggaagaagatggcaaacactgatcaatcccctaactgctggatttcaagaaactatgcagcaactcaccatcatgacaatgagccatctcgc

SEQ ID NO: 4680 - DNA, 596 bp, Artificial
  Synthetic
agcaaacgagagtgtgtgtgccgcaaacttagagagaggagcactgctttgagtactttataagatggctaccaagttgtgggcttcaagggttgcttcatacctcagagtatcaacgcttcacagagcatttgctactgttgtcaaggatttaaagtatgcagactctcacgaatgggtcaaagttgatggtagctctgcaacaataggcatcacagatcatgctcaggatcatttgggtgatgttgtgtatgttgaattacccgaagtgggggcttctgttactcaatctggcagttttggcgctgttgaaagtgtcaaggccaccagcgatatcaattctcctgtttcagggaaggtggtggaagttaatgagaagctcgactcctctcctgctctgatcaatgggagcccatatcaagaaggatggattataaaggtggagatgaacaaccccgacgagctcaaatcgttgatggaccctgacaagtattccagtttttgtgatgaagaagacgcgaaacactgattgaaacctcacaaagttgagcaagaacgcactttcctgcaggatttttcgtagtgcataaataggc

SEQ ID NO: 4681 - DNA, 756 bp, Artificial
  Synthetic
gccattacggccggggacattactagagagaaaaatggctttgagaatgtgggcttcttcaacagccaatgcattgagaatttccactgcctcaagagctaatctttcccctgcttattcactctctagatgcttttccactgttcttgatgggttgaagtatgcatcttcacatgaatgggtgaagcatgagggttcagtggcaacagttggaatcactgaccatgctcaggatcatcttggagaagtggtgtttgtggatctaccagaaactggtgctgctgtttcacaaggaagcagttttggtgctgttgaaagtgtgaaagctaccagtgacattaactgtccaatctcgggcgagatcgttgaggtcaatacaaagctcactgaaacacctggtttggttaattcgagtccatatgaagacgggtggatgattaaggtgaagccgagcagtccatccgagctagaatctttgatggggtccaaagagtacacaaaattctgtgaagaagaggatagtcactaaaacttgaaggtgttttgtttattcaacttggactaactttgcctggttaaggctgatactgtgatgaaacttcctgtcacttgttaaaattctacaaaaatcaaaacaacatccacttttctggtgttttttttgccttatgcagagttgtgatgtagtcttttggtaattaagatcatcttgctctctgattattacactccgatgttttctaaaaaaaaaaacat

SEQ ID NO: 4682 - DNA, 675 bp, Artificial
  Synthetic
ggagagagagagacagacagagtgcggcgccgaggaggagaggagcaataatccaattccaatccattcctccgcgacctcgtcgtccgatcatggccatggccgcctccaggttgctgtgggcttcccgcgccgcctcctacctcaagatctccactttccccagggccttctccaccgtgctgaaggatctgaagtatgctgacactcatgaatgggttaaggttgagggtgattcggcaaccgttggaattacagaccatgcccagcaccatttgggtgatgttgtgtatgtggagcttccagaagttggcagcagtgtatcccagggaaagaactttggtgctgttgaaagtgtgaaggcaaccagcgatatctactctccagtatctggagaggtggttgcagtgaacgatggactaggcgatgaacctggattggttaatacaagtccatacgagagtgggtggatcatcaaggtcaaggttagtgattcaggtgagctcaattcattgatggatgacgcgaaatactcgaaattctgcgaggaagaagatagcaagcattgaacaaataccagtgacttgtgatctgcaaagaatgcgccttgacccttttgtcaatgcttgtgatgtgctatcgagcacttatctttaccaccggctgctcctgaaa

SEQ ID NO: 4683 - DNA, 755 bp, Artificial
  Synthetic
cccgatcccctcatctcactgcagctttccgctatactaccaccaccactgagctgccactactcatccagctaactaggagaaggaaaaaagaagaacgcagatactttggtaacaagcaagaaattggcacagaaatggctctgaggctgtgggctagctcagctgccaatgccctcaagatctcatgcagtggagccaccagggctgcacctgcctactcaatctccagatacttctccactgttcttgatgggttgaagtacagctcctctcatgagtgggtcaagaatgatggctctgtggccacaattggaattacagaccatgctcagggccatctgggagaggtggtgttcgtggagctgccggaggcgggggcgaaggtgagccagggaggtgcattcggcaacgtggagagtgtgaaggccaccagcgacatcaactcccccatctccggtgaggtcgtcgaggttaacgacaagctctctgagacacccggcctgattaactcaagcccgtacgaggacgggtggatgatcaaggtgaagccgagcagcccgtcggagctggacgccctgctggacccggccaagtacaccaagcactgcgaggaggaagacgctcactaggctcttcctctctgtttttttctctcccattttgtcactccgacctaatttctccctgttgcaacaactgctctgtatccgtatacgattaataactgaatcttcaggctttgccatgtgttc

SEQ ID NO: 4684 - DNA, 629 bp, Artificial
  Synthetic
gaattcatgagagtgtgggcttcttcaattgcgggggcacttaaattctcttcatcttctaccttgaagcagacttcactctatccatctgcttttgccgcctccaaatgcttctccaccgttttggatggattgaaatatgcaccatcacatgaatgggtgaaacatgaaggagatgtacctaccattggtattacagaccatgctcaggatcatttgggagaggtggtgtttgtggagctaccataagctggtggtgcagtgacaaaagcaagtggatttggagctgtagagagtgtcaaggcaacaagtgacatcaactcgcctatttctggagagattgttgaggtcaacaccaagctcaccgacacccctggcttgattaactcaagtccttatgaggatggatggatgatcaaagtgaaaccatcaagtccagctgaacttgaatctttaatggattcaaagggttacaccaagttctgtgaggaagaagatgccagccattaatttagtttgatggatatgtttctttctttgccactttgtttcgaaatttcgatttgggttagctaactgaaatttctccatctgcagttgttatcaataatgatgtcaatattactgaa

SEQ ID NO: 4685 - DNA, 1044 bp, Artificial; identical to SEQ ID NO: 1177
  Synthetic

SEQ ID NO: 4686 - DNA, 684 bp, Artificial; identical to SEQ ID NO: 1175
  Synthetic

SEQ ID NO: 4687 - DNA, 747 bp, Artificial
  Synthetic
tggtatcaacgcagagtggccattacggccggggaccaagcaaaaactcaaaacttcacatctttagtagtagcatcaatattcaagatggttctccaaactcaacttgggttgaacaagccccaatcctacgctcacgagcaaaattattattccgacggcagccatggcggctctatgcaaatgacaaggccatcgggctattccaccatgccatatggccagtccactcacaatcacatgatgatgggtcatggtggccaacatcatggcggacactatggtggtcatggccatggctacggcggtcatgaacatcatggggcgcatatgccccatgactccactaacttttcaagcagcaccaatatggtccatagtgatgctggctatggcagtggaatgcaacaatctacccatatgttgtcagccatgggcatgggatcgaccaattatcatggccatggttatggtggcagccaccctagtcagtacagccagagccaaaagttcaactgggctcttaaggatctggaggaataaatatatgataaattttatgctatcctgtatggtgaaagtatgtgtgtgttttggtagtggattttgctaattatatagcatgaagaaactactacctaaataagtaataatgtactaaacagtctgctgctttacttgattatcaatgcatctacttatcattactaaatgatgaataaaaaataaaagtatgtttataacgaa

SEQ ID NO: 4688 - DNA, 738 bp, Artificial; identical to SEQ ID NO: 1182
  Synthetic

SEQ ID NO: 4689 - DNA, 1416 bp, Artificial
  Synthetic
cccacgcgtccggggagctcctcctcatcatcgaacataggtttccgattatcgtcgaacaactgatataatcatcacacaaaggtgtatacagcttcttggtgataaacagtcaacatgccggccacagcaggtagggttcgcatgcctgcgaacaacagggttcacagtagtgcagccctacagacgcacggcatctggcagagtgctattggttatgatccatatgctcctagcaaggaggacgacaagaaatctacccagaaggcgtcagcagctgatcctgaaaatgcttatgcgagctttcaaggtttgcttgcacttgcccggatcacgggatctaacgctgatgaaactcgtggggcgtgcaagaggtgtgggcgggtaggccacctcactttccagtgtaggaatttcgttagtgttaaggatgataacaaggataaggatccggaggtgattgaggctgccgtgttgtctggattggagaagatcaaggggtctaagatgaagggaaaagcagaaaatgaggagagcagtgaagaagaagaggagagtgagagttctgattcggattatgattctgaaatggagagggcaattgctgagaagtatgggaagaaggtaagtaggaagttgaagtcatctaggaagcacaacaagaaagattcagatgatgatgaggaggaggagtcagactctggaaaaaggaagaagaggggcagatcaaagaggaggaggagtgggaagaagaagggacacagtgattcggaggacgatgatgaagataaggatcgcaggaagaggagaaaggaaaagaggaggaaaagggatgactcatcagacgaggatgaagatcgtaggaggaggagaaaaagtaggaaggagaagaggaggaggaggagaagtcatagacatgctgacagttctgatgaatcaagtgatgattctcctccacggcacaagcgtaggagcaggaggacagcctcagcatctgattctgatgattcacgagttggcagagacaaaaaacgttctgagaagaggagcaggaagcgtcatgatgatgaatagtagtaatggactcgtgcaaggaggatataccatctactatttgaattgcaggtccattcctttctatggaattgcttttctaggcacttgatgtgtatctgtctatgtttactttttatctttttgcctcaacaaatactcgtgtgcttgagtctcccttcatggtcttgaatattgtttaactgacgttgcagtattttgccagttattacaaaatgtgggcatctttgttgaacctacttcaggttaaccttttgaaggttttgcggatttgttaattacaacctgtgaattatgcaactttgtaaggtgtttgttgaagtgatatatcactctgtactt

SEQ ID NO: 4690 - DNA, 590 bp, Artificial; identical to SEQ ID NO: 4165
  Synthetic

SEQ ID NO: 4691 - DNA, 748 bp, Artificial; identical to SEQ ID NO: 4473
  Synthetic

SEQ ID NO: 4692 - DNA, 599 bp, Artificial
  Synthetic
ttcgtctttctgcaaactcaattaatcccctctaccactctgccaccttcagatttgagcttgggtttgaaggtaaggaagtaacatatggcgtcaaagcgcatattgaaggagctgaaggatctgcagaaggaccctcccacgtcatgcagcgctggtcctgtggctgaggacatgttccattggcaagcaacaatcatgggccctacagatagcccttatgcagggggtgtattcttggtttctattcattttcctcctgattatccgttcaagccacctaaggttgcatttcgaactaaggttttccaccctaacatcaatagcaatggaagcatttgtctggatattcttaaagagcagtggagtccagcattgaccatatctaaggtcctgttgtccatctgctctctattgacagacccaaatccagacgatcctcttgtaccagaaattgctcatatgtacaagactgacaggtccaaatatgaggccactgctcgtagctggacacagaaatatgccatgggataatagcaaaagtgtcaccgggcatgtcagagactttgtagctgcaccgtcttaattgtgcttgggtg

SEQ ID NO: 4693 - DNA, 646 bp, Artificial
  Synthetic
tttttgccgccatcgccgtctttccttccttccttcgatcgatccatccctcctcctcttcgcgatcaagcttctcctcctccccccccccccaatggcctccaaacggatcctcaaagagctcaaggacctacagaaggacccccccacctcgtgtagcgccggccctgttgcggaagacatgttccattggcaggcaacgatcatgggacctgttgatagcccttacgccggaggtgtgttcatgttgacaatccactttcccccagactaccctttcaaacctcccaaggttgctttcaagacaaaagtatttcatccaaacatcaatagcaatgggagtatttgcttggatattttgaaagagcaatggagcccagctttgacaatctccaaggttttgctttcgatttgttctcttctcactgacccaaaccccgatgatcctctggttcctgagatagcacacatgtacaagatagacagagccaagtacgaatctactgcaaggaattgggcacagaagtatgctatgggctaatagttattataatggacatcccattgcaatggtagacaggccgagggattgattacactttcctgttcttgttttcaaaccatggggggttggatgtatcttgtg

SEQ ID NO: 4694 - DNA, 846 bp, Artificial; identical to SEQ ID NO: 4475
  Synthetic

SEQ ID NO: 4695 - DNA, 749 bp, Artificial
  Synthetic
tgcgaactccaggggcacctcctccaacacaaagcaggagttcaacgcagaatcaaaccaaaaccctagctcaccgccttgtttcctccgtattggtggttacaatgtcgactccggctagaaagaggttgatgagagatttcaagaggttgcagcaggaccctcctgctggtattagtggtgcacctcaagacaacaacattatgctttggaatgccgtgatatttggtcctgatgacactccttgggatggtggtacgttcaagctgactcttcaattctctgaggattaccccaataagccaccaacagtgcggtttgtttctcgcatgtttcatcctaacatttatgcagatggaagtatatgtttggatattcttcaaaatcagtggagtccaatatatgatgttgcagctatacttacatccattcagtcattgctgtgtgatcccaaccccaattcacctgcaaattcggaagcagctcggatgttcagcgagaataaaagggattacaaccgcagagttagagaagttgtagaacagagctggactgcagactgattctagggaagaaagacgtcattgctgactgcagatcaggagcaccacggctcatctatgtttcaatcagtaaatgtaacctcttttttgatcaatagattcctaatcttttcctaagaaaaaaacatgtcttgctgtggaggaagctgtggctgtggatctggctgcaaatgcggcagtggctgt

SEQ ID NO: 4696 - DNA, 471 bp, Artificial
  Synthetic
ggaatggcatcctctgctcagcttcgattgatgtccgatctgaaggccattagccatgagccacctgagggatgcagtgccagcccttatagcgatgcggacctttttgtttgggacgccacaatatttggtcccgaagatactccatgggaatgtggcattttctgcctccgtttggtctttggagagcattaccctgccaaaccacctcgtgtcaggtttacttccgagatatttcaccccaatgtgtacaatgatggcaccttatgcatggacattatacaagatgcttggtctccttgccacaacatctgtacaattctaacatctgttcagtcattgctaacagatccgaatcccgcaagcccagctaactcggaagctgcacatttatatcaaactgatattcaagcatataacaggcgagttcggcgttgtgtgaggaagtctttggaaagcacatagtatact

SEQ ID NO: 4697 - DNA, 635 bp, Artificial
  Synthetic
gcgtatcgggaggagaacggaagaatggcttcgaagcggatcctgaaggaactgaaggatttgcaaagggatcctcccacttcctgcagtgcaggtcctgttggggaagatatgtttcattggcaggcaactatcatggggccaactgatagtccttatgccggtggcgtcttcatggtcactattcatttccccccggactaccccttcaagcctcccaaggttgctttccggacgaaagtgttccacccaaatatcaacagcaatgggagcatctgccttgatatattaaaagagcaatggagtccagcccttacaatatcgaaggtcttgctttcgatttgttcacttctcactgatccgaatcccgatgacccccttgtgccggagattgcacacatgtataagacggatcgagccaaatacgaaggtactgcaaggagttggacacagaagtatgcaatgggttgagttgagtctttcttcactcaattgctactcgctcttaatatatcccccccccttgatgtaataaatatatgttggcagacaagttaaaatatcggcatacaaaaagccgtgtttctgaatgatcttgtttcaaaactgaatgaatgcaagcaatgtgtttttat

SEQ ID NO: 4698 - DNA, 483 bp, Artificial
  Synthetic
  misc_feature (235)..(235): The residue at this position can be any nucleotide.
gcatgtctggaggaatagctcgaggtcgtctagcagaggagcgcaaagcatggcgcaagaatcaccctcatgggtttgtggcgaggcctgattctcaaccggatggttcaatgaacttgatgctttggcaatgcattatacctggaaaagttgggactgattgggaaggtggtttcttccctttggcaattcatttcagcgaagactatcccagcaagccacccaagtgcaaatntacccaagggtttttccatccgaatgtgtacccatctgggacagtgtgcctgtccatatggaatgaggattctggatggagacctgccataactgtcaaacaaatacttgtgggaattcaggaccttcttgattcaccgaatcctgcagatcctgcccaaagtgatgcatatcaactctatgttcaagatcccattgagtataaaaagaggattagacagcaatccaagcaatatcctccccctattt

SEQ ID NO: 4699 - DNA, 529 bp, Artificial; identical to SEQ ID NO: 3632
  Synthetic

SEQ ID NO: 4700 - DNA, 605 bp, Artificial; identical to SEQ ID NO: 4526
  Synthetic

SEQ ID NO: 4701 - DNA, 361 bp, Artificial; identical to SEQ ID NO: 3631
  Synthetic
  misc_feature (234)..(234): The residue at this position can be any nucleotide.

SEQ ID NO: 4702 - DNA, 671 bp, Artificial
  Synthetic
gccttccctataacggcggtggctatttaagaactccaagtagcagaagttatagttgaagagggatctggatctgaatctgaatctgtgtcatggctagcaagaggattttaaaggaactcaaggatctgcaaagggatcccccaacctcatgtagtgctggtcctattgcaaatgatatgttccattggcaagccactatcatgggtccctttgatagtccatatgctggaggagtttttctggttaccattcatttccccccagactacccatttaagcctcctaaggtgtccttcaaaaccaaagtcttccatccaaatgtcaatagtaatggaagcatttgccttgacatcttgaaggaacaatggagtcctgctctaacaatagcaaaggtcctactctcgatatgctctcttttgactgatcccaatcctgatgaccctctcgttccagaaatagcccacatgtataaaacagacagggcaaagtacgagacaactgcaaggagttggaccttgaagtatgctatgccctaaataaagctcacctcttgccttgcatatagttgaggtatatatattatatatatacacacacgttattacatatgcaactactattgcattgctataatctttgctagaatctccaataagatatgtaatatg

SEQ ID NO: 4703 - DNA, 577 bp, Artificial; identical to SEQ ID NO: 4529
  Synthetic

SEQ ID NO: 4704 - DNA, 583 bp, Artificial
  Synthetic
taggtatggcgtcgaaacggatacagaaggagctgcaggacctgcagaaggaccccccgacgtcatgcagtgccgggccggctggggaggacctcttccactggcaggccaccatcatgggcccctctgatagcccctacgacggcggcgtcttcttcatcaccattcacttcccccctgactaccccttcaagccccccaaagtcagcttccagaccaaggtttatcatccaaacatcagctcgaacgggagcatttgcttagacattctaaaggaacaatggagtccagcgttgacgatttcaaaggtgttgttatccatctgctctctgcttacggatccaaatccagatgaccctcttgtccctgagatcgctcacatctacaaaacccagaaggctcgctacgaggagaccgcccgagcatggacccagaaatatgcaatgaactagttgaaaaatttccttacatatccttgcccacccttcaaactataataagcataaggtatgctttctatatatggaggctaatcgttattgtttctccgttgtctttctctatcatcaatcacagtttcttg

SEQ ID NO: 4705 - DNA, 615 bp, Artificial
  Synthetic
aagagttgatgcgatgtcaggagggatagcctgtggccgcctggcagaggagcgcaaggcatggcgaaagaaccacccccatgggtttgtggcaaggccagattctctaccagatggaacaatgaacctaatgctttggcagtgcattatacctgggaaagttgggactgattgggaaggtggttttttccctctagcaatctatttcagtgaagactatcccagcaagccaccaaagtgcagatttcctcaaggctttttccatccaaacatctatccatccgggacagtctgcctctctatcttgaacgaggattccggatggaggcctgccataactgtcaaacaaattttagtcgggatccaagatcttctagatgctccgaatcctgctgaccctgctcaaaccgatgcatatcagctctttgttcaagatcctattgaatataaaaggagggttagacatcagtcaaagcaatatcctccccctatttgaagctgaagcggctttgtttatgataggtggaccatgcatcagaaatgcatggcttgttgctgattattattctttttcaaatcacatgaaaatgaccacttcaatggaatgacagattt

SEQ ID NO: 4706 - DNA, 556 bp, Artificial; identical to SEQ ID NO: 4543
  Synthetic

SEQ ID NO: 4707 - DNA, 483 bp, Artificial; identical to SEQ ID NO: 4521
  Synthetic

SEQ ID NO: 4708 - DNA, 713 bp, Artificial
  Synthetic
ccccttttggctaccctacaaccttcttgagacccctttaaattcctcactttctctctctagaatctctctctttttctctctctatctctctctgaagtcgtatggcttcaggttctccttcacaagccagtcttctccttcagaaacaactcaaagatctcaatagaaacccagttgatggattttcagcaggtttagttgatgaaaataacttatttgaatggagtgttacaattattggcccccaagatactctatatgaagggggtttctttaatgctatcatgagttttcctcaaaattatcccaacagtcctccaactgtgagatttaccacagatatctggcatcctaatgtttactccgacggaaaagtttgcatctcaattcttcacccgcccggtgatgatccaaatggctatgagcttgccagtgaacgttggtctcctgtccacacggtggagagtatagttttaagcatcatatccatgctttcgagccctaacgatgagtctcctgctaacgttgaagctgctaaggaatggagggaaaaaagagatgaattcaagaaaagggtcagtcgttgtgtaagacggtcacaagaaatgtagtaaacatgcatgccaacctgcatttctgcgattaagccaaggaattggcatcgttcttttggctagctgtttatttatgctacaaaaatgtagaatttg

SEQ ID NO: 4709 - DNA, 666 bp, Artificial; identical to SEQ ID NO: 4535
  Synthetic

SEQ ID NO: 4710 - DNA, 664 bp, Artificial; identical to SEQ ID NO: 4537
  Synthetic

SEQ ID NO: 4711 - DNA, 636 bp, Artificial; identical to SEQ ID NO: 4539
  Synthetic

SEQ ID NO: 4712 - DNA, 619 bp, Artificial; identical to SEQ ID NO: 4540
  Synthetic

SEQ ID NO: 4713 - DNA, 707 bp, Artificial; identical to SEQ ID NO: 4541
  Synthetic
  misc_feature (190)..(190): The residue at this position can be any nucleotide.

SEQ ID NO: 4714 - DNA, 590 bp, Artificial
  Synthetic
  misc_feature (21)..(21): The residue at this position can be any nucleotide.
gcaaggctaggcaaggcaagnaagataagagagtgagagaggagagagagagagagagagagagaggggacagatagagagagagagagagctatggcggatactcaggcaagccttctcctccgtaaacaactcaaagagctatcaaaaaggcccgtggaaggattttcagctggtcttgtggatgattccaatgttttcgaatggaatgtcaccatcatcggtccgcctgacacattgtatgaaggtgggttcttcaatgcaataatgagttttcccacgaactatccaaacagcccaccatctgtgaggttcacctcggagatgtggcatccaaatgtttatccggatgggcgtgtttgtatctctattcttcatgctccaggtgacgatcccaatggctatgagcttgctagtgagcgttggtcgcctgtgcatacggtggagactattctcttgagcatcatagctatgctttcgagcccaaatgatgaatccccggcaaacattgatgcagcgaaggaatggagagaaagcagggacgaattcaaaaggaaggtaagtcggattgtaaggcgttcgcaagagtg

SEQ ID NO: 4715 - DNA, 608 bp, Artificial
  Synthetic
aggaaggcggaatactccttctcttctcttctctctctcataccgaggtattagggttccacaggcggagagaagagagagagagagagagcgtctttcttcctctaccgctgctactactactgctacgaccatgtcggggatcgccaatgctaacctaccgcggcggatcatcaaggaaactcaacggttattgagcgagccagcccctggcataagtgcatcaccttctgaggataacttacggtatttcaatgttatgattcttggcccaactcaatctccctatgaaggcggggttttcaaattggaattgtttctacccgaagaatacccaatggcggctccaaaggtccgattcctgacaaaaatttatcatccgaatattgacaagctggggcgcatctgcctcgacattttgaaagacaagtggagccctgcactccaaattcggacagtccttctaagtattcaggcccttttgagtgcaccgaatcctgacgatccactttctgagaacattgcgaagcattggaagactaacgaggcagaagctatgcaaacagcaaaggagtggaccaggatgtatgcctgtggggcctgaaaac

SEQ ID NO: 4716 - DNA, 690 bp, Artificial
  Synthetic
ctcctcctcttcctccctcccgatcccctcccccgcacgaaactcaaagcatccccggcgccgcagctccccggaggaggaagcccccgcgccccgccccgaccagatccgatggccaacagcaacctcccccggcgaatcatcaaggagacgcagcgactcctcagcgagccagcgccgggaatcagcgcgtctccgtcggaggagaacatgcgctacttcaacgtcatgatccttggcccggcacagtccccctatgaaggtggagtttttaagcttgaactctttttacccgaggaatatcctatggctgctccaaaggttaggttcctgaccaaaatataccaccccaacattgacaagcttggtaggatatgccttgacattctcaaggacaaatggagcccagcccttcagattcggacagttcttttgagtatccaggcactcctaagtgcaccaaaccctgatgatcctctctctgataacattgcaaagcactggaaagccaatgaagcagaagctgttgaaacagcaaaggagtggactcgcctgtatgccagcggtgcataaaacccaatgcctctcgtgatgtaataacccgtcatgctttagccttaatcaaatgccatttgcttgataagaacaaactggagatattggcagtggaagggagtttaaatgactacc

SEQ ID NO: 4717 - DNA, 712 bp, Artificial; identical to SEQ ID NO: 4524
  Synthetic

SEQ ID NO: 4718 - DNA, 627 bp, Artificial; identical to SEQ ID NO: 3118
  Synthetic

SEQ ID NO: 4719 - DNA, 764 bp, Artificial; identical to SEQ ID NO: 4512
  Synthetic

SEQ ID NO: 4720 - DNA, 860 bp, Artificial
  Synthetic
cccacgcgtccgcccacgcgtccgctcacctggcgcgccgaagcttctctcctctctctcaactccggcgagaggaggaggcggcggtggggcgttcgtcgggagagagaccagggccggggggctagggttcggccgttcagagaggcggcggctgaggaggaggaggaggaggaggagggggtgaggagagatgtcgacgccggcgaggaagcggctgatgcgggacttcaagcggctgcagcaggacccgcccgccggaatcagcggcgcgccgcacgacaacaacatcatgctctggaacgccgtcatattcggaccggatgacacgccgtgggatggaggcacgttcaagctgacactacaatttacagaagattatcccaacaaaccaccagttgttcggtttgtctcaaggatgtttcacccaaatatttatgcagatggaagtatctgcttggatatcctacaaaatcaatggagccctatatatgatgttgctgcgatattgacctctatccagtccctgctctgtgatccaaacccaaactcccctgcaaactccgaagcagccagactgttcagcgagaacaagcgcgagtacaaccgcaaagtccgcgagattgtggagcagagctggacggccgactaagccaaggacatgattgagttgcagtttctgcaacaagcttctcctaaagatatgcaattctggctttcccggtctgtatcacctactaaaaacataaaaaatcttcagttgttgtaattcctgagcttgatcccctgccttcccctacttgttttcccaatgtagtggctacctatttgatgaatttataaggtattgatgcttatgt

SEQ ID NO: 4721 - DNA, 770 bp, Artificial
  Synthetic
cccccccccatgattcccttctcgaatcttctcacttgctgctgaagtgctccgctccgctccgctccgatccaatccactccgcccgagtcccccacccatcgggacccaccagcgcgagggtgggtggccatcgatcgatcggcccatcggcgattcccgcgggatctgcggcggcgcggggggatttgatcggagggtgaatatgtcgacgccagcaaggaagaggttgatgagggatttcaaacgactgatgcaggatcctccagctggcataagtggggccccacaggacaacaatataatgctttggaatgctgtaatttttggccctgatgatactccttgggatggaggtacgttcaagctgacacttcagtttactgaagattatcctaacaagccacctacagtgcgatttgtttctcggatgtttcatcctaacatttatgctgatgggagcatatgcttagatatactacaaaaccagtggagccccatatatgatgtagctgctatactcacatccatccagtcgctgctttgcgatccaaacccaaattcacctgccaactctgaagctgcccgcctattcagtgagaacaagcgggaatacaaccgaaaagttcgtgagatagtggagcagagctggaccgcggactgatccactccatctaaccatatgatgcctgatacttaaaacgctcatcttttcagtgtgtcgtgtaccaaactgcttgtaattaaaatgctaaaacagtaaaacgtgc

SEQ ID NO: 4722 - DNA, 666 bp, Artificial; identical to SEQ ID NO: 3120
  Synthetic

SEQ ID NO: 4723 - DNA, 613 bp, Artificial
  Synthetic
ctccacgcctccacaaataaagctcgtcccgaggaagggcggcgacccaccccctcccaatcgccaaaaccctaactccgatccgatcgagctctgcttcccatggcgactgccgcgagccaggcgagcctcctgctccagaagcagctcaaagatctcgcgaagaaccccgtggatgggttctcggcggggcttgtggacgatagcaacgtgttcgagtggcaggtcaccatcatcggcccgcccgataccctgtatgatggaggctacttcaatgcaataatgaccttcccccagaattatccgaatagtcccccatcagtaaggtttacctctgagatgtggcatccaaatgtttatcctgatgggcgcgtatgcatttctatccttcatccacctggtgaagatcccaacggttatgagcttgcgagcgaacggtggacacctgtgcatacagttgaaagtatagttctgagcatcatttcgatgctctctagtccaaatgatgagtctccagcaaatattgaagcggctaaggattggagagaaaagagggacgatttcaagaaaaaggttagacgcattgttcgtaaatcacaggaaatgctctgaa

SEQ ID NO: 4724 - DNA, 552 bp, Artificial; identical to SEQ ID NO: 3121
  Synthetic

SEQ ID NO: 4725 - DNA, 707 bp, Artificial; identical to SEQ ID NO: 3122
  Synthetic

SEQ ID NO: 4726 - DNA, 250 bp, Artificial; identical to SEQ ID NO: 4495
  Synthetic

SEQ ID NO: 4727 - DNA, 625 bp, Artificial; identical to SEQ ID NO: 4496
  Synthetic

SEQ ID NO: 4728 - DNA, 692 bp, Artificial; identical to SEQ ID NO: 4497
  Synthetic
  misc_feature (413)..(413): The residue at this position can be any nucleotide.

SEQ ID NO: 4729 - DNA, 679 bp, Artificial; identical to SEQ ID NO: 3640
  Synthetic

SEQ ID NO: 4730 - DNA, 467 bp, Artificial
  Synthetic
aaccaaaaataccatacaccatgtcgggcaagcgaccatctgtggcccagaagcggctcatgaaggagtacaagcagttcattagtgatcctccccagggaatcagtgcaggtcctgctgacgaagataactttctactctgggaatgtctgatacagggaccagatgatactccgtacgagggtggcctgttccccgcaacactcaaattcccccaggattaccccctgtcccctccagtgatgaagttcacctgcgaaatgtaccaccccaacatttacaaggacggaaccgtgtgtatttccattttgcatgctcctggtgacgatcccaacatgtatgagagcgcttcggaacggtggtcgcccatccagtcggtagacaagattctgctgtcggtgatgagcatgctagccgagcccaacgacgagtcaggggccaacattgacgccagcaaaatgtggcga

SEQ ID NO: 4731 - DNA, 631 bp, Artificial; identical to SEQ ID NO: 3128
  Synthetic

SEQ ID NO: 4732 - DNA, 667 bp, Artificial
  Synthetic
ttgacagtgtgtgttcttctttctcgcacttgttccgtgtgcccggggttagccctagggcgatctttgcgcgatccgggcaggggatcggggccgcggcgcatccacgcgggcgatgcgctagattgggcacccggcggcgaggatcagggtttggatttgtcggtagcaatagccctatcgatctccatcgatcgatcgagctgggcggcgggggaatgggcgagagccaggcgagcctcctcttgcgcaagcagttgaaagatttgacaagaaatcctctggatggattctcggctggattggtggacgattccaatgtgtttgagtgggcggtgaccatcatcgggccaccagacaccttgtatgaaggtggttatttcaacgctatcatgagctttcctctgaattatccgaatagtcctccgaccgtgagatttacgtcggatatgtggcatccaaatgtttacccggatggtcgtgtttgcatctccatccttcacgctcctggagacgatccaaatggctacgagctggcgagcgaacgatggtctccagttcacacggtagaaactattcttttgagtataatctcgatgctttcgagcccaaacgacgagtcaccagccaacatcgacgccgctaaagagtggcgagagcgaagaga

SEQ ID NO: 4733 - DNA, 876 bp, Artificial; identical to SEQ ID NO: 4500
  Synthetic

SEQ ID NO: 4734 - DNA, 671 bp, Artificial; identical to SEQ ID NO: 3132
  Synthetic

SEQ ID NO: 4735 - DNA, 500 bp, Artificial
  Synthetic
gcagttctctgaagattatcccaataaaccaccaacagttcggtttgtgtcacggatgtttcatcctaatatttatgcagatgggagtatctgcttggacattctacaaaaccagtggagtccaatctatgatgttgctgctatacttacctccatccagtccttgctctgtgaccctaatccgaattctcctgcaaactcggaagctgctcggatgtacagcgaaagcaagcgcgagtacaacaggagagtgcgtgatgttgttgagcaaagctggactgctgactagtagtagtttgttgtaagcgttgtagctctctctactttctctcaatcacgattcagcaacagctttcttctcttttcattcatgtcttgtgtttccaaaactatttaagtgattccatgctttgatgtaacccaacatccttaaaaaaacaactttgtaccaaaccatctgaattattcacttttgtgtatatatgtattacgatttaaaa

SEQ ID NO: 4736 - DNA, 343 bp, Artificial; identical to SEQ ID NO: 4485
  Synthetic

SEQ ID NO: 4737 - DNA, 522 bp, Artificial; identical to SEQ ID NO: 3133
  Synthetic

SEQ ID NO: 4738 - DNA, 541 bp, Artificial; identical to SEQ ID NO: 4488
  Synthetic

SEQ ID NO: 4739 - DNA, 611 bp, Artificial; identical to SEQ ID NO: 4490
  Synthetic

SEQ ID NO: 4740 - DNA, 627 bp, Artificial; identical to SEQ ID NO: 4491
  Synthetic

SEQ ID NO: 4741 - DNA, 692 bp, Artificial
  Synthetic
gaatttcaattctcgctaatcaggctaagactcagatttcttcgattgtttggtttttaatggcttcgaaacgaatattgaaggagctgaaggatctccaaaaagatcctcctacctcatgcagcgccggtcctgttggagaggacatgtttcactggcaagctacaataatggggccctctgacagcccttacgctgggggtgtatttttagtcactatccattttcctccagattatccattcaaacctcctaaggttgcttttaggacaaaagttttccatccaaatatcaacagtaatgggagcatatgcttggacatactgaaggagcagtggagccccgccttaactatttccaaggttttgctttcaatctgctcacttttgacggatccaaaccctgatgacccccttgttcctgagattgctcacatgtacaagacagacaaggccaaatatgaagcaaccgccaggagttggacccagaagtacgccatgggctaactattgcctatggcggcttgaattgatataaagaaaaacaaatttcaatgtctttcttctctgttctctccattaacaagttgtacaatagcattaagcattgccctctgcaggaagaattatgatgctttaaattttgtttatatggattctaatatttgatgtggggaagcatatatttatctg

SEQ ID NO: 4742 - DNA, 678 bp, Artificial
  Synthetic
gcgaactcctcccaagtcatatccctcaaagtcacagtatctcgtactttggtttctccttttgtttgggataagagaaagacagtaatgtcaggaggtatagcccgtggccgtcttgcagaggagcgcaaagcttggcgcaaaaatcacccccatgggtttgtagcaaagccagagacgctttcggatgggtcagttaacttgatggtttggcactgcagtattcctggtaaagcaggaacggactgggaaggcggtttttatccggttacgatacacttcagtgaagattatcctagcaaaccacctaagtgcaaattcccacaaggcttcttccatccgaatgtctatccatcaggaacagtttgcttgtcgatcctcaacgaagatagcggttggagacctgccattacagtgaaacagatactggttggtatccaagacttgttagatcagccaaaccctgctgatcctgcccaaaccgaagggtatcatctctttattcaggatgctattgagtacaagaagcgggttaggctgcaggccaagcagtatcctcctctggtgtagtctaaataatggtcgtatgtttggatcgtggttctaatgcaacttgaaactatggtattcatagcctgctgatagctgacagtcttctggcaaatgatgctgacttgg

SEQ ID NO: 4743 - DNA, 764 bp, Artificial; identical to SEQ ID NO: 3130
  Synthetic

SEQ ID NO: 4744 - DNA, 651 bp, Artificial; identical to SEQ ID NO: 3127
  Synthetic

SEQ ID NO: 4745 - DNA, 683 bp, Artificial
  Synthetic
gatcgcatgcacacggcaggaaggggaagtggaggaagggttgcgatctcgcggatcgtccaggatagggcgccgcatcgactcgccgcctacgccgccgctgccgccgccgccgctatggccgtgaccctgggtttgtagggattttccatccagatttcgaggagatcgctgcgcgtttctcgttcatggctgagaacttacccccaaaggtgattcgagcgcttgcaaaggagctcaagagcttggacgagagccctccagaggacattcgcgttcatgtaaatgacgacaacttctcgagcattttcgcggacattgagggaccacccggaacaccgtacgaaagtggcgtcttccggatcaggcttttgcttagtcccgatttcccgcaaacgccaccgaaaggttatttcgtcaccaagatcttccatccaaacatcgcaaagaatggagagatttgcgtgaacgttttgaagaaggattggaagccgacgctcggcctgaggcatgttcttcttgtcgtacggtgcttgctcatagagccgtttccagaatcggcacttaacgaggacgctggaaagatgttgatggaggattacgatggatacgcaaagcacgccagattgatgacaaacatccacgcgatgaagccaaagccaaagaccacgaaagtcgccata

SEQ ID NO: 4746 - DNA, 705 bp, Artificial; identical to SEQ ID NO: 4503
  Synthetic

SEQ ID NO: 4747 - DNA, 668 bp, Artificial; identical to SEQ ID NO: 4504
  Synthetic

SEQ ID NO: 4748 - DNA, 653 bp, Artificial; identical to SEQ ID NO: 4506
  Synthetic

SEQ ID NO: 4749 - DNA, 621 bp, Artificial; identical to SEQ ID NO: 4507
  Synthetic

SEQ ID NO: 4750 - DNA, 557 bp, Artificial; identical to SEQ ID NO: 4508
  Synthetic

SEQ ID NO: 4751 - DNA, 570 bp, Artificial; identical to SEQ ID NO: 4509
  Synthetic

SEQ ID NO: 4752 - DNA, 641 bp, Artificial; identical to SEQ ID NO: 4519
  Synthetic

SEQ ID NO: 4753 - DNA, 806 bp, Artificial
  Synthetic
gacctgcgaactctccacgcctccacaaataaagctcgtcccgaggaagggcggcgacccaccccccccaatcgccaaaaccctaactccgatccgatcgagctctgcttcccatggcgactgccgcgagccaggcgagcctcctgctccagaagcagctcaaagatctcgcgaagaaccccgtggatgggttctcggcggggcttgtggacgatagcaacgtgttcgagtggcaggtcaccatcatcggcccgcccgataccctgtatgatggaggctacttcaatgcaataatgaccttcccccagaattatccgaatagtcccccatcagtaaggtttacctctgagatgtggcatccaaatgtttatcctgatgggcgcgtatgcatttctatccttcatccacctggcgaagatcccaacggttatgagcttgcgagcgaacggtggacacctgtgcatacagttgaaagtatagttctgagcatcatttcgatgctctctagtccaaatgatgagtctccagcaaatattgaagcggctaaggattggagagaaaagagggacgatttcaagaaaaaggttagacgcattgttcgtaaatcacaggaaatgctctgaaagataaggagcacaagggggagtaagcgagtgctacaacaggtgcactacacttaactgtctgtcgtcaaacgactacctaaagatagcatttttgcttcttcccctgtatatttccccctcagtgtcattcgagtggtgatgttggtcttgtctccgagatgctcggaaatgttgcctatt

SEQ ID NO: 4754 - DNA, 599 bp, Artificial; identical to SEQ ID NO: 3123
  Synthetic

SEQ ID NO: 4755 - DNA, 770 bp, Artificial
  Synthetic
gcaggcgacgcgcaagaaactgaagtctagtcttaaccccatccaagctcaatttcaatctcgtcgattctctttgaaattcttgccgcttcatcgttcaggcggtcagggatgtcgacgccagcgaggaaaagattgatgagggattttaagaggttacagcaggatcctcctgccggcatcagtggtgctccgtatgacaacaatattatgctctggaatgccgttatattcggtcctgatgacacaccttgggatggaggtacgttcaagctcacccttcagtttacggaggactaccccaacaagcctccaactgtgcggtttatttccaggatgttccatccaaatatttacgccgatggaagtatatgcttggacatactgcaaaatcagtggagtcctatatatgacgtagctgctatacttacttcaatccagtctttgctctgtgatccaaacccaaactcgccagcaaattcagaagcagcacgcatgtttagtgagaataagcgcgagtacaacaggaaggtgcgtgagattgttgagcagagctggacagcagactaacatctctcaggctgaatctgttttgggagattttcctggtaccgcctgtgtcgagctgaaaacttttcagtgccgttgctacattaaaaacaaatgtagcaggaaattgtacttttatgtgttgtaggaaactctgattgcctttatcttcatgttctgctactcgactatgagacgttgtacatatgatgatctcttgt

SEQ ID NO: 4756 - DNA, 761 bp, Artificial; identical to SEQ ID NO: 4531
  Synthetic

SEQ ID NO: 4757 - DNA, 713 bp, Artificial; identical to SEQ ID NO: 3633
  Synthetic

SEQ ID NO: 4758 - DNA, 546 bp, Artificial; identical to SEQ ID NO: 4542
  Synthetic

SEQ ID NO: 4759 - DNA, 616 bp, Artificial
  Synthetic
ttctcaagctagtctcctccttcagaaacaactcaaagatctctgtaaaagaccagttgatggattttcagctggtttggttgatgaaaacaacttattcgaatggagtgtcaccattatcggacccccagatactttatatgaagggggtttctttaatgctatcatgagctttcctcaaaattatcccaacagtcctccaactattaggtttacctcggaggtgtggcatcctaatgtttattctgatggaaaggtttgcatctcaatacttcacccacctggtgatgatccaaatggatatgagcttgctagtgagcgttggtctcctgtccatacggttgagagcataatattgagcatcatatcaatgctttcaagtcctaatgatgagtctcctgctaatgtggaagccgctaaggaatggagagataatagagatgaattcaagaaaaaggtcagtcgttgtgtaagacggtctcaagaaatgacataaagacacgaatgccaaaatcggacttctttcatcagttgttgtttgatacaaatgtagaattgttgtcaaggtctgtcataccttttgtaatatttgcgagtacggtcattatttacattt

SEQ ID NO: 4760 - DNA, 696 bp, Artificial
  Synthetic
aggaaaggagcgcatctcaaaagccccaagcctagggcctgtcttccccttggaacaaaagcaccccccacccatagccattagccattagccattatgtcagaaactcaggctagccttctccttggcaaacaacttagagagcttttaaaatctccagtggaaggtttctcagcagggctggtggatgattctaacctctttgaatggaatgtgaccattattggtcctcctgatacattatatgaaggtggtttcttcaatgccattatgagctttcccaaaaattatccaaatagtcctccaacagtcaggttcacctctgagatgtggcacccaaatgtgtatccggatggccgtgtttgtatttccattcttcatgccccgggggatgatccaaatggatacgaacatgctagcgagcggtggtcaccagtgcacacggtggaaaccattctattgagcatcattgcaatgctttccagtccgaacgacgagtctccggcaaatatagatgcagcaaaggaatggagagagaacagggcggagtttaagaagaaagtgcgtcgcattgtacggcgatctcaagagtgtctctgaatttggcaatataccagggtatgtatcctcattgagaaacccttgaaacttctctgaattgatagaaaaaaggaagggacatacatatatatcaga

SEQ ID NO: 4761 - DNA, 665 bp, Artificial
  Synthetic
tgcttacaggcgttagaagagaagacggagagagagagagagaagggaagtccaggcgtctctatctttcttactctgcccttctcagcattcccactgccatgtccacccctgcacggaagcgcttgatgcgcgacttcaagcggcttcagcatgatccccctgctggcataagtggtgctcctcaggacaacaacattatgctttggaatgctgtcatctttgggccggatgacacaccatgggatggaggtacgttcaagctgacattacaattttctgaggactatccaaataagcctccgacggtccgttttgtgtcgaggatgttccacccaaacatttatgccgatggaagtatctgcctggatattctgcagaaccaatggagcccaatctatgatgtcgcagcaatacttacatccattcagtctttgctctgcgatccaaacccgaactctccggcaaattccgaagcagcacgaatgtatagcgaaaaccggcgagactacaaccggaaagtgcgcgaaatagtggagcaaagctggacggctgaatgatggatgaactgtctacctctagtgatatacaagtgtgtcgaaacagttgcatgaggttgaactaattctctccttttacaagtttggcactttcgtaaaaattct

SEQ ID NO: 4762 - DNA, 669 bp, Artificial
  Synthetic
cccacgcgtccggtcgttgcttaattactgttcattcacaggaggatcctaatctctttcaggagtcgctatggcttcaaagcggatcttgaaggagctcaaagatcttcaaaaggatcctcctacttcgtgtagtgctggacctgttgctgaggacatgtttcattggcaagcaacgataatgggtcctccagatagtcctttttctggtggtgtttttctggtgacgattcattttcctccagattatccattcaagccacctaaggttgctttcaggacaaaagttttccacccaaacataaacagtaacgggagcatatgccttgacattttaaaggaacagtggagccctgccctaacgatttccaaggtgttgctttcaatatgttctcttttgacggatgctaatcctgatgatcctttggtcccagagattgcacacatgtacaagacagacaggaacaagtatgagacaactgcaaggagctggacccagaagtatgccatgggctaaacgtacctttgtatcatggggtcaagggcattttactttcagatacttcactatttacattcaatgtactaatctgttctttgagttgtaacatggagtccatgtcttaagaggaaaggaaaatcatggacgctgctcctaaaagtttgtat

SEQ ID NO: 4763 - DNA, 584 bp, Artificial; identical to SEQ ID NO: 3630
  Synthetic

SEQ ID NO: 4764 - DNA, 554 bp, Artificial; identical to SEQ ID NO: 4476
  Synthetic

SEQ ID NO: 4765 - DNA, 619 bp, Artificial
  Synthetic
gagagaagaatgtcaggaggcatgctcgaggtcgacttgctgaggagaggaaagcttggcgtaaaagccatccctttggattcgtggcgagaccggatagcaaacccgatggatccattgatctcatggtctggcgatgcatgattcctggaaaacctggtactgattgggattctgccctttttcctttaacaatctacttcactgaagactatcctagtaagccaccaaagtgcaaatttcctgaaggttttttccatcccaacgtttatccttctggaacagtttgcctctctattctcaatgaggatttggattggagaccagctattacggtgaaacaaatactgattggaattcaagagcttttagatgaaccgaatcccaacagtcctgctcaagaagatgcttacagactatttgttcaggatcctgcgcagtacaagattcgagtgaaacaacagtctaaacagtatcctccgaccttgtaattgtactcaactttcaaagtatatacatttgctatcgaattgaaaatactttgaaaatagttctggatttgttgagattatgcaactcatatatattatatatatatattaatcaaggaagatagcct

SEQ ID NO: 4766 - DNA, 600 bp, Artificial; identical to SEQ ID NO: 1225
  Synthetic

SEQ ID NO: 4767 - DNA, 462 bp, Artificial; identical to SEQ ID NO: 1239
  Synthetic

SEQ ID NO: 4768 - DNA, 553 bp, Artificial
  Synthetic
gttccggatctctgccccaaaacttgtcttggccatggcggcagtggatgaataccgatgcttcgttggcggcctgtcgtggtcgaccacggacagcaacttggaagacgcattccggccgtatggcaccgtgatcgaagccaaggtggtgcttgacagggacaccgaaaaatcacgcggctttggcttcgtgactttcgaggacgagacttcgatgcaagatgcgatcgatagcatgcacggcaaggatcttgatggccgctccatcaccgtgagcaaagctcagccaaagtccggaggtggaggccgagatggtggccgtgaccgagatggaggccgagacgggggccgagatggaggatatggaaggcgcggtggcggcggcggcggcggcggcggcggaggtggaggtgcaggcggaggtggcggtggtggctgcttcaagtgtggcgagaatggtcactgggctagagactgtaccagcagcggcggcggtggcggtgacaagtatgggagccgaggtggtgaccgacgtggaagtggacgctacggc

SEQ ID NO: 4769 - DNA, 638 bp, Artificial
  Synthetic
cccctggtggtctctcagaggtgggttggcttctcctccccctcccggttcggttcgggtccggttcgatttcggttttttcttcggttcgggggttggtgggaaagcatggcggcgccggatgttgagtaccgctgcttcgtcggcggcctcgcctgggccaccgacgaccgctccctcgaagccgccttctccacctacggcgagatcctcgagtccaaggtccgatggattccctcttctctgtgttttttttgatgcgatttggtggtggtgttcgtcagatctggttgcgtagatctgactatgggggttgtggtatgcggtgcagatcatcaacgatcgggagacggggaggtcgcgcgggttcgggttcgtgacgttctcgagcgagcaggccatgcgcgacgccatcgaggggatgaacggcaaggagctcgacggccgcaacatcaccgttaacgaggcccagtcgcgccgctccggaggcggaggcggcggtggctacggccagcgcggcggaggcggaggctacggtggcggcggctacggtggtggtggcggcggcggtggctacggccagcgccgtgaaggcggctacggcggtggcggtggctacggtggcggccgtggtggcg

SEQ ID NO: 4770 - DNA, 737 bp, Artificial
  Synthetic
cccgctcgtgctctctttgaggtgggttggcttctcctccccctctttaccttttcctcctcggttcggttccgtggttcgtctagggtttagtgggttgagatggcggcgccggatgtcgagtaccgctgcttcgtcggcggcctcgcctgggccaccgacgaccgctccctcgaggccgccttctccacctacggcgagatcctcgactccaagatcatcaacgacagggagacggggaggtcacgtgggtttggcttcgtcaccttctcctccgagcagtcgatgcgcgacgccatcgagggcatgaacggcaaggagctcgacggccgcaacatcaccgtcaatgaggcccagtcccgccgctccggcggcggaggcgggggctacggcggcggcggtggcggctacggcggcggtcgtggaggcggcggctacggaggaggtggcggcggcggctacgggcgccgtgagggcggctacggtggcggcggcggctacggcggcggccgtggcggcggcggcggcggctacggtggcagccgtggcggcggctacggcggcgactccggcgggaactggaggaactgattggtggggcccatcgtggccagttatccttagctatccgtgtcagaatcatcttatcatcgagtcgagtcgttatcgtgtccagtggctctctcgagtcgagaagccctctatccatccatccagtgttaggtgttcttcgtccg

SEQ ID NO: 4771 - DNA, 672 bp, Artificial
  Synthetic
acgcgtcgcgctcctcatttgtttctctctccttaaaccctcaaaacctttctttcctcagatttgtcaatttatctgcgcaaatggctttctacaacaaactcggtggtcttttgaggcagagcatttctggtaatgcagtaagtgcaacatcaccaatgccttcaatgcttgatgccgtccggtgcatgtcaaccaagcttttcattggtggtctttcatggggaactgatgatcagtcgctcagagacgcctttgctacctttggtgatgttgttgatgctagggtaattgttgacagagattctggcagatcaaggggatttggatttgtgaacttctcagatgatgaaagtgccaatgaggctattaaagcaatggatggtcaggaactccagggaaggaatattcgtgttagtattgcccaagagagagctcctcgaagcggaggttttggcggttccggtggatttggtggtggctatggtcaagctagagataatgatggatactaagtcactttgattttttctaagctgtcaatgtgtgcatgataacgtttatctaagaagaggactttggcggaagatagctttgttgagtttatctatattaagacttcttttcgtgcaaggttttagtatcaataatttttcctgatttatggctagc

SEQ ID NO: 4772 - DNA, 611 bp, Artificial
  Synthetic
ggtgctctctttgaggtgggttggcttctcctccccctctttaccttttcctcctcctcggttcggttccgtggttcgtctagggtttagtgggttgagatggcggcgccggatgtcgagtaccgctgcttcgtcggcggcctcgcctgggccaccgacgaccgctccctcgaggccgccttctccacctacggcgagatcctcgactccaagatcatcaacgacagggagacggggaggtcacgtgggtttggcttcgtcaccttctcctccgagcagtcgatgcgcgacgccatcgagggcatgaacggcaaggagctcgacggccgcaacatcaccgtcaacgaggcccagtcccgccgctccggcggcggcggcggaggcgggggctacggcggcggcggtggcggctacggcggcggtcgtggaggcggcggctacggaggaggtggcggcggcggctacgggcgccgtgagggcggctacggtggcggcggcggctacggcggcggccgtggcggcggcggcggctacggtggcagccgtggcggcggctacggcggcgactccggcgggaactggaggaactgattggtggggcccatcgtggc

SEQ ID NO: 4773 - DNA, 631 bp, Artificial; identical to SEQ ID NO: 1240
  Synthetic

SEQ ID NO: 4774 - DNA, 660 bp, Artificial
  Synthetic
tcttcttatcatcctcatcaccatcactatcgacgttatcgtcatcttcaacgtcatcctcgtcgccatcctcgacgctgtgtatcctgcgtcgtgcatcgtcgtcgtcgtcaccatgagtgtgggtggtggagccgacggggaatatagatgcttcgtaggagggctcgcttgggctaccgatgaccgtgcccttcaagctgccttccgtcagtttggcgaagttgtcgaatccaaggtgattagtgatcgcgaaactggtcgatctcgagggtttggatttgttacgtttggtgaggagaaagcgatgagggatgcgatagaatgcatgaatgggaaggatttggatgggaggagcatcacggtcaaccaggcccaaagccgctcatcaggcggtggcgggggccgcggtggctttcgtcgtccagaaggtgggaggtttggaaatgggggatataatgaggagaggagaggctatggtggtagaggaggaggaggtagctatgggggtaaagagcgtggctatggtggtggaggtgctcgtacaacctactctgttggaggaggtggcggtggtaaatatggaggaccccttgaccaaggaaattggcgaaagtgaattaggatagatggatagatagatagatagatatatagata

SEQ ID NO: 4775 - DNA, 542 bp, Artificial
  Synthetic
gggtgttgttgtttagttcgggtttcctgtttcgttctttgtgggccgtggatctagcggaagacaccccgccgttctcgagcttcgaacagccgacgttgcctagctgggatacatggcggcagtggagtattcctgtttcgtcggaggcctggcatgggccaccgacgaccgcagcctcgagaccgccttccgccccttcggaaatgtcacagactccaagattatcaatgatcgtgaaactggaaggtctcgtggctttgggtttgttaccttctctgaggagcaatccatgctggatgcgatagagggtatgaatgggaaggagctcgatggaagaaacattactgtaaaccaagctcagagccgtggttctggaggtggaggtggtggtggcggtggtggattccgcagatctgaaggtggccgatcaggaggaggagggggatatggaggaggagggtatggaggaggaggagggtatggaggaagtggtggctatgggcagtctggtggtggaggtggatataatggtggtggtg

SEQ ID NO: 4776 - DNA, 594 bp, Artificial
  Synthetic
gacggcacaatagtgtaaagcccagtagcatcttcttcaatggcgctagcttctcggttcggttcgctcctccgtcgtctgggggcaccgtcctctgcttcgaaccagggatcagcagcacttgcggtaacctctcctttctcgcaggtcctctccaggggtttctgcgatgcggccgatgcctcccccaagcttttcattggcggactggcatggattactgatgattcttctttgagggatgccttttcctcttttggtgttgttactgatgcccgtgttataacagatcgtgagactggcagatctaggggttttggatttgttaccttctctactacttctgaggctgagagtgcccttaactcaatgaatggccgggatctgaatgggagagcaatcagagtcaactttgcaacagaaaggccgtctggtggtatgggtatgggcaggtttggaggtggatgggggggctctggtggaggcggcggcggttttggtggagggaatcgcgacggcggtggttttggtggcggtggtggtggcggtggttttggtaatggtagtggtggttatggtggtggtgatgacctc

SEQ ID NO: 4777 - DNA, 464 bp, Artificial
  Synthetic
tagtttagttgtaagtagtattttctaggtctagagttcgaggatggctggcggcgtcgagtaccgttgctttgttggaggcctttcttggaacactgatgaccgaagccttgagactgcctttagctcttacggcgaggttatcgactccaagatcataaacgaccgggaaaccggtaggtctcgtggttttggctttgtgacattcgccttggagcaatccatgttcgatgccatcgaggggatgaacgggaaggagcttgacggccgaagcattacagtgaaccaggcccaggatcgttccagtggaggtggcggtggcggcggcggtgggggttacagatcagggcgttctggtggaggtggaggagggtatgatggtgagcgaagaagctatggcggagggggccggtctgttggcggcggtggatatggtggtagtggtggtggtggtggttatggag

SEQ ID NO: 4778 - DNA, 318 bp, Artificial; identical to SEQ ID NO: 1236
  Synthetic

SEQ ID NO: 4779 - DNA, 682 bp, Artificial
  Synthetic
gaaaaaaatggcagaaggtgaatacaggtgcttcgtcggtgggttagcatgggctactaccgaccaaacacttggggaggctttttctcagttcggcgaaattcttgactcgaaggtctgtggcaaaacagagcagagatcggattcgagccgatttgaatcggcttcgttgaccctctgttactggaaaaattgatctgttactactctctctgttactgttactactctctggtttatctgttactgttactatttgatactaatattccactttccccgaaacgattatcaatgacagagaaactggtcgatctagagggtttggatttgttacattcaaggacgagaaatctatgagggacgctattgaagggatgaacggccaggaccttgacggtcgtaacatcaccgtcaacgaagctcagtctcgcggaagcggtggaggcggtggcggttaccgtggtggtggcggtggaggctacggaggcggtggccgtcgtgaaggtggttatggcggcggtggtggttacggaggtggccgtcgtgaaggtggttatggcggcggtggcggctatggaggtggccgccgtgaaggtggttacggtggtggctctgaaggaaactggaggagttagattttccggttcctttagatttaattttttgtttgaattttatg

SEQ ID NO: 4780 - DNA, 705 bp, Artificial
  Synthetic
tctgtatctgcattgagaagtggcttaaaccctagccgctcctcatttgtttctctctctccttaaaccctcaaagattctccttcctcagatttgtcaatttatctgtacaaatggctttctacaacaaactcggtggtcttttgaggcagaacatttctggaaatgcagtaagtgcaacaacaccaatgccgtcaatgcttgatgccttccggtgcatgtcgacaaagcttttcgttggtggtctttcatggggaactgatgatcagtcactgagagatgcctttgctacctttggtgatgttgttgatgcaagggtaatcgttgacagagattctggcagatcaaggggatttggatttgtgaacttctcagatgatgaaagtgccaatgaggctattaaagcaatggatggtcaggaactccaaggaaggaatattcgtgttagtattgcccaagagagagctcctcgaagtggtggttttggtggctctggtggtggatttggtggcggctatggtcaagctagagacaatgatggatactaagtcacttttatttttgataagctgtcaatgtgtgcatgataacttttatctaagtagaggactttggtgggatagctttgttgagtttatctatattaagacttcttttcgtgcaaggttttggtatcaataatttttcctgatttatgggtaaaaa

SEQ ID NO: 4781 - DNA, 597 bp, Artificial
  Synthetic
gttgtttcgtcggtgggctcgcatgggcaaccaccgacagaaccttagctgacgcattcggtacatacggcgaagttctcgactcgaagatcattaacgacagagaaactggcagatctagaggatttggctttgttacctttaaggatgagaaatgcatgagggatgctatcgaagggatgaacggtcaggaacttgacggccgtaacattaccgttaacgaagctcaagctcgtggaagtggaggcggcggcggtggtggttacggaggtggccgacgtgaaggaggaggcggtggttacggaggtggtggtggtggttacggtggtagccgacgtgatggaggcggcggcggttacggaggaggccgacgtgaaggaggaggcggtggttacggaggtggtggtggttatggcggtggtggacgttattagtttcaatgtacttaattttggcccattgttaaattggcctttagattagtatccattactgttttagtgtggttggtgttattgtcctttatatatttggttaagatactgtgaatctgtattttacaaagttccatggaatctagtaaatgatggtttacga

SEQ ID NO: 4782 - DNA, 671 bp, Artificial; identical to SEQ ID NO: 1392
  Synthetic

SEQ ID NO: 4783 - DNA, 608 bp, Artificial
  Synthetic
aaacttttctccatctcttcgtagccgcctccctctcatctccgaatcttcattattttcaaagtagcagcggtctgtttcagaaatggcggatgatgaatatcgctgttttattggtaatttgtcatggtcaacttctgatcgaggattaaaagatgcatttgagaagtttggaaatcttgttgatgcaaaggttgtacttgacaagctctctggccgatctcgtggatttggttttgttacatttgatgaaaagagagcaatggaagatgccattgaagcaatgaatggagtggacttagatggtcgtgatattactgtagacaaagcccagcctgacaaaggttcaggtagagattttgatagtgatcgacctcgtgaccgagatcggggtcgcgatcgtgatcgcggtagccgtgattatggaggtggacggggatctggtggtggtggagactgctttaactgtggtaagccaggacactttgccagagaatgccctaatgaagggggtagaggtggtcggtatggtggcggaggtggtggtagtagaagcagtggctatggacctgataggaacggagatcgatatggaagccgcagcggca

SEQ ID NO: 4784 - DNA, 706 bp, Artificial
  Synthetic
tttacttcgtttttagggtttcttcttattcttattaatcagaaaagaatggcagaagttgaatacaggtgcttcgtcggtgggctagcatgggctaccaccgaccaaacacttggggatgctttttctcagttcggcgaaattctcgactcgaagatcatcaatgacagagaaactggtagatctagaggatttggatttgttaccttcaaggatgagaaatccatgagggacgctattgaagggatgaacggtcaagaccttgacggccgtaacatcaccgtcaacgaagctcagtctcgcggtagcggcggaggcggtggtggtggtggcggttaccgtggtggtggcggtggaggctacggaggtggtggccgtcgtgaaggtggatacggtggtggtggtggttacggaggtggccgacgtgaaggtggttatggtggtggcggcggttatggaggtggtcgtcgtgaaggtggttacggtggtggttctgaaggaaactggaggagttagatttccgttgcctttagatttatttttttgtttgaaatttatggttctacgtttggttgaagttccgttatggtttactttggttcctgttactgtcctcgttttgaccgcgagattgttaccgtgatgttacttgtggatctgtatttacaaagttctctggaatgaagtgaattaagatttacagtct

SEQ ID NO: 4785 - DNA, 388 bp, Artificial
  Synthetic
acccacgcgtccgcggacgcgtgcggttacaagggcctcttgcccggtccggtgttcgattcccaggttttccggctcggtcttgttcggttcgttttttccggttcgcgtttcggatctgaggtatgtcgtctgatgcggagtaccgctgcttctttggggggcttagcgtgggtcaccgatgatcaaacccttcaggaggctttcagtcgttatgtgtttttgttatagactctaaggtgattagtgatcgggaaacggggcggtctcgcgggtttggctttgtcacctttgcagatgagcaggcgatgatggaggccattcaggagatgaatgggaaggagctagatgggcggaatataaccgtcaatcaagcacagaatcgctc

SEQ ID NO: 4786 - DNA, 562 bp, Artificial
  Synthetic
cggggttcggaaacatggggtctgagtaccgttgcttcgtcgggggtctggcttggtccactaatgaccaggctttggaatccgctttcagtcaattcggaactgtcatcgaatcgaaggttatcaatgaccgtgagactggaaggtctcgtggattcgggtttgttacattcgaggatgagcaagccatgagggatgcaattgaagggatgaatggaaaggatctagatggcaggaacattactgtaaatcaggctcaggacaggtcatcaagtggtggtggtggtggcggctaccgaggaggtggtggtggcggtggaggttaccgtggtggtggtggtggttacggtggcggtggcagtggataccgctcaggtggtggtggatatggtggtggcggccaacgtagggattctgggtacggtggagaaggtggtggctactctggcggtgggggctacggtggtggtggtggtggatacggtggaagtggtggtggtggtggtaacaacaggtggagggacaattaaccaacctatcaaaggatgtgtaactagctatt

SEQ ID NO: 4787 - DNA, 434 bp, Artificial
  Synthetic
gtgggccgtggatctagcggaagacaccccgccgttctcgagcttcgaacagccgacgttgcctagctgggatacatggcggcagtggagtattcctgtttcgtcggaggcctggcatgggccaccgacgaccgcagcctcgagaccgccttccgccccttcggaaatgtcacagactccaagattatcaatgatcgtgaaactggaaggtctcgtggctttgggtttgttaccttctctgaggagcaatccatgctggatgcgatagagggtatgaatgggaaggagctcgatggaagaaacattactgtaaaccaagctcagagccgtggttctggaggtggaggtggtggtggcggtggtggattccgcagatctgaaggtggccgatcaggaggaggagggggatatggaggaggagggtatggaggagg

SEQ ID NO: 4788 - DNA, 604 bp, Artificial
  Synthetic
gtgttctgatactgcaatggccgctgccgtagagtatcgctgcttcgtcggaggtctgtcatggggcacagacgaccgcgccctcgagcgcgccttcagcacctttggggaggtcatcgattcgaaggttgttaacgatcgtgaatcggggagatctcgtggtttcggattcgtgacattcactcaagaacagtctatgcttgacgcgattgaggggatgaacgggaaagagctcgacgggaggaacatcactgtgaatcaagcacaagaacggaactccggaggtggtggaggcgggtttcgaaggtccgaaggccgttacggcgggggcgggggcggatacggcgggggcggttacagatccggcggtggaggcagtggcggatacggcggaggcagcggtggctatggcggtggtggccaaagaagggactccggcggctacaacggcggaggtggtggtggctatggcggtggaggccgctacgagtgagaacggataccagtcgggattcgaactaccggcctcgctgccagtgggaaattaactctgtcgggtctcgaactcccgaccggtttctttttcctgcctttttctttggac

SEQ ID NO: 4789 - DNA, 672 bp, Artificial; identical to SEQ ID NO: 1234
  Synthetic

SEQ ID NO: 4790 - DNA, 576 bp, Artificial
  Synthetic
  misc_feature (451)..(451): The residue at this position can be any nucleotide.
agaagggcagcgaagaagatgaaagaagagtatcgatgcttcatcggcggcttggcctggagcaccaccgatcgcggcttggagaccgctttcgagccctatggatccatcgtcgaagccaaggtggtgtatgatcgagaacagagccggtcccggggcttcggctttgtgaccttcgcggacgaggaggcgatggaaaacgccatccggaagatgcacaaccaggagctggacggccgatccatcactgtcagcaaggcgcagccgaaaactggcggcggcggcggcggcggcggcggtggcggtggccgtggaggagacagggaccgggacagggacagggacagggacagggaccggggtggcggcggctacgaccgcggacatggcggagctagtggcgactgcttcaactgtggaaacaaaggccactgggctcgtgactgtccanagagcggcggcggtggtggaagagaccgcggtggtggccgagaccgagacaggtatgggagtgatagatacggcagtgaccgcggtgacaggtacggtggcggcgatggtaaccgcggcagcggc

SEQ ID NO: 4791 - DNA, 805 bp, Artificial
  Synthetic
aagaaatggccgaggtcgatgtggagtaccgtggcttcgtcggcggcctcgcttgggcgacggacgacatgagcctcggcaacgcattcaaatccttcggcgatgtcgtcgaatccaaggtacatatacagtgagtgacaagggccgcttgaatctttgctttgctgcccagccgccgccccggatcgagagaatgctggccaatttaccccaagatctctctctctttctttgtaggtgatcaacgaccgcgagacgggcagatcccgcggctttggattcgtcactttccgggacgagaaatccatgaacgacgccatcgaatcgatgaacggcaaggatctggatggccgcaacatcaccgtccaccaggcacagcaaaggccgaccatgaccagccgctatagtggatctaaccaagaccgtggtggcgaccgcggcaacggcggcggctacagtgaccgtggtggcgaccgtggtaacggtggcggctacagtgaccgtggtgggtataacaggcggaattctggcgggggcggcggcggtggcggcgtcggtggcggcgtcggtggtgaggccggcggagctggcgttggtggcggcggcggtcgccgctacggcggtgcccggtcagacggtcggtccgatgttggtaactggagaagaagcgagtagtagcagcagctcgacgaggacggatcacgtccagagtaaacttaattgtcgtccatccagacttgttattgtctaattcccctgctattgtgttgtcatacagctagtgaaatacgaaacttgtggtttt

SEQ ID NO: 4792 - DNA, 543 bp, Artificial
  Synthetic
  misc_feature (529)..(529): The residue at this position can be any nucleotide.
  misc_feature (531)..(531): The residue at this position can be any nucleotide.
aaatggccgaggtcgatgtggagtaccgttggttcgtcggcggcctcgcttgggcgacggacgacatgagcctcggcaacgcattcaaatccttcggcgatgtcgtcgaatccaaggtgatcaacgaccgcgagacgggcagatcccgcggctttggattcgtcactttccgggacgagaaatccatgaacgacgccatcgaatcgatgaacggcaaggatctggatggccgcaacatcaccgtccaccaggcacagcaaaggccgaccatgaccagccgctatagtggatctaaccaagaccgcggcggcgaccgtggcaacggcggcggctacggtggtgcccggtcagacggtcggtccgatgttggtaactggagaagaagcgagtagtagcagcagctcgacgaggacggatcacgtccagagtaaacttaattgtcgtccatccagacttgttattgtctaattcccctgctattgtgttgtcatacagctagtgaaatacgaaacttgtggttttaccgctnanaaaaaaaaaaaa

SEQ ID NO: 4793 - DNA, 605 bp, Artificial
  Synthetic
catccgattcgccgccgccttcgtcttcctcgcagagatggcggacgtggaggagtaccgttgcttcattgggaatctgtcatggtccacaactgatgaaagcctcaaggatgcctttggcaaatttggcaacctcactgaagcaaaggtggtttttgacaagtattctggccgttctcgtggttttggctttgtgacctttgatgagaagaaagccatggaagatgctattgaaggaatgaatggattggatttggatgggcgggcgatcactgtcgataaagctcagccacaaggacctggtagagaccgtaatggagaccgtgattatgatcgtgaccgtggatctcgttatgaccgtggccgtgactttggtggtggtgggcgtgcaccacgtggctcaggtggtggtggggattgctacaagtgtggaaaacctggccactttgctagagagtgcccatctggagatggtggtggtagaggtgatagatatggtggccgagatgataggtacggtggtggtggtggcggtggcggccgttatggatctgaccgtggtggtgaccgttattctggtcgtagtcgagatggtggtggctacg

SEQ ID NO: 4794 - DNA, 697 bp, Artificial
  Synthetic
cccggtggtctctcagaggtgggttggcttctcctccccctcccggttcggttcggttcggttcgggtccggttcgatttcggtttttccttcggttcgggggttggtgggaaagcatggcggcgccggatgttgagtaccgctgcttcgtcggcggcctcgcctgggccaccgacgaccgctccctcgaagccgccttctccacctacggcgagatcctcgagtccaagatcatcaacgatcgggagacggggaggtcgcgcgggttcgggttcgtgacgttctcgagcgagcaggccatgcgcgacgccatcgaggggatgaacggcaaggagctcgacggccgcaacatcaccgtcaacgaggcccagtcgcgccgctccggaggcggaggcggcggtggctacggccagcgcggcggaggcggaggctacggtggcggcggctacggtggtggtggcggcggcggtggctacggccagcgccgtgaaggcggctacggcggtggcggtggctacggtggcggccgtggtggcggcggctacggcggcggctacggcggcggctacggcagccgcggcggcggcaactccgacgggaactggaggaactgagcggtggggccctcatgggccaagttatctatctatctaatcgagctaccatcatcatcatccgatcgttatcatcgttagtt

SEQ ID NO: 4795 - DNA, 299 bp, Artificial
  Synthetic
actagacctccgaaccaaaccgagggcaagagcatccgattcgccgccgccttcgtcttcctcgcagagatggcggacgtggaggagtaccgttgcttcattgggaatctgtcatggtccacaactgatgaaagcctcaaggatgcctttggcaaatttggcaacctcactggagcaaaggtggtttttgacaagtattctggccgttctcgtggttttggctttgtgacctttgatgagaaaaaagccatggaaaatgctattgaaggaatgaatggattggatttggatgggcgggc

SEQ ID NO: 4796 - DNA, 694 bp, Artificial
  Synthetic
ggtggtctctcagaggtgggttggcttctcctccccctcccggttcggttcgggtccggttcgatttcggttttttcttcggttcgggggttggtgggaaagcatggcggcgccggatgttgagtaccgctgcttcgtcggcggcctcgcctgggccaccgacgaccgctccctcgaagccgccttctccacctacggcgagatcctcgagtccaagatcatcaacgatcgggagacggggaggtcgcgcgggttcgggttcgtgacgttctcgagcgagcaggccatgcgcgacgccatcgaggggatgaacggcaaggagctcgacggccgcaacatcaccgttaacgaggcccagtcgcgccgctccggaggcggaggcggcggtggctacggccagcgcggcggaggcggaggctacggtggcggcggctacggtggtggtggcggcggcggtggctacggccagcgccgtgaaggcggctacggcggtggcggtggctacggtggcggccgtggtggcggcagctacggtggtggctacggcagccgcggcggcggcaactccgacgggaactggaggaactgagcggtggggccctcatggccaagttatctatctatctaatcgagctaccatcatcatcatccgatcgttatcatcgttagttttgtgtggaactatctagtttgt

SEQ ID NO: 4797 - DNA, 620 bp, Artificial
  Synthetic
cgtccgattctctttaaaaataaaaatatggcagctgaggttgagtcaggtgctttgtaggtgggctggcatgggctaccaccgatagaactttaggagatgcttttgctcactacggcgaagttgtcgactcgaagatcatcaacgatcgtgaaactggaagatcaaggggatttggctttgttaccttcagtgatgagaaagctatgagggacgcaattgaaggaatgaacggtcagaaccttgacggtcgtaacatcaccgttaatgaagctcaatcacgcggcagcggtggtggcggcggtggtttcggaggtggcagacgccgtgagggcggatacagtggtggtggcggatacggtggtggtagtggcggctatggaggtggcagacgtgagggtggctacagcggtggtggcggcggctatggtggtggttacggaggtggccgtaaccgtggatatggtggcggttatggtggtggtggtggtgatggtgggtcccgctactcaagaggtggcggtgcatccgagggaagctggaggaattaataattttgattttttaaaaaaaaatggtgattatgcttctgggttgggtaagagtctatttttgttact

SEQ ID NO: 4798 - DNA, 696 bp, Artificial
  Synthetic
gcgtccgttcttttttagggtttcttcttattaatcagaaaaaaatggcagaaggtgaatacaggtgcttcgtcggtgggttagcatgggctactaccgaccaaacacttggggaggctttttctcagttcggcgaaattcttgactcgaagattatcaatgacagagaaactggtcgatctagagggtttggatttgttacattcaaggacgagaaatctatgagggacgctattgaagggatgaacggccaggaccttgacggtcgtaacatcaccgtcaacgaagctcagtctcgcggaagcggtggaggcggtggcggttaccgtggtggtggcggtggaggctacggaggcggtggccgtcgtgaaggtggttatggcggcggtggtggttacggaggtggccgtcgtgaaggtggttatggcggcggtggcggctatggaggtggccgccgtgaaggtggttacggtggtggctctgaaggaaactggaggagttagattttccggttcctttagatttaattttttgtttgaattttatggttctaagtttggttgaagttccgttatggtttactgtggttcctgttactgttcttgtttttgaccgcgagattgttaccgtgatgttacctagtggatctgtatttacaaagttctctggaatcaagtgaattaagatttacagtct

SEQ ID NO: 4799 - DNA, 890 bp, Artificial
  Synthetic
tttccatctctcttataaattaaaaaaatcaatggctgaagttgaataccggtgcttcgtcggtgggctcgcatgggctaccactgatcgaaccctaggcgaagctttctctcagtatggcgaggtgcttgaatcgaaggtccgtttgtcggtcgcagagcagagatcggaatccgagccctgctttggcttcgtttacccctctgttactgttgattcatctgttactgttactatgtctctatctgttactgttgattcatctgttactgttactatttgatactattattcgttctctctaacgatcatcaacgaccgtgaaaccggtagatctagaggatttggctttgttacttttggcgatgagaaatccatgagggacgctatcgaagggatgaacggccaagaccttgatggtcgtaacataaccgttaacgaagctcaatcacgcggaagcggtggaggcggcggcggcggcggtggtttccgcggtggacgtcgtgagggaggcggcggatacggagggggaggatatggaggtggaagacgcgagggcggcggcggcggttacggcggaggcggcggcggttatggcggtggccgtgaccgtggatatggcggtggtggtgaccgtggatacggtggtgatggaggatcacgctactcaaggggtggtggtgactctgatggaaactggaggaattagataattgagaagatgtggattttagttattttgatcgcagtttaagttggttatatcttaatgttagtgtgactcttttttgaccgttatttggctcgttacgttactgtgtttttctattaactgagttcttatggaatgaattaaattaaggtctacaaattaaatctttcttttgcat

SEQ ID NO: 4800 - DNA, 487 bp, Artificial
  Synthetic
cggacgcgtgggtttcattagggtttaacctcttctctagtatctcagtatagtaaaatgactgctgaagtagaatacagttgtttcgtcggtgggctcgcatgggcaaccaccgacagaaccttagctgacgcattcggtacatacggcgaagttctcgactcgaaggtccgtttgcgcagagcagaaattgaatccgggcccattttttggctttgttgatgatcttctgttactgattactgtttattactctctggtttacttgattcatctgttactgttactgttattactgttatacccttgaaacgatcattaacgacagagaaactggcagatctagaggatttggctttgttacctttaaggatgagaaatgcatgagggatgctatcgaagggatgaacggtcaggaacttgacggccgtaacattaccgttaacgaagctcaagctcgtggaagtggaggcggcggcggtggtgg

SEQ ID NO: 4801 - DNA, 709 bp, Artificial
  Synthetic
gcgaaggggtttcagctgctccttctcagttccggttcgtttcttggtctgttttttgtgttctgatactgcaatggccgctgccgtagagtatcgctgcttcgtcggaggtctgtcatggggcacagacgaccgcgccctcgagcgcgccttcagcacctttggggaggtcatcgattcgaaggttgttaacgatcgtgaatcggggagatctcgtgggttcggattcgtgacattcactcaagaacagtctatgcttgacgcgattgaggggatgaacgggaaagagctcgacgggaggaacatcactgtgaatcaagcacaagaacggaactccggaggtggtggaggcgggtttcgaaggtccgaaggccgttacggcgggggcgggggcggatacggcgggggcggttacagatccggcggtggaggcagtggcggatacggcggaggcagcggtggctatggcggtggtggccaaagaagggactccggcggctacaacggcggaggtggtggtggctatggcggtggaggccgctacgagtgagaacggatcccagtcgggattcgaactaccgggctcgctgccagtgggaaattaactctgtcgggtctcgaactcccgaccggtttctttttcctgcctttttctttggacatgtttgcttactacttctgctactacaactactactttacaactacg

SEQ ID NO: 4802 - DNA, 585 bp, Artificial
  Synthetic
ggaggagactcctccgagattttcccctttgttctggttcgtttttctctgtttggtttctctgttcggggttcggaaacatggggtctgagtaccgttgcttcgtcgggggtctggcttggtccactaatgaccaggctttggaatccgctttcagtcaattcggaactgtcatcgaatcgaaggttatcaatgaccgtgagactggaaggtctcgtggattcgggtttgttacattcgaggatgagcaagccatgagggatgcaattgaagggatgaatggaaaggatctagatggcaggaacattactgtaaatcaggctcaggacaggtcatcaagtggtggtggtggtggcggctaccgaggaggtggtggtggtggtggtggttaccgtggtggtggtggcggtggttacagtggcggtggcagtggataccgctcaggtggtggtggatatggtggtggtggccaacgtagggattctgggtacggtggagaaggtggtggctactctggcggtgggggctacggtggtggtggtggtggatacggtggaagtggtggtggtggtggtaacaacaggt

SEQ ID NO: 4803 - DNA, 288 bp, Artificial
  Synthetic
  misc_feature (192)..(192): The residue at this position can be any nucleotide.
aagggttttggttttcggaaggctaacaacaatggcggaaggggagtaccgatgcttcgtgggaggtctggcctgggttacagatgatagggctctcgaagatgccttccggtcctacgggagggtcactgattccaaggtcatcagtgacagagagaccgggcgctcccgcggatttggattcgtgacgtntgaagacgaacagtcgatgcttgatgcgatcgaggggatgaatgggaaggagcttgacgggcggagcattactgtaaaccaagcgcaaagccgctc

SEQ ID NO: 4804 - DNA, 627 bp, Artificial
  Synthetic
caaaaatggagggttgcagtcgcatctcgccagactatatggcacaacagtttgacgtcaacgagaggatgagatctatactaatcgactggctcattgaggtacaccacaagtttgatctcagggaagagacattattcctaactgttaatttgatagatagatttttggagaaacaatccgttgtgagaaagaaactgcagcttgttggtcttgtcgccatgttactagcgtgcaaatatgaggaagtttctctccctgcggtggatgatttggtggtcatttcggataaagcatacacaaggaaggaggttcttgaaatggaaaaattgatgctcaatacgctgcagtttaatatgtcagttccaactccatatgtttttatgagaagatttctcaaagctgctcaatcagataaaaagcttgagctactttcgttcttcttgatcgaactttgcctcgtggaatatgaattgcttaaatttccaccatcgtttattgctgctgctgcaatctatacagctcagtgcacactttatggtgttaaacaatggagtaagacgtgcgagctgcactctaaatactcggaagatcaacttctggagtgttccagattgattacggaat

SEQ ID NO: 4805 - DNA, 625 bp, Artificial
  Synthetic
gggctatgctcattgcctctaaatatgaagaaatttgggctcctgaggtgaatgattttgtgtgcatctcagacaaagcctacagtcatgagcaggttttggcaatggagaaaaggattcttggccaattggagtggtacttaacagttccaacaccttatgtgttcctcgtccgcttcattaaagctgctgtttccaatgcacaaatggaaaacatggtttatttcctggctgaattggggttaatgaattatgcaacaaatatatactgcccatccatgattgctgcctcagcagtctatgttgctcaacacacactgaattgcactccgttttggaacgatacgctaaaactgcatactggtttctcagagtctcagctactgggttgtgcaaagttgctggtaagctatcatatggaggctccagaacacaagctaaaggtgatttacaagaagtattccaaaccagagagaggtgctgttgcactgcgacctccagccaaattcctcttggctgcttcttcatatgagtaataataggggcttagttcgagttctctactttatttttaaatttttttcttgtattgaaatatttagttaagctctcttactttggatct

SEQ ID NO: 4806 - DNA, 662 bp, Artificial
  Synthetic
gcggtgcttttgtgaaccccttcaaatatcagattgagaacacggtatattttctggctgagctggggttgatgaattatgcaaccattatctactgtccctcgatgattgctgcctcagcggtctatgctgctcgacacaccctcaataggacaccattttggaatgagacacttaagctccacactggtttctcagagtctcagctaatagaatgtgcaaggttgttagtgagctatcaatctgcggctgcaactcacaagctaaaggtgatatacaagaagtactccagtccggagagaggtgttgtttcattactaactccggccaaattcctgttggctgcatcattatcaagtgtgtcatcggggcgatgcgatttagccaagagcacagaagcaggagcaacatcatcatcccctatggtggtggtaggttgtcaaaggtgccacatgtatgtcatggtaactgaagctgatccaagatgcccccaatgcaagagcactactactaggaagatgacttaagttggtttcattaatcaagaatccaaacagttcttttattgcttgctaggtttcatttttgtttctataaatggagcactacttgagctccatagttgtgacttacatttttgtttcttgattaatattcttttt

SEQ ID NO: 4807 - DNA, 531 bp, Artificial
  Synthetic
aaatgctcaagtttccgccatcattcatagctgctgcagcaatctatacagctcagaccacactctacggtgttcagcaatggagtaagacatgcgagtggcatactagttactctgaagatcaacttctggagtgctcgagatcgattgtgatcatcaccagaaggcagcaacaggaaaactaactggagtacataggaagtacagcacgtctaaatttggttatgcagcaaagtgtgagcctgcccattttcttgtgcagacacaacagcaataagaaaaggcgcatgtatagttattactaactttatgtgcacatggattcctaaagatttaattaggaagttccattggtataacgagaacgggtcggagtaataggaagattaacttagccttatagagctccggggagtttgataatctcttatagagctcattgttgttgcattttacaatgttcaaaatttgaacatggctggatttcagtttcatttacgaacagtaataaaaagtcaaaaaacttttcac

SEQ ID NO: 4808 - DNA, 718 bp, Artificial
  Synthetic
acatttttagtctgaataaaatggccaaggctactgtatcatccattgtcctcctcctcactttgaacattctcttcttcgcaatggttagttcaacttacatcccatgcccaccaaaaacaaagaatcaaccccatcccactaccccatcatccaagggttataagaagtgccaaaaggacacactaaaattgaaggtgtgtgccaatttattgaatgacttggtgcatgttgttattggaagctcatcaaagagttcatgctgctctctcattgagaatcttgctgatgttgatgctgcagtttgcctttgcactgccattaaagctaagctcttgggaactaaccttgataccgctctttccctcagcttattgctcaacaattgtggaaagactgttcctaaagacttccaatgtgcataaatggccatcttcccaccccaacttgtttggtaatgaggcgtagttgtctgtttgtggtgtttgttttctccataagattttcgtcggagatttcaactaaaaaataatcagtactgagtgtgtttgtgcacggttgcttattttctcaggaaatatgtggaattattctagtgcttagaagtactgagtgtgtttattcatggttgcttattttcaatgtgttgtatcccatatttatttgtaataagatggttatgttctcactaaggaaatatattatgattgatctcggg

SEQ ID NO: 4809 - DNA, 496 bp, Artificial; identical to SEQ ID NO: 1588
  Synthetic

SEQ ID NO: 4810 - DNA, 612 bp, Artificial; identical to SEQ ID NO: 1589
  Synthetic

SEQ ID NO: 4811 - DNA, 691 bp, Artificial
  Synthetic
acgttcagtttgaataaaatggccaaggctactgtatcatccattggccttctcctcgctctgaacattctcttcttcacaatggttagttcaacttacatcccatgcccaccaaaaacaaagaatcaaccccatcccgctaccccatcatccaagggttataagaagtgcccaaaggacacactaaaattgaaggtgtgtgccaatttattgaatgacttggtgcatgttgttattggaagctcatcaaagagttcatgctgctctctcattgagaatcttgctgatgttgatgctgcagtttgcctttgcactgccattaaagctaagctcttgggaactaaccttgataccgctctttccctcagcttattgctcaacaattgtggaaagactgtccctaaagacttccagtgtgcataaatggccatcatctattttcatcctatcccgacttgtttgggaatgaggcgtagttgtctgtttgtgttgtttgttttctctacaagatattcgttggagaaatactatcagtaataagtgtgtgtatgcatggttgcttattttcaatgtgttgtatcccatatttatttgtaatatgatggttatcttctcattaaggaattatatgatgttttatctcgggaaatcaattattgacaaggtattgatattaagttgttttttttcc

SEQ ID NO: 4812 - DNA, 651 bp, Artificial
  Synthetic
caacatttcactaattagccacattcaattgttgagagtgctaactatttaactcttagaaatggctaagtttgcaatatcctccattgcccttcttctcactttgaacattgtcttcttaactatggttagttccactaatgtcccatgcccacccaccccatcaaagggtcattccaagccccaccctaagcctacccctaccccctctaccccctctaccccatccaccccatcaactccatcatcaaagggtaagtgcccaaaggacacacttaagctaaaagtgtgtgccaacttattgaatgacttagtgcaccttggtattggaagtgatccagccaagactccatgttgttctctaattcatggacttgctgatcttgatgctgctgtttgcctttgcactgcaattaaagccaatttattgggaattaacctcaacgtacctctttccctcagtttgttgctcaacaactgtggaaagtatgttcctaaggatttccaatgcgcataaactagctagccaataactttctccctgcagaaaatttccacttcatatatttatttttcagtgtgtttaatttggtattttgtatgcttatagtttgcttatgttttcaaaggaagatatattgtattctaatt

SEQ ID NO: 4813 - DNA, 986 bp, Artificial
  Synthetic
tggtatcaacgcagagtggccattacggccggggatcacaactaactttgacatctcaaactagcaacctctcactttcctcttgataaaccatggctgcttctacaatggctctttcttccccttctttcgctggacaggcagtgaaactctccccatctgcctcagaaatcactggaaatggaagggtctccatgagaaagactgtcgccaaacccgtcgcatctagcagcccatggtacggtccagaccgtgttaagtacttgggcccattctccggtgaggccccaagctacttgaccggtgaattcccaggtgattacgggtgggatactgctggactttcagcagatccagaaacttttgccaagaaccgtgaactcgaggtgatccactgcagatgggctatgcttggtgctcttggatgtgtcttccctgagcttttggctcgtaacggtgtcaagtttggtgaggctgtgtggttcaaggctggatcacaaatctttagtgagggtggacttgactacttgggcaacccaagcttggtccatgcacaaagcatcttggcaatctgggcttgccaagttatcttgatgggagctgttgagggttaccgtgttgctggtgggcctcttggtgaagttgtcgacccactctaccctggtggcagctttgacccattaggccttgctgatgacccagaggcatttgccgagctcaaggtaaaggagatcaagaatggcagacttgccatgttttctatgttcggattctttgttcaggccattgttaccggaaaaggtccattggagaaccttgctgaccaccttgcagaccccgttaacaacaatgcgtgggcctacgccacaaactttgttcccggaaagtgaatcttaaaacattctcaaaattctgattgtttgatggccttgtaaagctgttgtgagttacctgacaatataatgcgattttgtttgtgtttcaag

SEQ ID NO: 4814 - DNA, 795 bp, Artificial
  Synthetic
acaaataagattaaaaatcttacaaatggctacttctgcaattcaacaatctgcatttgctggacagacagctcttaagtcacagaatgagctcgttaggaagattggtagctttaatggtggacgtgccactatgcgacgtacggttagaagtgccccacaaagcatttggtatggagaagacagaccaaagtacttgggaccattctccgagcaaactccatcttacttgactggtgagtttccgggtgattatgggtgggataccgcgggactttcagctgacccagaaacattcgccaggaaccgtgagcttgaggtgatccattgccgttgggccatgcttggtgctttgggttgtgtcttccctgaaatcctttccaagaatggtgttaaatttggtgaggcagtttggttcaaggctggatcccaaatcttctcagaaggcggtcttgactaccttggtaacccaaaccttattcatgcacaaagcattcttgctatttgggcatcccaagttgtgctcatgggcttaattgaaggatacagagttggcggaggcccactgggtgaaggtcttgacaagatctatccgggaggagcttttgacccactagggctcgctgatgatcccgaggcattcgctgagttgaaggtgaaggaaatcaagaacggccgattggctatgttctcaatgtttggatttttcgttcaagccattgtcacaggaaagggaccaattgaaaacctttacgatcatattgctgaccctgttgccaacaacgcatgggcttt

SEQ ID NO: 4815 - DNA, 888 bp, Artificial
  Synthetic
aaaaaagaagcttctttagctcaccaattaaacaaatggccacttctgcaattcaagaatctgcatttgttggccggacagtggctaaatcacaaaatgagcttgttaggaaaattggcagctttggcggaggccgtgctaccatgagacgtactgttaaaagccctcctcaaagcatctggtatggagaagaccgtccaaaatatttgggcccattctctgagcaaactccatcttaccttactggtgaatttcccggtgattacgggtgggatactgctggactctcagctgacccagaaacattcgcaagaaaccgtgaacttgaggtgatccattgccgttgggccatgcttggtgctttgggttgtgtcttccctgaaattctatcaaagaatggtgttaaattcggtgaagctgtttggttcaaggcaggagcccaaatcttttcagaaggtggacttgactacctcggcaacccaaaccttgtccacgcccagagcatccttgccatttgggcttgccaagttgtcctagtgggcttgattgaaggatacagggttggtggaggcccacttggtgaaggtcttgacaagatctatccaggaggtgccttcgacccacttggcctagctgatgatcccgaggcttttgctgagttgaaggttaaggaaatcaagaatggacgattggctatgttttcaatgttcggattctttgttcaggctattgttacaggaaaaggcccaatcgagaacctttacgaccacattaatgacccagtagccaacaatgcttgggcttttgctaccaactttgtacccggaaagtgaaatgttttgtctgtgttatatgtaaaaatttgggctaatgaagttttctgcttgt

SEQ ID NO: 4816 - DNA, 750 bp, Artificial
  Synthetic
tcgactcagcaagagctagacatggcttcgctctcttcctcattggccgggcaagtagtgttgaaggcacagagctcactcgcagcgaaggtgggcaacaatgtattgggcgaggcaagagttagcatgaggaaaactgcctccagagtgtcggtaccggacagcccatggtacggcccagagcgggtcaagtacctaggcccattctccggcgactcgccctcatacttgactggggagttccccggtgactacggctgggacactgctggcctctctgccgaccccgagacctttgcccgcaacagggagctagaggtcatccactgccgatgggccatgttgggcgcactgggctgtgtcttccctgagctcctctcaaagaacggtgtcaagtttggcgaagctgtctggttcaaggctgggtctcagatctttgccgagggtgggcttgactacctgggtaaccctagcctggtccatgcccagtctatccttgccatctgggcttgccaggtcatcttgatgggtgctgttgaaggctaccgtgttgctggtgggccccttggcgatgtaactgaccccatctaccctggtggcagcttcgaccccctagggctagctgatgaccccgaggccttctctgagctgaaagtgaaggagataaagaatggacggctggctatgttctccatgtttggattcttcgtgcaggccatcgtgactggtaagggcccagttgagaacttg

SEQ ID NO: 4817 - DNA, 688 bp, Artificial
  Synthetic
gctttcttcctctccatcttcgtttgtgctccctgatcgagcaatggccaccatgaccgccgccgccaccacattcgccggccagaccgtgctcaaggcccagaacgagttcgtcgcccgcaacgccagcaatggatcccgggtcgcgatgcgcaagaccgccaaggcggcatccagcggcagcccatggtatggccccgaccgcgtcaagtacctcggccccttcagcggcgaggttccctcgtacctcaacggcgagtaccccggcgactacggctgggacactgccgggctgtcggccgacccggagacattcgccaagaacagggagctggaagtgatccactgccggtgggcaatgctgggtgcccttggctgtgtcttccccgagcttctctccaagaacggcatcaagttcggcgaggcagtgtggttcaaggccggttcccagatcttcaaggagggtggactcgactacctgtgcaaccccagcctgatccacgcccaatccattctcgccatctgggcctgccaggtcatcctcatgggcgcagtggagggctaccgcgtcgccggggggccgttgggcgaggtgacggacccgatctacccaggtggcagcttcgaacccctcggattggcagaggatcccgaggcgtttgcggagctcaaggtgaaggagatcaag

SEQ ID NO: 4818 - DNA, 669 bp, Artificial
  Synthetic
cccggcgactacgggtgggacaccgcggggctctccgccgacccggagacgttcgccaagaaccgggagctggaggtgatccactccaggtgggcgatgctcggcgcgctgggctgcgtgttcccggagctcctcgcccgcaacggcgtcaagttcggcgaggcggtgtggttcaaggcggggtcgcagatcttcagcgagggcgggctcgactacctcggcaacccgagcctgatccacgcgcagagcatcctcgccatctgggcggtccaggtggtgctcatgggcgccgtcgaggggtaccgcatcgccggcgggccgctcggcgaggtcgtcgacccgctctaccccggcggcagcttcgacccgctcggcctcgccgacgacccggaggccttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcctacgccaccaacttcgtccccggcaagtgagcgccgccgccgccgtgctgccatggcgacgcatcgccttcagctaagctagctaggttgacgacgatgcgcgtctctgcaggagagtgt

SEQ ID NO: 4819 - DNA, 853 bp, Artificial
  Synthetic
gaattcgttagccatggcagcttctacaatggctctatcttcacccgcattggctggtaaggcacttgttccttccagctctgaagttttcggtgaaggcagaatctccatgagaaaaaccgttgcaaagccaaaaaccgtttcatctagcccatggtacggacctgaccgtgttaagtacttgggaccattctctggtgaatctccatcatacttaaccggtgagtttgccggtgattacggttgggacactgccgggctttctgctgacccagaaaccttcgccaagaaccgtgagctggaggtcattcactgcagatgggctatgttgggagctcttggatgtgtcttccccgaattgttgtctcgcaatggtgttaaatttggtgaagccgtttggttcaaggccggttcacaaattttcagtgaaggtggattggactacttgggtaactcaagcttggttcatgctcagagtattctagctatctgggctacacaagttatcttgatgggtgcagttgaaggttaccgtgttgctggtggtccactaggagaggttgtcgacccactttacccaggtggtagctttgaccctcttggccttgctgacgatccagaggcttttgctgaattgaaggtgaaagaaatcaagaatgggagattggcaatgttctcaatgtttgggttctttgttcaagctattgtgactggtaagggacctttggaaaatttggctgatcacctagctgatcccgttagcaacaatgcttggaactacgccactaacttcgcacccggaaagtgaagaaattttgtttgagattgtcagattagattattggaaactgat

SEQ ID NO: 4820 - DNA, 651 bp, Artificial
  Synthetic
gaattcggggaggcagtgaagctaactccatccattccagaacgcgaaggaagaattaccatgctcttccagaaaaggacaccggcaaaagcagctaaatcatccaaacccgcagtttcatctaacagcccatggtatggtcctgacagagttaagtacttgggacctttctccggtgaggcaccatcatatctcaatggtgaatttcctggtgactatggttgggataccgctgggttatctgctgatcctgaaactttcgccaagaaccgtgagcttgaagtgatccattgcagatgggctatgctcggagctctaggatgcatcttccctgaattgctctcgcgcaatggagttaaattcggtgaagccgtttggttcaaagccggagcacagattttcagcgagggaggattggactacttaggtaactcaagcttagtacatgctcaaagcattttagctatttgggcgacacaagttatcctgatgggtgcagtggaaggttaccgtgtcgccggtggacctcttggtgagattgtcgacccactgtaccccggtggcagcttcgaccctcttggacttgctgatgacccagaggcttttgctgaatggaaggtgaaggagattaagaacggaagattggcgatg

SEQ ID NO: 4821 - DNA, 940 bp, Artificial
  Synthetic
gaattcaggtaagaatggcaaccatggctctgtcttctccatcatttgcaggcaaagctgtgactctaaacccgggaacagaattcccaaccaatgtaagatctggcagcaacagcaagatctcgatgaggaagacatccgcaaagaagcctgctgcttcttcaggaagtccatggtatggtccagaccgtgtcaagtacctcggtcccttctctggtgagtctccatcctacttaactggtgaattcgctggtgactatggctgggacactgctggactatcagctgatccagagacctttgccaagaaccgcgaacttgaggtgatccattcaaggtgggcgatgcttggcgctttgggctgtgtcttccctgaactcctctcgagaaatggagtcaaattcggcgaagcagtttggttcaaagccggctctcagatattcagtgaaggaggacttgactatttgggaaattccagcttggttcatgcacagagcatcctggctatatgggccactcaagtcatccttatgggcgccgtcgaaggctacagagttgctggcggtccactaggtgaggttgttgatcccctttacccaggtggaagcttcgatccattaggcctcgcagaggacccagaggcatttgccgagctaaaggtaaaagaactaaagaacgggcgacttgctatgttctccatgtttgggttcttcgttcaggctattgtgacgggcaaaggtcctctagagaacctggcagaccaccttgccgacccagtgaacaacaatgcctggtcatatgctacgaacttcgctcccgggaagtgagcataagcatagcaaaggcaaaatggagtttgatttcctactttttttctgtaatatcctctgtacattcatttagcttgtaaaattgtgtagaatgtagctgcggttggtct

SEQ ID NO: 4822 - DNA, 953 bp, Artificial
  Synthetic
tttctagtagctgcagtcaagaatactttcttatctcttccttctacaatggcaactgctacaatgtctctctcttccccttcttttgccggaaaggcaataaaactctcaccatcttcctctgaaattactggaaatggaaaagtcaccatgaggaagactgttaccaaggctaagcctgtctcctctggcagcccatggtacggtcctgatcgtgtcaagtatttgggcccattttctggtgagtccccaagttatttgactggtgaatttcctggtgattacggttgggatactgctggactttcagctgatccggaaacctttgccaaaaaccgtgagctagaggttattcactgcagatgggctatgcttggagctcttggttgcgtctttcctgagctcttggcccgtaacggtgtcaagttcggcgaagctgtatggttcaaagctggatcgcagattttcagtgagggtggacttgactacttgggcaacccaagcttggtccacgcgcaaagcatcttggctatttgggcttgccaagttgtgttgatgggagccgtcgagggttatcgtattgctggtggacctcttggtgaggttgttgacccactttatcctggtggtagttttgacccattgggtcttgcagatgacccggaagcttttgctgagcttaaagtaaaggaaatcaagaatggcagacttgctatgttttccatgtttggattctttgttcaagctatcgtcaccggaaagggtccattggagaatcttgcagaccatcttgcagaccccgttaacaataatgcttgggcatatgccacaaacttcgtccctggaaaatgaagttcataaaagagtcttgttctattgccttgttgtttgatggttctgtaaagttattgtgaattacaaaaaaatgacaatatgaaatttgttcggtctcc

SEQ ID NO: 4823 - DNA, 754 bp, Artificial
  Synthetic
cccacgcgtccgccttttttggtttttttttttatcataaagcttcttaaatatttcacacacatacaaagtaatttacaagatatgaaatctgcatcacatttccaagatgcaacaaaccggatacacacaactcgatcacaaattaaactcactttccggggacgaagttggtagcgaaggcccatgcattgttgttgactggatcagccaagtggtccgcgaggttctccaacggtccctttccggtgacaatggcctgaacgaagaatccaaacatagagaacatagccaaccttccgttcttgagctccttcaccttcaactccgcgaaagcctcggggtcagtagcgaggcccaatgggtcgaagctcccacctgggtaaagcaagtcctctgcttctcccaatggaccatctccggcgactctgtagccctcaacagctcccatgaggataacttgagtagcccaaatggctaagatgctctgagcgtggaccaagctcgggttgcccaagtagtccaatcctccgtcgctgaagatctgtgaaccagccttgaaccaaaccgcttctccgaacttcactccgttcctagccaatagctcagggaaaacgcagcctagggctccgagcatggcccatctgctgtggataacttctagctcacggttcctagcgaaggtctcgggatcggcggatagaccggcagtgtcccacccgtaatcaccggggaactctccagtgaggtagct

SEQ ID NO: 4824 - DNA, 805 bp, Artificial
  Synthetic
  misc_feature (606)..(606): The residue at this position can be any nucleotide.
cccacgcgtccgtgtttagaagaagcaatggccacttcagcaatccaacactcttctttcgctggccaaacgaccctaaagccatccaacgatctcctccgcaaaatcggagcctccaatggcggtggccgcatcatcatgcgtcgtaccgtcaagtctactcctcagagcatctggtacggaccagaccgtcccaaatacctaggaccattttccgaaaacacaccatcatacctaaccggagaataccctggagactacggttgggacaccgctggtctctcagccgatccagaaacattcgcaaagaatcgtgagctcgaagtgatccacagtagatgggcaatgttgggagctttaggctgcaccttccctgaaattctctcaaaaaacggagtcaaattcggtgaagccgtgtggttcaaggcaggatctcaaatcttctcagaaggagggcttgactacctcggaaaccctaacttgatccacgcgcaaagcatattagctatatgggcgtgtcaagttgtgctaatgggattcattgaagggtacagaatcggaggtggtcctcttggggaagggcttgacccgctttacccgggcggngccttcgacccgttgaacttagcggaggatccagaagcgttttcagagttgaaagtgaaggagcttaaaaacggtcgtcttgctatgttctcaatgtttggattctttgtccaagccatagttaccggtaaaggtccgatcgaaaatctgttcgatcacattgcagaccctgtggctaacaatgcttgggcttacgcca

SEQ ID NO: 4825 - DNA, 923 bp, Artificial
  Synthetic
gaattcgggcacagctgtagctttgaacgcacaggggaaattcccaaccaatgttagatccagtagcaatggaatgattgtgatgaggaagacatcagcaaagaagcctgctgcttcttcaggaagcccatggtacggtccagaccgtgtcaagtaccttggacccttctctggtgagtctccatcttacctaactggtgagttccctggtgattacggctgggatactgctggactatctgcagacccagagacctttgccaagaacagggaattggaagtgattcattccaggtgggctatgcttggcgctttgggatgtgttttccctgaacttctctctagaaatggagttaattttggagaagcagtctggttcaaagctggttctcagattttcagtgaaggtggacttgactacttgggaaactccagcctggttcatgcacagagcatcttagctatttgggcaacccaagttatccttatgggagctgttgagggatacagagttgccggtggtccactaggtgagatcgtcgacccactttacccaggtggtagctttgaccccttaggacttgcagaggacccagaggcatttgctgagctgaaggtaaaggaacttaagaacgggagacttgctatgttctccatgttcggattcttcgttcaggctattgttaccggcaaaggtcctttagagaatctggcagatcacctgtctgaccctgtgaacaacaatgcttggtcatatgctaccaattttgctccaggaaagtgagaatgtacatgatagtcaactaagatgatttcatttccttcaaaaggcgaaggagatggcttttcttatctttcaacttttgtacatacatccatttagcttgtaaaacaatctggcattcggattaatttgtacttaa

SEQ ID NO: 4826 - DNA, 834 bp, Artificial
  Synthetic
gaattcaagtcatggccacctctgccattcaaaggtctgcattcgctggtcaaactgctttgaagcaacaaaatgagttcatccgcaaagttggcaatgtggaaggtggtcgtatctccatgcgccgcactgtaaaaagcattcagtcaagcatgtggtatggaccagacagacctaagtacttgggaccattctcagaacagaccccatcttacctcactggtgaatttccaggtgactacggttgggacacagccgggttatctgctgacccagagacatttgcaaagaaccgtgaactcgaagtgatccactgcaggtgggctatgttgggtgccctaggatgtgtcttccctgaggttctctcaaagaacggtatcaactttggcgaggcagtatggttcaaagctggatcacagatcttctctgagggaggtttggactaccttggaaaccctaacttggtacatgcccaaagcattcttgcaatctgggctactcaggttgtgctaatggggtttgttgagggatacagagttggtggtggtccacttggagaaggactagacaaactttaccccggtggatcttttgaccctctaggattagctgatgacccagagtcattctctgaattgaaggtaaaggaaatcaagaatggaagacttgctatgttctctatgtttgggtatttcgttcaggctattgttaccggaaagggtccaattgaaaacctttatgaccacgtcgccgatcctgttgcaaataacgcatgggcttacgctactaactttgctcctggaaaatgaatgtaaattttcctagggtgtatca

SEQ ID NO: 4827 - DNA, 767 bp, Artificial
  Synthetic
taccggtcttgcttcagagccagagctagagctagaaatggcctcgttctcttcctccctggctggtcaagtagtgttgaagccacagagctcactcgcagcgaaggtgggcaacaatgtattgggcgaggcaagagttagcatgaggaaaactgcctccagagtgtcggtaccggacagcccatggtacggcccagagcgggttaagtacctaggcccattctccggcgactcgccctcatacttgactggggagttccccggtgactacggctgggacactgctggcctctctgccgaccccgagaccttcgcccgcaacagggagctagaggtcatccactgccgatgggccatgttgggcgcactgggctgtgtcttccctgagctcctctcaaagaacggtgtcaagtttggcgaagctgtctggttcaaggctgggtctcagatctttgccgagggtgggcttgactacctgggtaaccctagcctggtccatgcccagtctatccttgccatctgggcttgccaggtcatcttgatgggtgctgttgaaggctaccgtgttgctggtgggccccttggcgatgtaactgaccccatctaccctggtggcagcttcgaccccctagggctagctgatgaccccgaggccttctctgagctgaaagtgaaggagataaagaatggacggctggctatgttctccatgtttggattcttcgtgcaggccatcgtgactggtaagggcccagttgagaacttgg

SEQ ID NO: 4828 - DNA, 882 bp, Artificial
  Synthetic
gtctgatcaaggaggcagagcccagccatggcttcggtgacagcagcgctttcttcctccctggccgggcaagtagtgttgaagccacagagcgagctagcagcgaaggtgggcaacaatgtgctgggcgaggcaaggattagcatgaggaaaactgcctccagagtgtcggtgccagacagcccatggtacggcccagagcgggtcaagtacctaggcccattctccggcgactctccctcatacttgaatggggagttccccggcgactacggctgggacactgccgggctctctgctgaccccgagacatttgcccgcaacagggagttggaggttatccactgccgctgggccatgttgggcgctctaggctgtgtctttcccgagctcctcgccaagaatggcgtcaagttcggagaagctgtctggttcaaggctgggtcccaaatctttgctgagggtggtcttgactacctaggtaaccctagccttgtccatgcccagtctatccttgccatctgggcttgccaggtcatccttatgggtgctgttgaaggctaccgtgttgctggtggtccccttggtgatgtgactgaccccatctaccctggtggaagctttgacccccttggcctagctgatgaccccgaggccttctctgagctcaaagtgaaggagattaaaaatggtcggttggctatgttctccatgttcggattcttcgtgcaggccatcgtgactggcaagggcccagtcgaaaacttggttgaccaccttgctgaccctgttaacaacaatgcctgggcattcgccaccaactttgtccccgggaattagagtgtagtctgctacttgtttgaatgatcttttcctataatg

SEQ ID NO: 4829 - DNA, 834 bp, Artificial
  Synthetic
cgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggagcccgtggtacggcgccgaccgcgtcctctacctcggcccgctctccggcgagccgccgagctacctcaccggcgagttcccgggcgactacgggtgggacaccgcggggctctccgccgacccggagacgttcgccaagaaccgggagctggaggtgatccactcccggtgggcgatgctgggcgcgctgggctgcgtcttcccggagctcctcgcccggaacggcgtcaagttcggcgaggcggtgtggttcaaggcggggtcgcagatcttcagcgagggcgggctcgactacctcggcaacccgagcctgatccacgcgcagagcatcctcgccatctgggcggtccaggtggtgctcatgggcgccgtcgaggggtaccgcatcgccggcgggccgctcggcgaggtcgtcgacccgctctaccccggcggcgccttcgacccgctcggcctcgccgatgacccggaggccttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcctacgccaccaacttcgtccccggcaagtgagcgccgccgccgccgtgctgccatggcgacgcatcgccttc

SEQ ID NO: 4830 - DNA, 661 bp, Artificial; identical to SEQ ID NO: 1373
  Synthetic

SEQ ID NO: 4831 - DNA, 370 bp, Artificial
  Synthetic
atcctcggagaaaggttgtgttggctgctagctagtaatggggatatgtgtgtttcaaatttttagtagtactattacgttaggtaaagtcactaaaattctcgtttaatcctagttatgatcgaaaagctaataagagggtttatttcttttgttatatacgtagtagtactagtaattttatgttagaagaggagagagggatagctgagaattattgaggattaactacgtacgtttcataagctttctttggatgttaatgatgtgatagaatgagagttgtggtcatcatatgtacaatttaaaattgttatccctttgatgaactgactttctaattaaaagattgaagttctcttctctaagc

SEQ ID NO: 4832 - DNA, 447 bp, Artificial
  Synthetic
tggctgccacttctcttactttatttctagcttttctttgtttctctcaagttatctacttgaatgccgtcccaattacaagaagcgaatgtctggtatacaaatctcaagaacacaaggttttaaagaatatgaatgagagtatggaaatagctgatcgtgccatcataagaagaatggacgccgagctcaatgattatcctggtgccggtgcgaataatcaccacactccaggccacccttaggaaaaggatgacatgcactaatcgagaaatgattctcagagaaaggttgtgttggctgctagctagtaatagatatatatgtgctccaaatgtttagtagtattattgtgttaggtaaagtcactaaatttctcgtttaaatcctagttatgatcgaaaatctaataagaggagttttatctcttttgttataaaaaaaaag

SEQ ID NO: 4833 - DNA, 446 bp, Artificial
  Synthetic
taatatcaaagaaaagaaaggaaaatgacttgtacattttctctcaaattgattgttagtgttgtcactttgctttgtttaattcacttttcctgtgtttgtgatgctaaaaggatgcttagggaggaaaatgagaagttatttaaggtaaaaaaggatgattcggcttctccttctccagattcaacaaacattggtggatttccttttccattcaattttccaccattttctgatggaattccaaatatacccttcaattttccatttcctgactttggatcatcacgaggattgcctgggtttggaattcctgggactggggataataacccatttacttttccaatccctggagatcctaatgttgctgttccacccccagctgtcgccccttaaattcctatacaactttctctctgtgattatcagattaaatttgtgag

SEQ ID NO: 4834 - DNA, 501 bp, Artificial
  Synthetic
ttcttttctatttaatatcaaagaaaagaaaggaaaatgacttgtacattttctctcaaattgattgttagtgttgtcactttgctttgtttaattcacttttcctgtgtttgtgatgctaaaaggatgcttagggaggaaaatgagaagttatttaaggtaaaaaaggatgattcggcttctccttctccagattcaacaaacattggtggatttccttttccattcaattttccaccattttctgatggaattccaaatatacccttcaattttccatttcctgactttggatcatcaggaggattgcctggttttggaattcctggtactggtgataataacccatttacttttccaatccctggagttcctaatgttgctgttccacccccagctgccgccccttaaattcctatacaactttctctctgttattatcagtttaattttgtaagaagaaggaaatcaaggagtaagttttagagccataggctcaaa

SEQ ID NO: 4835 - DNA, 800 bp, Artificial
  Synthetic
tttctattttatatcaaagaaaagaaaggaaaatgacttctacattttctcttaagttgattattagtgttgtcactttgctttgcttaattcagttttccagtatttgtaatgctaaaaggatgcttagggagtctaatataggaaaggaaaatgagaatatatttaaggagaaaaaggatgattcaacaaacattggtggatttccttttccattcaattttccaccattttctgatggaattccaaatatacccttcaattttccatttcctgactttggatcgtcaggaggattgcctggttttggaattcctgggaccggtggtagtggtactggtgataataatccattttcgtttccgatccctggagttcctaatgttgctgttccacccccagctgccgccccttaaattcctatacaagtttctctctgttattagcagtttagccttttggctggggtcatgtaaaacattaaaaaaaaaatgataaagaagaaggaaatcaaggagtaagttttagagccataggctcaaatgaattactatttcttgtccttgtttctgatgtaattaattagaaaatgggaaatgacatggatgtcaagtaaaaaagaactcgtatttttctacccgattaacaagggtatcaccttcaaacttgacttcagcacgcgtgttgtagttcccgtcatctttgaaagatatagtgcgttcctgtacataaccttcgggcatggcactcttgaaaaagtcatgccgtttcatatgatccggataacgggaaaagcattg

SEQ ID NO: 4836 - DNA, 1031 bp, Artificial
  Synthetic
ttattctcttcttttttgacaagaaaatatcatgaatttcctctcatctttggcaaagagcgccggcggtcaatccgccgacgagcctaagaaaaccgccggtgaggaagcttcaactgctgaccttttttccagtgcgaaagtgttagcatattcagctcaaagtcaattcaacaaagattccggcaacgtcgataacaaaaaagtcgctgctgctgctgctgatgttcttgacgctgcacagaaatacggaaagttagacgaaactcaaggtgttggacagtatattgaaaaagccgaaacttatctccaccagtacggttctgctaacccatccaccaccaccgatgccgccgctgcaaaggccccggcagccacaccagataccaaagatacaaaggcacctacaccggctccggcggcagcagatactgatgaaacaaaggcaccggcaccggctcctgcggcagcagatactgaagaaacaaaggcatcggctccggcaccggcggcagcagatactgaggaaacaaaggcaccggcaaccgcagataccgaagaaccaccggcaccggcaccagcaccggcgccggcaccggaagagaagggagaagggtatgggcaatacgtgaaaatggcagaaggatttctgaaatcaggagatgatgaatcagcgaaagcatctgaaggaggatcagattatcttaagatggccggtgacttcttaggcaagaagtgattagtttaatcagattctttttaataatgactgttattttccaagtttttcttctttcattttctttgccactgttcagtgttcattaccggcggcgaacttcttcagtagccgtcgccggagctggtttttacttggcatgtatgtaatttgtgtgtgtgtgtgtgtttttccagtatgatttttagagtgtaatggaatttgtgttatatggataaagtgatcctttatgatgttattggtgtatatgatatggtcgtgattcttaattatattcgtcttccttctattc

SEQ ID NO: 4837 - DNA, 885 bp, Artificial
  Synthetic
agaaccctcgttctgtttctcccctccccccccccctctctctctctctctctctctctctctcttaaccaaaagtgaagcatggctaccgtagaggcagtaaagccctgtgatgatgtacccaaagtagagacctccctccctcctcctcctcctgtcaaagaggaggtaaagccagtagaagctgaaaaagaggcagctcccgaggtttccaagccagtagaagcttccgctgatgtcagaactccaaaggatcgcgatgtggccctagccaaggtgaatacggagaagaagctagctcagatcaaggcttgggaggagaataagaaatctaactccctcaacaaatatcaatgtgaggtttctaaaattgatgcttgggaaaactcaaaaaaggctagtgctgaggcgaagctcaagaaagctgaggaagcgttggagaataagaaggcagcctatgtggaaaggatgaagaatgagattgcagccatccacaagctggcagaggagaaaagggcagctgcagaggccaagaagggtgagaatcttgttcagacagaagaaacagctgccaaatacagggcctcgggtgagataccgaagaagatgatgtgctttggaggttgattcttcatatctctctcacatttaactatggggagggttccttcatatgcaagaatatcacattggggcattatagtcaatgggatatccacagtactagagctattgtttttgatttttcacttagattttgtgtgaatgtatttgggtagactatgatattttgctttgggtatatattcctttccatgaaagacatgattattgcgaaccatcgaatatgctttgttaggtattcaatgaatgattgtatcatgc

SEQ ID NO: 4838 - DNA, 982 bp, Artificial; identical to SEQ ID NO: 4204
  Synthetic

SEQ ID NO: 4839 - DNA, 612 bp, Artificial; identical to SEQ ID NO: 4205
  Synthetic

SEQ ID NO: 4840 - DNA, 501 bp, Artificial; identical to SEQ ID NO: 4203
  Synthetic

SEQ ID NO: 4841 - DNA, 1050 bp, Artificial; identical to SEQ ID NO: 4201
  Synthetic

SEQ ID NO: 4842 - DNA, 908 bp, Artificial; identical to SEQ ID NO: 4198
  Synthetic

SEQ ID NO: 4843 - DNA, 690 bp, Artificial; identical to SEQ ID NO: 4195
  Synthetic

SEQ ID NO: 4844 - DNA, 735 bp, Artificial; identical to SEQ ID NO: 4196
  Synthetic

SEQ ID NO: 4845 - DNA, 680 bp, Artificial; identical to SEQ ID NO: 4197
  Synthetic

SEQ ID NO: 4846 - DNA, 647 bp, Artificial; identical to SEQ ID NO: 4199
  Synthetic

SEQ ID NO: 4847 - DNA, 603 bp, Artificial; identical to SEQ ID NO: 4200
  Synthetic

SEQ ID NO: 4848 - DNA, 941 bp, Artificial; identical to SEQ ID NO: 4202
  Synthetic

SEQ ID NO: 4849 - DNA, 652 bp, Artificial
  Synthetic
gaagtcgacactgccggaaccctagctcctcttaagctcgacctcagctatggcggcggcagtagcagtagcagcctcttcctccctctctctttcccggcactctgccgccacggcaccagtgtcgcccctgcgtagggccctccccccgtcgctgcctttccccgcctcccaagctctcaagctctctacttcgcctttcgtcccagccactctaagatttttgcccttatctgtcaatgcggtttcaactgaggaaaaaacgtcatcatcggttgaagccgaagtaccggccgaggatttagtggccgacttaaaggaaaagtgggataagctggagaacaagtcgacagtcttaacctacggcggaggtgctttgcttgccatttggttctcttcgatagttgtttctgccattaacgcagttcccctgcttccgaagcttatggagtttgtgggccttggatatactggttggtttgtctataggtaccttcttttcaaggaaagtaggaaagagctagtcttggatattgaggatttgaagtcaaagataaccgggtctggaaaggaagattaggcaaggagggacttattctatccatggcaagtaaggtggtttgtctgtgtgtgttttaggtaggataaattt

SEQ ID NO: 4850 - DNA, 248 bp, Artificial
  Synthetic
gtacgaggcactcgcacggagagagagagagagaaaggaagaggagatagatagatagatagatagatagagagagagagaagagccatggccacagcttccatggtttcattgcaggccacagccatggccttccccttttcaccttcaacatctcgccactcccactcccattccccttcacttgccttcacaagaatgcccccccccgccaaccctctcaagccctccctcttcatcccgtcagg

SEQ ID NO: 4851 - DNA, 838 bp, Artificial
  Synthetic
cccacgcgtccggaagaaaatatactactttttggggatatcaagaaaccaaaaaaggagatttgagatagacaagaaagagaggccaaagttaagcaataagcatacaccgccagccccaaaaatctaagcatcggccaaatggcagcagcagcttctacttcaatggcagctactgccgtctttgcttctcgtttcccactttcctccaccaccaaagccgcccctgttcgctgctccgctttgccttaccttccaccccgcctttctgctaccgcgttctctacttccttccagtttgctgaacccaagaaggcttcgctactccaggtcaaagcctcttcatcagaagaatccggtgctgttgataccagtgaattgttgacagatctaaaagaaaagtgggatgctgttgaaaacaagtctacagttatagtatatggaggtggggcaattgttgcagtttggctgtcttcaattgttgttggtgctatcaactcagttcctttgctcccgaaaataatggagctggtgggccttggatacaccgggtggtttgtctaccgctatcttctattcaagtcaagtagaaaagaattggcagaagacattgagcaattgaagaagaagattgcaggaactgaataaatgcacataaatggcaatgccagttcagactgttaaattttctgtacaagaggcatctgctcgtgtgaagtagagtagattttgttgtaattttcttctattctgagcaaatcttcaaataaaataatgtatttaccttacagttcattgtgcttataaattatatagcagtatccactctgtttctatg

SEQ ID NO: 4852 - DNA, 797 bp, Artificial
  Synthetic
cgtgtcttgtccctactattcgacccacgcgtcgcccacgcgtccgcccacgcgtccgcccacgcgtccgcgaagcatttccacaatcgcgtagagagagagagggagacagaagagagagagagatagagagagagagaagcgatggccgccactgccgccctctctctgcatgcacccccttcgttggcgaatgccgccccctccccttcttctctctctctctcctctgcccctttccccagaatggccttctccgctagaccttccctccgcctctcaggtaacctaagattttcacctctgcccatcaaggcaatatcaaccgaggaaaaacaagcatccgtagaaactgaagccccagtagaagatgtattggcggacttgaaggaaaagtgggacaaaattgagaacaagtcaactgtgttcatttatggtggaggtgctctggcttccatttgggtgtcatcaatagtcgtgggagctattaacacagttccattgcttcctaaggtaatggaactggttggactaggctacactgtttggtttgtgtacaggtacctcctttttaaggaaagcaggaaagagctagtctctgatattgaggatatcaaggcaaagatagtcggtgttggtaaggaagagtgaagtaaaagctcagaagatataatgtggtatgtctagggttaaaaagaaaattgttctattgaagttgactcttgttcgcttttgtaacgtttgactacattccatgaaggaggtggaaaatttgagtcagattcctgctgatgtgt

SEQ ID NO: 4853 - DNA, 537 bp, Artificial; identical to SEQ ID NO: 1445
  Synthetic

SEQ ID NO: 4854 - DNA, 656 bp, Artificial
  Synthetic
gcggacgcgtggggggagattttagggcgaattccggggcgcgatggcggcatctatcgcggcattcacggccgctccatcttcttgctgcgcggcggcggtggcgtcggcatcggcctcgtcgtcatcgattcggccgcttccactgaaaagatcggtcctcaagctccacagcgcggcaatgccggggtctttgaagttctctccgctcacagtgatggctacgacctcgtccgaggagaagacaactgggacgacgacgtcgacggaagaagtgagcaagcaagtggaggacattgtgtcggatttgaaggaaaagtgggatggtgtggagaacaagactactgtcttgatttacggtggtggagcgctggtcacgctatggttctcggcaacaatcgttggagctatcaactcggttccattgcttccaaaggtaatggagcttattggactgggatacactggctggttcgtctaccggtatcttctcttcaagtcgagtagaaaggagctgctggaagacgtggaagagctcaagaagaagatcacgggcgcaaccgagtaagaagacgagtagagcgagctgtttgatgatgtccgaaagaagaaactctgacgtgcctggatggaaccaggccggctttgatcgatcg

SEQ ID NO: 4855 - DNA, 643 bp, Artificial
  Synthetic
cccacgcgtccgggccagggaagagccaggtagagccgaagagggtccacgactgacatggccgccacggcgtgctccacggcgcctcttctcggtggagctcgcctccccgccgtcggcgccgccttgccgccgccctccgttctcctcctcccccagcgcaacttcccctctcctctccgcctccatgacgcaccgaggctatctctgctccgggcgagggcgtcgtccgacgacacctcgtcctccgccgcgaccggcgacgagctcatcgaagacctgaaagctaagtgggacgccgttgagaacaagtccaccgtcctcacgtacgccggcggcgccatcatcgccctctggctgtcgtccgtcatcgtcggcgccgtcaactccgtgcctctgcttcccaagttcatggagctcgtcgggctcgggtacacaggctggtttgtgtaccgctacctcctcttcaaggaaagcaggaaggaattggccgacgacgtcgattctttgaagaagaggattgctgggacagagtaaaaaatgccgtcgtctgcaccaattttttggaacgattctttggatcgcacattgcagagaccaaaacccgttgtttagagtactagtgtttggtaccgcgaagctt

SEQ ID NO: 4856 - DNA, 466 bp, Artificial; identical to SEQ ID NO: 1450
  Synthetic

SEQ ID NO: 4857 - DNA, 695 bp, Artificial
  Synthetic
gaattcaagagaaaaacaagtacagagagagtgagtttagtgaagaagtaatggcaactatgtatgcagcagcaagtgcatcttcaatgctagtggcaagacctcgtttgccaaaaaccattagctgctcagcaggtttaccttatcttccacctcgtccatccgtttcttcattctctacctccatcaaaaactacccagtgtcaagcagcagattttcaactctccgagtcaaagctgaggagacatcatctgttgaggttaatgatataattgaagacttaaaagagaagtgggatggacttgaaaacaagtctaccgttcttatctacggtggtggtggtttggttgcactttggctatctacagttgtggttggcgccatcaattcagttcctttgcttccaaagatcatggaactagtaggactcggttacactggatggtttgtctaccgataccttctcttcaagtcaagcagaaaagaactagcaagtgatatcgaatccttgaagaaaaagattgcaggaaccaccgaatagagtcagacataagatggtcttgcagtggggctattttgtttattgtccttagatttatttgagaatcattatatggctcttgtttttttagttcttctggatctcatgtataagagagatttatgtgaaccctgttaatgttaatacttcatt

SEQ ID NO: 4858 - DNA, 652 bp, Artificial; identical to SEQ ID NO: 1447
  Synthetic

SEQ ID NO: 4859 - DNA, 754 bp, Artificial
  Synthetic
cccccagagtgtgagatcgagctgaaagaaaaagagaggccacgaagagagctcagctgctgcctctagcttacttggtgataaggaggaggaggaggaggagggcaccgacatggccgcagccacggcgtacaccgtggcgctcctcggcgccaccggcgcgcgcgtccccgccgctccacgctccgccgcgcttctgccgcgccgcggcggcgtgctccaaccgctgcgcctccaggacgcgccgcgactgtccctgctccgcgtcagggccgcctccgacgacacctccacctcggccagcggcgacgagctcgtcgccgacctcaaggcaaagtgggaggcgatcgaggacaagccgacgttcctcctctacagcggcggcgccgtcgtcgccctctggctcaccaccgtcgtcgtcggcgccatcaactccgtgccgctgctccccaagatcctggagctcgtcggcctcggctacaccggctggttcgtctaccgctacctcctcttcaaggagagcaggaaagagttggcgaccgacatcgagaccttgaagaagaagatcgctggaacggagtaattaagcagctgcatttgtccggggaagttttggggggtgactctctagagtgcttgctgctgcttcctctgtgtgatgtttgtatatctctacgagaatatgttctgctcccatgtgcagtaacagcgtagtgcaaaaactgtatcaaacctactatcagttgtttcttcg

SEQ ID NO: 4860 - DNA, 594 bp, Artificial; identical to SEQ ID NO: 1483
  Synthetic

SEQ ID NO: 4861 - DNA, 911 bp, Artificial
  Synthetic
acaagacttctgtttctgctattgcctcatcgacattaagtgctagtttacctactttgcctcctttgacaacaagtcctgatgtaccggcaatatctattaaacccaatccagtacctagcccagctttgtctcaatctgtatctactgtcatggggccatccagttctaatctagtggagacacccacaccttctctggtaactccggggcagctgctgcaatctggaccaattgatgttccatcaactcaatctacacagacagctcaaaaagatgttgaagtggtacaagtattgcctgcaccatcttcagaaactccagctccggttaaaacagaagctcagccaccaatattaccattaccacctcagacacgtgtgcagaagacaaatggagctccatatcaggcacgttacaacaactacagagggcgcggtggaagaggaatgggggtttcaagaccggtaacaaaattcgaagaggattttgattttatggccatgaatgagaagttcaagaaagacgaagtgtggggtcatcttggcaaaagtaacagagaaggagatggaaatggcagcgacgaagatgtctctttcaatgaatatgatgatgttcttcctaagattgatgtcaaggtggttatttaaattctctttgacctcaattcttatgcatacccttgtccacgtatcttggacctagctttgtatttatgtcagtgttgtcaaaagcgcgcataaagcgcactcaagccccgattcgaggtccaaaacatgttgagcgctttgcttcgctttgtgtgcgctgtagtgtcacatcaaagctctaaagcatacttttcctcgtcaatgagtgtaatcctgaaaaggctacattaaacaattaatatttcactctcgtaaattttt

SEQ ID NO: 4862 - DNA, 793 bp, Artificial
  Synthetic
  misc_feature (736)..(736): The residue at this position can be any nucleotide.
agatccatacacaaatactcgataaaactctccttgtatctgaatctaatcaacttctcagatccaaactccgatcggaacaatgtcctcgactttcagcggcgatgaaactgctcctttcttcggcttcctcggcgccgctgcggctctcgtcttctcctgcatgggagcagcgtacggaacagcaaagagcggtgtaggagtggcgtctatgggagtgatgagaccagagctggtgatgaaatccattgttccggtggttatggctggtgtgttgggtatttatggtctgattattgctgttattattagtactggtattaatcccaaaacaaagtcgtattacctgtttgatggatatgctcatctctcctctggtctcgcttgtggtcttgctggactttctgctggaatggctattggtattgttggtgatgccggtgttagggctaatgcacaacagccaaagctttttgttgggatgatcctcattctcatttttgctgaagctttggctctttatgggcttattgttggaattatattgtcttcacgagctgggcagtccagagcagagtgaagttggcttattaatactattcttactatgatgtatgtgagactcagtaaaccctggcaaaacttgatccttgctaaagtcaaaaagttatctatgtctatgtttgttattcatgttggcacggttgctactggtgctgctatgtgctgtttgtanaaaaataggagtgagtatttattttaataataacttaagaagttttcgtatttgacc

SEQ ID NO: 4863 - DNA, 764 bp, Artificial
  Synthetic
aaggcgtaaggtgggggaatacccgtgctgtggtggtggtgtggtggtggtcactggtcttcttcacaagccatatactactactagttggagtggagagagagagagagggagagagagatctgattcatctctctgataataaatcaaattgatcattgaatcagagagagacaggatggcgacgatggagttcaatggcgatacgacagcccctttctttggattccttggggctgcctttgctctcatcttctcttgcatgggtgctgcatatggaactgcaaaaagtggtgttggagttgcgtccatgggagtgatgaggcccgagctagtaatgaagtctatagtcccagttgttatggctggtgttttgggtatctacggcctcattattgcggttattatcagtactggaataaatcccaagagcaaagcttattacttgtttgatggctatgcccatctctcatcagggttggcttgcggtctttctggtctctccgcagggatggccattggcattgtcggagatgctggtgtaagagctaatgcacaacaaccaaagcttttcgtgggcatgattctgattcttatctttgctgaggctcttgccttgtacggtttgatcgtgggaatcatcttatcgtcccgtgcaggacaatctagggagtgaggctacgcatggttttgtgatctgtttatcgaataatcaagaacgccgggttcacaaggctacccttgaagttttgtgatgccatatg

SEQ ID NO: 4864 - DNA, 680 bp, Artificial
  Synthetic
ttcctctctctctcttcctatcttccttgtttgatctctgatccggcaatggattccaatggagatgccaccgctccttttttcggcttcctcggggccgccttcgctctcatcttctcttgtatgggggctgcatatggaacggcaaagagtggtgttggggtggcctccatgggtgtcatgaagcccgagctagtgatgaagtcgatagttccggtggttatggctggtgttttgggtatctacggcctcatcattgcagtcatcatcagtactggaatcaatcccaaaagtaaatcatactacctctttgatggctatgcccatctctcgtctggattggcttgtggcctttctggtctatccgctggtatggccattggtatcgttggggatgctggagtcagagctaatgcacaacagccaaagctattcgtaggcatgatcctgattcttatctttgctgaggcgcttgcgttgtatggcttgattgtgggcattatcttgtcatcacgcgctggccagtccagggagtgaacttgagactccggtatgcattgaatgatcaaggactcgtctcttttgtgagattagcctaagttttttaatggtagagacgccttatcaagacatgtttcatcatattcaagtgatagcctgtgctagagcatctgctatag

SEQ ID NO: 4865 - DNA, 962 bp, Artificial
  Synthetic
agcacgtgaatatcaccgaattatcaattattgcgtcaacagccaatcaaagagggagagagaacgagggaggagcaaccagaaacagatctattcaactccaaaactcaaaaacactgtatatttacagttctcagatccaaatcctaacgacaatgtcgaccttcgccggagatgaaactgctcctttcttcggcttccttggcgccgccgcggccctcgttttctcctgtatgggggcagcttatggaacagcaaagagtggtgttggagtggcgtcaatgggagtgatgagacctgagttggtgatgaaatctattgtgccagtggttatggctggtgtgttaggtatttatgggttgattattgctgtgatcatcagtactgggattaaccccaaaacgaagtcgtattacctatttgatggctatgctcatctctcctccggtcttgcttgtggtcttgctggcctttctgctggaatggctattggtattgttggtgatgctggtgttagggctaatgcacaacaacctaagcttttcgttgggatgatcctcattctcattttcgctgaagctttggctctttatggacttattgttggcattatcttgtcttcccgagctggccagtctagagctgagtgaagttaactccattcttaccgcgttgtatgtgggacttcagtagaccgaggcagtcaaaagtatctaatacgtgtattgttattcattatcccacagctggaacttaattcagtggtgcaatgttctgtctgtagaaataggaattaaatttttctactcaataataatagcttaaagagctgtgcaatttggtcagtatttatcgtatattttgcggtgaacggtctgaaccattttgtttatgagattcgtgcatgtatcatttcatcttgatttattatgttgattgtgcaacatctatgagtttgagct

SEQ ID NO: 4866 - DNA, 831 bp, Artificial
  Synthetic
accgatcagaaaaattgtcatcaaaattccgatcggtcactggcgaaatctctgataaactgaaaaaaatgtcatcaactttcagcggcgatgaaacggcgcccttcttcggtttcctcggagcagctgcagctctcgttttctcctgtatgggagctgcttatggaacggcgaagagtggggtgggggtagcctcaatgggagtaatgaggccagagcttgtgatgaagtcaattgtgccggttgttatggccggagtgttaggtatttatggtttgattattgcggtaattatcagtacgggaattaaccctaagaccaaatcatattacctttttgatggatatgcgcatctttcttctggtttggcttgtggtctggctggcctttccgctggaatggctattggaattgttggtgatgctggtgttagagcaaatgcacaacaaccaaaactgtttgttggtatgatcctgattctcatctttgccgaggcattggctttatacggactgattgtcggcatcatcctttcttcccgtgctggtcaatctagagcagaatagaaattaatgatttccaggttcatgatggaatcattttgcatcattgtgctggcagtttggtaactgatactggtttagatgcatcttttccttttccgtcacactgtgtagatttggaagctgctttttccctgcatgcaatctagagaacgttctcttaatttttcaattgctatattttgcaataatgaggagcatcttgttggttgaatgctgatacaattgtataatttttgttggaatgcatttattacctcggtatatg

SEQ ID NO: 4867 - DNA, 769 bp, Artificial
  Synthetic
gatcaataagcctttttttccctctcagatcgcgaatcgcttcaataccaattcgaagaaaaaaaaatggcatcgacttttagcggcgatgaaacggcaccgttcttcgggttcctcggtgctgcagctgccttagtcttctcctgtatgggagcagcttatggaacagcgaaaagtggggtaggggtggcatcgatgggagtaatgaggccggaattggtgatgaagtcaattgtgccagttgttatggctggagttttgggtatttatgggttaattatagctgtgattattagtactgggattaatcctaaaacaaagtcgtattatttatttgatggatatgctcacctttcatctggacttgcttgtggtctcgctggcctttctgctggtatggctattggaatcgttggcgatgctggtgttagagctaatgcacagcagccaaagcttttcgttgggatgattctgattcttattttcgctgaagccttggctctttacggccttattgtcggcatcatcctctcttcccgcgctggtcaatctagagcagagtagagaaagatcttctcgtgttccatatttgtgtagtatctttgtgttcttcctcgttggacgagtgagtttggctgttaaatcacattttgttttgatttgggctccaagattatgtatttgtttgcgtggctagagaattggttacgtgcagatcagctgtagattagatctctcaataaggatatcagtttttctgatgctccat

SEQ ID NO: 4868 - DNA, 645 bp, Artificial; identical to SEQ ID NO: 2428
  Synthetic
  misc_feature (597)..(597): The residue at this position can be any nucleotide.

SEQ ID NO: 4869 - DNA, 389 bp, Artificial; identical to SEQ ID NO: 3214
  Synthetic

SEQ ID NO: 4870 - DNA, 631 bp, Artificial; identical to SEQ ID NO: 3216
  Synthetic

SEQ ID NO: 4871 - DNA, 750 bp, Artificial
  Synthetic
gctttgttttctctctctctcttgatccagcttcggaggttggctatggcgacgatggacttcaacggggatacgacggcccccttcttcggatttctgggagcagcctttgccttgatcttctcttgtatgggtgcggcatatggaacagcaaagagtggagttggggttgcttcaatgggtgttatgaggcctgagcttgtgatgaagtccatagttccagtggttatggctggtgtcttgggtatttatggtttgatcatagctgtcattatcagcacaggaatcaaccccaaaagcaaggcatattacttgtttgatggatacgcccatctctcgtcaggcctagcttgtgggctttctggtctttcagctggaatggcaatcgggattgttggtgatgccggtgtcagggcaaatgcacagcagccaaagctttttgttggcatgattctgattcttatttttgcggaggctcttgctttgtacggcttgatcgtcggcattattctctcttctcgtgcaggtcaatcaagggaatgattcttccatgccctttgattctacccattccaactatccaaattatattgtcctatggtaggacatgtttttctttcttttttaactatatttttttcttccggatttgaccaataaggaaacaaagaaggcaactctttgtttcaatgagttttcatctcttagtggatgtatgcttttctttcatgagtgataagaaatatcatt

SEQ ID NO: 4872 - DNA, 662 bp, Artificial
  Synthetic
taagggatagatccgtggatagccggggaggagaatcggatccatggcgtcgaccgatgcgttcagcggcgatgagacggcgcccttcttcggattcatcggcgccgccgcagctctggtcttttcctgcatgggagctgcgtatgggacggcaaagagtggtgttggcgtcgcgtccatgggtgtgatgcggccggagctggtgatgaaatcgatcgtcccggtggtcatggcgggagtgctgggaatttacggcctcatcatcgctgtgatcatcagcaccgggatcaacccaaaggccaagtcgtactacttgttcgacggctatgctcatctatcgtcgggcctggcctgcggtctctccggtctctcggcaggcatggcgatcggcattgtcggtgatgcgggtgtccgggccaatgcacagcaacccaagctttttgtgggaatgatcctcatactcatctttgccgaggctttggctctatacggtctcattgttggaatcattctgtcgtcccgtgccggtcagtccagaggataagcagcagcgttaattttaaggtggtttatatgcgagcattcttcttagcgttttttgttttgcttactgcttgtattattattccttccaacaaataattctcgcttattaaaaaaaa

SEQ ID NO: 4873 - DNA, 857 bp, Artificial; identical to SEQ ID NO: 985
  Synthetic

SEQ ID NO: 4874 - DNA, 602 bp, Artificial; identical to SEQ ID NO: 2427
  Synthetic

SEQ ID NO: 4875 - DNA, 801 bp, Artificial
  Synthetic
aagagatcgatcgatcgatcaaccgatctcgccggagaaggaagaggagcaaagatgtcgtcggtgttcagcggcgatgagacggcgcccttcttcggcttcctcggcgccgcctccgccctcatcttctcatgcatgggtgcggcgtacgggacggcgaagagcggcgtcggcgtggcgtccatgggcgtgatgcgcccggagctcgtgatgaagtccatcgtgcccgtggtcatggctggtgtgctcggtatctacggcctcatcatcgccgtcatcatcagtacagggatcaaccccaaggctaagccgtactacctctttgacggctacgcgcatctgtcgtccgggctcgcctgtggcctcgccggtctcgctgccggaatggccatcggcatcgtcggtgatgctggtgtcagggcaaatgcacagcaaccaaagcttttcgtgggcatgatcctcatcctcattttcgcagaagcgcttgccctgtatggtctcattgtgggcatcatcctctcatcccgtgccggccaatctcgtgcagattaggcactttgcggtaccataccgctgttattccactggctatattcttgagaaaacctgaaacttacttgggagctctagtttaatgtattaaaagatcgatttgtagcttaaggaaggtggcacttccagtcctttttgtttcttttgtggtggttcatgcaaagttttttgggttaggctggatttgctgctcctgagcaaacggatttaatctcattcgtggtgaataaaaaacacgggattgtagct

SEQ ID NO: 4876 - DNA, 996 bp, Artificial
  Synthetic
ctgaatccccaaatcgaagcactcctctcctctcctctcctcagatcggatcgcgagagccccaatcccaccaccgatcgatccattcctgctgctcgcggccaccggagaaggagagagagagagagctcgacctcgtcggcgggtgaaggatcgcagcagcagcagcggcggtagagcaggaggagaggcgaagatgtcgtcggtgttcagcggcgatgagaccgcccccttcttcggcttcctcggcgccgcctccgccctcgtcttctcatgcatgggggcggcgtacgggacggcgaagagcggcgtcggggtggcgtcgatgggggtgatgcgcccggagctcgtgatgaagtccatcgtgcccgtggtcatggctggtgtgctgggtatctacggcctcatcatcgcagtcatcatcagcacggggatcaaccccaaggccaagccctactacctcttcgacggctacgcccacctctcatctggcctcgcctgtggtctcgccggtctcgctgccggaatggccattggcatcgttggtgacgccggagtcagggcgaacgcccagcaaccaaagctgttcgtgggtatgatcctcatcctcatttttgccgaagcgcttgctctctatgggctcatcgtcggcatcatcctgtcatcccgcgctggccaatctcgtgcggattaggcatgtttcaacacgcaaacccttagtgggttcttgtttcatattcctgaaactacaagctgacctctaggggtttattctgtcttagtttctgttcttctgttgggtcatgaacaaaaaaacatctgtatccaagggatgtttgcccttgtggtgccattctttttcgctatggtggtgctggcggcggtctgaatcttatttatgcacagtttttttgggtctggctagacagtgatgtaatctggtgaataagcaaataattcgtaatgcaatgggagcatgagactcttttgttcact

SEQ ID NO: 4877 - DNA, 429 bp, Artificial
  Synthetic
tactggtattaatcccaaaacaaagtcgttttatctgtttgatggatatgcttctctcctctggtctcgcttgtggtcttgctggactttctgctggaatggctattggtattgttggtgatgccggtgttagggctaatgcacaacagccaaagctttttgttgggatgatcctcattctcatttttgctgaagctttggctctttatgggcttattgttggaattatattgtcttcacgagctgggcagtccagagcatagtgaaattggcttattaatactattcttactatgatgtatgtgagactcagtaaaccctggcaaaacttgatccttgctaaagtcaaaaagctatctatgtctatgtttgttattcatgttggcacggttgctactggtgctgctattgtgctgtttgtaaaaaaat

SEQ ID NO: 4878 - DNA, 361 bp, Artificial
  Synthetic
acaaaagccaattctctctctctccctccagattcaaacgatccgatccaaaactttgagatccgagaagatgtctacgttcagcggcgatgaaactgctccgttcttcggcttccttggcgccgccgccgctctcgtcttctcctgtatgggagctgcttatggaacagcaaagagtggtgttggtgtggcttcaatgggagtgatgagacctgagttggctatgaagtctattgtccctgtggttatggctggtgttttgggtatttatggacttattattgctggtatcattagtaccggcatcaatcctaaggctaagtcttactacctatttgacggatacgctcacctttcgtct

SEQ ID NO: 4879 - DNA, 479 bp, Artificial; identical to SEQ ID NO: 1491
  Synthetic

SEQ ID NO: 4880 - DNA, 846 bp, Artificial
  Synthetic
agcgaaaggctacaataatctctctctctctttctctctctctctagaagattttgagaagtatctcagatccaaatcaataacacacttctgagatccaatcagaaacaatgtcttcgactttcagcggcgatgaaactgctcccttcttcggctttctcggcgctgctgcggccttggtcttctcctgtatgggagcagcttatggtacagcaaagagtggcgtaggggtggcatcaatgggtgtgatgaggccggagttggtgatgaagtcaattgtgccggttgttatggctggtgttttgggtatttatggattgattatagctgtgattattagtacagggattaacccgaaaaccaagtcttactatctttttgatggatatgctcacctttcttctggtcttgcttgtggtcttgctggcctttctgctggtatggccattggaatcgttggtgacgctggtgtgagagccaatgcacaacagccaaagctttttgtcgggatgattttgattcttatttttgctgaagccctggctttgtatggccttattgttggaatcatcctctcttctcgtgctggtcagtctagagcagagtagaagaagagaatgctgtgcaccattactgtgaattatctttgtgtttttcatggatgagctagtctggctgctgaattacatttcccttttttctttgggttccaagattctgtacttgatttcttggttagaagaattggttcatatatgcggttctgctgtagattagatccctaaataaagaagtcagttaatctgatgccccaactttcaaggacaatgggttttttgtaaatgc

SEQ ID NO: 4881 - DNA, 988 bp, Artificial
  Synthetic
ccccgccaaatcgaagcactcctctcctctcctctcctcagatcggatcgcgagagccccaatcccaccaccgatcgatccattcctgctgctcgcggccaccggagaaggagagagagagagctcgacctcgtcggcgggtgaaggatcgcagcagcagcagcggcggtagagcaggaggagaggcgaagatgtcgtcggtgttcagcggcgatgagaccgcccccttcttcggcttcctcggcgccgcctccgccctcgtcttctcatgcatgggggcggcgtacgggacggcgaagagcggcgtcggggtggcgtcgatgggggtgatgcgcccggagctcgtgatgaagtccatcgtgcccgtggtcatggctggtgtgctgggtatctacggcctcatcatcgcagtcatcatcagcacggggatcaaccccaaggccaagccctactacctcttcgacggctacgcgcacctctcatctggcctcgcctgtggtctcgccggtctcgctgccggaatggccattggcatcgttggtgacgccggagtcagggcgaacgcccagcaaccaaagctgttcgtgggtatgatcctcatcctcatttttgccgaagcgcttgctctctatgggctcatcgtcggcatcattctgtcatcccgcgctggccaatctcgtgcggattaggcatgtttcaacacgcaaacccttagtgggttcttgtttcatattcctgaaactacaagctgagctctaggggtttattctgtcttagtttctgttcttctgttgggtcatgaacaaaaaaacatctgtatccaagggatgtttgcccttgtggtgccattctttttcgctatggtggtgctggcggcggtctgaatcttatttatgcacagtttttttgggtctggctagacagtgatgtaatctggtgaataagcaaataattcgtaatgcaatgggagcatgagactcttttgttc

SEQ ID NO: 4882 - DNA, 663 bp, Artificial
  Synthetic
ccacgcgtccgaaaaaggaggaggatttgatctacctgttggacgacgaagacgacgacgacgacggcgacaatggccacaatggatttcaacggcgacaccactgcccccttcttcggcttcctgggggcagccttcgctctcattttctcctgtatgggagctgcatatggaacggcaaagagtggagttggagtggcttcaatgggtgtcatgaggcccgagcttgtgatgaagtccatagttccagttgttatggctggtgtcttgggtatttatggcttgatcatagctgtcattatcagcacaggaatcaatcctaaaagcaaagcatactatttgttcgatggatacgcacatctatcatcaggcctggcttgtgggctttctggtctctcagctggaatggccattgggattgttggtgatgctggtgtcagggcaaatgcgcagcaacccaagctctttgtgggcatgattcttatcctcatctttgcagaggctcttgctttgtatggtttgattgttggaattattctctcgtcacgtgctggccaatcgagggaataaggtgtgagctcaaatgaccctgctttccttttataagagttagcctatccttgggtgtactactactggtatcgagactgtttgggcaggttt

SEQ ID NO: 4883 - DNA, 651 bp, Artificial
  Synthetic
atttgtgtggatcgatctgatcgaaggacaacaatggccgactcagacttcaatggcgacaccactgcccccttcttcggcttcttgggagccgcctttgccctcatcttctcttgtatgggtgcggcatatggaacagcaaagagtggagttggggttgcttcaatgggtgttatgaggcctgagcttgtgatgaagtccatagttccagtggttatggctggtgtcttgggtatttatggtttgatcatagctgtcattatcagcacaggaatcaaccccaaaagcaaggcatattacttgtttgatggatacgcccatctctcgtcaggcctagcttgtgggctttctggtctttcagctggaatggcaatcgggattgttggtgatgccggtgtcagggcaaatgcacagcagccaaagctttttgttggcatgattctgattcttatttttgcggaggctcttgctttgtacggcttgatcgtcggcattattctctcttctcgtgcaggtcaatcaagggaatgattcttccatgccctttgattctacccattccaactatccaaattatattgtcctatggtaggacatgtttttctttcttttttaactatatttttttcttccggatttgaccaataagga

SEQ ID NO: 4884 - DNA, 540 bp, Artificial
  Synthetic
tggtatcaacgcagagtggccattaggccggggaaagcaagaatcagcaaatggctgatgagggagtgaaattgctaggacactggccaagcccttttgctctaagggttcattgggctctgaaacttaaaaggggttgattatgattaccaagaagaagatctcccgaacaaaagtcctttgctcctgcagtataatccagttcataaaaagattccagttctggttcataatgggaaacctattgcagaatcattagtcatacttgaatacatcgacgagacttggaagcataatcccctcctccctgaagatccttatgaaagagccaaagcgtttctgggcaaaatttattgatgataagtgtgtgccaggaatctttggtactttctctaaggtcggagaggagcagcagcagatagcaaaagaagctcgcgagaacttgaaacttctggagggcgagctagacaagaaaagcttttttggagatgcgaggataggcttcattgacttgcatctgcttggataatttttgggctc

SEQ ID NO: 4885 - DNA, 623 bp, Artificial; identical to SEQ ID NO: 1926
  Synthetic

SEQ ID NO: 4886 - DNA, 529 bp, Artificial
  Synthetic
agaaattgaagcaatggcaggaggaccaaaggaagaagaagaggcagtgacgcttttgaatatgtggcgcagcccattcgggatgcgggtggtcttcgctttgaagctgaagggggtcaaataccagttgatcgagcagagcctcagcgagaaaagccagcttctgataaaggccaaccctatctacaagaaggtgcctgtcctgatccacaatggaaagcccatttgtgaatcctccatcattgtgcaatacatagacgagacatggccagatcaggaagaagaagccgacctcctccctaaacagcccttagcccgggcccatgctcgcttctgggctgattttattgacaaaaaggtatttggtcttttgccaaggatgataagatcgagtggggaggaaattcaaaaggctagggaggagttaattgggtgccttgaggtgatagaaggggaactgaaagatgaatatccattctttggtgggaagaggatgggttatgcagatgtggttcttgcacccctagtg

SEQ ID NO: 4887 - DNA, 360 bp, Artificial
  Synthetic
cggacgcgtgggtggcgaacctaccgattcttttggattactggccaagtatgtttgggatgagggctagagttgcgttgcgagagaaagttgttgagtttgaatacagagaggaagatttctcgaacaagagccctttactcctccagagtaatcccattcacaagaaaatcccggttctggtccacaacggtaaaccggtatgtgaatctcttaacgttgtccagtacgtcgacgaggcttggcccgagaagaacccgttcttcccttccgatccttacgggagagctcaggctcgattctgggctgatttcgtggacaagaagttcaccgacgcccaattcaaggtatgggggaaga

SEQ ID NO: 4888 - DNA, 661 bp, Artificial
  Synthetic
ggcaattttgtcaagcaatccttaattttcagcgaaaaaaatggcagatgaagttgtccttttggatacctatgtaagcgtgtttgggatgagggttaggtttgcgctggccgagaaaggcataaagtatgaatacaaggagcaggatttgctgaacaaaacccctcttctcctacaaatgaacccaattcacaagaaaattccagtcttgatccacaatggaaaaccaatatgtgaaacccttatcattgttcagtacatagatgaagtttggaaggacaaatcccctttaatgccctccgacccttatgagagagctcaagctaggttttgggctgattatattgacaaaaagatttatgatgctggaaggaaaatttggactacaaaaaaggaggatcaagaagcagcaaataaagaattcatagagtgctggaagttattggaaggggagttaggagacaagccatactttggaggggaaagttttgggtttgtggatatggcccttattccttactattgctggttccctacttatgagaaatttggcaattttagcatagaggcagagtgtcctaagattgtggcatgggctaagaggtgtatgcaaaaggagagtgtctcaaagtctcttgttgaccctggcaaagtctatgat

SEQ ID NO: 4889 - DNA, 390 bp, Artificial
  Synthetic
cccacgcgtccgacgaacacttacaaaaaaaaatctctttgtgagctttagcgatcgtaacaatggcgaacgaggtgattcttcttgatttctggccgagtatgttcgggatgaggacaaggatcgcattgagggagaaaggtgttgaatttgagtacagagaagaagatctaaggaacaagagtcctttgcttctccagatgaatccgattcacaagaagattcctgttctcatccacaatggtaaaccggttaacgaatctatcatccaggttcagtacattgacgaggtctggtctcacaagaaccctatccttccttctgatccttacctgagagctcaagctaggttctgggctgatttcattgacaagaagctgtatgatgctc

SEQ ID NO: 4890 - DNA, 316 bp, Artificial; identical to SEQ ID NO: 1518
  Synthetic

SEQ ID NO: 4891 - DNA, 449 bp, Artificial
  Synthetic
attctgttggattgttggtgcagtatgtatgggatgagggcaagaatagcacttgcagaaaaaggtgtgaagtatgagtacaaagaagaggatttgaacaataaaagcccactgcttttggaaatgaaccctattcacaagaaagtcccagtcttaattcacaatgggaaatcaatttgtgagtcacttgttatagtccaatatattgatgaagtttggaaaggaaatggaccattgattccttctgatccttatgagaaagctcaagcttggttctggtctgactatatgggtaataccgtacatgaatatgcagtgaaaatatgggcatcaaaaggagaataccaagaacaagcatgtaacgactatttatgtcgacttaagttgatagagggagtacttggtgacaagccttattttggaggagaaaactatggatttttggatat

SEQ ID NO: 4892 - DNA, 640 bp, Artificial
  Synthetic
cgttatttattatgcatcttgactacccctcgacccacgcgtccgcggacgcgtgggcggacgcgtgggttctgctagatttctggccaagttcttttggtatgaggataagaattgcattggccttaaagggaatcaaatatgaagcaaaggaggaaaacctatctgataaaagctctttgcttctggagatgaaccctgttcacaaaaagatacctattttgattcacaatagtaaacccatttgtgagtctctaaacattcttgagtacattgatgaagtttggcatgacaaatgtccattacttccttctgatccttacgaaaagtcacgagccagattctgggctgactatattgacaagaagatatatagcacaggaagaagagtgtggagcggtaaaggtgaagatcaagaagaagcaaagaaggaattcctagaaatattcaagactttggaaggagaccttggaaataaaacttactttggtggtgataatttgggttttgtggatgtggctttggttccctttactagttggttttattcttatgagacttttgctaattttagtatagaagcagagtgtccaaagctggtggtatgggcaaaaagatgtatggagaacgagtgtgtctc

SEQ ID NO: 4893 - DNA, 751 bp, Artificial
  Synthetic
cttattcttcttctcacttgcttttcataacaatggcgaacgaagaggtgattctgttggatttctggcctagtatgtttgggatgaggctgaggattgcattagctgaaaaggagataaagtatgagtacaaagaagaggacttgaggaacaaaagccctttgcttttacaaatgaatcctatccacaagaaaatcccagtgttgattcacaatggaaaacccatttgtgagtctattattgcagttgagtacattgaagaagtttggaaagacaaagcccctaatttgcttccttctgatccttatgacagagctcaagctaggttctgggctgactacattgacaagaagttgtatgatgttgggaggaagttatgggcaacaaaaggagaagagcaggaggcagctaagaaagatttcatagaatgcctcaaggtgctggagggagcattaggagacaagccttactttggaggggaaagttttgggtttgtggatattgctctgattggatactacagctggttttatgcctatgagacttttggcaacttcagcacagaggccgagtgcccaaagtttgtggcttgggccaaaaggtgcatgcagagggagagtgttgctaagtctttacctgaccaacctaaagtccttgagtttgtaaaagttcttaggcagaagtttggacttgagtaaacatatgcatatttggttatgcaccataatgtattaaaagaaggcatttcatt

SEQ ID NO: 4894 - DNA, 636 bp, Artificial; identical to SEQ ID NO: 1938
  Synthetic

SEQ ID NO: 4895 - DNA, 658 bp, Artificial; identical to SEQ ID NO: 1521
  Synthetic

SEQ ID NO: 4896 - DNA, 613 bp, Artificial; identical to SEQ ID NO: 1933
  Synthetic

SEQ ID NO: 4897 - DNA, 740 bp, Artificial
  Synthetic
agaggggcattgaagcattagcagcacagcaacaatggcgagcgacagcgtgaaggtcctcaacttctggccgagcatgttcggcttgcgcgtccactacgctctggacctcaaaggtgtgccttacgagtacaaggaggaggacttggcgaacaagagcgaagagctcctcaaggcgaatcccatctacaccaagatcccggttctcatccacaatggcaagcctgtctccgaatccctcatcatccttgactacatcgatagcgtctggcccagttctcccaagctgctcccaaaagatccatacgacaaggccgtggctctcttctgggcggatttcgtcgataaaaaggtgtatgatgctggacattggatcatcagagctactggagagcagcacaagaaagccggcgaggatttcaagtgggcgctgatgaagatcgatgaagctctcggcactgttgctccaggcaagcctttctttggcggtgacgccatgaacattgcggatgtgagccttgcaccgtttatatgctggttcgaggggtaccagaaggtgggaggattccagcttccaggtcccgaggagtggcctcgtctctacaagtggattgatgctgtcaattccgtggaagcgatcaagaaatctactccaagtcgggagaagatggttgagtttatcgagctctataggaaacgaatggcaggggctgcataagagaaatatcactgatcggtga

SEQ ID NO: 4898 - DNA, 685 bp, Artificial; identical to SEQ ID NO: 1519
  Synthetic

SEQ ID NO: 4899 - DNA, 495 bp, Artificial
  Synthetic
gcttccactcaagaagtgacccttctcagcgcttgggcgagccccttcagcatgcgagtcaagttggcactcacactcaaaggcattgagcacgaagatcttccacaggatctcagcaacaagagcaagctgctgctcgactccaatcccatccacaagaagatcccggtcctcatccacaaggggaggccactgcccgagtcagtcaccattgtccagtacattgatgaggtatggcctggaaagtccccgctgctgcctcaggatccattccttcgtgccgagcaccgcttctggaccgacttcatcgacaagaagttcttcgactgcttcatgcgcttcatgcgcactgaggataatgccggaatcaacgaccaattggatgcatctcgagagagcgctagagaagctcggaagcaagaaggggccgttctttggcggcgagagcatgtcgttcctgcacgtgattcttgcccctttcagcgtctggatccc

SEQ ID NO: 4900 - DNA, 605 bp, Artificial
  Synthetic
cgtccgggcttccactcaagaagtgacccttctcagcttttgggcgagccccttcaacatgcgagtcaagttggcactcacactcaaaggcatcgagcatgaagatcttccacaggatctcagcaacaagagcaagctgctgctcgactccaatcccatccacaagaagatcccggtcctcatccacaaggggaggccactgctcgagtcagtcaccattgtccagtacattgacgaggtatggcctggaaagtccccgctgctgcctcaggatccattccttcgtgccgagcaccgcttctgggccgacttcatcgacaagaagttcttcgactgcgtcatgcgcttcacgcgcactgaggataatgccgcaatcaacgaagaatttgtcgagaattggatgcatctcgagagagcgcttgagaagctcggaagcgagaaggggccgttctttggcggcgagagcatgtcgttcctggacgtgattcttggccctttcagcatctggatccctggcgtcggcaatgtcctgggcctcaagacgccccatgagaaatgcccgcgtctacacaagtggtttactggcatctctgagcatcccgatg

SEQ ID NO: 4901 - DNA, 642 bp, Artificial
  Synthetic
aaaagagaaatgggggaagagggagtgaaactcttgagcttctggtcgagtccttatgcttgtcgagtgaggctagctctgggtctcaagggcatcgagtttgagctccaggaggaagatctgtacaatgcaaagagtgagctgctgctgaattccaatcccgttcacaagaagatcccagttctcatccacaatggcaaggccatctgcgagtccgtcaacatcattgagtacgttgacgaagtctgggcggatcgaagccccagttttctccctcgggatgatgcgtttgctcgagctactgctcggttttgggctgatttcgtcgacaaaaagtttatgagcaggacggcggcatcctaccgagcagcctattccagcgcaggtgaggaaaaagagcgagcaaacaatgagatgattcaagatttcatggcactggaggagtttcttgcgagacagggaacagtgtttttcagcggaagcaacacggacatgggctttgttgacattgttgcctctttcatgccatggtggacgcccgcatacgtagagatcgctcggctccgcgtgcccggccccgatacctgtcctcgtctctcccgctggatggatgcagtcaaaggcaatctttttgccagagcc

SEQ ID NO: 4902 - DNA, 591 bp, Artificial
  Synthetic
  misc_feature (406)..(406): The residue at this position can be any nucleotide.
  misc_feature (425)..(425): The residue at this position can be any nucleotide.
caaacatcgacacatcgtgtccatcggaggcacaggagagatggccggcgccggacgcgacgagctgaagctgctcggcatgtgggccagcccgtatgtcagcagagccaagctcgcgctccaactcaagggcgtgagctacgagtacatcgaggaggatctcggcaacaagagcgacctcttcctccgctccaacccggtgcacaagacggtgccggtgctcatccacaacggcaaccccatctgcgagtcgagcatcatcgtgcagtacatcgacgagtccttcccctcctccggcgcctccctcctccccgccgacccctacgaccgcgccgtcgctcgcttctgggccgcctacatcgacgacaagctagcggcgccgtggagaatggtgtacagggtgaanacggaggaggagagggacnagctcatgaagcagacgctcgcggcggtggacgtgctggagggaggactgaaggagtgctccaaggggaagggatgcttcttcggcggcgacagcgtcggctacgtcgacgtcgtgctgggtgggctcgtgtcgtgggtgcacgccagcgacaagctctccggcgc

SEQ ID NO: 4903 - DNA, 651 bp, Artificial; identical to SEQ ID NO: 1929
  Synthetic

SEQ ID NO: 4904 - DNA, 463 bp, Artificial; identical to SEQ ID NO: 1928
  Synthetic

SEQ ID NO: 4905 - DNA, 611 bp, Artificial
  Synthetic
agaacagtctcaaagcttcgcccaagcagagaagaatggccgccggaggaggaggaggagacgagctgaagctgctcggattgtgggcgagcccgtacgtcctgcgagcgaaattcgcgctcagcttcaagggcctgagctacgagaacgtcgaggaggacctccacaacaagagtgagctgctcctgagctccaacccggtgcacaagaaggtgcccgtgctcatccacaacggcaagcccatctgcgagtcgcagatcatcgtggagtacgtcgacgaggcgttccctgacgccggcgagtcccttctcccctccgacccttacgaccgcgccgtcgctcgcttctgggccgcctacatcaatgacaagttcatgccggcgtggcagaaggcgtcgttgggcctcacggaggaggagaaggcggaggcggtgaagcagatgctcgccgcgatcgagaacctggagacggcgttcaaggagttgtccaaggggaagcccttcttcggcggcgacaccgccgggtacctcgacgtcacgctcggcgccgtggtcggctgggcgcgcgccggcgaggtcctgttcgggaggaagctcttcgacgccactagg

SEQ ID NO: 4906 - DNA, 546 bp, Artificial; identical to SEQ ID NO: 1930
  Synthetic

SEQ ID NO: 4907 - DNA, 577 bp, Artificial
  Synthetic
gaattcagaaggtgaggaagactagatcaaaatattttcttgtggtatcagaagaaaggtaaactctaaatttagttatggcaggatcaggaagtgaagaggtgaagatcttaggtggatggccaagtccatttgtgatgaggcctagaattgcactcaacattaaatcagtcaagtacgattttcttgaagagacatttggtagcaaaagtgatcttcttctgaaatcaaatcctgtctacaagaagatgcctgttatgattcatggagataaacccatcaatgaatcaatgaccattgttcagtacattgatgatgtctgggcttctgccggtcattctatcatcccttctgatccttatgatgcttccattgctcgtttctgggcaacctacattgatgacaagttctttccatctttaactggtgttgcaaaaagcaaggatgcagaacaaagaaaagcagccattgaacaagtgattgcagggtttgctctaattgaagaagcttatcagaaaattagcaaaggaaaagactttttcggtggagaaaaaatcggataccttgatattgcatt

SEQ ID NO: 4908 - DNA, 522 bp, Artificial
  Synthetic
gcaagaatggagatgatgaggtgattctattgaactttggcctagtatgttggaatgagagtaaaggttgcactagctgaaaaggagatcaaatatgaatacaaggaagaagattatttactgctaaaagtcctttgctactgaaaataaatccaatccacaaaaaagtcccagttttaattcacaacggtaaaactgtttgtgaatctcttattgcagttcaatatattgatgaggtttggaatgacaaagcttcattgttaccctctgatccttatgagagagcacaagctaggttctgggctgattacactgacaagttgtatgattatgggagaaaaatatgggcaaccaaaagagaagagttagaggaagctaagaaggaattgatagatccactcaagttactagagctagaagtattgggagacaaaccttactttggaggggaaagcttcggttttgtggatattgccttaattggattttactgctggttttatacctatgagtactttgcca

SEQ ID NO: 4909 - DNA, 614 bp, Artificial
  Synthetic
gcgtttttttctctcattcaactgaatctcttctgtttctgatattttgctttgatatatcatggcgggaaatgatgtgaaaatattaggagcatggcctagtccatttgttatgaggccacgtattgctcttaacataaaatctgtggcctatgattttttggaggaacaatttggttctaaaagtgaacttctccttaaatcaaacccagtttacaagaaaatcccagttctaattcatgacggaaatcccatttctgaatctctcattattgttcactatattgatgaagtttggagttctggtccatctattctcccttctgatccttatgatcgtgctattgcccgattttgggccacttatatcgacgataagtggtttccagcaatgcgtggcattgcagcagcccaaggggaggatgcacaaaaggcagcaacggaaccggtggtcgaagggctggtattattggaagatgccttcaagaattgcagcgaaggcaacaagttctttggtggagacaaaatcggatacttggacattgcccttggctgctttttgggctggatgagggtgactgagaagttgaacaatgtaaagctgcttgatgaag

SEQ ID NO: 4910 - DNA, 901 bp, Artificial
  Synthetic
tcaaacatatagaaaagtaccacttaattagtgagatggcagaagtgaagttgcttggtgtttcactcagcccttttagtcgaagagttgaatgggctctgaagattaaaggagtggaatatgaatttatagaagaagacctacaaaacaagagccctctgcttcttgaatcaaaccctgttcacaagaaaataccagtgcttattcacaatggaaagcccatttctgaatctatggtcattcttgaatacattgatgagacttttgaaggcccttctatcttgcctaaagacccctatgaacgagctttagctcgtttctgggctaattttcttgatgttaagtgcataactacaattggaaaagctttatttggaaaaggagaggagtcagacaaagctatagaggaatgtggtgagctgctcaagattcttgataatgagctcaaggacaaaaaattctttgtgggagataactttgggtatgctgatatagctgcaaatttaatggcattttggctgggaattcttgaagaagcctctggagtaattttggtgacaaatgaaaaatttcccaatttttgtgcatggaaagatgagtatattaactgcagccatgttaaggaacatttaccttcaagggatgcattactttcccattttcaacctcgctttcaaactgcagcagctcccaaataaaaatacttgcgggactacactagattgttgttgttgtatttgcaaattgtcatgatttgaattgtggcaataaaacacctactaacgaaaaccagcttttcacagagtagggagtatcttgtgtatttgttttgctgatttgtcaatgattttatgtgattgtaatttcttccagctattacatgataagagtcatgttttcc

SEQ ID NO: 4911 - DNA, 597 bp, Artificial
  Synthetic
ccggaaccaagaaggacactaaagcagtagtctagtctcggggccaagcaagaaccaaaaagcaattaagatcgaactcgagcaaacatgtcgtcgactaacaacagttcaggcgagccgccgccggcggtgcgcgtgctgggcggttgggcgagccccttcacgaaccgcgtggtggtggcgctgaagctgaagggcgtggagcacgagatgttgcaggagacggtggggaagaagagcgagctgctgctccggtccaacccggtgcacaagaagttccccgtgctgctccaccacaggaagcccctccccgagtctctcgtcatcgtcgagtacatcgacgaggtctggccggcctccaatggcggcgccccggccattctccctcgcgacccccacggccgagccgtcgagcggttctgggcacggtacgtcgatgacaaggtaagggcatgtcttgcgtaatttttttttgtctctgaacattttcttcttgtttcttggagaatttttgctcttgctttgatgatatttttgcagattctaccagggcttcgggttttgagaggatcggtggccggagacaaggaccaaacc

SEQ ID NO: 4912 - DNA, 530 bp, Artificial
  Synthetic
gatggccggatcaggagacgagctgatgctgctcggcaaatggccaagcccattcgtcaccagggttgagctcgcgctcggcctcaagggcctcagctacgagtacgtcaagcaggacctcgtcaacaagagcgagctcctcctcgcctccaacccggtgcacaagaagatccccgtgctcatccacaacggcaagccggtctgcgagtcgtcaatcatcgtgcagtacatcgacgaggccttccccgacgccggcgccggcgccgccctgctccccgccgacccctacgagcgcgccgtcgctcgcttctgggtcgcctacgtcgacgacaagttcgttccggcatgggtggcgacgttcagaggcaagacggaggaggagaaggcggaggggatgaagcaactgctcgcggcggtggagacgctggagggagccctgaaggattgctccaaggggaagcccttcttcggcggcgacacagtccggatcgtggacgtcgcgcttggtggcctcatctcgtgggtgaaag

SEQ ID NO: 4913 - DNA, 845 bp, Artificial
  Synthetic
atttagaaccaaagtagtgatatcatatggcaggagtgaagttgcttggtctttggtatagcccttttagtcacagagttgagtgggctctaaagcttaagggcgtgaaatatgaatttgtagaagaagatttacaaaacaagagccctctgcttcttcaatcaaaccctgttcacaagaaaataccagtgcttattcacaatggcaaacccatttctgagtctcttgtcattcttgaatacattgatgagacttttgaaggtccttccattttgcctaaagacccttatgatcgatctttagctcgtttctgggctaagttccttgacgataaggtgactgtaatagtgaatactttccttagcaaaggggaggaacaagaaaaagctaaagagcaagtttgggagatgttgaaagttcttgacaatgagctcaaggataagaagtttcttgtaggtgacaaatttgggtttgctgatattgcagcaaatttggtggcattttggctaggagttttcgaagaagcctctggaattgttttaatgacaagtgaaaaatttccaaatttttctaagtggagagatgagtacactaactgcagccaactcaaggaatctctgcctccaagagatgagttgcttgcttttttccgagctcgttctcaagctgctacaacttctgcttccgctcccaaatgaacagattcgcatacattttatgaagtttcgagattatgtgttagaataaacttttgaatctaggacgaggtctgtagattcaattatgtatacttatgcaaaaggaaaaaaattaaattttatataagattaagctcgttcagaact

SEQ ID NO: 4914 - DNA, 620 bp, Artificial
  Synthetic
aagttagttctctctccctctcttaggcaggtctcaaaggccatttctctctctctctctttctctctctctcgtgggcaggtctcaggggtcatttctctctctctctctcaggaaaactagaataggaggtgaagggcaaatggcaggaggacaagaaggggaggtgaagcttctctcagcttggtttagcccatatggaggaagggtagtgttggccctgcatgtcaaggaggttcccttttcctacattgaggaggatctgggaaagaagagccagctcttgctcgaatccaaccctgtttacgagaaggtgcccgtccttctccatgccggcaaggccatctgcgaatcccgtgtcatcatcgagtatattgacgaggtttggcctggccgtggtagcttgttgccccttgacccttacgcccgttcgcagcatcggttctgggtcgattacatcgacaaaaagctgtcgagcgcatggcggctagtcctgtctacatcaggcgaagaacaaggaaaggcggtggaggagttgattgccttgttgaagcctctggatgaggcattgagggagctatctggaggcaaacccttcttcaatggagatgacatgggct

SEQ ID NO: 4915 - DNA, 614 bp, Artificial
  Synthetic
gagagagagagagagagagagagagagagagtgagtaagggtgagagtgagagtgaaagttgaggtaagaatgggagagggagagggagatgtgaaggtgttgagtagctgttatagcatgtttgggatgcgagtcctaatcgcccttcatgagaagaatgtgccctttcatctcattgaagaggatctctctaacaagagtgaactgttggtgcaatcgaatcccatccataagaagatccccgtgttggttcacaaggggaaaagcatctgtgagtcaagcatcatcgttgaatacataaatgagacatggccttcccctcccctcttcaacccgtccaccccttacaacacttaccttcatcgcttttgggctgattacattgacaagaagttctatgatgcagggtcaaggattgttacaagtgcagctagagaagctcaagagggtgcaattaaggacttggtggagagttacaagatgatggagaaggcattggctgagatgagtggtggggttaagcctttctttggtggagagtcagtggggtttgtagatgttatgttggcaccctttttaccttggttttgctcattcgagatcataggggggt

SEQ ID NO: 4916 - DNA, 566 bp, Artificial
  Synthetic
tgagagttgagggttgagagttgaaaagagcaataatcaacaataatgggtgacctgtgagggagaagaggaggtgaagctgttggggttctggccaagcccatatgtcatgagagtggtctttgccttgaggttaaagggggtcaagtatgaggacatagaggagattccgttcgagaagagccaacgatttggtggaggcaaaccctgtgtacaagaagatacctgtcctcattcacaacgggaaacccatctgtgagtcttccatcatcctgcaatacatcgatgacacatggccacatgaacacacaaacttccttcctaaacagccctttgccagggcttatactcgcttctgggctgatttcattgacaagaaggtattccagccgatgcatactccttgtgtatttctgattcaattcaattcaattcaactagtgcttatcgtcataaaattggtttaatggtgattgcaggtatttgatgcggcttctcgagttctgagatcgagcggggagcaacaagaaaaggcgtgggacgagtatattgggtaccttgaggtt

SEQ ID NO: 4917 - DNA, 345 bp, Artificial
  Synthetic
agcaagcagggttgtaagcaagttaaagtacgaatgggagagggagagggagatgtgaaggtattgaacagtaggtttagcatgtttggcatgcgagttttaatagcccttgaggagaagaatgtgccctatgaactgattgaggaggatctgagaaacaagagcaagctcttggtgcaatcgaatcccatccacaagaagatccccgtcctcctccacaaggggaagcccatatgcgagtcaagcatcatcgttgaatacatcaacgagacatgggcttcccctcccctcttcgatccttccaccccctacaacacttcccttcatcgcttttgggcgaattac

SEQ ID NO: 4918 - DNA, 741 bp, Artificial
  Synthetic
gaaaggggaaaaaaagaggaagaaaggacacgccaagcatggaggagggacaacagagggcgggggaagtgaaggtgttggggaattgggccagcatgttttctatgcgagtctgcattgctctcgatgagaaggccgtcccatacgaagccacaaacgaggacctacgaaacaagggccagctcttgctacaatccaaccctgtccacaagagtgtccccgtcctccttcacaatggcaaccccatctgtgagtcttccatcatcgtcgaatacatcgatcagacatggccttcccctccccttttcaaccccgccaccccttacaaccgagccatgcatcgcttctgggttgatttcattgacaaaaagtttagtgaagcgggtgcaaggatttttagaagtccaccaggagaagttcaagatggtggatcaaaggacttggttgagagttacaagacgctagagaaggcattgaaggagatggcttgtgggaagcctttctttggtggagaatccattgggtttgtggatgttgccttagctccatttatatcttggttcaagacatatgagacactgggaaaattcaagttaccaggggaagaagaatgccctttgttaagtgcatgggtgaagaaagtgtccgaagtgcctagtgtgaaaaaaaccttgccagaccccgacaaggtccttgactttgtctatggcctcagaagcatacttcttcagtagtgaatgc

SEQ ID NO: 4919 - DNA, 502 bp, Artificial
  Synthetic
gagagagagagagagagagagagaaggtgaagatgggggatgaggtgaaggtgttgggctcttgggtgagcggtttcgccttgagagtgtgcattgccctcaacgagaagggcgtcccatacgagctcttagaggaggaccttcaaaacaagagccagctgttgctccaatccaaccccgtccacaagaagatccccgtcctccttcacaatgggaaacccatctctgagtctcccgtcattgtcgaatacatcgatgaaacatggccctcccctccccttttcaacccccccacccctcacaaccgagccttgcatcgcttttgggcagatttcatcgacaaaaagtttgctgatgcaagcttgaggattatacatagcccacctggagaagtacaagatggtggagtgaaggacattgtggaaagttataggattctatagaaggcattggaagatatggcatgtggaaaacctttctttggtggagaatccattgggtt

SEQ ID NO: 4920 - DNA, 673 bp, Artificial
  Synthetic
gagagagagatagagagagagagagagagagcgagagtggtggtagcagcagcagctgagagtgaaagagagagagagagcgtgggggtagcagcagttgagagagagagagagagagagagagtagtagtagtagtaggcaaggaagaaggtatggcaactgtgagtgaaagtgaaagtgaggtgaaggtgctgtccacatgggctagcatgttcggcatgcgcgtgctcatcgccctcaacgagaagggcgtcccctatgagctcacggaggaggaccttcgcaacaagggccagctcttgcttcagtccaatcccatccacaagaaggtacccgtcctcctccaccatgggaaacccatctgtgaatccaacatcattgttcaatacatcgacgaaacgtggccttcccctcccttctttcaaccccctaccccttataaccgtgccatgcacctcttctgggccgacttcgttgacaaaaagttttatgcagagacgggcttgaaggttctaagaagcatgcctggggaagaccgcgacaaagcggtggaggagtttcagaacagctacaaaatgatggaaaaggcattgggggatatggcatgtgggaagcctttctttggtggagactccattggctttcttgacattgcctttgctcctttcgttt

SEQ ID NO: 4921 - DNA, 606 bp, Artificial; identical to SEQ ID NO: 273
  Synthetic

SEQ ID NO: 4922 - DNA, 598 bp, Artificial; identical to SEQ ID NO: 1629
  Synthetic

SEQ ID NO: 4923 - DNA, 277 bp, Artificial; identical to SEQ ID NO: 1630
  Synthetic

SEQ ID NO: 4924 - DNA, 801 bp, Artificial
  Synthetic
tgtatggcgcagagtggccattcggccgggggaagccaagtttgggaaaatcttaaaagaaagaaagaaatgatgacgaatcgccacttcctcttcgctcttcttttcactttctttctttcagctgttgctgcagattcttctgaagagtgtgtatacacattgtatgttaaaactggatcaatcataaagggtggaacagactccaaaatcagcgttacacttggcgatgctaaaggaaaatcagtatatattccagatctagagaaatggggtttaatgggcccaaattatgattactacgaaaggggtaatgtggatatcttcactggtagaggccaatgtttaagcccaccaatttgcaggcttaatgttacttccgatggatcaggtgaccaccacggttggtttcttgattttgttgagactacttttactgggccacacaaaacttgtagccaatccatattctatgtcgaacaatggttggcttctgatgctcctccttatgagttatcagtttctcttgatggttgtaaaaagaagactgggcttcgacatgctcggcgttttgtcgtgggccagcccaatgggtctgcttcagaatagtttggcccgttgaagttctttttgtaattttgtcgttgagatgattttgatgtgtagattgccctgtgttttcccttctctttggttgaaataaatttcttgtttggggcttcctttcttgcttgtttagtcgtcatatctttgacttattggctcttttggcaatttgcaatcttttatgtactcaataag

SEQ ID NO: 4925 - DNA, 799 bp, Artificial
  Synthetic
gtcatcacacaagtgaagaagcagtagcagtagaaggagatagaagggaacctctctctctctctctctctctttgctgatgatgaagacgactatggctgttttcgcccttctctctctcttccttcttctcctccccccttttccttcatcagctgatgatccttgtgtatactcaatctatgtacgaacggggtcaatattcaaggggggaacggattcgaagatgagtgtggagctctacgatgcgaatgggtactacattacgatcaacaatttggaggagtggggggggttaatgggtccagaccacgactactatgagaggggcaatcttgacatctttagtggtttgggggactgcctgaccggacccatctgcgctctcaacctcacctcggacggcacgggggcccaccatgggtggtattgcaactacctggaagttactgccacgggtgcccacatcccttgctcccaacagctctttaccatagagcaatggcttgccactgatacctctccttactccctcactgcccttcgatataattgccctgatgctttgtcctcgcctcgcttccctcgcatgccttccaattcgcaaccgaagaatggtcaactaatgtcccattagtactctatcaccctgcttcgtaataaaaagatagccccttcttgtgtactatggagggaggggggtatctctctcaaggtaccttatttgttgatgtttctcgaggcacctcgcattaatgtatgtgttgtttactatcttgtacgcttgtgtgataaatct

SEQ ID NO: 4926 - DNA, 614 bp, Artificial; identical to SEQ ID NO: 1673
  Synthetic

SEQ ID NO: 4927 - DNA, 629 bp, Artificial; identical to SEQ ID NO: 1672
  Synthetic

SEQ ID NO: 4928 - DNA, 579 bp, Artificial; identical to SEQ ID NO: 1676
  Synthetic

SEQ ID NO: 4929 - DNA, 619 bp, Artificial; identical to SEQ ID NO: 1674
  Synthetic

SEQ ID NO: 4930 - DNA, 374 bp, Artificial
  Synthetic
aaaaaaacaaaatggctcgtcgcgatgttctcctccctttcctcctccttctcgccaccgtctccgccgtagctttcgccgaagatgatccagactgtgtatacacattctacctcagaaccggatcgatctggaaagccggaaccgattcgatcatcagcgcaagaatctacgataaggacggtgactacatcggaatcaaaaaccttcaagcttgggctggattaatgggacctgattacaattacttcgagaggggtaatctcgacattttcagtggaagagcaccgtgtttacctagtccgatctgtgccttaaacctaacctccgatggctccggcgatcaccatggttggtacgttaattacgttgag

SEQ ID NO: 4931 - DNA, 1020 bp, Artificial
  Synthetic
ttttcctctcattttctagagaaagaaacaacaagacgtacagaacgagagttcaagaatctgcaatgggagtggctcgagttaaccaattctggttgcatcttgtcatcctcttctccatctccgttgcttccatttctagcactgtaagtcacccttctctacttctactacgttgacagatttagagtagatgcactggattacgtcgaactcaccgcgttaaaaagctgcccggtgcaataagctcccgtagtggacgggtccggagaagggtcgaactcactgctttacttcttaattaccttatatgtaagaaaagaaacaaatatatatgagtaagaatacaacacattgattctaaattataaatttgtcactgtgtaccataatatttttcattttgcaattgctgaattgatgggaaaatgcaggaactgaattgtgtatacacagcttatgttcggactgggacatactggggatctggaactgactcaaaaatttccttgtctctttatgatgccactggccatggacttagaatcaataacctacaagcctggggcgggcttatgggcccgggttatgactactttgaaatggaccaattggatatgtttacgggccgtggtccatgtttgactgggccaatctgtaaaatgaacttgacttctgatggatcaggtgagcaccacggatggtactgtaactacggggaaatcacgtctacagcagaacacaaacgatgcagccaacaggcgttcaccgtggaggcgtggctcagtgccggtcagtacccagatgggttgaccgccattaaggaacaactgtaagcgtatttccaacgaacaacaaccaattcatgattctgatcaatcttatcatgttgtggatgtaatttaattcgagtttattggacgttgtatgatttacgaaggccatttaggccaaggcctgatatgtactctcacgagtgctacatagttggaatgaaaagttttctttacccatatcttt

SEQ ID NO: 4932 - DNA, 741 bp, Artificial
  Synthetic
gagaggaagaaaaagctcaagagaagacatgggaatagcagctcactccaaccatttctggtcccttctcttcatagtctttttctctttctccatctcctccatttccggatctgatgatgattgcgtgtacacagcttatgtccgaacgagttcaataataaagggtggaacagattcgattatcagtttgagtctctacgatgcaaacgggtatggtcttagaatcaagaaccttgaggcctggggtgggcttatgggctctggttacaactatttcgagaggggaaatttggacattttcagcggacgaggcccatgtttgactgggcctgtctgcaaaatgaatttgacttccgacggaacaggcaaaggccatggatggtactgtaactacgtggaggtcaccgtcaccggagtccataaagcatgcaaccaacagaatttcgaagtggagcagtggctagctactgatgcttcgccgtatgagcttacggctgttagagacaactgtaagaagtccaagtccgatgagaaactgtccatttccgatgtctacggaactcattccactccacctgtttctgtgatttaaatttctagttattgggttttaatgggcctggacccacatttcccttttacccttattactgtgatgtgaaatttatcaggggtaagaatgacatttcatgtgtgtcaatgttgctttcatgttatagtatgagatagaggagtagt

SEQ ID NO: 4933 - DNA, 666 bp, Artificial; identical to SEQ ID NO: 1677
  Synthetic

SEQ ID NO: 4934 - DNA, 648 bp, Artificial
  Synthetic
gaattcacatctaaagtcaacaacaagagcttctcgcttctcctcgtctctgttctcctctcttttgcaatcctctctcaatctgctgatgattgtgtatacacagtatacacaagaacaggatcaatcatcaaaggaggaacggattcaaaaatctcactaagattatacagcaaatacggtaagtacatcgagatcccaaatcttgaatcatggggtggattaatgggtcctggttacgattatttcgaaagaggtaatcttgatatcttcagcggaagaggttattgtctgggttcaccggtttgtgccatgaatctgacttccgatggtactggttccggtcacggatggtatgtgaattatgttgaagttactactaccggtgcacatattaattgtggtcaacagaattttgaagtggaagattggcttgctcttgatagatctccttatagtcttaccgctatcaagaataattgtaatcagaaattatctgatcatgattctcattctgctgatcagtctatgtaaaatttgatctcttgtttgattcggtggtggtctagtatgagtgatcggacggtcgtcattgtgtgttgtaatgttgaaattattttcttgaataaaatgattgagtgagtagtg

SEQ ID NO: 4935 - DNA, 516 bp, Artificial
  Synthetic
agaaagagagagaccagagagagagagagagagagactggtaacaatggcaatggcgttgagagcagcgttccagtgcacgccaagcgcatcatccctttcgtcctcctcctcctcggcatcgcccctcctccgtcggggtgctgctgccgccctgaggtttgcacgctgctcgacccccggtaacgcgggaagcccactctgcagccctcctcccttcagagccgccgctcggtcctggcgcgccctctccctccctgcctcccagctcaccgcctcccctcccacccccgcttacaccatcaaggaggagggtaagcccgagtccctcgacttccgcctcttctacttcagcgatgattccggcaaaaagatctcaccatggcacgacatacctttagaagccaaggatggcatgttcaactgtattatagagattccaaaggaaaccagtgcgaaaatggaagtggccaccgacgaattctacacccctatcaagcaagatactaagaagggc

SEQ ID NO: 4936 - DNA, 635 bp, Artificial
  Synthetic
gtcgctccgccgccgccgccgctgttcactccgcaccaactccgacgatcccccggcgagctctcgacgatggcgacggcggcgacggcgtcggctacggcggccacccgcttcacgcggctggcgggggtcgggctccggcgcacggcccgcctccccacggccgtgcggttccagcgccgggtgctcgccaccaccgcgctcctcaggaccgccgagctccggcccaaggagcagggcctgcccgagacgctcgactaccgcgtgttcctcgtcgacggcgggggccgcaaggttgtcgccgtggcacgacgtgcccctgcgcgcaggcgacggggttgttccacttcgtcgtggagaatcccaaggagagcagcgccaagatgggaggtcgccaccgacgagtcattcacccccatcaagcaggacaccaagaagggcaacctccgatactacccgtacaacattaattggaattatggattatttccccaaacatgggaggacccaactcttgcaaacaccgatgtcgaaggagcatttggggataatgatcctgttgatgttgttgagattggtgaaagacgtgctaacattggagatgttcttaaggtaaaaccgttggcagctttagc

SEQ ID NO: 4937 - DNA, 590 bp, Artificial; identical to SEQ ID NO: 2542
  Synthetic

SEQ ID NO: 4938 - DNA, 549 bp, Artificial
  Synthetic
gccattacggccggggactggaaaatagttgctatttcactagacgatccaagagcttcacttgttaatgatgttgatgatgtagagaaacattttccgggcactctcaccgcaatcagggactggtttagagactataagatacctgatggaaaacctgccaataggtttgctcttggcaacaagccagcaaacaaggattacgctcttaaggtgattacggaaaccaatgaatcttgggcaaagcttgtcaaaagatctatccccgctggtgagctttcacttgtatagatgccaattgatagagcttgagccagctagttttcatgctcgtaacctaaactggacgcggaaaatggccccaggattatgctcttcgcttttgaggtggaagtccattcatattcttaagacagttttttgttaaaaatgttactgtttttctatttcatcatccataattttgttcatgcagtagtgttttcaaattttatttagggtgaaaacaggtgtactgactactgataattgaattgatcgtcattcctc

SEQ ID NO: 4939 - DNA, 583 bp, Artificial; identical to SEQ ID NO: 1694
  Synthetic

SEQ ID NO: 4940 - DNA, 574 bp, Artificial
  Synthetic
cccccgagtctcccgccgccgccgccgggggtcactccgcaccaactccgacgatcccccggcgagctctcgacgatggcgacggcggcgacggcgtcggctacggcggccacccgcttcacgcggctggcgggggtcgggctccggcgcacggcccgcctccccacggccgtgcggttccagcgccgcgtgctcgccaccaccgcgctcctcaggaccgccgagctccggcccaaggagcagggcctgcccgagacgctcgactaccgcgtgttcctcgtcgacggcgggggccgcaaggtgtcgccgtggcacgacgtgcccctgcgcgcaggcgacggggtgttccacttcgtcgtggagatccccaaggagagcagcgccaagatggaggtcgccaccgacgagtcattcacccccatcaagcaggacaccaagaagggcaacctccgatactacccgtacaacattaattggaattatggattatttccccaaacatgggaggacccaactcttgcaaacaccgatgtcgaaggagcatttggggataatgatcctgttgatgttgttg

SEQ ID NO: 4941 - DNA, 621 bp, Artificial
  Synthetic
acttttacagatctatttgactatttcccgctcacagctttggttgaatccgaaattttttgcctccatggtggtttgtctccatctattgaaactcttgataatattcgtaattttgaccgagtccaagaagttccacatgagggggccatgtgtgatcttttgtggtccgatcctgatgatcgatgcggctggggtatttcacccaggggtgctggatatacatttggccaagatatatctgagcagtttaaccacaccaacaacttaaaactaattgcgagagcacaccaactggttatggagggattcaattgggcacatgatcaaaaagtggttaccatatttagtgcccctaattattgctaccgctgtgggaatatggcatccatcttggaagttgacgactgcaatggccatacattcattcagtttgaaccagctcctagaagaggggaaccagatgtaacccgaagaacgccagattacttcttatgatgaagcaacagaaactcggtggttttgctgcagcaggttttgctaaacttgtcctaggaggtctatagttaatactgctgtagtttcacgatactgcgattgcatgaagcatgtaaatcgggc

SEQ ID NO: 4942 - DNA, 673 bp, Artificial
  Synthetic
agatgcgaaaattaacagagtgtatggtttctatgatgaatgtaagaggcgattcaatgttcgactgtggaagattttctgtgattgcttcaactgcttgcctatggcagcactcattgacgataagatactctgcatgcatggtggcctctcacctgaactgaatagcttggatcaaataaaggatatcgagaggcccactgagattcctgactatggtcttttgtgtgatttagtttggtctgatcctagtcctgactcagaagggtggggagagagtgacagaggtgtttcctgcacttttggtgcagataagcttgtagaatttttggagaagaatgatcttgatcttatatgccgcgctcatcaggttgttgaggatggctacgagttctttgcgcaaaggagattagtgacaatcttttcagctccaaactattgtggggaatttgataatgcgggtgctctgttgagcatagatgaaagtttaatgtgttcttttcaaatcttgaagccaaatgatacaggggctccacattcaaggaaaccaacttcaaacaagaccccaaaaactggaaacgcttaacttatattatatcaagctacaaagcataattgttgtcagcccgaagggggtgatctcttttatgtctcggatccaccagggcatggc

SEQ ID NO: 4943 - DNA, 637 bp, Artificial
  Synthetic
gcacgagggtctatgtgtgatctcttgtggtctgatcctgatgatcgttgtggatggggaatatctcctcgtggagctggatacacctttgggcaagatgtctccgaacagtttaatcacactaataatttaaagcttatagcaagggcacaccagctagtaatggaaggcttcaactgggcacatgagcaaaaagtggttacaatattcaagtggcaccgaactattgctatcgctgtggtaatatggcatccattttggaaattggcgataacatgagtcagcatttcattcagtttgatccagctccaagacgaggagaaccggatgtgacaaggaggacccctgactacttcttataatagactcagtcgattttctatgatagttcatctttggtctggataaccaggatggctgggagattggcaaggtatatatttaactgcaattctgtgttgtatcatgaggatgggctagtgcttggctaatagttgggttagctcttaggctaaaggtggttgggttagtgcatattcttcgtttctgcaaagaaggcatcaaggttgtagtggtgtgagtagtgcaatgttcttgcaatctttgttggatcaagtgttttcctcaatttttactt

SEQ ID NO: 4944 - DNA, 589 bp, Artificial; identical to SEQ ID NO: 1733
  Synthetic

SEQ ID NO: 4945 - DNA, 636 bp, Artificial
  Synthetic
ttctacacgctttaccagtttttttatactgtcacaaaggacacgtgtcgtgtaaatgtgctcaccaaaattggtgtttcaaacctgtcaactttattctgcttgatcaatcatcacacacacacacacagagtagaggaagaaggatatgggttcagtagatttggatgatataataaaccgtttaattgaagttcgacatagaccagggaaacaagtccagctatccgaatacgaaatcaggcacctttgtctcaaatctaaagaaattttcttgcaacagcctaatcttcttgagcttgatgcacctatcaagatctgtggggatatccatggccagtattctgatctactgaggctattcgaatatggtggatttcctccaagatccaattacctattcttgggcgattatgtggatcgtgggaagcagagtctggaaacaatatgccttatacttgcatataaaataaaatatcgtgagaactttttccttttgaggggaaatcatgaatgtgcttctgtgaatcgtatatatggattctatgatgagtgtaaacgaaggttcaatgttcgactgtggaagatattcacagattgttttaactgcatgcctgtggcagctctgattgacga

SEQ ID NO: 4946 - DNA, 537 bp, Artificial
  Synthetic
gccccctccacctatctctctcctctctctctcttctctctttctctctctctctctctctctctgtctatctgtctgcagatcgacagagatttagctgttttctgggttaggggaggagaagaaggggtaggtcgagatgagtgtgcctcctggtatcgtggaccgcaatgcgaatctggatgcgcagatcgagcagctcatgaactgcaagcctctctccgagacccaggtgcgagctttatgtgagaaagcggaggaaattttgatggaggagaacaatgtgcagcctgtcaaatgtcctgtcacgatatgtggtgatattcacgggcagtttcatgatcttgcagaactatttcggattggtggaaagtgtccggacactaattatctattcatgggtgactatgtggatcgtggatactactcagtagaaactgttactcttctagtagcactgaaggttcgataccctgaaagaatcaccatacttaggggcaaccatgaaagtcgtcagattactcaagtgtacgggtt

SEQ ID NO: 4947 - DNA, 629 bp, Artificial; identical to SEQ ID NO: 1731
  Synthetic

SEQ ID NO: 4948 - DNA, 605 bp, Artificial
  Synthetic
cacgccttattttggttgctataagcacccccttgccctgccctgccctgcccagccctccccctcccctgccctgccctttgggggatttcgtcacagagagagagagagaggagaaagagagagagagagatggggctacagctggatcagtggatcgagcaggtcaagggcggccagtgcctcctcgaagacgagctcaaacaactctgtgaatacgtgaaggagatactgattgaagagtcaaacgtgcagcctgtgaatagtccagtgactgtctgcggggatattcatggccaatttcatgatttgatgaaactctttcaaacgggtgggcaagtacctgatactagctatatctttatgggtgatttcgtggatcgaggctacaatagcctggaagtcttcacaattttgttattactaaaagcgaggtatccagccaacatgacacttcttaggggtaatcatgaaagcaggcaaatcacacaggtgtatggattttatgatgaatgtcagcggaaatatgggaatccaaatgcgtggcgttattgtactgatgtattcgactacttgacactggctgctattattgatggcagagt

SEQ ID NO: 4949 - DNA, 816 bp, Artificial; identical to SEQ ID NO: 1732
  Synthetic

SEQ ID NO: 4950 - DNA, 771 bp, Artificial
  Synthetic
tccatttttttacggcttattctgatttctgttgcctcatccatctccgtctccgtcgccatcgccaggaggaggaggaggaggcctcgagccccccccctgccacctaactgtaactgtttattatccgtctccgccacctctaatggaccaagccttgctggatgatatcattgcacgcttgttggacgtgcggagcagccggccagggaaactggtgcagctttctgaggcagaaatcaggcagctatgtaccactgccaagactatcttcatggagcagcctaacctgattgagcttgaagcacccatgaagatttgcggtgacattcatggacaatactctgatctattacgtctttttgagtatggtgggtttccaccaaatgccaactatctctttctaggagattatgtggaccgggggaaacaaagccttgaaacaatctgcctactccttgcatacaaaatcaagtatcctgaaaacttcttcttacttaggggaaaccatgagtgcgcttcaataaatagaatatatggcttctacgatgaatgcaaaaggagattcaatgtcaggctgtggaagacatttacagattgtttcaacacattacctgtggcagctctcattgatgaaaaaatattatgtatgcatgggggactatccccggatttgcataaccttgatcagataaagaggctgagccgtccggctgatgttccagatcaaggcttgctctgtgaccttttatgggcagatccggacaaaga

SEQ ID NO: 4951 - DNA, 638 bp, Artificial
  Synthetic
gggacttgcggcaggttgccaaaatcgttcccaaagatccggatgcaaagaagaagattcgggaatgcgagagcgcgatcaagaagttaagattcgaggaggcggtcgccaccgacgagaggcgctcggttgcaggcacgatagatcccagtacttttgtagtagaagactcgtacacaggagcgaggatacaaggagaccaactatacttgaaattcgttaaacagatgatgcaagagttcaaggacgagaaacgtttgcacaaaagatacgcttatcagataatgcggcagaccttggatctgctcactagtctcccgactctcgtcgaaataactatcccagagaatcgccacattacagtatgtggcgacattcacggccagtactatgacctgcttaacatctttgagataaacggcttgccttcgaacgagaatccttacctgtttaacggcgattttgttgatcgagggtctttctccgtcgaagtaatcctgacgttgttcgctttcaagtgcttgtatcctcaagccatgcaccttgcgaggggaaatcacgagagccaaagtatgaacaaagtctatggttttgacggtgaagtcaaggccaagtacttctcagacgtaatgccagag

SEQ ID NO: 4952 - DNA, 583 bp, Artificial
  Synthetic
cccacgcgtccggtgtgcgtagcttagatcgtgtccaagaggttccgcatgagggaccaatgtgtgatcttctatggtctgatccagatgaccgctgtggttggggcatatctcctcgtggtgctggctacacttttgggcaggatatatccgagcaattcaatcacaccaacaatctcaaacttgtagctcgggctcatcaactagttatggaaggatataattgggctcatgaacaaaaagttgttactatattcagtgctccaaattattgttaccgatgtgggaatatggcatccattttggaagttgatgactgcaacagccatacttttattcagttcgaaccagctcctaggagaggtgagcctgacgtgacacggaggacgcccgattatttcctttgagttaatggtgctaccatttgtcaccttgtattgcgaatttgcgatagtcaaatgctggtcagtgatactttgctggactgtgaaacctgcgcataggccaacgaacaataacaagggaacatcagatcccttcgtaaaacttgaccctccattggtcaatgcaagagatgctgcta

SEQ ID NO: 4953 - DNA, 801 bp, Artificial
  Synthetic
tcctctctctctctctctctctctctctctctctccgtctgtagagctgagagaaaatcaaaccaaatcaaatcaagtttgatttcatcccccttttccgctagggtttctgcacaaatttccctccagaatcagtagaaaagaagatcaatcagcaatggatccggtgccatcgagcgcatctcatggaaatcttgacgaacaaattgctcagcttatgcagtgcaaacccttgtctgaacaggaggtaagagggctatgtgagaaagcaaaggagattctaatggaagagagcaacgtgcagcctgtgaaaagccctgtgactatatgtggtgatattcatggtcagttccatgatcttgctgagctttttcgaattggtggaaagtgtcctgacactaattatttgttcatgggagattatgtggatcgtggatactattctgttgaaacagtaacgcttttagtggctctcaaagtgcgatatccccagcgaattacaatcctaaggggtaatcatgagagtcgccagattactcaggtttatgggttttatgatgaatgcctgcggaaatatggtaatgccaatgtgtggaagactttcacagatctgttcgactactttcctctgactgctttggttgagtcagagattttttgcctccatggtggtctgtctccatctattgaaactcttgataatattcgcaattttgaccgtgtacaagaagttccacatgagggtgctatgtgtgatcttttatggtctgatcctgatgatcgatgtggttggggtatctc

SEQ ID NO: 4954 - DNA, 652 bp, Artificial
  Synthetic
gggctcaaggattgcataagaagatcatatccactttgcttaggccgcgaaattggaaagcacctgttaatagaaagttctttctcgattcatatgaagtgggtgagctttgttatgcagctgagcagatcttcatgcatgagcctacagttcttcaattgaaagctcctgtcaaagtttttggtgatcttcatggacagtttggtgatttgatgcggctatttgatgaatatggatttccttcaacagctggagacattacttacattgactatttgtttctgggtgattacgttgatcgaggacagcacagcttggagacaatcactttactcctagctctgaagattgaatatccagagaatgtacatttgataagggggaatcatgaagctgctgatataaatgcactttttggcttccgtattgaatgcatcgagagaatgggagagagtgatgggatctgggcatggacgcgtttcaatcaactttttaactatcttccattggctgccctcgtcgaaaagaaaatcatctgcatgcatggtgggatagggaggtcaattaattcattagagcaaattgagaagatagagaggcctataacaatggatgctggttcaatagtcctaatggatttgctatggtctga

SEQ ID NO: 4955 - DNA, 548 bp, Artificial
  Synthetic
cccgtgatgaatgcttgagaaagtatggaaatgcaaatggagggaaatactttacagacttgtttgattatttgcctctcacagctcttatagaaaaccaggtgttctgccttcacgggggtctctctccatcattggatactttagataacatccgtgctcttgatcgtatacaagaggttcctcatgaaggacccatgtgtgatcttttgtggtctgacccagatgacagatgcgggtggggaatttcaccgagaggagcaggttatacatttgggcaagatatcgctcaacagtttaaccatacaaatggtctatctctcatctcaagggcacatcaacttgtaatggaaggatttaattggtgtcaggacaagaatgttgtgacggtcttcagtgcaccaaactactgttatcgctgtggtaacatggctgcaattcttgagattggcgaaaacatggatcagaacttcctccaatttgatccagctcctcggcaaattgaaccagacacaacacgcaagactcccgactactttttgtaattt

SEQ ID NO: 4956 - DNA, 610 bp, Artificial
  Synthetic
atacaggcgacgcgagcaaccacgcggtcgcagaagaaagagagagagagagatggcggcatgagcacctcctcctggatcgccacctcccccgatcccccgcaaaccctagcgaccgggccccccagcgccacctcccctggggcggcgccctggtgaggagggaggaggaggagggggaggtggggaggggggaggcgactatgccgtcgcacgcggatctggaccggcagatctcgcagctgcgggagtggaagttcctgggggaggcggaggtgagggcgctgtgcgagcaggcgaaggccatcctcatggaggagtggaacgtgcagccggtgcggtgccccgtcacggtctgcggcgacatccacggccagttctacgacctcatcgagctcttccgcatcggcggcgaggcgcccgacaccaactacctcttcatgggcgactacgtcgaccgtggctactactcagtggagactgtctcgttgttggtggctttgaaagtacgctacagagatcgaattacaatattgagaggaaatcatgagagcagacaaatcactcaagtgtacggcttctacgatgaatgcttgagaaagtatggaaa

SEQ ID NO: 4957 - DNA, 685 bp, Artificial
  Synthetic
gaattcaaaggcgatctgagaagaagaagataggggacgagaattgttgtctcgttttaccaccaattcatcgctctctgtcttacttcccactcattaattttagggttaggtttcctcgattgtattgctgaaaagtaattttatttcatttttttttttttggaagaaaatgagtgtggatccggtttcaaccaacactcatggcaacatcgatgagcagatttcacagcttatgcagtgcaagcccttacccgaacaagaggtcaggacattgtgtgagaaggctaaagagatattaatggaagaaagcaatgtacagcctgttaaaagtccagtgacgatatgcggtgacatccatgggcaatttcatgatcttgcagaactttttcgcatcggaggaaagtgtccagataccaattatttgtttatgggagactatgtggatcgtggttattattcagtggaaacagtaactctgctggtcgccctgaaagtgcgatacccgcaaagaattaccattcttagaggaaatcatgaaagtcgccagataacacaagtctatgggttctacgatgaatgtttgcgaaagtacggcaatgcgaacgtgtggaagacttttacggacctatttgactattttccattgacagccttggtggaatcagaaattttttgtttgcat

SEQ ID NO: 4958 - DNA, 622 bp, Artificial
  Synthetic
ccccccccccccgattgaatgaatcaatcaggggataatcttcttataccaagtcgctcacatctacaccctcaaaactcaaaccccatttgcagtaggtaaaaaattgttagagaaaactgaaaaaaatggaccaaaatgtgttagatgatattataagtcggcttcttgaagtaaagggtaaaccagggaaacaagtagtgttaacagaggctgaaatcaaacagctgtgtttgatttctaaagagattttcttgaaacagcctaatttattggaacttgaagcacccatcaagatttgtggtgacattcatggtcaatattctgatcttctgcggctttttgagtatggtggtttgcctcctaaatccaactacttatttttaggggattatgttgatcgcggcaagcagagcctaaagactatatgtcttttacttgcatacaagataaaatatcccgaaaactttttcttgctaaggggaaatcatgaatgtgcttccataaaccgtatatatggattttatgatgaatgtaagagaagatttaatgttagattatggaaaatcttcacagattgcttcaattgtctgccagtggccgctttaatagatgaaaaaat

SEQ ID NO: 4959 - DNA, 533 bp, Artificial
  Synthetic
agcacctctgttttctccgttgggttttgcaatttctgattgagccacgattccgtcagtctcgattaatcgccaacaacagttgagtaaatcggctccatccacattacattccagacaaatctgtacatttgcgaagcaaagccacttaattgcaagtacgaagggcagagcagtagatttagaagagggacgatggatttggaccagtggataacgaaggttaaagaggggcagcatctggctgaggacgagcttcagctcgtctgtgaatacgttaaggatatcctgattgaggaatcaaatgtgcagcctgttaatagtccagttaccgtctgtggggacatacatggccaatttcatgatttaatgaaactcttccacactggaggtcacgtgccagagacaaattacatctttatgggagattttgttgatcgtggatacaatagtcttgaagttttcacgattttgttgctccttaaagcaagatatcctgccaacattactcttttacgtgggaatcacgagag

SEQ ID NO: 4960 - DNA, 653 bp, Artificial; identical to SEQ ID NO: 1724
  Synthetic

SEQ ID NO: 4961 - DNA, 713 bp, Artificial
  Synthetic
atcattcatgatttcaagaaaactatccatattaacccatcaatatcaaatctacaactttttctcttgtaataaacgattctaagagaaaaatacaaacacccttttcttgtttcttccttgaccttttgttatttagtttgttttggattgtgggtatttttagcttgtttttagtgttttcttgaaaccccatcaatatcaaatctacaattttttcttctttctataagaaaatacaaacacccttttgcacccttttcttgtttttccctttcccttttgttgtttttctagtgtttgtggaaaccccaggtcgagaaagaaacaaaggaatggcacaaaataacgagcagcaggtacatgtgcagggattagtagaggcaggggttcttgatgatataataaacagattattggagtttaggaatgcaagaacagtgaggcaggttcagctttcagaagctgagatccgttcactttgtagtgcttcaagggaaatcttccttcagcagcctaatcttcttgaacttgaagcccccatcaagatctgtggtgacattcatggccaatatggtgatcttttgaggctttttgaatacggtggttttcctcccgaggctaattatttgtttttaggggactacgtcgaccgtggcaaacaaagtttggaaactatatgccttctacttgcatacaaaattaaatatcct

SEQ ID NO: 4962 - DNA, 697 bp, Artificial
  Synthetic
gaagacaatccgtatctgttcaatggtgactttgttgatagagggtctttctctctagaggtcatattgacattatttgccttcaagtgcatgtgtccatcagctatataccttgcgagaggaaatcacgaaagcaagagcatgaacaagatatatgggtttgagggcgaggtcagatctaagttaagcgaaacctttgtggaactctttgctgaagtgttctgttgcttgcctttggctcatgtcataaatggggaagtctttgtagttcatggaggccttttcagtgttgatggtgtgaaactttctgatattagagcaatcgatcggttttgtgagccccctgaggaggggttaatgtgtgaattgctatggagtgatccacaacctcagcctggtagaggacctagtaaacgaggtgttggtctttcttttggggcggatataactaaaagattcttgcaggaaaataatttggatttagtggttcgatctcatgaagtgaaggatgaaggttatgagattgagcatgacggcaagctcatcacggtgttttctgctccaaattattgtgaccagatgggtaacaagggtgctttcatacggttcgaggctcccgatatgaagccaaacattgtgacattttcagcagtgccacatcctgatgtcaagccgatggcatatgcgaacaacttcc

SEQ ID NO: 4963 - DNA, 336 bp, Artificial
  Synthetic
ctctgtataaatctctagaaaattctagagaaaaaaatgccgtcgcatggagatctacatcagcaaatcgcacaattgagtgcagtgcaagccgctatcagaagcggaggtgaaaacgctgtgtgatcaagcgagagctatacttgtagaggaatggaatgttcagccggtgaaatgtccggtgactgtttgcggcgatattcatggacagttttacgatctcattgagctctttcggattggcggcaacgctcctgatactaattatctcttcatgggcgattatgttgaccgtggatactattcggtggagacggtcacacttttggttgctct

SEQ ID NO: 4964 - DNA, 1217 bp, Artificial
  Synthetic
gatattattcgtggtttggttgagtttcggaacacaagacctggatcggggaatcaagttcatctcagtgaaggtgaaattcttcagctttgtgctgtctccaaagaaatatttcttcaacagcccaatctgcttgaattggaagctcccatcaagatctgcggtgatattcatgggcagtattcagatctattgaggctttttgagtatggagggttccctcccgaagctaattatttgttcttgggtgattatgttgaccgtggcaagcaaagcttggaaacaatatgtcttcttctagcttacaaaatcaagtaccctgagaacttcttcttgttgagagggaatcatgaatctgcttccattaatcgtatttacggtttctatgatgagtgcaaacgcaggttcaatgtcagactctggaaaatattcaccgattgctttaactgtcttcctgtggccgccttaattgatgacagaatactatgtatgcatggtgggatttccccagagctgaaaagtttggaccagattagaaatattgcacggccgatggatattccggagtctggtttggtatgtgatttactatggtcggatcctagtggagacgtaggctggggcatgaatgatcgtggtgtttcatacacttttggagctgacaaagtcgcagagttcttggagaaacatgacatggcccttatctgtcgtgcccaccaggttgttgaagatgggtatgagttctttgcagaaagacaacttgttacagtattttcagctcccaactattgcggggaatttgacaacgctggcgcaatgatgagcattgatgagagcttaatgtgctcattccagattctaaagccgtcagaaaagaagtcgccttttctgtgacaccgattatccagtgaccaccattgcttcaaattaacaattctacaaaagttgtatactggcaagaggatctagagacggaaactgctcaattgggaccttaatggtactgataatagagcattagacatgtagctgttgacagtgatggcatcgagcagaaggaacaagtcaagtctgtactgtgattttagcatctctcacatctatgtttgtctaaaatgtgtgtgtgtttttagtcttctctctgaataatattagattctcatttgtactctctatttacctaggagaacccaaattcaaaactttttttagtctca

SEQ ID NO: 4965 - DNA, 642 bp, Artificial; identical to SEQ ID NO: 1727
  Synthetic

SEQ ID NO: 4966 - DNA, 625 bp, Artificial; identical to SEQ ID NO: 1725
  Synthetic

SEQ ID NO: 4967 - DNA, 651 bp, Artificial
  Synthetic
agaggcagaggcggcggcgcagcgttctagattgtggagatattcatggccagttttacgacatgaaggagctatttagagtagggggtgattgcccgcagacgaattatttgtttctaggcgattttgttgatcgaggattctactcggtggagacgttcttgttgttgttagctctcaaggttcgttatcccgacaggatcacgcttataagaggaaaccatgaaagccggcaaatcacgcaggtttatggtttctacgacgaatgccttcgaaagtatggatctgttaatgtatggcgctattgcacagacatttttgactacttaaggtttgtcagcattgattgataacaggatatttggtgtgcatggggggctctcccccgcgattaccaccatcgatcagatcaggacaatcgaccgaaagcaagaagttccacacgacggtgcgatgtgcgatctgctgtggtcggaccccgaggacataatcggctgggggatgagcccgagaggcgccggttacttgttcggcggcaacgttgcaacggcctttaatcacgcaaacaagactgagattatctgccgagcacaccagctggtcatggaaggctttaagtggatgttcagaagcaggtggtgacagtgtggt

SEQ ID NO: 4968 - DNA, 595 bp, Artificial
  Synthetic
aacgaaggaaaaagcttttatgcaaaatcaactttggtgttgtgtataagctacgcatagctccgatccgaaccgatctgaatccgcaaagaagaagactagtcgtcgctagtgtcgctgctgctgtggtttttgttgatgttgtagtagtagtcgtcgccatgtcttgtgttctcttcacttgcctgctcccttcttgtccgccggcttgaggatctggaaagaacacatgagcgtatcgtccacgctcatcatcgctcctgcgttgtcaaattcgccgcagtagttcggggccgagaatattgttacaagctgcctcttggcaaagaactcgtagccgtcctccactacctggtgagctcggcacacgagatccaagtcatgcttttgtagaaaatccgctaccacgtccgctccaaatgtatacgagacgccacggtcgttgcttccccagcctgtcacgtccttgtccggatcggcccagagaagatcacataagagcccggtgtcgggaacgtccgtgggccgggagatcttcctgatcatgtccaagctcttcatgtccggggagaggcccccgtgcatgcacagtatc

SEQ ID NO: 4969 - DNA, 698 bp, Artificial
  Synthetic
gagtagagaagagtttagaaatagaggtataggcgacacaggcccggcccgatccgagggctccctggatgcgcatcggacggcgtcgcagccactgccccgccccgccccgccccgcccagatcccttccagggttagacgattgtattgtttagggttttgtgcattgctaggatgaacgtggcaccgccagcagcaaatggctacggtcagctggacgcacagatcgagcagctgatgcagtgcaagccgctggtagaacaggaggtgcagtccttgtgcgagaaggccaaagaaattttgatggaggaaaataatgtgcagccagtaaagtgtccggtcaccatttgtggcgacatacacggccagttccacgaccttgcggagctcttcagaatcggtggcaagtgtccagataccaactacttgtttatgggggactatgtggaccgaggatactactctgttgagaccgcaacccttttggtcgcgttgaaggttcggtatcccgaccgaatcaccattctacgagggaatcacgaaagccgccagatcacgcaagtttacggtttttatgacgagtgcttgcgaaagtatggaaatgcaaacgtttggaagatcttcaccgatctgtttgactattttcctttgacggccttggtagagtcggagatattctgcttgcacggagggcttt

SEQ ID NO: 4970 - DNA, 527 bp, Artificial; identical to SEQ ID NO: 1722
  Synthetic

SEQ ID NO: 4971 - DNA, 614 bp, Artificial
  Synthetic
ggctatggcggcgcatcgcgacgagggctggttcgctatcgatcgagaggagggatgcgcggtggtgcccggcatctagatgtggcgacgccgcgattcttcttcttcttcttgtcccagcttctccgggcgtggagattttcggatttccggcctcaagcaactggagctagggcgcattggctgtgggtgatctaccgccggggcagggttgcacggatctgattgttccagcagcgctagggtttgtggattttggggagatttcttctccaaatcgtcgtcttcttggatcgatcgatccctcttgcttcgtccatccgccatgccttcccacggtgatcttgatcggcagatcgagcagctatgggagtgtaagccgctctcggagatggaggtgaagaatctgtgcgagcaagccagggccatcctcgtcgaggaatggaacgtccagccggtcaagtgcccggtgacggtgtgcggcgacatccacggccagttccacgatctgatcgagctctttcggatcggcggcaaggcgcccgacacgaattatctcttcatgggcgactatgtcgatcgcgggtactactctgtggagactgtgacgctgc

SEQ ID NO: 4972 - DNA, 582 bp, Artificial
  Synthetic
ggagaagaggcagaggaatggcgcagtgagtgagcatcgatcgatcgatcgcggggcggcggcggccatgtccgacctggaccggcagatcgagcagctcaagcgatgcgagccgctcaaggagtcggaggtcaaggcgctgtgcctcaaggccatggagatcctcgtcgaggagagcaatgtccagagagtagactctccagtcacgatttgtggagatattcatggccagttttacgacatgaaggagctatttagagtagggggtgattgcccgcagacgaattatttgtttctaggcgattttgttgatcgaggattctactcggtggagacgttcttgttgttgttagctctcaaggatcacgcttataagaggaaaccatgaaagccggcaaatcacgcaggtttatggtttctacgacgaatgccttcgaaagtatggatctgttaatgtatggcgctattgcacagacatttttgactacttaagtttgtcagcattgattgataacaggatatttggtgtgcatggggggctctcccccgcaatcaccaccatcgatcagatcaggacaatcg

SEQ ID NO: 4973 - DNA, 591 bp, Artificial; identical to SEQ ID NO: 1735
  Synthetic

SEQ ID NO: 4974 - DNA, 541 bp, Artificial; identical to SEQ ID NO: 1736
  Synthetic

SEQ ID NO: 4975 - DNA, 739 bp, Artificial; identical to SEQ ID NO: 1730
  Synthetic

SEQ ID NO: 4976 - DNA, 617 bp, Artificial
  Synthetic
ggagaactggagctctctctctctctctctctctctctctctctatatatatatatatatatatataaaggtctgcattaaggtctaatttacaccgatctgcgatcattgaggggaataaggagggaagggttggattgagaatggagaacaacggggttgtgacagtgtacggcaatggggccatatctgagccgaagaaggcttcctatgcggtcaaggttggcttagcccagatgcttagggggggcgtcatcatggatgttgttaatgctgaccaagcgcggatcgcagaggaggctggagcagccgctgttatggcattggagcgtgtccctgcagacatccgtgcacaaggcggtgtcgctcggatgagcgacccggagctcatcaaggagatcaaagctgctgtcacaatcccagtaatggccaaggcccggatcggccattttgtggaggcccagatcttggaagccattggaattgactatgttgatgagagcgaagttctaacccccgctgatgacgcccaccatataaacaagcacaacttccgggtcccgttcgtgtgtggttgccgcggtcttggcgaggccctccgtagaatcgccgagggt

SEQ ID NO: 4977 - DNA, 1358 bp, Artificial
  Synthetic
gccctcatatattgaaggcatcgccaacccgatcacaaaccttcttgtccagacttgcaaaccactcaatcgattccttgataccccttgggacaactctacttgttctctccaaacttacccctccaaataccatcatcaccatcaccatgaccaacgacgtctctaccaacggctcttctgccgctcctgcgaccaccttcgccctcaaggctggtctcgcccagatgctcaagggcggcgtcatcatggacgtcaccaacgccgagcaggcccgcatcgccgaagaagctggtgcctgcgccgtcatggccctcgagcgagttcccgccgatatccgcaaggacggcggcgtcgcccgcatgtccgacccggctatgatcaaggagatccaggacgccgtcaccatccccgtcatggcaaaggcccgtatcggccacttcgtcgagtgccagatcctcgaggctcttggtgtcgactacattgacgagtccgaggtcctgacgcccgccgacgacgagagccacgtcgagaagagcccctttggcgtgccctttgtctgcggctgccgcaacctgggcgaggccctgcgccgtattgccgagggcgctgccatgatccgaacaaagggcgaggccggcaccggtgacgttgtcgaggccgtccgccacatgaagactgtcaacagggacattgcgcaggccaaggctgctcttgccgagggcggtattgttcgtctccgcgagcttgctcgtaagctcgaggttgacgtcgagctgctgcgccagactgctgagctgggccgtctccctgttgtcaacttcgccgccggtggtgttgccactcctgctgatgctgctctcatgatgcagcttggctgtgacggcgtcttcgtcggcagcggcatcttcaagtctggcgaccctgccaagcgagccaaggccattgtccgcgctgtcactcacttccgtgaccccaaggtccttgctgagtgcagcaccggactgggcgaggccatggttggcatcaactgcgacgctatgaagcccgaggagaagcttgccggccgtggctggtaaataccccctattatatgattttagcaagggaaagcaagaggaggaaaagcaaaagtgtggtatataaaaacggaagagacagaggaggaaaaaatgactggcacagagcctcaaaatgtatctattctactgttggatttgggcgttgtggactttttatcgctttgggtggcacttagcatgctgaacatcaaaattctgaagatgccgtcaggatatgcaacctattgaggattatacagcatagcacgaaatctacatttacttgtttgcacttga

SEQ ID NO: 4978 - DNA, 274 bp, Artificial
  Synthetic
ctcttgaacgtgttcccgccgatattcgagctcaaggcggtgttgctcgaatgagcgatccagagatgatcaaagaaatcaaaaacgccgtgacgattccggtgatggcgaaagctagaattggtcatttcgttgaagctcagatcctggaagcaatcggagttgattacgtcgacgagagtgaagttctcactctcgccgacgaagataatcacatcaacaaacataatttcaaaatcccttttgtttgtcgatgtaggaatctcggtgaagc

SEQ ID NO: 4979 - DNA, 686 bp, Artificial
  Synthetic
cccgatccctagccactttactcctattctcctccaccaccttttcatttcctatctcctcctcttttctcttctgctcagttcctctctttcacatacacactcacaaaaaaaattcgattatggccggaagcggtgtggtaacactttacggaaatggtgcactcaccgagactacaaagcaatcccctttctcagtgaaagtgggtctcgctcagatgcttcgcggcggcgttatcatggacgtcgtcaatcccgagcaggcccgtatagccgaggaggcaggcgcgtgtgccgtcatggcccttgagcgcgtccccgctgatatacgcgctcagggcggcgtagcccgcatgtcggatccccagcttatcaaagaaatcaaacaggctgttaccatccccgttatggccaaggcccgtatcggtcacttcgtcgaggcccaaatcctcgaggctatcggaatcgattacgtggatgaatcagaagtcctcactctcgccgacgatgagaaccacatcaacaagcacaatttccgcattccttttgtctgtggctgccgtaacctcggcgaagccctccgccgtatcagggagggagccgccatgatacgcaccaagggggaagccggtaccggcaacatcatcgaagccgtccgtcacgtgcgttccgtgatgggtgatatc

SEQ ID NO: 4980 - DNA, 647 bp, Artificial
  Synthetic
ttccattgctttaatcaggatcgcggaggcggaggaagaaagagtagcggcgatggatgccaacggcgtggtggccgtgtacggcaacggcgccatagcggagcccaagaaggcgtcatacgcggtcaaggtcggtctcgcccagatgctccgcggcggcgtcatcatggacgtggtcaacgccgagcaggcccgcatcgccgaggaggccggcgcggtggcggtcatggccctggagcgcgtcccggcggacatccgcgcccagggtggcgtcgcacggatgagcgacccgggcatgatcaaggacatcaagaaggcggtcaccattccggtcatggcaaaagcccgcattgggcattttgtcgaggggcaggtgctcgagtccatcggcgtcgacttcgtggacgagtccgaggtgctcacccccgccgacgacgccaaccacatcaacaagcacaacttccacgtcccgttcgtgtgcggctgccgcaacctgggcgaggcgctgcggcggatcaccgagggcgcggtcatgatccggacccaagggcgcacgcggcaccgggaacgtgatcgaggcggtgcgccacgtccggtcgctcatgggggacatccggcggctgcgcagcctggacgaggacgaggtg

SEQ ID NO: 4981 - DNA, 651 bp, Artificial
  Synthetic
tgttattaggcctaaacctaccctctgttcttttcaggtaacttagcggtttcttttccctgtgtttggtgttcgtagtcaaatctggctatggctggtaatggcgtagtggccatctatggcaatagtagctccatcgcagaccccaagaagtcctcctatggtgtcaaggtcggccttgcccaaatgctccgcggtggtgtcatcatggacgtcattaacgttgaacaggcccgtatcgccgaagaagctggtgccgtcgctgtcatggcccttgagcgcgtccctgctgatatccgtgctgaaggcggcgtcgcccgtatgagtgaccctggcttgatcaaggagatcaaggctgccgtcactatccctgtcatggccaaggcccgcatcggccactttgttgaggcccagatcctcgaggccatcggtgttgactacattgatgagagcgaggtcctcacgccggccgacgatgctcatcacgtcaacaagcacaacttccgtgtcccgtttgtctgtggctgccgggacctcggcgaagcactccgccgcattgcggagggcgctgccatgatccgcaccaagggggaagccggcactggcgacatcgttgaggcggtccgccacgtgcgttctgtaggtggagaa

SEQ ID NO: 4982 - DNA, 713 bp, Artificial; identical to SEQ ID NO: 2591
  Synthetic

SEQ ID NO: 4983 - DNA, 1803 bp, Artificial
  Synthetic
aattttctctctttcatttcttcctctcaattttcttcttctgccacttttaattttcctctaatggatcccgtttcagtttggggcaacgaacctctctccgccgtagatcccgaaatccatgacctaatcgaaaaggaaaaacgccgccaaagccgcggaatcgaactaatcgcatcggaaaatttcacatcattcgccgtaattgaagctctcggcagtgctttaaccaacaaatactccgaaggaattcccggtaaccgttactacggtggaaatgaatacattgacataatcgaaaacttgaccagaagccgtgctttaacggcttttcatttagatccaacaaaatggggagtaaatgttcaaccctattctggtagcccagcgaatttcgctgcgtatacagctgttttgaatccacatgataggattatgggattggatttaccatctggtggacatttaactcatggttattatacttctggagggaagaaaatttctgctacttcgatttattttgagagtttgccttataaggtgaattcaacaaatggatatattgattatgataggttggaagagaaggctttggattttaggcctaaattgattatttgtggaggtagtgcttatcctagagattgggattataagagatttagagaaattgctgataaatgtggagcccttttgctttgtgatatggctcacattagtggccttgttgctgctcaggaagccgccgatccctttgaatattgtgacttggtcactaccaccactcacaagagcttgaggggtccaagggccggtatgatcttctaccgcaagggccctaagccaccaaagaagggacagcctgaggatgcggtctatgactttgaagacaagattaactttgctgttttcccctcgctccagggtggtcctcacaaccaccaaattggtgctcttgctgttgccctaaaacaggccgcaactcctggttttaaggcttatgctaagcaagttaaggccaatgcagttgctctcggcaactacctcatgagcaaaggatacaaactcgtaactggtgggactgagaaccatcttgtcctttgggatcttagacctcttggtttgactggtaacaaggttgagaagctttgtgaccttgccaacattactgttaacaaaaatgctgtttttggcgacagcagtgctttggccccaggaggtgttcgtattggtactcctgcaatgacatcaaggggattggttgagaaggacttcgagcagattgccgagttcctccacagggctgttaccatcaccttgaacatccagaaggagtacggaaagcttttgaaggatttcaacaagggtcttgtcaataacaaggaaattgaagaactcaaggctgacgtcgagaaattctcatcctcctttgacatgcccggcttcaagttgtctgagatgaagtacaaggactaaattcagtgtgcatcacaactgctattgtatttcttggtttgtttctttagtttggatggaagaaaaatgtttctctacaagttaaattcaattcagaagaaaaacaaataatggttttcctctttattctgcatttggtgctgtaggttattggatttttgtcctgcaaggcatttcgtaagtggcctcttcttaaactttaccaagattgtaatgtccaaaatgagtaccacgaatgtatgttgttttcatttcttgtatcctagtaattcatgcaatcctctgtctcttatatatgactgattacactttcgtacccataaa

SEQ ID NO: 4984 - DNA, 600 bp, Artificial; identical to SEQ ID NO: 4662
  Synthetic

SEQ ID NO: 4985 - DNA, 742 bp, Artificial
  Synthetic
gctccatcctcatccaaacctcacttctcacttcttcttcttcttcttgtgttcgactacctctgcattcttgtggggttaggggttcgagagattgtagaggatggcaatgctttccatcgcagctcttcgacggatccagtccgttgctcgagcaggaggaatccgtttgtcttcgtctgctgcagcagttgccaatgaagagtcatacctccgcctcaaagacaaatcacatgtcacgtggccaaaagtactaaatacatctttggaagagatagacccagaagtcacaaatataattgaactggagaagaatcgccaatggaagggtctggagctcattccttcagagaactttacatcactctcagtgatgcaggctgttggttctgtcatgacaaataaatacagtgaaggctatccgggagccagatattatggaggaaatgagtttatcgatatggcagagtcactatgtcaaaaacgggcacttgaggcttttcgcttggacccggcaaagtggggagtgaatgtgcagccattgtcgggttcaccagcgaacttccatgtttacactgctctcttgaaaccacatgacagaattatggctcttgatcttcctcatggtggccacctttcccatggataccagactgatactaagaagatatcggctgtttcaatatactttgagacgatgccataccgactgaacgaaaccacaggcttcatcgactatgat

SEQ ID NO: 4986 - DNA, 690 bp, Artificial; identical to SEQ ID NO: 4665
  Synthetic

SEQ ID NO: 4987 - DNA, 653 bp, Artificial; identical to SEQ ID NO: 2001
  Synthetic

SEQ ID NO: 4988 - DNA, 597 bp, Artificial; identical to SEQ ID NO: 378
  Synthetic

SEQ ID NO: 4989 - DNA, 1962 bp, Artificial
  Synthetic
ccccgaccgagcgagccgcatacgcattccgtcgaacacctcacccgcacccaccaccaccaacctcccaccccacaacccacatccatgtgcacgcgcgccctcctctcctcctccgctatatatcccctcctctccacccctccccaccactcccctctcctcccgcctcgccgccgcaaccaccgccgcctcgccgcagcatcacccgcagccgccgccgccgccgccatggactccgtcgcgtcgtgggggctgaccccgctcgccgcggccgacccgctcgtccacgacctcctcgagcgggagaagcggcggcagcggagcggcatcgagctcatcgcctcggagaacttcacctccttcgccgtcatggaggccctcggctccgcgctcaccaacaagtactccgaggggatgcccggggcgcgctactacggcgggaacgacgtcatcgacgagatcgagaacctgtgccgcgaccgcgccctcgccgcgttccgcctcgacgccgcgtcgtggggcgtcaacgtgcagccctactccggctcgccggccaacttcgccgcctacacggcgctcctcaacccgcacgaccgcatcatggggctcgagctcccctccggtggccacctcacccatggctactacaccgcgggcgggaagaagatctccgcgacgtcgatctacttcgagagcctcccctacaaggtgagcgccgccacggggtacatcgactacgagaagctggaggagaaggcgctcgacttccgccccaagctcatcatctgcggcggcagcgcgtacccgagggactgggactacgccaagctcagggccgtcgccgacaaggtcggggcgctgctcctctgcgacatggcgcacatcagcggcctcgtcgccgcgcaggaagctgcaaatccttttgagtactgtgatgtggttaccaccaccacgcacaagtccctccgaggaccaagagctggcatgatcttctacaggaagggccctaagcctcccaagaagggccagcctgagggtgctgtctatgactacgaggacaagatcaacttcgcagtgttcccgtcactgcaaggtggtcctcacaaccaccagattgcagcccttgctgttgctctgcagcaaaccatgacacctggattcaaggcctacgcaaagcaggtcaaggccaacgctgtcgccattggcaagtatcttatgagcaagggctacaaaatggtgactgatggaactgagaaccaccttgttctctgggatcttcgccctcttggcttgactggcaacaaggttgagaagatgtgtgacctttgcagcattacacttaacaagaatgctgtctttggtgacagcagtgcattggctcctggcggtgtccgcattggtactcctgcgatgacatccaggggtcttgtcgagaaggactttgagcagatcggcgagttcctccaccaggccgtgaccatctgcctcaacatccagaaggagcacggcaagctcctcaaggacttctccaagggcctggtgaacaacaaggacatcgagaacctcaagctggaggtcgagaagttcgccacctccttcgacatgcccggcttcaccctcgacagcatgaagtacaaggagtaggaaaacaaaaacacacacaaaccatggtcctaccgccgctaatcgtcgaccagctgtgctctcgtggaccgccgtcgtcgtcatcttcttcctcggcacaagctggccctgtgttacggattttgtctgcccatcgagatgataggtttcataaaacgctctctcccccaccctgctgctgcctctggtttggttgccaacctcatcccccatcggtttttttcctcctcttgtttctaatttctaggagctgtgccttttggaatcatggaatgtcaagtatttgccaataatcaatccgtttgatttctgcct

SEQ ID NO: 4990 - DNA, 590 bp, Artificial
  Synthetic
cccccccacctctatcagggtcacctgccagacttccatgtttacactgccctattgaaaccacatgagagaatcatggctttggatcttcctcatggtggacatctttctcacggctaccagactgatactaagaagatttcagcagtttcgatattctttgagacaatgccctacagattggatgaaagcactggcttgattgattatgatcagatggagaaaagtgccgttctttttaggccaaagttgatcgttgcgggtgcaagtgcatatgcgcgtctttatgactatgaccgcatgcggaaggtttgtgacaagcagaaggcaatacttctagcagatatggcacatatcagtgggcttgtcgcagctggtgttgttccatctccttttgattatgcagatgtagtgactaccactactcacaagtcactccgtggaccacgtggagccatgatcttttacaggaagggggtgaaaggagtaaacaagcaaggcaaagaggttatgtatgactttgaggacaagatcaatgctgctgtcttcccaggtctgcaaggtggaccacataatcataccattactgg

SEQ ID NO: 4991 - DNA, 1203 bp, Artificial
  Synthetic
ctgagaattgttggattgtgtgattgttttttcaattacaatggatttgagccaatcgcaatcgagtaatctctcgctagggtttattgctcatgcgtccccggcgggaagcgcacctagtcgtgctcatatcgccgacgactcgatcacttttcagatcgattctagggttaaggaccaatcgcatctgattccgcctgttccacttcaattgatggacaagcaaacggaggagaacgaaaagaacgggggagagagtggggatgaagagagggaagttgaagaatttcgtattctaggacattccatgtgtataaaacggaggagagatattgatagcacgtcgtcttcttcgtcttcaaagtgctttagggttacgagttccaatgagcatatgctagggctagaatcgcgaataagcgctgttagagcttggggtaatcagggtttacaggtagctgacccggatatatttgagataatggagaaggagaagcagagacagtacaaagggattgaactgattgcctctgagaattttgtatgcaaggctgtgatggaggcattagggagccatttaacaaacaagtattctgaaggagcaccgggggcaaggtactatggtggtaatcagtttatagatgagattgaaactctatgttgtaagcgtgcattagctgcttttggacttgaccctgagaattggggtgtgaatgtgcaaccatattcttgcacttcagcaaactttgcggtttatactggtttgctactgcctggtgatcggataatgggattggatacaccgtctggtggaaacacaagtcatgggtattatcttcctaatggaagaaaagtttcaggggcttcaattttctttgagagtctgtcttataaggttgacccccaaactgggtatgtagattttgataagcttgaggaaagggctcttgatttccgtcctaagatacttatatgtggggggagttcgtatccccgggaatgggattatgcaaagtttagacagattgcggacaaatgtggtgcagttttgttgtgcgatatggcacaaattagcggtctcattgctgcaaaggaatgtgcgagtccctttgattattgtgatatagttacttcaacaactcataaaagtcttcgaggtcctaggggaggtattatcttttataggaaaggatcaaagccaag

SEQ ID NO: 4992 - DNA, 724 bp, Artificial; identical to SEQ ID NO: 4658
  Synthetic

SEQ ID NO: 4993 - DNA, 1897 bp, Artificial
  Synthetic
  misc_feature (1832)..(1832): The residue at this position can be any nucleotide.
ggtgtgtgtaacaggggagaagctgacaataattatggccatggcaacggctcttcgaagactctcctcttctgttgacaaaccaattaagcgtctctataatggcggctctctctattacatgtcatcgttgcctaatgaagctgtttacgagaaggaaaaaaatggtgtcacgtggccaaagcaactgaatgctcctctagaggaggttgatcctgaaattgctgacattattgagcttgagaaagcacgccagtggaagggacttgaactcattccttcagaaaatttcacttctgtgtctgtaatgcaagctgttggatccattatgacaaacaagtacagtgaaggatatcctggggctagatactatggaggaaatgagtatattgacatggcggaaacattatgccagaaacgtgctttagaagcattccggttggatcctgcaaaatggggagtgaatgtgcagcctctatcaggatcacctgctaattttcatgtttacactgcacttttaaaacctcatgaaagaatcatggcccttgatcttccccacggtggacatctttctcatggatatcagactgatacaaagaagatatctgccgtctctatattttttgagaccatgccatacagactgaatgagagcactggctacatcgactatgaccagcttgagaaaagtgccacactctttaggccaaagttaattgtcgctggtgctagtgcttatgcacgtctttatgactatgcacgtatccgaaaggtttgtgacaaacagaaggctatcatgttggcagatatggctcatattagtgggttagttgcagctggagtcatcccatcaccatttgattatgcagatgttgtgactaccacaacccacaaatcccttcgcgggcctcgtggtgccatgattttcttccggaagggtgtgaaggaggttaacaagcaaggaaaggaggtgttgtacgactatgaagataaaattaaccaggcagtctttcctggacttcaaggtggtcctcacaatcatacaattactggcttggcagttgctttgaaacaggcaatgactccagaatacaaagcttaccaagagcaatgccttagcaactgctcaaaatttgcccaggcgttagcgggaatgggttatgaacttgtttctggtggaacagagaatcacttggtcttggtgaacttgaaaaacaagggtattgatggttctagggttgaaaaagttttggaagcggtacatattgcagccaataagaacactgttcctggagatgtatctgccatggtccctggtggcatcagaatggggactcctgcactcacatcaaggggatttattgaggaagattttgtgaaagttgctgaattctttgatgctgctgtgaagatagcagtgaaaataaagggtgaggctcaaggaacaaagttgaaagactttgtgacaacactacagtctagtgcttccatccagtcggagattgcaaaactccgccatggtgtggaggagtatgcaaagcagttccctacaattgggtttgagaaggaaaccatgaagtacaaaaactgagagctcgactgagtatatacacaaggaccaatatccaatttcttgaaggtgtatgggatgcacattcaaactgcagtttgctctcaaggataggattttcatcttataatattatgtaaaatccagcagtacttggttcccaactttgcactttgtatattaacgattgtaaatcatctcaggtccttgaaagcaataaactcctcttatctcagtaaaaaagaaagaagaaaaacattgncctgtattgcttaatattttccttttattaatgagagtaccatgtgttgtgttggaaaaaaaatg

SEQ ID NO: 4994 - DNA, 676 bp, Artificial
  Synthetic
  misc_feature (610)..(610): The residue at this position can be any nucleotide.
gtctgtttcttttctcacaatcccaccaaactacctcacaatgtctcccacaaacgctgagtatgcgctctctgagacgcacaaggagatgctcgagaagtctctcctcgactccgaccctgaggttgccaccatcatgaaggatgagattcagcgccagcgcgagtccattatcctcatcgcctccgagaacatcacctctcgcgccgtcttcgatgcccttggttcccccatgtccaacaagtactccgagggttaccctggtgctcgttactacggtggaaaccagcacatcgaccagatcgagcttctctgccagcgccgtgcccttgaggccttccacctcgattccgagaagtggggtgtgaacgtccagtgcctttctggatcccccgccaacctccaggtctaccaggctatcatgcctcctcacggccgtcttatgggtcttgaccttccccatggtggccatcttagccacggttaccagacccccgcccgcaagatctctgctgtctctacctacttcgagaccatgccttaccgtgtcgacctcgacaccggcatcatcgactatgacaccctccagaagaacgctatcctctaccgncccaaggtcctcgttgccggtacttccgcctactgccgtcttatcgactacgagcgtatgcgcaag

SEQ ID NO: 4995 - DNA, 1194 bp, Artificial
  Synthetic
cccccccccccagttggatcggttatgactaacaagtatagtgaaggatatcctggtgccagatactatggaggaaatgagtacgcatactgtttgctaaatctcgttctcctaattcttttgtaattaacctgtattttcatgttatatatcagcttcagatattcttttcctattatgagagaatgagtgtccaggtacatagacatggcagaaactttatgccagaaacgtgctttggaagcattcaggctggatcctgcaaagtggggagtgaatgtgcagcctctatcaggatcacctgctaattttcatgtttacactgcattattaaaacctcatgaacggatcatggctcttgatcttcctcatggtggacatctttctcatggatatcagactgatacgaagaagatatctgcagtctctatattctttgagacaatgccttacagactcaatgagagcactggctatattgactatgaccagcttgagaaaagtgccacactctttaggccaaaattaattgttgctggtgctagtgcctatgcacgtctttacgactatgaacgaatccggaaggtctgcgacaaacagaaagctattttattagcagatatggcacacattagtggattggttgcagctggagtcatcccatcaccatttgattatgctgatgttgtcactaccacaacccacaaatcccttcgtggtcctcgtggtgctatgattttcttcaggaagggtgttaaagaggttaacaagcaaggcaaggaggttttgtacgactatgaagacaaaatcaatcaggcagtctttcctggacttcaaggcggtcctcacaatcacaccattactggcttggcagttgccttgaaacaggcaatcactccagaatacaaagcataccaagagcaggtcctcaacaactgctcaaaatttgcccaggctttaatggagaatggttatgagcttgtctctggaggaacggagaatcacttggttttggtgaacctgaaaaacaagggtattgatggttctagggttgagaaaatcttggaagctgtacatattgcagccaacaagaacactgttcctggggatgtatctgccatgggccccggaggcatcaggatgggaactcctgcgctcacttatcgtggattaggtgaagaagattatgcgaaa

SEQ ID NO: 4996 - DNA, 1411 bp, Artificial
  Synthetic
gcttcttcttcttgttcgactacctctgcattctttgtggggttaggggttcgagagattgtagaggatggcaatgctttccatcgcagctcttcgacggatccagtccgttgctcgagcaggaggaatccgtttgtcttcgtctgctgcagcagttgccaatgaagagtcatacctccgcctcaaagacaaatcacatgtcacgtggccaaaagtactaaatacatctttggaagagatagacccagaagtcacaaatataattgaactggagaagaatcgccaatggaagggtctggagctcattccttcagagaactttacatcactctcagtgatgcaggctgttggttctgtcatgacaaataaatacagtgaaggctatccgggagccagatattatggaggaaatgagtttatcgatatggcagagtcactatgtcaaaaacgggcacttgaggcttttcgcttggacccggcaaagtggggagtgaatgtgcagccattgtcgggttcaccagcgaacttccatgtttacactgctctcctgaaaccacatgacagaattatggctcttgatcttcctcatggtggccacctttcccatggataccagactgatactaagaagatatcggctgtttcaatatactttgagacgatgccataccgactgaacgaaaccacaggcttcatcgactatgatcagcttgaaaaatctgctactctattcaggcccaaattaattgttgctggagccagtgcttattcccggcactatgactatgcgcgcatgcgtaaggtctgtgacaagcaaaaggctgtgctcttggcggatatggcgcatatcagtggacttgtagctggtggtgtggttcccactcccttcgactttgcagatgttgttacaactactactcacaagtctttgcggggccctcgcggggccatgatattctataggaaggggctcaaggaggtcaacaaacaaggacaagaagttatgtatgattatgaagacaaaatcaatgccgctgtgtttcctggtctccaaggaggaccacacaatcacacgattactggccttgccgtggccctaaaacaggcagcctcatctgaattcaaagcttatcaggagcaagttctgagtaattgtgctcatttcgcaaaatctcttatgtcgaagggctatgagcttgtgtctgggggaactgataatcaccttgtgctcgtgaatcttaagaacaagggaattgatggatcaagggtggaacgtatcttggaactggctcacattgctgcaaacaagaacaccgtccctggggatgtgtcttgcctgattccaggaggcatccgaatgggaactcctgctttgacatcgagaggatttacagaggagaatttcgagaag

SEQ ID NO: 4997 - DNA, 657 bp, Artificial; identical to SEQ ID NO: 2000
  Synthetic

SEQ ID NO: 4998 - DNA, 641 bp, Artificial
  Synthetic
tgtttctggtggaacagagaatcacttggtcttggtgaacttgaaaaacaagggtattgatggctctagggttgaaaaagttttggaagcggtacatattgcagccaataagaacactgttcctggagatgtatctgccatggtccctggtggcatcagaatggggactcctgcactcacatcaaggggatttattgaggaagattttgtgaaagttgctgaattctttgatgctgctgtgaagatagcagtgaaaataaagggtgaagctcaaggaacaaagttgaaagactttgtgacaacactgcagtctagtgcttccatccagtcggagattgcaaaactccgccatggtgtggaggagtatgcaaagcagttccctacaattgggtttgagaaggaaaccatgaagtacaaaaaatgagagctcgactgagtgtatacacaaggaccaatatccaacttcttgaaggtgtatgggatagactttcaactgcagtttgctctcaaggataggattctcatcttataataatatgtaaaatccagcagtacttggttccagactttgcactttgtatattaacgagtgtaaatcaactgaggtccttgaaagcaataaactcctcttatctcagtga

SEQ ID NO: 4999 - DNA, 676 bp, Artificial; identical to SEQ ID NO: 1771
  Synthetic

SEQ ID NO: 5000 - DNA, 747 bp, Artificial
  Synthetic
gaatctcaataagtgaagggattttggtggttaattgtaacatggaagcttgttgcggagctgcaatcatgggttcagttcagcagcctgtttgggttaaaagttcagcttttccttcaaaaggggctgctggtattccggctcgggttaaattatgctctgtaaaaccctgcagagcatctccaattgaagggagcttgttaacaggaagccctacttcttctgtaggtgctaggagcagttttgaagactatggattgagtgaagctgatcctgatgtccgtgctataattgacaaagagaagaaacgtcaatttaggagcttagaacttattgcatctgagaatttcacatctcgagcagtgatggaagcagttggttcttgccttacaaacaaatactccgaagggcttccaggaaaaagatactatggtggtaatgaatacattgatgagttggaaactctctgtcaagaaagagcattggctgcctttagtttagatggaaagcaatggggtgtgaacgtccaaccattatctggttcgccagcaaattttgcagtctacacagctgttcttaatccacatgaccggattatgggattggacttacctcatggtggccacttgtcccatggatttatgactcctaaacgacgagtttctgccacctctgtttactttgagtccatgccttatcgacttgatgaatctacaggcatcctcgattataaaatgcatgagaaaa

SEQ ID NO: 5001 - DNA, 138 bp, Artificial
  Synthetic
catctttctcatggttatcagactgacaccaagaagatatcagctgtgtctatcttctttgaaacaatgccctatagattggacgagagcactggctacatcgactacgatcagatggagaaaagtgctactcttttc

SEQ ID NO: 5002 - DNA, 621 bp, Artificial; identical to SEQ ID NO: 4663
  Synthetic

SEQ ID NO: 5003 - DNA, 657 bp, Artificial
  Synthetic
cggacgcgtggggctcgccaatggaaggggctcgaactcattccttcagaaaatttcacttccctttcggtgatgcaagcagttggatcggttatgactaacaagtatagtgaaggatatcctggtgccagatactatggaggaaatgagtacatagacatggcagaaactttatgccagaaacgtgctttggaagcattcaggctggatcctgcaaagtggggagtgaatgtgcagcctctatcaggatcacctgctaattttcatgtttacactgcattattaaaacctcatgaacggatcatggctcttgatcttcctcatggtggacatctttctcatggatatcagactgatacgaagaagatatctgcagtctctatattctttgagacaatgccttacagactcaatgagagcactggctatattgactatgaccagcttgagaaaagtgccacactctttaggccaaaattaattgttgctggtgctagtgcctatgcacgtctttacgactatgaacgaatccggaaggtctgcgacaaacagaaagctattttattagcagatatggcacacattagtggattggttgcagctggagtcatcccatcaccatttgattatgctgatgttgtcactaccacaacccac

SEQ ID NO: 5004 - DNA, 675 bp, Artificial; identical to SEQ ID NO: 2002
  Synthetic

SEQ ID NO: 5005 - DNA, 659 bp, Artificial
  Synthetic
aagaaggctagggttcttggcctcgaaatatgggcagatctatcttccagcgcctagatcgccgcatcgcccgcattacagtcgcgctagatcaatggcggccgtcaaggactggggcaatcagccgctggtggcggtggacgaggagattttcgacctgatcgagcacgagaaggcgcggcagtggcgggggatcgagctcatcgcgtcggagaatttcacgtcccaggcggtgatcgaggcgctgggcagcgccctcacgaacaagtactcggaaggtatgccagggaatcgctactacggcggcaacgaattcatcgaccagatcgaggagctgtgccgatccagggcgctggcggcattccggctggatccgggcagctggggcgtcaatgtccagccctactccggcagccccgcgaatttcgccgcgtataccgctgtgcttgagccgcacgaccggattatggggctggatcttccgtcgggtgggcatctcacgcatggctactatacgtccggcgggaagaagatctcggccacctccatctacttcgagagcttgccttacaaggtggatccgaagactggctacattgactatgatcggctcgaggagaaggccatggatttccggcccaagcttatcatctgtggcg

SEQ ID NO: 5006 - DNA, 840 bp, Artificial
  Synthetic
  misc_feature (731)..(731): The residue at this position can be any nucleotide.
gaaccctcttcatcatcttcttcctcagaaatctcctgatcttctttctaaattcccaatctaaccctctccaaggatcccgtcaatgaatggggtaacacacccttaaacgttgcagatccagacatcttcgatttaatcgaaaaagaaaagagaagacaatgcagaggtatcgaattgatcgcttctgaaaacttcacatctttcgctgtgattgaagcacttggtagtgctttaacaaacaaatactccgaaggtattcccggtaacagatactacggaggtaatgaattcatcgatgagattgaaaatctatgtcgttcaagagctttggaagcattccgatgtgatccagcgaaatggggtgtgaatgtacagccttactctggtagtcctgctaattttgcagcgtatactgctttgttgaatccacatgatagaattatgggtcttgatttgccatcaggtggtcatttgacacatggttattatacatctggtggtaagaagatttctgctacttcaatttactttgagagtttgccttataaggtgaattctactactgggtatattgattatgataagttggaagagaaagctttggatttcagacctaaattgattatctgtggtggtagtgcttatcctagagattgggattatgctagatttagagctgttgctgataaatgtggtgctcttttgctttgtgacatggctcacattantggtcttgttgctgctcaggaagctgccaacccatttgaatactgtgacgttgtcacaaccacaactcacaagagtttgaggggacctagggctggtatgatcttcttc

SEQ ID NO: 5007 - DNA, 1901 bp, Artificial
  Synthetic
gaattcgagagaaatctttttttggggttgagaggagagagagagacacacagagagaaaaaatggcgatggcaatggcacttcgtaggctctcatcttcttcaatcaacaaacctatccgtcctctcttcaatgccgattcctactattgcatgtcatctcttccaagtgaagctgttgatgattctaaggataaatctcgtgttcaatggccaaagcaattgaatgcaccattagcagaagtggatccagagattgctgacattattgagcttgagaaagctaggcaatggaagggtctggaattgattccttcagagaatttcacatctgtgtcggtcatggaagctgttggttctatcatgactaacaaatacagtgaaggttatcctggtgctagatactatggaggaaatgagtacattgatatggcagaaactttgtgccagaaacgtgccttggaggctttccgtttggatcctgctaaatggggagttaacgtgcaatctttgtctgggtcccctgccaatttccaagtctacactgcactattgaagccccacgagagaattatggcacttgaccttccacatggtgggcatctttctcatgggtatcagactgacaccaaaaaaatatctgctgtatctatattttttgagacaatgccataccgattggatgagagcactggttacattgattacgatcagttggagaagagcgctacactcttcaggccgaaactgattgttgctggtgcaagtgcttattcacgcttctacgattatgcacgcattcgccaggtgtgcgacaagcaaaaagctatattgttggcagatatggctcacatcagtgggcttgttgctgctggtgtcatcccatctccatttgagtatgccgatgtggtgaccactacaacacataaatcccttcgtggaccacgtggggcgatgatattttacagaaagggattgaaggaagtcaacaaacaaggcaaagagatcatgtacgactatgaggacaaaattaatcaagctgtctttcctgggcttcaaggaggtccacacaatcacacaattactggattagcagttgcactgaaacaggcaactaccccagaatacaaggcttatcaagaacaagtgctcaaaaattgctcacagtttgccaaaaccttgaacgcattgggatatgaccttgtttccggtggtactgaaaaccatttagtcttggtcaatttgaaaaacaagggtattgatggctcaagagttgagaaagtaatggaattggttcatatcgctgctaacaagaacactgttcccggggatgtctctgccatggttcctggtggcattcgaatgggaacacctgctctcacttcaaggggattccttgaggaagatttcgctaaagtagcagagttctttgatgctgctgtgaatttggccttgaaagccaaagctgaatgcaaaaaaggtgcaaaattgaaggactttatggccgcggttgaaaacagtgctagcattcagtctgaaattaaacagctccgtcatgacgttgaggaatatgcaaagcaattccctacaatcgggttctgcaaaacaacaatgaaatacaagcaataaactccactattataagtgggcatatatgcttcggtagtgcagtggagtatctacaaaggcgaatgagatggacacgggaagggagcaaactgccttttaatgtagggaatatatgaatgctttcaatcagtgaatgggatatattgttgacactacagggttctaagcatgaagagagtaccatttggttcaaatttcattcttcattcaagaattgaattatatgtatattattaaacttgatcaattataatgcaacaatataaagcttgt

SEQ ID NO: 5008 - DNA, 655 bp, Artificial; identical to SEQ ID NO: 4667
  Synthetic

SEQ ID NO: 5009 - DNA, 722 bp, Artificial
  Synthetic
ctttatcttgatgctgttgagtcccacaaaggacattgtcatgtatgtgaactccccaggagggtcagtaacggcaggaatggccatatttgataccatgcggcatattcggcctgatgtctccactgtctgtgttggacttgctgcaagtatgggagcttttcttctcagcgcgggcaccaaaggaaagagatacagcttgccaaattcaaggataatgattcaccagcctcttggtggcgctcaaggtggccaaactgatatagatatacaggctaatgagatgttgcatcacaaagctaacctgaatgggtaccttgcctaccacactggtcaaagtcttgagaagattaaccaggatactgatcgtgattttttcatgagtgcaaaggaagctaaagagtatgggctaattgatggtgtcatcttgaatcccatgaaagcccttcaacctcttgcagcagctgctgaacaatcatagctgagtcaattttctcccaatcattttcctctcgcgcttggatgatgttattgatagtcatgactagagattgtaattgattactgggttttgggtagaattatcattcctgctgccaggagcaattgtacacgaacgtttacaagttcatcagagggaagagtaaaatgtatctgacctaatcccataaacgtttttcgcaggtcttgatgtttcttttaaagattacttttttactttc

SEQ ID NO: 5010 - DNA, 705 bp, Artificial
  Synthetic
cacgcgtcgctcagaggatggctatggcgttcttgagtacgccagaaatcgttcacagtgggacgcaacttaaccagtggagcagcagcagcagcagcagcaatagctggcggcactccagggcagctcttcctcttcccatgcgacacgaatgcagatcgaagcggctatcgtgcgttacccgggcgtcgagaatgcagcagaatagcatctccagcgagcggttttggtctccggatgtggcgattcaagatggactgtggtcgataaggagagatttggaggttcctccctcggcttatttgggaggaacttttactgccgggcaaggccaaggtccgcctcccatgctacaggagcgtttccagagcgtcatcagccagcttttccagcacaggataattcggtgcggtggagcagtggacgacgatatggccaatctcatcgtagcgcagcttctgtatcttgatgctgctgatccaaagaaggatattgtgatgtacgtgaactcccctggaggctctgttaccgctggaatggccgtgtttgacactatgaggcacattcgtccgaatgtgagcactgtctgtgttggacttgccgcaagtatgggtgcttttcttctcagtgcaggcacgaaaggaaagcgttacagcttgccaaactccagaattatgatccatcagcctctcggtggcgctcaag

SEQ ID NO: 5011 - DNA, 596 bp, Artificial
  Synthetic
ttttttttttcagcacagtaagaaactttactttggtcttcatgtatgtatcaactacagagtttgatcccaaacaaatctgattttccttgtagaatagaaacatatttcatggaaaatctcagttcatcaaaggcccaaaaaagaacaagtgctaaagctgaaccactacctttaggcgattaagctgctgcaagtggctggagagctttaagagggttcatgataacaccgtcgataagtccatactcttttgcttctttggcactcatgaagaaatcacggtctgtgtcctggtttatcttctccaggctttgaccagtgtggtatgcgaggtaaccgtttaggtttgccttgtgatgcagcatttcatttgcctgaatgtcaatgtcggtttggccaccttgagctccaccaagcggctgatggatcattatccttgagtttggtagactgtatctttttcctttggttccagcactaagcagaaaagctcccatactagcagctagaccaacacaaacagtggacacatcaggccggatgtgcctcatagtatcgaatatagccatgccagctgtaactgatccaccagg

SEQ ID NO: 5012 - DNA, 582 bp, Artificial
  Synthetic
gtttagggctcttgccctagagctatggcgacatggacgttgccgcattcttcgccttctccgccgcgcgggccggtccatcgcgtcgatctcaagaacaaggtacatagagtaggcgctgctgctcgcggcaggggcccgattctggggaaatcgaggcttctttgcgagaactggggagttggaagctctagccctgattcgcagccgccagaaggtcgatcgttcctcttggatccagcgggggtcctactacagcagcgcattgtgttccttggatcgcaggttgacgatgtgtcggcggaccttatcatcagtcagcttcttcttctcgacgccagagattcatcaaaggatataaaaatgtttatcaactcgcctggtggctctgtttcagctgggatgggaatttatgatgctatgaagctgtgccgagcggatgtatcaactatttgcttcggcctcgcagcgtcgatgggggctttcttgctggcttctggaacaaaagggaagagatactgcatgccaaattctcgtgtcatgatccatcaacctttgggaggcgctggtggtgcggcgatt

SEQ ID NO: 5013 - DNA, 622 bp, Artificial
  Synthetic
gctgccggcaatgatgaatgccacggcgtcatcgtctcctcgctgcttcaatccaagtgacaaatcgtcagcggcgtggagcatctcgcggcgccaccaccaatctgggcttggcatcgggaggctggggcggcgggggatttgccgagcacaagtggtgatgatgcccatcggcacccccaaagttccctatagaacacccggcgaggggacttggcaattcgtggatatctggaatgtgctgtaccgagagagaataatttttatggggcagcacattgacgaagagtttggcaatcaagttctcgcgaccatgctctacttggacagtgttgattccagcaaagacctccacttttacatgagttgtcctggtggtgatttaactccttccatggctatttacgatacaatgggaagcattaaaagccggatgggaaccatggcaatgggttatgcgtataacatcgctggcttcttgcttgcagctggagacaagggcatgcgaagctccatgcctctcacgagaattgccatacaacctcctcaaggagccgctcgcggaaaggcggacgacatacaaaacgaggctaaagaactttctcgtgttcgtgactatctg

SEQ ID NO: 5014 - DNA, 695 bp, Artificial
  Synthetic
cttggcgcccggcaagaaccatggctggcatggattccagagctcgaggtcaggcatcgcgaggttccggcggagagaatgcgcgatccatggcggcggcggcggcggcggcgtctcaatatcgccgccatcgccggctctttcccatccgttcgtgatgcctagaatgcgagggtttgatcttccattcgtcgagtggtgaggggaggcagggcagtgaggagaatacgatcagggcggcgaagaaggggtcgccgccgctggccccggtggtgatcacgccggctggggtgtcggaccttaccagcctcatgtttcgcaataggatcatcttcattggccagcctatcaattcgcaagtggcacagcgagttatctcccagctcgtaagccttgctgccgtcgacgagaacaaagatatacaaatttatatcaattgtcctggaggaagcacgtactcagtgtttgccatttacgattgcatgtcatggattaagccaagaatcagcactgtatgctttggcatggcggcgagccaaggagctttgattctagccggtggaacgaaaggtcttcgtttcgcgatgccgaactctagagtgatgatccatcaacctcaaggaggctgtggtgggaccatggaggacgtgaggagacaagtgaacgaagtcgtacaatcaagaaacaaaatcgat

SEQ ID NO: 5015 - DNA, 708 bp, Artificial
  Synthetic
ccccgagtttcttatcccgtttttttaccagggtgctcgtgggataactcttaaatccgccggcgaacactctccctctagtattccgtcactgaatctcgccggagcaataaaatggtagcgtcttccatcaccggaacgtcaattattcctgcctctttccggaagcaaacgtcttcttcgtctttgttttcttctagaacaaatcaataccagttacttttctgcagaagcttaacgaagcgggtagtttctgttctccgaagtccgtattctgattcatcagctattggattgtctcacaagactctgaaaaccccgttaaagctcaatgagcacgaatccagcggtcttaccaattcaagctttggtgttatcgaagcaaaaaaggggaatccacccgtcatgcctgctgtgatgacaccaggggggcctttggatctctctactgtgttattcaggaatcgaattatcttcattggacaaccaatcaactccgcagttgctcagagagttatatcacaacttgtgaccctcgcaactatcgatgaaaatgcagatattttgatctatcttaattgtcctggtggaagtacctattctgtcttggcaatatatgactgcatgtcatggataaagcctaaggttggtacagtatgtttcggagtagctgcaagccaaggagcacttcttcttgccggtggagaa

SEQ ID NO: 5016 - DNA, 684 bp, Artificial
  Synthetic
taaaagcaaagagaaagaaggaacagcttagatggagggaggttgtctaacattcaccacagcaccaacaagaccttcaaccttattcaattacaatcccacaattaccaaacaattttacagcaattcactacctaatactattacaaatgataaacgaagaagaggattgtcaataaaagcatcgacccacaacttttctacagcgaaaccgacgctatctcggaactgggatgtttccagttactcaaaagcacctgcttggttgcccagatttgaagaacttgatactaccaatatgcttcttcgtcaaaggattatcttcttgggttctcaggtagatgatatgactgcagattttgttataagccagctattatttcttgatgccgaagatcagaaaaaggacatcagattgatcattaattcacctggtggttcagtaactgctgggatgggaatctatgatgctatgaaaatgtgcaaggctgatgtttctacaatctgcatgggactggctgcatcgatgggtgcgtttctcctcgcatctggcagcaagggaaagaggtactgcatgccgaacgcaagggtgatgattcatcaaccacttggaacttctggtggtaaagcaacagagatgagtatacggatcagagaaatggcataccacaagattaagcttaa

SEQ ID NO: 5017 - DNA, 403 bp, Artificial
  Synthetic
  misc_feature (340)..(340): The residue at this position can be any nucleotide.
gatatggcaaatttgatagttgctcaactgctttatctctatttggatcgagagcatcaagataaagatattgttatgtacgtgaactctcctggaggttctgtcactgctggaatggccatctttgacaccatgaggcatatacggccgaatgttagcactgtctgtgtaggtttagctgcaagtatgggtgcatttattcttagcggaggtaccaaagggaaaagatacagccttccgaactcaagaataatgattcaccagcctcttggaggagcccagggtcagcagactgatgttgaaattcaggccaatgagattctgcatcataaagcaaatntgaatgcgtatcttgcctatcatacaggccaatcactggacaaaatagtgcaagacacggaca

SEQ ID NO: 5018 - DNA, 707 bp, Artificial
  Synthetic
cctctcccattcgtggattggctcttggagaagaagggtttcgaggtttcttggccagtctatattctggcaagcggttgtgaaggtgggcattgctgtctctgaagggtctttacatcatcatcagggtaggtaacaatgtcaggagcagggcaacgtctaaatgtagtcccgacagtaacagttctaggtgtgattaaaactcgtttggtgggtgcaacgaaggggcatcagctactaaagaagaagagcgatgcattaacagtacagttccgtcaaatcctaaggcacatcgtacagactaaagaggccatgggggactctatgaaagccgctgcttttgccctcacagaggccaaatacaccgctggcgacaacatcaaacacgttgtccttgaaaatgttgactccgccacagtcaaagtccggtcaaagcaggacaatgtggcaggagtcaaacttccccgttttgagttcgtgacagaggcaggggagtcaaagaatgatttgactggtcttgctcgaggaggtcagcagatccacctctgtaaatcggcgtttatcaaatcagttgaggttcttgttgagttggcctctctgcagacatcgtttcttacccttgatgtggccattaagaccactaaccggagggtcaacgctttagagaatgtggtcaaacccaagttggagaacaccataagctacat

SEQ ID NO: 5019 - DNA, 281 bp, Artificial; identical to SEQ ID NO: 2220
  Synthetic

SEQ ID NO: 5020 - DNA, 719 bp, Artificial
  Synthetic
tgcaattcgatcttagccccgagaattttgttcttggcacagttgacccaactcttttcttctgctgagatatctgaataatctcctgatctctttcttctccgtgcgaaatctagtttttaagtagcttagcaaaatgtccgggcaaagtcagcgtttgaatgttgtacccacagttacgatgctgggagttattaaagctcgccttgttggagcaacaagaggccatgctttgctgaaaaaaaaaagtgatgctttgactgtgcaattccgtcagattctaaagaatatagtgtcaacaaaggaatcaatgggagaagtcatgaaagattcctcctttgctctgactgaggcaaaatatgctgctggtgagaacatcaagcacgttgtccttgaaaatgtccagaatgcaactcttaaagttcgatctcggcaggaaaatattgctggggtgaagctccccaagtttgaacatttctctgaaggggagaccaagaatgacctgactggattagctagaggggggcaacaggtacaagcctgtcgtgctgcttatgtgaaatctattgagttacttgttgagcttgcatcgctgcaaacatcattcttgactcttgatgaggcaatcaagaccacaaatcggagggtcaatgccttggagaatgttgtaaagcctcggctggagaatacagttctttacatcaagggggaacttgatg

SEQ ID NO: 5021 - DNA, 369 bp, Artificial
  Synthetic
gagaagccgtctttccgacgcgaatgaccttgggtatgatgaagggaaagctcaagggagctacccagggtcacaacctgctgaagcgaaagtccgaggccctgaccaagcgggtcagagacattacacgaaagattgacgaatcgaagcacaaaatgggcagagttatgcagaccggagccttctctctcgctgaggtcacctacgctaccggggacaacatcaactaccaagtgcaggagtccggccgatccggtcgtctgggtgtgcgtggcaaggaaaaaaacgtctccggtgtccagttggcctccttttcttcttactacgtcgaggagaactccgacttctctctcaccggtcttggtcgag

SEQ ID NO: 5022 - DNA, 704 bp, Artificial; identical to SEQ ID NO: 2221
  Synthetic

SEQ ID NO: 5023 - DNA, 723 bp, Artificial; identical to SEQ ID NO: 2216
  Synthetic

SEQ ID NO: 5024 - DNA, 677 bp, Artificial; identical to SEQ ID NO: 2218
  Synthetic

SEQ ID NO: 5025 - DNA, 481 bp, Artificial
  Synthetic
ctcgatgaggccatcaagaccaccaaccggcgtgtcaacgcgctggagaacgtcgtgaagccgaggctggagaacaccatcagctacatcaagggggagctggacgagctcgagcgtgaggacttcttcaggctcaagaagatccagggttacaagaagagggagatcgagaggcagatggctgcagccaagcaattcgcagaggaacagcttgcggaggaggttgccctcaagaggggtatctctgtgggtgctgccaccaacatgttggttgccggtggagagagggacgaacacatcatcttctgatcatcttcggtcatacagtgattcaatcgtggtggaaataataagttgtgatgctggagctccagaatcgcacctgtttatagagtggcggacgttttgtttcaggcgggagtctggactctgttcatccaaaagaccacaaataatttggacttggaaccaaccaacggat

SEQ ID NO: 5026 - DNA, 706 bp, Artificial
  Synthetic
gccattacggccggggagttcgaactcggacagatattgggattcgattttcgacccgagagttttgttcttggcacagttgacccaactctcttcttctgccgagtttatctaatcaatctcctcctgatctccttcttctcccttagtagtttagcaaaatgtccgggcaaagtcagcgtttgaatgttgtacccacagttacgatgctgggggttattaaagctcgccttgttggagcaacaagaggccatgctttgctgaaaaagaaaagtgatgctttgactgtgcaattccgtcagattctaaagaatatagtgtcaacaaaggaatcaatgggagaagtcatgaaagactcctcctttgctctgactgaggcaaaatatgctgctggtgagaacatcaagcacgttgtccttgaaaatgtccagaatgcaactcttaaagttcgatctcggcaggaaaatattgctggggtgaagcttcccaagtttgaacatttctctgaaggggagaccaagaatgacctgactggattagctagaggtgggcaacaggtacaagcctgtcgtgctgcttatgtgaaatctattgagttacttgttgagcttgcatcgctgcaaacatcattcttgactcttgatgaggcaatcaagaccacaaatcggagggtcaatgccttggagaatgttgtaaagcctcggct

SEQ ID NO: 5027 - DNA, 1125 bp, Artificial
  Synthetic
ggcccacgcgtccgttaaaggcaacgttgatagttgaccccactcccccgcaagcgcctctcccatctgattcgtgtctgaaatcctcgctatctttctctcccattctgacgaattcgacttctaaagtagctaagcaaaatgtccgggcaaagccagcgtttgaatgtcgttcctacagttacaatgcttggtgtgatcaaagctcgccttgttggtgctacaagaggccatgctctgctcaagaagaagagtgatgctttgactgtgcagttccgtcagattctaaaggacattgtgtcaacgaaggaatcaatgggagatgtcatgaaaacttcctccttcgctctgacagaggcaaaatatgcttctggcgagaacattaagcatgttgtccttgaaaatgtccagaatgcaaccatcaaagttcgatctcgccaagacaatattgcgggtgtaaagctccctaaattcgagcatttcgctgaaggagagacaaagaatgacctgactggattagctagaggggggcaacaggtgcaagcttgccgtgctgcttacgtgaaatctattgagttgcttgttgagcttgcctctctacagacatcattcttgacgcttgatgaggcgatcaagaccacaaatcggagggttaatgcattggagaatgttgtgaagccacggttggagaacacagtgctttacatcaaaggagaacttgatgaactggaaagggaagatttctttcgtctaaagaagatacaaggttacaagaagagggaggtagagagacagatgctggcttccaagcaatacgcagaggaaaaggctgcagaagaaatttccttgaagagaggtatttcgctaggtacagcccataacttgctatcccatgcttcacagaaagacgaggacattattttctgataaggaggtcaaatgatttatttaaattgcattgtgtggcttgtcttttcttgtccttcattacaaatggaaaattgattagatggagagtcttttcgtatttaataagagctctatgcatatttgtatttaaaagttaatttatggacaatatggggggttaccttgttaaaaaaaaaatgacaaaaaaaaattact

SEQ ID NO: 5028 - DNA, 754 bp, Artificial
  Synthetic
cccgctcttgaaagcaaaggtcaagggtagcaatagctttaagcttagaaattattttcagaaatggcttcctcagttatgtcctcagcagctgctgttgcgaccggcgccaatgctgctcaagccaacatggttgcacccttcactggcctcaagtccgcctcctccttccctgttaccaggaaacaaaaccttgacattacctccattgctagcaatggtggaagagttcaatgcatgcaggtgtggccaccaattaacatgaagaagtacgagacactctcataccttcctgatttgagccaggagcaattgcttagtgaagttgagtaccttttgaaaaatggatgggttccttgcttggaattcgagactgagcgtggattcgtctaccgtgaacaccacaactcaccaggatactacgatggcagatactggaccatgtggaagttgcccatgttcgggtgcactgatgccactcaggtgttggctgaggtcgaggaggcaaagaaggcttacccacaagcctgggttagaatcattggattcgacaacgtccgtcaagtgcaatgcatcagttttatcgcctccaagccagaaggctactaaaatctccatttttaaggcaacttatcgtatgtgttccccggagaaactgttttggttttcctgcttcattatattattcaatgtatgtttttgaattccaatcaaggttatgagaactaataatgacatttaatttgtctttggt

SEQ ID NO: 5029 - DNA, 686 bp, Artificial; identical to SEQ ID NO: 1715
  Synthetic

SEQ ID NO: 5030 - DNA, 649 bp, Artificial; identical to SEQ ID NO: 1849
  Synthetic

SEQ ID NO: 5031 - DNA, 743 bp, Artificial
  Synthetic
ccccggcctcaacagcactgctactggacatactctactactactagccagtaagctagctaactaactacgtggctatggcccccaccgtgatggcctcctcggccacctccgtggctccattccaagggctcaagtccaccgccggcctccccgtcagccgccgctccaccaactcgggcttcggcaacgtcagcaatggcggaaggatcaagtgcatgcaggtgtggccaattgagggcatcaagaagttcgagaccctatcgtacctgccaccactcaccgtggaggatcttttgaagcagatcgagtacctgcttcgatccaagtgggtgccttgtctcgagttcagcaaggttgggttcgtctaccgtgagaaccacaggtctcccggatactacgatggcaggtattggaccatgtggaagctgcccatgttcggctgcaccgatgccacccaggtgctcaaggagctcgaggaggccaagaaggcctaccctgatgcctttgtccgtatcatcggcttcgacaacgtcaggcaggtgcagttgattagcttcatcgcctacaagcccccaggttgcgaggagtctggtggcaactaagctaagatcaagcatcgcgctggtggattgctgcctataataatagtatgcagctttgttttgggctatgttgatgatatatcaatatataatatgctatatatttttattttacagtttggttatgtaccatctcaa

SEQ ID NO: 5032 - DNA, 424 bp, Artificial; identical to SEQ ID NO: 1710
  Synthetic

SEQ ID NO: 5033 - DNA, 580 bp, Artificial; identical to SEQ ID NO: 1709
  Synthetic

SEQ ID NO: 5034 - DNA, 524 bp, Artificial; identical to SEQ ID NO: 1852
  Synthetic

SEQ ID NO: 5035 - DNA, 808 bp, Artificial
  Synthetic
ctctactactactagccagtaagctagctaactaactacgtgctatggcccccaccgtgatggcctcctcggccacctccgtggctccattccaagggctcaagtccaccgccggcctccccgtcagccgccgctccaccaactcgggcttcggcaacgtcagcaatggcggaaggatcaagtgcatgcaggtgtggccaattgagggcatcaagaagttcgagaccctatcgtacctgccaccactcaccgtggaggatcttttgaagcagatcgagtacctgcttcgatccaagtgggtgccttgtctcgagttcagcaaggttgggttcgtctaccgtgagaaccacaggtctcccggatactacgatggcaggtattggaccatgtggaagctgcccatgttcggctgcaccgatgccacccaggtgctcaaggagctcgaggaggccaagaaggcctaccccgatgcctttgtccgtatcatcggcttcgacaacgtcaggcaggtgcagttgattagcttcatcgcctacaagcccccaggttgcgaggagtctggtggcaactaagctaagatcaagcatcgcgctggtggattgctgcctataataatagtatgcagctttgttttgggctatattgatgatatatcaatatataatatgctatatatttttattttacagtttggttatgtaccatctcaatggcctctgctcttaacacatatgtaataatctcttccctccctctccgaccgggtttattgtaagagtactacaattatcgttgggtgaggatatgt

SEQ ID NO: 5036 - DNA, 561 bp, Artificial; identical to SEQ ID NO: 1711
  Synthetic

SEQ ID NO: 5037 - DNA, 625 bp, Artificial
  Synthetic
gaattctgccatgcatgtgtaagtatgaactgattcagactgtgaaactgcgaatggctcattaaatcagttatagtttgtttgatggtacttgctactcggataaccgtagtaattctagagctaatacgtgcaacaaaccccgacttctggaagggatgcatttattagataaaaggtcgacgcgggctttgcccgttgctcagatgattcatgataacttgacggatcgcacggcctttgtgctggcgacgcatcattcaaatttctgccctatcaactttcgatggtaggatagtggcctactatggtggtgacgggtgacggagaattagggttcgattccggagagggagcctgagaaacggctaccacatccaaggaaggcagcaggcgcgcaaattacccaatcctaacacggggaggtagtggcaataaataacaataccgggctcttcgagtctggtaattggaatgagtacaatctaaatcccttaacgaggatccattggagggcaagtctggtgccagcagccgcggtaacacccccggatactacgatggtcgttactggacaatgtggaagctacccatgttcggttgtaccgacgcttcccaggttatc

SEQ ID NO: 5038 - DNA, 689 bp, Artificial; identical to SEQ ID NO: 1851
  Synthetic

SEQ ID NO: 5039 - DNA, 698 bp, Artificial
  Synthetic
gaattcaaggtcgacgcggactttgcccgtgggtcagatgattcatgataacttgacggatcgcacggcctttgtgctggcgacgcatcattcaaatttctgccctatcaactttcgatggtaggatagtggcctactatggtggtgacgggtgacggagaattagggttcgattccggagagggagcctgagaaacggctaccacatccaaggaaggcagcaggcgcgcaaattacccaatcctaacacggggaggtagtgacaataaataacaataccgggctcttcgagtctggtaattggaatgagtacaatctaaatcccttaacgaggatccattggagggcaagtctggtgccagcagccgcggtaattccagctccaatagcgtatatttaagttgttgcagttaaaaagctcgtagttggactttgggttgggtcgtccggtccgccctttgggtgtgcaccggtcgtctcgtcccttctaccggcgatgcgttcctagccttaattggccgggtcgtgcctccggtgctgttactttgaagaaattatagtgctcaaagcaagcccaagctctccagcaacggtggaagagttaactgcatgcaggtatggccaccaagtggtttgaacaagtgtgagaccctctcataccttcctccatcgaccgtcgagcaattgtcaaaggaagt

SEQ ID NO: 5040 - DNA, 293 bp, Artificial; identical to SEQ ID NO: 1706
  Synthetic

SEQ ID NO: 5041 - DNA, 611 bp, Artificial; identical to SEQ ID NO: 1705
  Synthetic

SEQ ID NO: 5042 - DNA, 654 bp, Artificial
  Synthetic
atggcttcctcagttatgtcctcagctgccgctgtttccaccggcgccaatgctgttcaagccagcatggtcgcacccttcactggcctcaaggccgcctcctccttcccggtttccaggaaacaaaaccttgacattacttccattgctagaaatggtggaagagtccaatgcatgcaggtgtggccgccaattaacaagaagaagtacgagacactctcataccttcctgatttgagcgtggagcaattgcttagcgaaattgagtaccttttgaaaaatggatgggttccttgcttggaattcgagactgagcatggattcgtctaccgtgaacaccaccactcaccaggatactacgatggcagatactggacgatgtggaagttgcccatgttcgggtgcaccgatgccactcaggtcttggctgaggtagaggaggccaagaaggcttacccacaagcctgggtcagaatcattggattcgacaacgtccgtcaagtgcaatgcatcagtttcatcgcctacaagcccgaaggctattaaaatctccatttttaggacagcttaccctatgtattcaggggaagtttgtttgaattctcctggagaaactgttttggttttcctttgttttaatcttctttctattat

SEQ ID NO: 5043 - DNA, 736 bp, Artificial; identical to SEQ ID NO: 1704
  Synthetic

SEQ ID NO: 5044 - DNA, 736 bp, Artificial
  Synthetic
ccccccccgaatattcagcaatggcttcctcagttatgtcctcagctgccgctgttgccaccggcgccaatgctgctcaagccagtatggttgcacctttcactggcctcaagtccgcaacctccttccctgtttccagaaaacaaaaccttgacattacttccattgctagcaacggcggaagagttcaatgcatgcaggtgtggccaccaattaacaagaagaagtacgagacactctcataccttcccgatttgagccaggagcaattgcttagtgaagttgagtacctgttgaaaaatggatgggttccttgcttggaattcgagactgagcgtggattcgtctaccgtgaacaccacagctcaccaggatattatgatggcagatactggaccatgtggaagttgcccatgttcgggtgcactgatgccactcaggtgttggctgaggtcgaggaggcaaagaaggcttacccacaagcctgggttagaatcattggattcgacaatgtccgtcaagtgcaatgcatcagtttcatcgcctacaagccagaaggctactagaatctccatttttaaggcaacttatcgtatgtgttccccggagaaactgttttggtttttcctgcttcattatattattcaatgtatgtttttgaattccaatcaaggttatgagaactaataatgacatttaatttgtttcttttctaatatatgcttttgtaacttgt

SEQ ID NO: 5045 - DNA, 737 bp, Artificial
  Synthetic
cccacgcgtccggcaaaagctaaataattaattgcaacaatggcttcctctgtgatttcctcagctgctgccgttgccaccggcgctaatgctgctcaagccagcatggttgcacccttcactggcctcaaatctgcttcctccttccctgttaccagaaaacaaaaccttgacattacatccattgctagcaatggtggaagagtccaatgcatgcaggtgtggccaccaattaacatgaagaagtacgagacactctcataccttcctgatttgagccaggagcaattgcttagtgaagttgagtatcttttgaaaaatggatgggttccttgcttggaattcgagactgagcgtggatttgtctaccgtgaacatcacagctcaccaggatactacgatggcagatactggaccatgtggaagttgcccatgttcgggtgcactgatgccactcaggtgttggctgaggtcgaggaggcaaagaaggcttacccacaagcctgggttagaatcattggattcgacaacgtccgtcaagtgcaatgcatcagttttatcgcctccaagccagaaggctactaaaatctccatttttaaggcaacttatcgtatgtgttccccggagaaactgttttggttttcctgcttcattatattattcaatgtatgtttttgaattccaatcaaggttatgagaactaataatgacatttaatttgtttcttttctaatga

SEQ ID NO: 5046 - DNA, 1878 bp, Artificial
  Synthetic
gaattcaaaagctcgtttgattctgatttccagggcgaatacgaaccgtgaaagcgtggcctatcgatcctttagatcttcggaatttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgacagtgccgcgatagtaattcaacctagtacgagaggaaccgttgattcacacaattggtcatcgcgcttggttgaaaagccagtggcgcgaagctaccgtgtgcaggatttgacgccagaggattcgtgtacagagaacacggtaacacccctggatactatgatggtcgttactggacaatgtggaagttacccatgttcggttgtaccgacgcttcccaggttatcaaggagctagaggaggccaaggctgcttacccagactcattcatcagaatcatcggattcgacaacgttcgtcaagtacaatgtgttagtttcatcgcatacaagccagacagtactgcctactgaaaacctttgatgaattagttcatacttacatatgcttgtctcaaagattaagccatgcatgtgtaagtatgaactaattcagactgtgaaactgcgaatggctcattaaatcagttatagtttgtttgatggtacttgctactcggataaccgtagtaattctagagctaatacgtgcaacaaaccccgacttctggaagggatgcatttattagataaaaggtcgacgcgggctttgcccgttgctcagatgattcatgataacttgacggatcgcacggcctttgtgctggcgacgcatcattcaaatttctgccctatcaactttcgatggtaggatagtggcctactatggtggtgacgggtgacggagaattagggttcgattccggagagggagcctgagaaacggctaccacatccaaggaaggcagcaggcgcgcaaattacccaatcctaacacggggaggtagtgacaataaataacaataccgggctcttcgagtctggtaattggaatgagtacaatctaaatcccttaacgaggatccattggagggcaagtctggtgccagcagccgcggtaattccagcaacggtgggagagttaactgcatgcaggtatggccaccatccggtttgaagaagtttgagaccctctcataccttcctccattgaccgtggagcaattatcaaaggaagttgactaccttctccgtaatggatgggttccctgtttggaattcgacgccagaggattcgtgtacagagagcacggtaacacccccggatactacgatggtcgttactggacaatgtggaagctacccatgttcggttgtaccgatgcttcccaggttatcaaggagctagaggaggccaaggctgcataccctgactctttcatcagaatcatcggattcgacaacgttcgtcaagtacaatgtgttagtttcatcgcatacaagcccgagagcaccagctacgaacagtaaaagatgaacataatccaattcatttctgtgtctttttaatttttgttttttgttttaatttgttttcctaattcggttttagcgagttatattattcgtaatctttaaatggattcgagtgtatgagcaacgataataataatatcgtctaatccgattgtttttatttgtttatcacaatatatatgatgcataaatgatgataataattaaagattgcttttgaatt

SEQ ID NO: 5047 - DNA, 619 bp, Artificial
  Synthetic
cgtgactctgctctagcacctcaccaagcagaaagctagagagctagcaatggcgcccaccgtgatggcctcgtcggccacctccgttgctcccttccaggggctcaaatccaccgccgggctccccgtcagccgccgctccaacagcgccggcctcggcagcgtcagcaacggtggaaggatcagctgtatgcaggtgtggccgattgaaggcatcaagaagtttgagaccctgtcgtacctgccaccgctcacggtcgaggacctcttgaagcagatcgagtacctgctccggtccaaatgggtgccttgcctcgagtttagtaaggtcgggttcgtctaccgtgagaaccacaggtctcctgggtactatgatggcaggtactggaccatgtggaagctgcctatgttcggatgcactgatgccacccaggtgctcaaggagctcgaggaggccaagaaggcatatccagatgcatttgttcgcatcatcggcttcgacaacgtcaggcaggtgcagttgattagcttcatcgcctacaagcccccgggttgcgaggagtctggcggaaactaagctagttggcaagccagcaagctcactcgtgagctctataca

SEQ ID NO: 5048 - DNA, 664 bp, Artificial
  Synthetic
gccattacggccggggaagaaaaaaaagaacgaagaaagggagcaggcacgaaacgcagccgagcaacaactgaaagcgaggcttcttcagcttcagctcgactatgaatccaattcttcaaacgtgaagaaaataaagctgctaatcgtttcacgctttctggatataatattggaaactgaaacttgattacctaggatgaagaagcttctagaatttgggaggaaagcaatgttctatattagggttctttcaggctacgaagagcgtcgaatccgatcttatcgattacagatgcaacaacgccttaaacaggcggaggagaggaaggcagcaataaggaaggttcctgaacagatgatattgtcagaagttaggcgaatggtggaagagatgcaagctttgaagaagaagctagaggagactgaggctgctgttgatgactacttcaaaccaataaataaggaagcagaagcaatagtgaaaatgcagcttgaaggagaggagaatagaacaaaggagatgatgaatatcttgcagaaacaagcttttcttgagaagcatcagccagagaaactaataagcgcagaaaatgtggtcacagaaaaacatggccaagataaagcatctacatagattccaccagaagtaagatgcttttgt

SEQ ID NO: 5049 - DNA, 427 bp, Artificial; identical to SEQ ID NO: 4241
  Synthetic

SEQ ID NO: 5050 - DNA, 402 bp, Artificial; identical to SEQ ID NO: 4243
  Synthetic

SEQ ID NO: 5051 - DNA, 272 bp, Artificial; identical to SEQ ID NO: 4245
  Synthetic

SEQ ID NO: 5052 - DNA, 433 bp, Artificial; identical to SEQ ID NO: 4244
  Synthetic

SEQ ID NO: 5053 - DNA, 504 bp, Artificial; identical to SEQ ID NO: 4242
  Synthetic

SEQ ID NO: 5054 - DNA, 567 bp, Artificial; identical to SEQ ID NO: 4247
  Synthetic

SEQ ID NO: 5055 - DNA, 448 bp, Artificial; identical to SEQ ID NO: 4246
  Synthetic

SEQ ID NO: 5056 - DNA, 350 bp, Artificial; identical to SEQ ID NO: 3188
  Synthetic

SEQ ID NO: 5057 - DNA, 625 bp, Artificial; identical to SEQ ID NO: 2340
  Synthetic

SEQ ID NO: 5058 - DNA, 717 bp, Artificial
  Synthetic
gcttcctcttaattccaattcagcctctctgtttagtaacgcattcacaatgtctggacctggcgtcggcttcgagtatcctcctcagtccgtttcttggctgaagcgcgatgtgcttctcttcgccaactctatcggcgctactgctgacgagcttcacttcctctacgaactccaccccaactttgccgtcttccctacttaccctgtcatcctgccgttcaagggcgacacacaggaagtgattgacttctacgcctcccagaagaagatcaaggtccctggcgtccccgacttcgactcccgccgcgtcgtcgacggccagcgaaagattgagttcctcaagcccctgcccgtctcctccgagggccacaagttcgagatccgccaaaaggtcctcggcgtctacgacaagggccgtcccggctccgtcgtcgacacccagctcgagctcgtcgacgccaacaccaacgaagtctacacccgtctcttcggcagcgccttctacgtggcccagggcaactggggcggtcccaagggccctgccaccgagaacttcccccctcccaaggacaagaagcccgactgggtgttggagaaccagatctccagggaggctgctcacctgtaccgtctgaatggcgactacaaccccctgcacgccacccccgagcctggtgtcaagatgggcttcccaggcgccatcatgcacggtct

SEQ ID NO: 5059 - DNA, 289 bp, Artificial
  Synthetic
ggcgcccaggagcaatgtctcagggcccaacgaatgtgcggtgaacgagctgctactgcaccgccgattgtctgatgcaagcaagggagttgtttgtttgctccatccttgattcactttaatgcttgttattaggtactttaagagccaggttgaaagggtactttgcaagtgcttaaatctccattctgccttatactccatgcctgtaattgtatagtagcaccagggtaagccagcaataccgcaagctggcagtatcaatcgccatttttctctacaaaaaaag

SEQ ID NO: 5060 - DNA, 781 bp, Artificial; identical to SEQ ID NO: 2625
  Synthetic

SEQ ID NO: 5061 - DNA, 583 bp, Artificial; identical to SEQ ID NO: 688
  Synthetic

SEQ ID NO: 5062 - DNA, 605 bp, Artificial; identical to SEQ ID NO: 2377
  Synthetic

SEQ ID NO: 5063 - DNA, 265 bp, Artificial; identical to SEQ ID NO: 2390
  Synthetic
  misc_feature (85)..(85): The residue at this position can be any nucleotide.

SEQ ID NO: 5064 - DNA, 479 bp, Artificial; identical to SEQ ID NO: 4450
  Synthetic

SEQ ID NO: 5065 - DNA, 826 bp, Artificial; identical to SEQ ID NO: 2413
  Synthetic
  misc_feature (633)..(633): The residue at this position can be any nucleotide.

SEQ ID NO: 5066 - DNA, 456 bp, Artificial; identical to SEQ ID NO: 2434
  Synthetic

SEQ ID NO: 5067 - DNA, 686 bp, Artificial; identical to SEQ ID NO: 2436
  Synthetic

SEQ ID NO: 5068 - DNA, 559 bp, Artificial; identical to SEQ ID NO: 2438
  Synthetic
  misc_feature (518)..(518): The residue at this position can be any nucleotide.

SEQ ID NO: 5069 - DNA, 829 bp, Artificial; identical to SEQ ID NO: 2437
  Synthetic

SEQ ID NO: 5070 - DNA, 713 bp, Artificial; identical to SEQ ID NO: 2440
  Synthetic

SEQ ID NO: 5071 - DNA, 634 bp, Artificial
  Synthetic
ttgaagagtggccattactgctattctctctcctctctcctctctcctctccttgctgagcattggcccagacgtgtcctcttcccttcagaatgtctgttttaccacactccatggctgattcttcagtttcaatccttgtgaaactggctcttctggcgcagaaatttacagggttaaagtcaagtgcttttcttggtcagcaagttggccaaccacaaatgagcatgccgttggtagttcaatgcaaagaaaatggtggaagcagaatttcaaatggctctcgccacacatgtttccaggtttgagaaggtgacaatggccgcaccagatccgattcttggtgtcaacgatgcttttaagctagacaagaacgaattgaagttaaatcttggtgttggagcatataggaccgaagagcttcagccttatgttttaaatgtggtgaaaaaggctgaaagacttctgctggagaaaggtgaaaataaggagtatcttcctattgagggtctcgcggctttcaacgaagcaactgctagcttgattttcggagcagatagtcctatcattaaagaaggcagagtagcaacagtgcaaagcctctcaggcacttgttctcttcgacttgcagctg

SEQ ID NO: 5072 - DNA, 688 bp, Artificial
  Synthetic
cccacgcgtccgctccctcaacaaatatcacacttccattacatctttgaagttcttttcattcattttatcaaaatgacaaattcctccaattctgtttttgcccatgttgttcgtgctcctgaagatcccatcttaggagtcacagttgcttataacaaagataccagcccactgaagttgaatttgggtgttggcgcatatcgcactgaggaaggaaagccccttgttcttaatgtggtgagacgggctgaacaaatgctcgtcaatgacacgtctcgggtgaaggagtatctctcaattactggactagcggattttaacaagctgagtgcaaagcttatatttggtgctgacagccctgccattcaagagaacagggtgactactgttcagtgcttgtcgggcacaggttctttgagggttggggctgagtttctggctaagcattatcatgaacgtactatatatataccacagccaacatggggaaaccatccgaaggttttcactttagccgggcttttagtaaaatattaccgttactacgacccagcaacacgaggcctggatttccaaggacttttggatgatcttgctgctgcacccgctggagcaatagttcttctccatgcatgtgctcataacccaactggcgttgatccaacaaatgaccagtgggagaaaa

SEQ ID NO: 5073 - DNA, 667 bp, Artificial
  Synthetic
aaaaaaggaaagttagcaagcaaaggtttcgtactgtcaaaatgaacatgtcacaacaatcaccgtcaccgtccgctgaccggaggttgagtgttctggcgagacaccttgaaccatcgtcctgcgccaccgtcgaatcctctatcgtcgctgctcctacctccggaaatgctggaaccaactctgtcttctctcacatcgttcgcgctcccgaagatcctattcttggcgtcactattgcttacaataaagatagcagccccatgaagttgaatttgggagttggtgcatatcgcacagaggaaggaaaacctcttgttttgaatgttgtaagacaagcagagaagctactagtaaatgacaggtcccgcgttaaagagtacctatctattactggactggcagacttcaataaattgagtgctaagctgatacttggcgccgacagccctgctattcaagagaacagagtaacaactgtccagtgtttgtctggcacaggctcattgagggttggagctgaatttttggctcgacattatcatcaacgcactatttatattccccaaccaacatggggaaaccacccaaaagttttcactttagctgggttatcagtaaagagttaccgctactatgatccagcaactcgtggactcaattttca

SEQ ID NO: 5074 - DNA, 609 bp, Artificial; identical to SEQ ID NO: 2845
  Synthetic

SEQ ID NO: 5075 - DNA, 236 bp, Artificial; identical to SEQ ID NO: 4346
  Synthetic

SEQ ID NO: 5076 - DNA, 532 bp, Artificial; identical to SEQ ID NO: 2446
  Synthetic

SEQ ID NO: 5077 - DNA, 1227 bp, Artificial; identical to SEQ ID NO: 2445
  Synthetic

SEQ ID NO: 5078 - DNA, 636 bp, Artificial; identical to SEQ ID NO: 4344
  Synthetic

SEQ ID NO: 5079 - DNA, 983 bp, Artificial
  Synthetic
catggcgatccgagccgcgatttccggtcgttccctcaagcttagctcgtcggtaggagcgcgatctttgtcgtcgttgtggcgaaacgtcgagccggctcctaaagatcctatcctcggcgttaccgaagctttcctcgccgatcctactcctcataaagtcaatgttggcgttggagcttacagggacgacaatggaaaacccgtggtactggagtgtgtcagagaagcagagcggaggatcgctggtagtttcaacatggaatatcttcctatgggaggtagtgtcaacatgatcgaggagtcactgaagttagcctatggggagaactcagacttgataaaagataagcgcattgcagcaattcaagctttatctgggactggagcgtgccgaatttttgcagacttccaaaggcgcttttgtcccgattcacagatttatattcctgttcctacatggtctaatcatcataacatttggaaagatgctcacgtccctcagaaaacgtaccattattatcatcctgaaacaaaggggttagactttgctgcactaatggatgatataaagaatgccccaaatggatccttctttctgcttcatgcttgtgctcacaatcctactggggtggatcctacagaggaacaatggagggagatctcacaccagttcaaggtgaagggacattttgctttctttgacatggcctatcaaggatttgctagtgggaatccagagaaggatgctaagtctatcaggatatttcttgaagatggtcatccgataggatgtgctcaatcatatgcaaaaaatatgggactatatggccagcgagttggttgcctaagtgtggtttgtgaggatgaaaaacaagcagtggcagtgaaaagtcagttgcagcagcttgctaggcccatgtatagtaatccacctgttcatggcgcacttgttgttgctaccatccttggagatccaaact

SEQ ID NO: 5080 - DNA, 656 bp, Artificial
  Synthetic
ccctcgaccacgcgtccgcggacgcgtgggtttcatcgatcagttcttccctttctcttcggttccctgtaaaaccaaagcctccccatttttctcttctacccgagctttaagatggcttccacaatgttctctctagcttctgccgctccgtcagcttctttttccttgcaagataatctcaagtcaaagctgaagttggggacttctaaccaaagtgcctttttcgggaacgacttcgtgaaggcaaagtcaaatggtcgtactactatgactgttgctgctaacgtctctcgatttgagggaataactatggctcctcctgaccccattcttggagtttctgaagcattcaaggctgatacaaatgaactgaagcttaaccttggtgttggagcttaccgcacggaggagcttcaaccatatgtcctcaatgttgttaagaaagcagaaaaccttatgctagaaagaggagataacaaagagtatcttccaatagaaggtttggctgcattcaacaaagtcacagcagagttattgtttggagcagataacccagtaattcagcaacaaagggtggctactattcaaggcctgtcaggaactgggtcattgcgtattgctgcagcactgatagagcgttacttccctggctc

SEQ ID NO: 5081 - DNA, 763 bp, Artificial
  Synthetic
atctagtcatctcacgacatttgactaacgactctatttattaacctgacggtgcaccccaacccagtaacacgttactaactaccccgtctctatcaccacgtgactctgaaccaaatctttggctttattttcacgttcccaacacaaaatccaaaccgccaatcaccccatctttttaatcagcaactctcccctcaacactacggttttcgaagtagttatttattcatatttataatgtcatactttgcatcagtccccgcagctcccgcagatgcccttttcggcctcatggccaagtacaaggccgataccttcgacaagaaggtcgacctcggagtcggagcctaccgagataacaccggaaaaccctgggtcctccctgtcgtctccaaggtcgattctctgattgtcgccgaccccactgccaaccacgagtacctccccatcactggtctgccagacttcaccaagtctgccgccaagctgattctggggcctgactctcctgccatcaaggagaaccgagttgcctcttgccagacaatctctggaactggagcaaaccatctgggatctctcttcctgtcgcggttcccctcctccgccgctccccccaagagcgtcttcctcagccgttctcccccttcccctggagcaaccggagatactcctccccgagctgctggcggccgaatctggatctccaaccccacctgggccaaccacaagcagatcttcgagaacgtcggtctgaccg

SEQ ID NO: 5082 - DNA, 826 bp, Artificial
  Synthetic
gatcagctatggagagcgtggcgctcaagcgagtttctgctgtagccaaccatctcaatcccgagcagcagcagcagcagcagcagcagcaactctccatggctgtcgccgccagcgccggcgcctcttcggtgtttgatcatctggagcaggcgcccgaggatcccattctgggaataactgtggcatacaacaaggaccctcatcccgggaaagtgaaccttggagtcggagcttaccgcacagaggaagggaaaccccttattttgcatgtggttcatcgtgctgaggaacgtcttctagctgatcgctccagaaacaaggaatacttgtcaatcactgggctggcagactttaacaagcgaagcgcgacgctcattcttgggagcgatagccctgctatcgtggagaagagattggtaactgcgcagtgcctttctggaacgggttccttgcgtgtaggagccgagtttctttcaagacattatggtgtgaagctggttttccttcctaccccgacgtggggaaatcacttcaaggttttcatgaatgctggacttggtgttaagacgtatcgttactatgacagcaaaactcgtggtcttgactatgagggtatgctcgaggacataagtgcagctccgaccggatcggttattctcttgcatgcatgtgctcataatcccactggcgtggatccgacaccgcagcagtgaaggaatccgtcagacaattcggaagcgaggacacttgccatttttcgacagcgcgtatcaggggttcgccagcgggagtttggacagggatgcgctcgcggttcgaagct

SEQ ID NO: 5083 - DNA, 583 bp, Artificial; identical to SEQ ID NO: 2847
  Synthetic

SEQ ID NO: 5084 - DNA, 579 bp, Artificial; identical to SEQ ID NO: 2846
  Synthetic

SEQ ID NO: 5085 - DNA, 1099 bp, Artificial
  Synthetic
gctagcgggcttgtcaggaacgcggggaagcgattcatgtctactgcggcggcggcttcggcatcgtcggctccagctggagctcgatccggatggtgggaagccgtgcagccggcgccgcgggatccgatcctcggcgtcactgaggcttttctcgccgattccgatcccaaaaaggtcaatgttggcgtgggcgcgtataggaacgatgagggcaagccggtcgtgctggaatgcgtccgcaaggccgagcaaatcattgctggcaagcaaaatatggaatatcttccaatgggaggccttgtgaagtttaatgatctctccgtcaagcttgcctatggcgactccgctccagttcttgaggagaagcgagtggccgcggtccagacgctctctggaactggtgcttgcagacttttcgctgatttccagaagcgattcaagccagactcacgcatttacatcccggttcctacctgggccaaccatcataacatttggagggatgcccgagtcgaggctcacactttccgctactacaagccaagtacgcggggattggacttcgaagggtttgtggaagatctgaaaaaagcgccggagggatctttcgtcctgctgcatgcttgcgctcacaaccccaccggagttgaccctaccgccgagcagtggaaggaaatttctcagcttttcaagagcaatggactcttcccgttcttcgacatggcttaccaaggattcgcgagcggtgacactgtcagggatgctcaggcaatccgcatcttcatggaagatggacatcagctggcctgcgcacagtcgtttgccaaaaacatgggcctgtatggacaaagggtcggatgcttgagtgtcgtctgcgacaacccggaacaggctgtgaacgtaaagagtcagctgcagcaaattgctcgtccaatgtacagcaatccaccgcttcacggggctcagattgtcaccaccgtgttgagcgacccggagctcaaggagatgtggtacaaggaagtcaaggtcatggcggacaggatcattggaatgcgcgacgctctaaaagccaacttggagaagcttggctcgaagc

SEQ ID NO: 5086 - DNA, 668 bp, Artificial
  Synthetic
tggtgttaaggttctgatttcgtctcctacatgggggaaccacaagaacatcctgagtgacgcaggcgtgccatggtcagagtacagatactttgatcctcagactgttggactggatttcaacggcatgattgaagatatcaaggctgctcccaaaggctcggtgatattacttcacggttgtgctcacaaccccaccggcatcgacccgacaccagaacaatgggatgcaattgccgatgtgctcgaggagaaaggccatatgccattctttgatgtcgcataccagggattcgcgagtggaagtctggatgaggacgcgaactccgtcaggaagtttgccagtcgtggtttcgagatgttcgtcgcgcagtcttacagcaagaaccttggcctgtatgcggaaagaattggtgcgattaacgttatcctgccaaccgcagacctggcgacaagagtaaagagccagcttaaacgactggcaaggcctatgtactcgaatcctccagtccatggagcacgcattgttgccaacgtcgtcggcgactcggttttgttcgacgagtggagagccgagatggagatgatggctgggaggatcaagggtgtgaggcagaagctctacgaggcactgtcgacgaaggacaagagcagcaaagactggtcct

SEQ ID NO: 5087 - DNA, 73 bp, Artificial
  Synthetic
aatctcgttcccaatcaactccgtctgcctctctcgcccgcatcaacaaacattgcgagccacatctctccac

SEQ ID NO: 5088 - DNA, 610 bp, Artificial
  Synthetic
cggcggatcgccgggagcatgaacatggagtaccttccaatgggtggaagcataaagatgattgaagaatcacttaaactggcctatggggagaactgtgagttcatcaaggacaagaggatcgcagcagtgcaggctctttcaggaactggtgcatgtcgcctctttgcagatttccagaagcgtttcttgccagattcacagatttatatacccacacctacatgggccaaccatcacaatatttggagggatgcccaagtaccacaaaagacatttacctattaccatccagagtcaagaggacttgactttgcaggcctaatggatgatatcaagaatgctccagatggttcattctttttgcttcatgcttgtgcgcataatcccactggagtagatccttcagaggaacaatggagggagatatctcatcagttcaaggtgaagaaacattttccattcttcgacatggcataccaaggatttgctagtggtgatccagagagagatgccaaggcaattcgaatatttcttgaagatggacatcaaattggatgtgcacagtcatatgcgaaaaacatgggactttatggacaaagagcaggat

SEQ ID NO: 5089 - DNA, 571 bp, Artificial; identical to SEQ ID NO: 4343
  Synthetic

SEQ ID NO: 5090 - DNA, 676 bp, Artificial; identical to SEQ ID NO: 2450
  Synthetic

SEQ ID NO: 5091 - DNA, 488 bp, Artificial
  Synthetic
gtctctccactacttcccccccatcaagccctccgcccttgccgtcggcaccatcttctcccacttctcctctttgattggtttcgcccccgtcattggcgacaccatcaagcgagccaaggccgctgacacccccgaggagtttgcccgacagaaggagaacaacggcgtcctcgccctctacggatcttctctgctcggctccggtctgcagtcttacgccgtgtcggccctgattgtcctcaccggcaccaccaccactaagggtgctgcctacctcggaggtctcatcttcgccgtcaactccatccccaccctcgtcaccggaatcttccaggagaaccgacccgtcgagtacctcgttggcaagaccctctctgctctgctggagaccgttggtcttactctcactctgaactggtggggaacccgaaacgagactctttctctcgccaagtaagctgtatattaatgcattatgatgattc

SEQ ID NO: 5092 - DNA, 302 bp, Artificial; identical to SEQ ID NO: 2453
  Synthetic

SEQ ID NO: 5093 - DNA, 531 bp, Artificial
  Synthetic
tcgacccacgcgggcgcaacaacatccactcagctggccctctggcttcacctcggaacccgattgtcagctccgccaatccagccatggttcggctgcccaaccaccctcaaattagaaatactcaggcccagcagcatgtcgcgcaataccatcagcacccatcctccgcaccagccacgccagccgcaagcataatactaaatagacagtttgagagctcagcgggcccggccacaaagagagggccgcggtccattacagggcccggaaatctgccgacaacgtcaagcggcttagcgagacattcatcccttggtcctggtatacctaagagcggctctggagctaatctgggagccggcggtgctgtccgggcaggaagtgctggaccgagagcaggatcggtcaaaggggtagttggagtagcgggtcgcagaggcaccccgacgatgagtggtcggaagaagccacccaacagatcgtcactttcccgggtgaagacggcctcaaacagaaattcgccggcat

SEQ ID NO: 5094 - DNA, 698 bp, Artificial; identical to SEQ ID NO: 4238
  Synthetic

SEQ ID NO: 5095 - DNA, 787 bp, Artificial; identical to SEQ ID NO: 2469
  Synthetic

SEQ ID NO: 5096 - DNA, 723 bp, Artificial
  Synthetic
atcatctaattcaagtatgtcatatcccgcggtgtgtgatgcgatgtgatgtgattgactgatgctgatctttgtcgattgttttacttgtagcaaactcaagtataacttatacctactatttatacctactcaacagtatactcgaccttgtccaacaaaatcaaaacaaaacaacaaccgaggcaaatcaaataacaaactacctcaaaaatggactcttcaccaccaacaaccccaaccaaaactcaacaatcacaaaacctccagcaatcttctcctcacccccaagactcctcccccgcctgccaatccgccatcaaacactcctcatcgtggaagcccagctcgctcgaccgccgcctcagctggagctcccaggaccagaagcacgcgctgcagatgagcggcattgacggcgtgcagtcgggacaccagggctttacggagcgatgaatgcctttccatccagtcggggtctttctttctttttttattctatggagagaaggtgtagattgggaatgaaagagggggaaagaagatgaattcataaaactctatatgagcgtggttttcttcttcttctttctttctcttttcaatgatttgatgaaacaaaagggctattgggaaaatttgggaaattgggtcactggcattgcatggcaacggagcgaaaaagaaaaaaacaataggcataatgcacgcgactttgtgtgt

SEQ ID NO: 5097 - DNA, 162 bp, Artificial
  Synthetic
gtgggaacccgcggcctcagcgagcctaacatcgttgttggcgctgcgttcggctatggcggtctcgttcagcttttggctggcatgtgggaaatcgctctcggcaacaccttcggtgccactgctctttcatcttacggtggtttctggatcggaacagct

SEQ ID NO: 5098 - DNA, 1232 bp, Artificial
  Synthetic
ataaatagtagctgcttgttgtgaagcactgctttcatcaaaacaagtactctccaatcacatctggtgttcgaacaaggtcaccacccaacaacatttcgcatattccatcaggtcgatcgattcccaagtccgacaatcaccatggctgacgaaaccgtcaacatcgctcccaatgagaaggagaccaacggtgtccagcagcagacggcggtaccgcgccagggcttcacacacaaccaccacagcgacttcaatgagatgaccattggccagtatgctcaggcttttggtggtgctctccaacccggggcatggaggccatatgagcaccgcaagctcgccaaccccgcccctctgggtctttctgctttcgccttgactacctttgtcctctccgccatcaacatgcacgctcgaggagtctcggcccccaatgtcgtcgtctctctcgcctttggttatggcggtcttgttcagctgcttgctggcatgtgggaggttgctgccggtaacacctttggtgctactgctctgggttcatatggtggtttctggatctcatacggtattctcttgacccccgaatggggcatcacggctcctgatggcccgtacgagggcaacgttgctagcgtgcttggcttcttcctgactggctggttcatcttcaccactgtgcttctgctctgcaccctgcgatccactgttgctttcttcctcctcttcttcttccttgacctggcctttttcttcctcgccatggagcaatacgctgccgacttgggcaacgcgaccgcttccctggctctgcagaagaccggtggtctctttggtttcttggctgctttcgcggcttggtacaatgccttggccggtatccaggacagcagcaactccttcttccaggttcccgtcatccacttcccctggtccgaggccgctcgtgagcgccgtgccagcaagtctgagcgtgctcaggcataaatttcgtctttggaagtgtgatctgttcttggttatgatgagcgatgttgggaaaaggaatgatacctgagtgaagcgagcgcgcggttcctagcgggctgggctgcgagtaagaatgaatacaactgggccttttttctttttttatctggttaacaaacgttattgcgatgtaatacaggaagctgcataccagctgctgatatacctattaatgaaaaaaaaaaaacaaaaacaaaacaccc

SEQ ID NO: 5099 - DNA, 591 bp, Artificial
  Synthetic
gccctcttctacaaccatgaacaccgaaatccccgatctcgaaaagcagcagattgaccacaactctggctctgacgacccccagcctatccacgacgatatggcccccgtgtctcgaatccgatcctctggacccaaccacgagtacattcatattgccgaccagaagttccacagagacgacttctacagggcctttggtggtaccctgaaccccggtggagctccccagccttcccgaaagttcggtaaccctgctcctctcggtctgtctgcctttgccctcactactcttgttttctcgctgtgcaccgtccaggctcgaggtgtccccaaccccagcatcgccgttggccttgctctgttctacggaggtgtctgccagttcgctgccggtatgtgggagtttgtccaggagaacacctttggtgctgctgctcttacttcgtacggaggtttctggatgtcttgggctgctattgagatgaacgcatttggaatcaaggactcttacaacgaccctattgaggttcagaacgcggttggtatttatctgtttggatggttcattttcactctcatgctcactct

SEQ ID NO: 5100 - DNA, 106 bp, Artificial
  Synthetic
aaaatcgctcccaatgaaaaagagaccaaaggtgtccagcatcagaagggggtaccgcgccagggcttcacacacaatcaccacagcgacttcaatgaaatgacca

SEQ ID NO: 5101 - DNA, 126 bp, Artificial; identical to SEQ ID NO: 2475
  Synthetic

SEQ ID NO: 5102 - DNA, 685 bp, Artificial; identical to SEQ ID NO: 2505
  Synthetic

SEQ ID NO: 5103 - DNA, 249 bp, Artificial; identical to SEQ ID NO: 2598
  Synthetic

SEQ ID NO: 5104 - DNA, 411 bp, Artificial
  Synthetic
gcaacctaagcgcacctagatatcatggcggacaacactaaccccggaaactttgccaaccggtatgatatcaacagcggttttaaaagtaaatcattgaccaattgttgttagccccaaggaggaagtgcagtcgattgcatccaagggtggacaggcgagtcaccagggcggcttcgcttccatggatcctgacaagcagcgcgagattgcgtccaagggcggccaggcctctggaggatcttttgagcccggaagcaagaaagctcaagaggcgggccgcaagggtggtttgcagtaaagcatgaccgtaactctagtgtcgattcactggtagacggtgtgattatctcttattgtagataaacatacactagcaattttgctctaatacaaactaattggtcctac

SEQ ID NO: 5105 - DNA, 1027 bp, Artificial
  Synthetic
acatttcgaacacacaacacaatgcacagaacatactctctccgaaacagcagagctcctaccgctgctcagctcgcctcccctcctcctcccacctcttctactaagagcggacgattcttcggcaatggttccattgtccactctttccgacgatccgccgccggctccatgggccccgatctcgcccgaaagctcgcccagctcgtcaagatggagaagaacgtgatgcgatccatcgagcagcaggcccgagagcgacgagaggttgccaagcagctgtctctctggggtgaggacgctgacgaggatgtctccgacgtcaccgacaagctcggtgttctcatctacgagattggtgagctcgaggaccagttcatcgacaagtacgaccagtaccgaatcaccctgaagtccgtgcgaaacattgaggcttccgtccagccctctcgagaccgaaagcagaagatcaccgaccagattgcccacctcaagtacaaggagcccaactcccccaagattattgttcttgagcaggagcttgtccgagccgaggctgagtcccttgtcgctgaggcccagctctccaacatcacccgagagaaggtcaaggccgctttcaactaccagtttgacgccatccgagagcactccgagaagctcgctctgattgccggctacggtaaggctctgctcgagctgctcgacgacacccccgtcacccccggtgagtctcgacccgcctacgacggctacgaggcctccaagcaggtcatcatcgatgccgagaacgcccttgcaagctggactctggaccaggcttccgtcaagcctactctgtccatccgacgagctgacgttgacgactacgatgacgaggaagaggagggagccgagtgggccgaggacgagccttccgccgttgtggaggagggcaaggttcttgacgcctaagtctgccgtggaaaaggacatgctaatttttgttgaaaagtctcttttgtatttttaactactttttactact

SEQ ID NO: 5106 - DNA, 660 bp, Artificial; identical to SEQ ID NO: 2512
  Synthetic

SEQ ID NO: 5107 - DNA, 452 bp, Artificial; identical to SEQ ID NO: 550
  Synthetic

SEQ ID NO: 5108 - DNA, 632 bp, Artificial
  Synthetic
aacagaggatggacacctactacatatcccatggctcccccatgctccccctgcagtcctctgcggatgcccacggcttcctctcccgctggcgggaggtcaacctccccgacaagcccaccgccatcctctccatctccgcccattggtacacctctgagcccctcatcaactctgtcgcgaaaaacgacaccatccacgacttctatggcttccctcccgagctctacactctacaatacaatgctcctgggtctcctgcccttgctcaaagagtgaaagagctgctcaaatctgcggggttcaaatcggtacgggaggaccccaagagagggttggatcatggtgcttgggtgccactttacctcatgtatcctgaggctgatataccagtcgtccaactatctgtgcaaccacacaaagatggtgcccatcatttcaaaatggggcaagccttggcacccctcagggatgagggtgtccttataatgggatctggaagtgctacccacaatcttcgagctttggacttgagcaatggacctccccctgcttgggccctgtcttttgacaattggctcaatgactctctaatcaatggaaggtttgaagatgtgataaattatgaaaag

SEQ ID NO: 5109 - DNA, 313 bp, Artificial; identical to SEQ ID NO: 2516
  Synthetic

SEQ ID NO: 5110 - DNA, 567 bp, Artificial
  Synthetic
gggcctttgaaattgaaggagacgttcttcatatcacatggttcccctacgctttccatagatgagtctttgcccgccaggcacttcttaaaaggctttagagaaagatttttaaatcaaaagccgaatgcgatattgatgatttctggtcattgggaaacttctgaaccaactgttaattctattcgtggccgccatgataccattcatgacttctacggcttccctaaacccatgtaccagctcaaataccctgcaccaggagctccagaattggctaaaagggtgaaggaagttctcatggcatcagggttcacgacagtgcatgaagacaaaaaaacgtggtttggaccatggtgcatgggtccctctgatgctcatgtacccggaagcagatattccagtctgccagctctcggtccagcccaatagggatggtacttatcactacaacatgggaagagcattggcctccctcaaggatgaaggtgtcctcataattggttctggatcagccactcacaacctaagggctctcggttcatccaaaagtgttgtttcttgggc

SEQ ID NO: 5111 - DNA, 585 bp, Artificial
  Synthetic
ggggtccacagcacaggtaataacaattgggccattccgccgccatatcgccagcctgctgcaggggggcagcagcagcagcagcaacaacaacaggagcagcagcgtccgcagcggcagcaacatgatgatggacgtgctctatgtgtctcacggctcacccatggtgccttttgaggagatcccagtcagggacttcttgaagggcatggccgggctggtcaagagcaggcccaaggcaattctcatggtgtctggccactgggagacacgggaaccgacggtgactaccacagcgcgaaaccccacgattcacgacttctatggcttccctcgcgagctctacgagctcaagtatgatgcgcctggtgctccggacgtagccaagcgagcaaagcagcttctctacgacgccggattcaagcaagctggcgaagatcccacacgaggcctggatcacggcgcctgggttccactgtcgctggcgtttccagccgctgacattccagttttccagttgtctctacagtctcacaaggacgctgcctaccactaccagctaggccgtgcattggctccgctcac

SEQ ID NO: 5112 - DNA, 631 bp, Artificial; identical to SEQ ID NO: 2517
  Synthetic

SEQ ID NO: 5113 - DNA, 624 bp, Artificial; identical to SEQ ID NO: 2522
  Synthetic

SEQ ID NO: 5114 - DNA, 344 bp, Artificial; identical to SEQ ID NO: 2529
  Synthetic

SEQ ID NO: 5115 - DNA, 721 bp, Artificial; identical to SEQ ID NO: 2539
  Synthetic

SEQ ID NO: 5116 - DNA, 630 bp, Artificial
  Synthetic
gaaaaatggagctcaatgattagaaattatcaatacttcgtccaaagaaatggaggaagttgtttggaatccagcatgaaagaaaacaatagagagaggagggggataggagcgggccaaagtgcctcttatcttcaacttttaaaaattcaaaatttacagaagggagagctccccagcaggaacagttctcttgacaagtttagcccaagcttcgttggtttcagttattaccttcagagcataatccttgttggctgctttgttcccaagtccaaacttattggcaggctttccatctgggatcttgtagtctctgaaccaatctcttatagcagtgagagtgcccgggaaatgtttctcaacatcaccaacatcattgacgagtgaagcttttgggtcatccaacgaaatcgcaacaattttccagtcgagttctccttcgtcaatcatagccaaagcacctaaaggcttgactttaagaatctcgccaatttttccttgcctctccccaatttcaacaacatcaactggatcattatctccgaatggcccttcaacttcagaattagctactgtggggtcttcccatgtctgtgggagcaatcccatagttccaattgatgttgt

SEQ ID NO: 5117 - DNA, 615 bp, Artificial; identical to SEQ ID NO: 2541
  Synthetic

SEQ ID NO: 5118 - DNA, 603 bp, Artificial; identical to SEQ ID NO: 2540
  Synthetic

SEQ ID NO: 5119 - DNA, 643 bp, Artificial
  Synthetic
caaaaaggctccaggcatcgtctttgacaaggaggactacactgctcgctacaactggtcaattccgctacgttcatacgcggaagaaaaagaacatgtcgctaacagcaatcgcaacaacaatgcagacggctctgcaacgagcagaaacgatggatcccgcctctctaagccttctccagaaaggctcttcccacaattcctctcccaactatggagcctccggaacggtgacaagagggatattgcaagactatcaggcggtaccgaccagcgatgaaagcgatgccacccgtccgagaaaggtttcatacagcgatgcggcgaagaaggccgggaaccatgcgaagagccagagctctctgcggcaacgaaacggagtctccggctcggaggatacaagatcgccaacaaaagcaaagtcatcatggacgaaggaaacatttcgaaaatttcagtcccttcagttggaaaacaagggaagcgtggctagagatcacctggctctcgaacgcacatttctagcatggcttcgaacctctctcgcttttgcatcgattggcgtcgccgtgacgcagctattccgcctcaacactgataacgcttccgcctccgatttcgaccacacaaggctacaaaagat

SEQ ID NO: 5120 - DNA, 1098 bp, Artificial; identical to SEQ ID NO: 2551
  Synthetic

SEQ ID NO: 5121 - DNA, 397 bp, Artificial; identical to SEQ ID NO: 2554
  Synthetic

SEQ ID NO: 5122 - DNA, 476 bp, Artificial; identical to SEQ ID NO: 2555
  Synthetic

SEQ ID NO: 5123 - DNA, 522 bp, Artificial
  Synthetic
atccccggattcaacactcaatgccgcctccatgaacgactcgagcttcgtccaagcccaacagcgcgtcgctgagcgacgagcggcccgcgaggtcgaacaacgggcccgaatcgcggctcagcgcgaatcgtctcgcgtgaacaaccagctgcagcgtctgccataccccctcaatcgcctcgccggtgtctgggatgcagccgcctctatagaaaacacccggcctgcgtttcgcgttgcgcaggttgatgccgagctgctggatgaagagctgctggagctcctcaaggggcaggttggcgacgccctcagatactatgccggcgggcatctcaaagacgactggtcttccgagattcagctggcgctcagggccatcctgttcaaactgaccgtctgggataacgatgcaacgtacggagcggctctacaaaacctcaaatacaccgacgccagaaaagggggccccgtgctgtcacccccgacgaggctacaaaagtcactatacgggctggtaac

SEQ ID NO: 5124 - DNA, 379 bp, Artificial
  Synthetic
ggaggatcaggtgcgatgtgaggctgatttggggtgtatgattcgtgagcgtgtaagaggaggcagcccacgactttctctctgtgtctgtgcttgctcacttgctcgcctccttggattcggcctgttgatccgaatcagaagtaaatgtgtttgagactgagacttggtctggtcgagacgatatgagatgtggcatggaattagaaacacgtgtttggtatggcgattgcgatgcgatgatccgcagaaagcaagatctcagggcgactaacacggatatacggaggttcgaccaagacacgaggaatgatggggaaagtctcagtatgtcactacggaatttatgattacgtagcaatgtatgaattatcatttc

SEQ ID NO: 5125 - DNA, 61 bp, Artificial
  Synthetic
ggggtgcgatgtgaggctgatttggggtgtatgattcgtgagcgtgtaagaggaggcagcc

SEQ ID NO: 5126 - DNA, 604 bp, Artificial; identical to SEQ ID NO: 2562
  Synthetic

SEQ ID NO: 5127 - DNA, 661 bp, Artificial; identical to SEQ ID NO: 2564
  Synthetic

SEQ ID NO: 5128 - DNA, 706 bp, Artificial; identical to SEQ ID NO: 2567
  Synthetic

SEQ ID NO: 5129 - DNA, 610 bp, Artificial
  Synthetic
attaggaaatattcaatagaatatatctgaaccaacatcattccataagattcttaaaaacaacaacccttcttcttcagttacacagaagagaaacgaaactagagcacctaacattttaaaagatccccacgactatctatatctaccagacacatgggaacaaataaaaaacgaaacactcatatatgaaattttctttttttttcctatgaataaccaaagtgtgcaaggaaatgaggtctaattctcacctccaatgcaattcagtcgaatcaaagcctttgattattcattcagaccgagcagcaaacctttcaaccttacgggcattaaggttaattccaaccatagcttcacccaaaccagagctaacatcagcaagaatgtcaggatcgctataatgagtcacagcttgcacaatcgccctagcacgtttagcaggatcaccactcttaaaaacaccggaaccaacgaaaacaccatcacaacccaattggatcatcagagcagcatcagcaggagtagcaacaccaccagcagcaaattgaacaaaccatgggattgtagtccaccacttcatcccacacaaagtaatcgcttatgtcgt

SEQ ID NO: 5130 - DNA, 605 bp, Artificial; identical to SEQ ID NO: 1857
  Synthetic

SEQ ID NO: 5131 - DNA, 589 bp, Artificial
  Synthetic
tgtactaacagtatatggaaatggagcaataacagaggcaaaaacctcaccattctctgttaaagtacgattaccacagatgcttagaggaggagtaatcatggatgttgttaatgcagaacaagccagaatcgctgaagaatcaggtgcttgtgctgtcatggcattagaacgtgtaccagcagatattcgtgctcaaggtggtgttgctcgtatgagtgatccacagatgattaaagaaatcaaacaggctgttactattcctgtcatggctaaagctcggattggtcattttgttgaagctcagattctcgaagcaattggtgttgattatatcgatgagagtgaggttttgacccttgctgatgaagaacatcatattaacaagcataatttcaggattccatttgtttgtggttgtcgtaatcttggtgaagccctaaggaggattcgggaaggtgcggctatgattcgaacaaagggtgaagctggaactggtaatgttgttgaagctgttaggcatgtgaggtctgtcatgggtgatatgaggcttgtgcgtaatatggatgatgatgaggtgtgttcatat

SEQ ID NO: 5132 - DNA, 530 bp, Artificial
  Synthetic
gcgggattaggagttggagaagaggtgatacgagatgtcgtacgatgacgtggagatagaggacatggagtggaacgcggagctcgaagcgtacacctatccatgcccttgcggagacctcttccaaatctctctgcctgaccttcgcttgggagaggagatagccagatgccctagctgctccctctacatcaccgtcgtctacaacctcgaagacttccaagaccctcggcccccgcctcgcccccaacagccgatcgccgtcgcctgatctttccagttgcttcgttcagtaaactcgacatctacattctatcctaaattgatagtcaccaaatgtctggtgcacttgagactgtttatctgacaagatttcatgtatcttggagttttgcttaaatcagcatgtagaatgataactgttggcttcttgatgtttcaaaggttagatattgtcatatctcgtgtgagttttttaaatttttggtcatgctagataccatgataatatattatgcaaggactatatg

SEQ ID NO: 5133 - DNA, 956 bp, Artificial
  Synthetic
gtcggattcaggcctcagcgctcggatcggcctcttttcctctcttccctctctgctttccatctgcccagcagaccgagtttggcagcgcaatgttgcctctatcggtgcggcgcgcggtggccgctgctcctcagggggcaagtgggctgacttctctcgccgcgtcggctccaaagatcacagcctcgagcttcatcctgaatcgtcctcagcggcgctactcctcgtcgaaaccctcaagatccgatgagcccaacgatattgctgccggccagtcggtgccggcatctacctcgcgcggagagagcaaaggcagcaggaaacgaaagagcaaggattcagccgaccgaaatgcggctttcaagaaactgcccagtgtccctagcactcaccacatgtctcaagaggccctgagcttatcgagcttcttctcactccaccgtcccatttccatcacccagaccatgcccaggactgttaccgacgagcactttgcatccatatttgcgcctcgatcaaaatcgaacaggatacgagacactgtctctacaatttctgacaccattgagcagctggaaggccccatggctcaggtgacaataggatctcaggaccaaggggctggcgatggtatgcacagagttgatgtcaagaaccctgacggaaccgagtcgagcatctatctccaggttgacaccatgtctggagacttcttgcctttccgcccccctccgctgcccgaggcgcagcaaggcattgaggctgaaggagttgcggctgaggctgaagctctggaagaggcagctcaccaccgagtttacaaggccatgttcaccattgaggagtccacagagtcagacggccaaatcaggatcatcgcccacagccctcgaattatccaggacgagcagccccggagcttcttggagcgtctggcagtccgccaactgcgg

SEQ ID NO: 5134 - DNA, 596 bp, Artificial
  Synthetic
tctcaatgcctggtcgctccaccatacgtcttatccgccattttgatgtacgcaacctcgtggtacggcgacaagtacaagacgcgtgcaccgatcttgatcctcaactcgacgatctccatcatcggcctgcctatcatgggcttttcgtccaataatgccgtccgatatttcggcgcgttcatcggcattgccggctctaacgcaaatatccccgccaccatggcgtaccaggcgaacaacatccgcggacagtggaagcgagccttctgcagcgccacattgacaggtctgggtggtgttggtggtattgctggtagcctggtgtttcgctcgcaggacgctccagagtatgtgaatggcttcatcgccgtcattgtggcaaatgttgttgttgtgattatcgcctgtttgctaagtattctcttcaagcgtcgcaataagctggccgacgagggcaagctgattctcaacgacaacccagacttcagatacacactttgaatgataggcttcgaatgcttgtgggccagtcgtaatggagactagaagaaccatctcgggatcgagtagccaaagaaatacctaacatagaa

SEQ ID NO: 5135 - DNA, 812 bp, Artificial; identical to SEQ ID NO: 2737
  Synthetic

SEQ ID NO: 5136 - DNA, 398 bp, Artificial; identical to SEQ ID NO: 2738
  Synthetic

SEQ ID NO: 5137 - DNA, 633 bp, Artificial; identical to SEQ ID NO: 2838
  Synthetic

SEQ ID NO: 5138 - DNA, 397 bp, Artificial; identical to SEQ ID NO: 2527
  Synthetic

SEQ ID NO: 5139 - DNA, 483 bp, Artificial
  Synthetic
agcaattgcgcgccaaaagactgtacagagacgtcttttgatatattttcaaaatgggtggcggtggaaaaatcccttaccccaagcacgtctggtcgccttctggtggttggtacgcccagcctgccaactggcgcgccaacacgctcatcgccggagccgccatgttcggcgtcatcgctattacgtggaagttcagcgccgacagggaacgatgggcgcataagccggagccgtgggagtggcatcctagccgatagtacgtttatttttgattgtattgggtgtggttgtgggaatttggtcgtttttgctaacgtttttcttttgcttgaagctggtcaaagcagttgatcgagtgggacaaggaggacaagctgaaggcagcaagcaacagcaaggagtagagttttctttttgggagaaggataatagacgaaattgtacaaattctatacgaacaaaaggcaaacatttcaaaac

SEQ ID NO: 5140 - DNA, 410 bp, Artificial; identical to SEQ ID NO: 2940
  Synthetic

SEQ ID NO: 5141 - DNA, 73 bp, Artificial
  Synthetic
cccacgcgtccgcaacacttacaactatcaacatctaccatattcaagatgccttctttcatatgtcaccctc

SEQ ID NO: 5142 - DNA, 813 bp, Artificial; identical to SEQ ID NO: 2963
  Synthetic

SEQ ID NO: 5143 - DNA, 505 bp, Artificial; identical to SEQ ID NO: 498
  Synthetic

SEQ ID NO: 5144 - DNA, 267 bp, Artificial; identical to SEQ ID NO: 2972
  Synthetic
  misc_feature (186)..(186): The residue at this position can be any nucleotide.

SEQ ID NO: 5145 - DNA, 329 bp, Artificial; identical to SEQ ID NO: 2982
  Synthetic

SEQ ID NO: 5146 - DNA, 559 bp, Artificial
  Synthetic
atcctgtagctgccctcacgcacatcccccggcacggtgtggcccgcgccgtccacggccacaaacgccagccggccggagctcttccacgaccccgtcgccgccatgctctccggcagctcccgccacggcgcgaggcgatagtcggccagcccgctccagcgcaggttctcgtacgcccagatgttgcccggcgtgttgacgatgtagtcctcgttgccctgcaggaccagcacgcggatgtcgcccaggttgggggttcggtaggcgtcgaggatgcgggcgacctcgcgggtggtggtccggaagggatctttggagtggacgaaggcggagttgaggaccatgtcgatgtcttcgaatatataatatgggggaagcttcagggctttcttgatgtgggcttggttgatgtaggctgacatgttgcctttcctgatgtctgcgcagaagggccagttgggacatggaatatggactgttttgcaaatattagacaactacgttcagacattcaggagaagcttgaaagtttcttcagaaaaaacaaaaaaaaaac

SEQ ID NO: 5147 - DNA, 734 bp, Artificial; identical to SEQ ID NO: 2995
  Synthetic

SEQ ID NO: 5148 - DNA, 1023 bp, Artificial; identical to SEQ ID NO: 2998
  Synthetic

SEQ ID NO: 5149 - DNA, 410 bp, Artificial; identical to SEQ ID NO: 2999
  Synthetic

SEQ ID NO: 5150 - DNA, 254 bp, Artificial; identical to SEQ ID NO: 3000
  Synthetic

SEQ ID NO: 5151 - DNA, 203 bp, Artificial; identical to SEQ ID NO: 3001
  Synthetic

SEQ ID NO: 5152 - DNA, 304 bp, Artificial; identical to SEQ ID NO: 3003
  Synthetic

SEQ ID NO: 5153 - DNA, 446 bp, Artificial; identical to SEQ ID NO: 3005
  Synthetic

SEQ ID NO: 5154 - DNA, 747 bp, Artificial; identical to SEQ ID NO: 3012
  Synthetic

SEQ ID NO: 5155 - DNA, 619 bp, Artificial
  Synthetic
tcgaccacgcgtccggttgagaaacgcgagaacggcattgagaagaggtgaaaattcgttcgacatagagcacaatcatggccatgattgatgtctctcggcggaggaggtcgcttctgaaggatgcgactgcattggaccatctgcccgctgaattacttgaaattatcaagcatcagtcgtcgacgaagctcttcgatgctgtatcagaagccgcgctcataccatcacttacagagaggatctttgtgcatttcgaagatgtgttttcagacatttgcgcacgatggattctcaacgccggcaacggaccacgacggttattaattgcgtcagctattgccaggattttgccatttgcgccgtatctctcgacttttcttcaatgtcccggcagaggtggagaggaagcggcgcagggaccttcgcttcacttggtgctgccgaccattgatggagtgaatttggggttggatgcagatgcattgctgcaggctttattaacatactgggagacttttccagcttcgacctgagaactttcagctcattaattccacccgagtacctgcagagcttgtttgcgcatgagagccgggcagtgagatatctaaaaaaa

SEQ ID NO: 5156 - DNA, 705 bp, Artificial; identical to SEQ ID NO: 3015
  Synthetic

SEQ ID NO: 5157 - DNA, 326 bp, Artificial
  Synthetic
attgactacacacataaatacaccagcaaaacatcttctgcgatttctagtgttttttcacttacaccagcgcgaccatcgccaaagctacatacaacacaacacacaacacaatacatacacatccagacactaccgtctaacataacacaaaccgccgaaatggtcactcaaccagccaagatccccgttgccgccccaggccccctcgctagagctttcccagccgtcatcgccgtcggcgtcatctctgccgtcgcgctaaacgttcgctcccaactcaagactcattcagccactcaggaccgcttcttctcccagtacaa

SEQ ID NO: 5158 - DNA, 591 bp, Artificial; identical to SEQ ID NO: 3021
  Synthetic

SEQ ID NO: 5159 - DNA, 611 bp, Artificial; identical to SEQ ID NO: 3022
  Synthetic

SEQ ID NO: 5160 - DNA, 580 bp, Artificial; identical to SEQ ID NO: 3023
  Synthetic

SEQ ID NO: 5161 - DNA, 1085 bp, Artificial
  Synthetic
gcccccaaagctcctggactggtccctccaaaagccacagccgcaagcttggcagattggtaaaggtccagaaccccaggccacttggtattaaagtatttctccgttaaggaatgaaagaaaggtggctgtacttcagctcatgcttagttggaacacagcccaagcaatagcacaaagaggcgtctactccaaccatatccagccattatctagacaaaatagagaaagaaacagagaaaagccacgatatcggatatcgaccaacttcaaactggcaaagctgcaatcaacccccgacgttgggcttgctctagaatccgcccagctggctgaggaagcgaattccttctcctcggcctccgttatacttccttttacgtaccgtgatattgtgatagacagacgcctccaaaaaggaacatcacaacaaagtatcgccaagaatcctcatccgcaagtacacagggggaaacaacaaaacaagcttccgactcctcgactccagtggggggcatcccagccagtcaatgataaacacacaatcaaacagagcacgatacagagagaagaagcacctcaagccgccgtcagtttcaccccccctttaaaagagatttgaacccgaaaagggccgctcgcatattcaagcctttcgccaatgagatcccccatccatcctctcacatcccgcaccctccacaccaaatgcaaaacccccaataaattctgtcgacgggagaaaaataagatatgcagagaggagctcactcagctgtggccacgtagaaagcctcggcccgttcgcaacccacagcctgtatcaagtcaaaaccatagaagggccagcgccatgcccagccggaataacgtcatgcattgcttgaatatgcctcttgtgcgtcttataccatcagtatgagccaccattttcttgcatctagtcgtatatcttgccgtgtccgtgtcgcagcctcggcagcctcagtttcaacatctgaagaagaaggggaggaaaaaaaaaggaggctggataggtagttctgcagccgtcatagtgcaaaatattccctccatcacaaaaa

SEQ ID NO: 5162 - DNA, 1432 bp, Artificial
  Synthetic
cacacctgcaagccgtcggctcttccttcctattcccattgacaggataaacatacgtctaggctgcttctgcttggcaggaactacctttccgagcatctgccactgcctatctgggtattgggcattgcccaacgtggtgcgcacttgctcgatccatacctacaattacgggtaccttgatgatctggggtatcttgtagtttagtttgtatctgccgggtcacgagcagccaccaccgccaacatttggtactaggcaatacttctgggtgccgatatatcacctgtcacgtcttttcaggttttgcatctttttgctctcttcatcatcatcatctttcttctttgtcacaatcactttgccgtcttccacggacatttccgcagatctgcatcacagagatctgcatcagagaggatttcaagcttttcctctttgtttgccttcctctcctcttctcttcttggatcacaaaacaatcggcaaaattgacatctcgatattttctgcctccaatcacagccgtcataccacctgtggcgtctttgccatcaattctctgctgcggtgctacccgccctgcagcaatttttcccgctggccgtctgcaggcttgcctcggctgtgggtttttcgtcgaccactgaggcttagtgcccatcagccactaaagcggcttgacgtcgattctcaactttgaacccttttgagctgcctctggcctctgcctcatctctcccacaccctcacgcgcgcagtcttgaatcaacaccccttcacgcactcgccattgccgcgctcctcgtcacgctctgctcgattagccgtctctcgcccattgattgaacctgctctcggcctctgcagccaccctcacgcaacctacgcctgacatcctctgcgtcgctcggctgtctcccggttttatccatcagctgaaccttcaccttcgccttcgctctcaagagggaatccgagggcccggccgttctctgccatctattgttattgccattaacgctgctgctgctgccactgtctcctctactcctgtttcgccctcatatgtctcagccgcctcgccggatgcctctactatcacaccctaaacaccgtattagcatacttgatcttaccaaactgccgttgcagtaacgccggcttcatcttcttgacaatgccgtcgaaaactaacaatggtgtgggagttcaggtcgaggacacaaagatatgcgttgtcatggttggtctcccggcccgcgggaagagctacattgcccagttagcccagagatacctgcaatggctgtcgattccggcagcgactttcaatgtcggcaactatcggcgcaatgacgctccacagccgactgccgacttctttgattttaacaatcccgaaggagagcggaagcgccgtgcggctgc

SEQ ID NO: 5163 - DNA, 360 bp, Artificial; identical to SEQ ID NO: 870
  Synthetic

SEQ ID NO: 5164 - DNA, 305 bp, Artificial; identical to SEQ ID NO: 3029
  Synthetic

SEQ ID NO: 5165 - DNA, 656 bp, Artificial
  Synthetic
gggggggacgatgcggcgcatgtaccaggtgtgcaagctggtgcacgccgatctgagcgagtacaacatcctctaccacgacggcaagctgtacatcatcgacgtttcgcagagcgtggagccggaccacccgcggtcgctcgagttcttgcgcatggatatcaagaacgtgggcgacttcttccggcgcaagggcgtcgacacgctgcctgaccgggccattttcaacttcatcaccgtgcctgaggggccggtcgaggagcctgagctggcggaggcgattgccaagttatacgagacgagacttcctgctgcgaacgaggaggaggctgctgctgaggaggtggacacggaggttttccggaaccagtacatcccgcagacgctggagcaggtgtatgacattgaaaaggatgtcaagaagctcggtcttggagagggcaatgagttggtgtacagcaagttgctggctgaccaggttgttgcgcccaaggcagacggcgaaggagaggatgaggatgaggaagattcggacgatgagtcgggcgagggagcttcccttggcagtgatgattctgaagatgatgagagtcggtttgacaagggacggccgagaggtcgcaagtttgaggacaaggacgagaaaaagcaacata

SEQ ID NO: 5166 - DNA, 456 bp, Artificial; identical to SEQ ID NO: 3033
  Synthetic

SEQ ID NO: 5167 - DNA, 356 bp, Artificial; identical to SEQ ID NO: 3038
  Synthetic

SEQ ID NO: 5168 - DNA, 586 bp, Artificial; identical to SEQ ID NO: 3049
  Synthetic

SEQ ID NO: 5169 - DNA, 612 bp, Artificial; identical to SEQ ID NO: 3050
  Synthetic

SEQ ID NO: 5170 - DNA, 531 bp, Artificial; identical to SEQ ID NO: 3051
  Synthetic

SEQ ID NO: 5171 - DNA, 591 bp, Artificial; identical to SEQ ID NO: 3052
  Synthetic

SEQ ID NO: 5172 - DNA, 597 bp, Artificial; identical to SEQ ID NO: 3058
  Synthetic

SEQ ID NO: 5173 - DNA, 171 bp, Artificial
  Synthetic
gtaacatgatgatattggcgcaggggcatatggacgacatgattctaatctggagagaagccgcattgtactgtattaactaaagattggatgaggatattatctggcgttttggattggcaaacgggaatacaaatggcgagtcatgaatgatcgaaaaaaaaaaaacca

SEQ ID NO: 5174 - DNA, 659 bp, Artificial; identical to SEQ ID NO: 3059
  Synthetic

SEQ ID NO: 5175 - DNA, 606 bp, Artificial
  Synthetic
ccgcccagcgtcatctttcacaatgagatcctccccccttcacccgatctagccctgctcgtctacagcttctcatctcaaatcaaggttacagatagccccgtcccgcttcgctagcaagaagcgaggcgctacggcgggcgtcgaggaaaagatcttcgcactcggacacatcctggacgtcaatctgagtacggccattcgccttggcaagaatgcttgagggtgtcagcagttgtagccagtatcttaagctgacacggacaccgtgctcggaaattttgtcaatggcagcgtccgtaatagacacaccctctgtcgtggcccggagcttgacaatcttcttaatctcgtctgccgagtatggggaggtggggatgatgagcattcgggcaaggaagtcaggaggaatgccatgagccgcgacaacgtcgtcggtacctcttattgtggacattccacggttggatgccaaaaccacaatgggggcgaggtgtgattccaatgctcggtttaaataggtgaagcactccacgtcaagcatgtgagcctattgtagtccagtgttagtatctgataccagtagattaaaaaaaaaacaaaaac

SEQ ID NO: 5176 - DNA, 631 bp, Artificial
  Synthetic
tcaacaacaaggtggcggagtggagagaggaagggaaggccgagatcgtcccgggggttctcttcatcgacgaggtacatatgctcgacatggagtgcttctcgttcctcaaccgggcgctggagaacgagatgtctcccattctcgtcgtcgctacaaaccggggcatcaccaagatccgagggaccaactacaagtccccgcacgggatcccgatcgatctcctggaccggctgctcatcatctcaacgcagccatacaccgaggacgagatgcggcggatcctggacatccgggccgaggaggaggacgtggaaatgtccgaggaggccaaggagctgctcaccaagatcgggcaggagacgtcgctgaggtacgcgatccatctcatcaccgccgcggcgctggcttgccagaagaggcgggggaaggaagtgggcatcgaggacatcagcaaggtctactcgctcttcatggacgtgaagagatcgacgcagttcctcatggagtaccaggagcagtttatgtttaacgaggtacctgatgctaccgatatggtggaaggatagatggaagtcgtcatgtctagctgattttacgtagctctctgcgagaagttagtaaagatttt

SEQ ID NO: 5177 - DNA, 578 bp, Artificial; identical to SEQ ID NO: 4363
  Synthetic

SEQ ID NO: 5178 - DNA, 604 bp, Artificial; identical to SEQ ID NO: 2532
  Synthetic

SEQ ID NO: 5179 - DNA, 610 bp, Artificial; identical to SEQ ID NO: 3065
  Synthetic

SEQ ID NO: 5180 - DNA, 353 bp, Artificial
  Synthetic
cccacgcgtccggactggcccgacaatgactatcgcttattttgtggagatctgggcaatgaagtcaatgacgacgtcctctcaaaagctttttcacggttcccctccttcaacatggcaagggttgttcgagataacagaactggcaaaacaaaaggatatggatttgtgagcttttcaaaccctactgaccttgctggagcaattaaacaaatgaatgggaagtatgttgggaaccgccctattaaattgcgtaaaaccaattggaaagagaggaccgatgttgatgctctacaaagacagaagaatcacatccagaagaaacctaacatgcccaagaacagtatccttcc

SEQ ID NO: 5181 - DNA, 952 bp, Artificial
  Synthetic
tgtggacacacgttttcataaagtaaataccaccggttggggctaaagctaaacatagcagcccaacaatacataaccataccgttttcaacaaaactaatgataatgtttgttcatttatatttatgagtaacaggtttggaaattttaagccacaaaaataaaagagatcgtcacttgtgaagtatgctcttcttcacagttttttgcttcttattgctgtgatgcttttgtctttcagcagcctcctgatctgttctctctttccagctactctttcgtagttttatcggacgatttccaacatacttaccattcatttcttttaaggctgctgctagatccgcaggatttaagaaactcacaaacccataacccttggttttaccagtccgcttatctctaatgaccttggccatattgaaggtggggaatctagcaaatgctttggaaagaacatcatcattcacttcgttcccaagatcaccacagaacagacgatagtcattttctggccattctgaaagagtaggatcctcccaagactgtccagcagctttacgaggaatggctctctttttagtttctgctttgtgttcggtttcactacttgccaaagcagcttttacattctcaagagcttctggtgtaattgtctgtgcatctctttggaacaattgatgtgcctgttggtactgagggtaagcgtagacggcaggaaccggtccaacaggctgaggatagaccgtagctccgggaatggatgccacaggcgccggtacagcaggcgaaggcgccgccgcgtaaggctgtggaggctgatacggagcggaatagtaagaattagctgcgtatgtgtactgagacgaggaagatgaagaagaagaacctgaagatggtgggattgacatcggagaagcaaatcgccgcctcgcaaaatcggacgcgtggg

SEQ ID NO: 5182 - DNA, 582 bp, Artificial; identical to SEQ ID NO: 3066
  Synthetic

SEQ ID NO: 5183 - DNA, 197 bp, Artificial; identical to SEQ ID NO: 404
  Synthetic

SEQ ID NO: 5184 - DNA, 409 bp, Artificial; identical to SEQ ID NO: 2358
  Synthetic

SEQ ID NO: 5185 - DNA, 392 bp, Artificial; identical to SEQ ID NO: 3067
  Synthetic

SEQ ID NO: 5186 - DNA, 454 bp, Artificial; identical to SEQ ID NO: 3068
  Synthetic

SEQ ID NO: 5187 - DNA, 592 bp, Artificial
  Synthetic
cccacgcgtccgccaccgcgacactccccttcccttccttctccggtctcctccctctctcgtcgtcgtcgtcgtcgccgtcgccggctcgccgcgttctcctccgccgccgctgctgagccgggatggccgcgcgtagcccctacttcgtccccgagagcgaggggatccgggccggggagtcgccggccgcggcgctccgcaggatcctcgcgtcgccgggggcgcaccaggccccctgctgcttcgacgcgctcggcgcccgcctcatccagcgcgcggggttcccgatctgcttcatgggcggtttctgtgtttctgccgcacgacttggattgccagatgctggtctcatctcatatggagaaatggtagatcaagggcgtctgatcactgaagctgtatcactcccagttatcggcgatggtgataatggctatggaaatgctatgagcattaagagaaccgtaaaagggtatattaatgctggttttgctggaatcatgctcgaagatcaggtggcaccaaaagcatgtggacatactgaaggaaggaaagttatctcaagggaggatgctatcatgcacataaa

SEQ ID NO: 5188 - DNA, 599 bp, Artificial
  Synthetic
actccccttcccttccttctccggtctcctccctctctcgtcgtcgtcgtcgtcgccgtcggcggctcgccgcgttctcctccgccgccgctgctgagccgggatggccgcgcgtagcccctacttcgtccccgagagcgaggggatccgggccggggagtcgccggccgcggcgctccgcaggatcctcgcgtcgccgggggcgcaccaggccccctgctgcttcgacgcgctcggcgcccgcctcatccagcgcgcggggttcccgatctgcttcatgggcggtttctgtgtttctgccgcacgacttggattgccagatgctggtctcatctcatatggagaaatggtagatcaagggcgtctgatcactgaagctgtatcactcccagttatcggcgatggtgataatggctatggaaatgctatgagcattaagagaaccgtaaaagggtatattaatgctggttttgctggaatcatgctcgaagatcaggtggcaccaaaagcatgtggacatactgaaggaaggaaagttatctcaagggaggatgctatcatgcacataaaagctgccgtagatgctaggaaagagagtg

SEQ ID NO: 5189 - DNA, 239 bp, Artificial; identical to SEQ ID NO: 3069
  Synthetic

SEQ ID NO: 5190 - DNA, 154 bp, Artificial
  Synthetic
atactcggacccaagcaagattctcgctacatgctgctctgacgatggactaggatcacgtctggtggaagaagctaggttcccgtacatatgtttgggtggattcatggtcgcgtctagcttgggattaccagacactggatacattgccttc

SEQ ID NO: 5191 - DNA, 622 bp, Artificial; identical to SEQ ID NO: 3070
  Synthetic

SEQ ID NO: 5192 - DNA, 624 bp, Artificial; identical to SEQ ID NO: 2343
  Synthetic

SEQ ID NO: 5193 - DNA, 637 bp, Artificial; identical to SEQ ID NO: 2347
  Synthetic

SEQ ID NO: 5194 - DNA, 286 bp, Artificial
  Synthetic
aaatgggaaggatattcacggtggagcttgaaggaagatcttacagatgcaggttctgcagaacccatctcgctcttcccgatgatcttgtctctcggtcgtttcattgccgtagaggaaaggcttacctcttcaaccgttcggggaacataagtatgggtcctctaaaggaaagactgatgctttccggtatgcacaccgtagctgacattttctgctgctgttgtggacagaatgttggctggaaatacgaatcagcgcacgagaaagctcagaagtataaaga

SEQ ID NO: 5195 - DNA, 640 bp, Artificial; identical to SEQ ID NO: 2351
  Synthetic

SEQ ID NO: 5196 - DNA, 602 bp, Artificial; identical to SEQ ID NO: 3084
  Synthetic
  misc_feature (158)..(158): The residue at this position can be any nucleotide.

SEQ ID NO: 5197 - DNA, 620 bp, Artificial; identical to SEQ ID NO: 2349
  Synthetic

SEQ ID NO: 5198 - DNA, 410 bp, Artificial
  Synthetic
gggaaagagggacttggcgcatggggaagatcatccaggaatatttgtcgggcgatcgaatctactgctgcagcaattgccatacccatgccgccgatcacgagcaggttgtgtccaagaatttcaatgggcgatttggccgtgcctacctcttcaacaaagtggtgaatgtgtttctggggcccaaggaagagcgaatgctcatcactggattgcacacggtgaacgatatctactgcatttgctgccagcaagtcctcggctggaaatatgatactgcgcaggaagagagggagaagtacaaggagggcaagtatatcattgagaagaaaaagatgaccaaagagaattggtaacgtgtgaatacgataacattcatgtatttaataataagaatcctattttaattc

SEQ ID NO: 5199 - DNA, 551 bp, Artificial
  Synthetic
cccacgcgtccggcacaaagtcgattcctttccgcctcagcggggccgcttgtttcgatcgaagcatcgcgagaggcagcccgccgcctgggtttcgtgccgattttgatttcctttttcttggccgcctctgcctctctctctctctctctctctccctttcttggttcgattgttcctggttcttggcctgattggttgaacctgcttcttctggaatcaattaggggagaaatatttgcaggagaggggcggtggcgatggcggagttggttgggccgcgggtgtacagctgctgccattgccggaaccacgtctgcctccacgacgacatcatctccaaggcctttcaggggaggaacggccgtgcgtttcttttctctcatgctatgaacatatctatgggtccaaaggaggacaggcagcttatgacagggcttcacacagttgctgatatctactgccgtgattgccgtgaggtattgggttggaagtatgaaagagcatttgaagaatcccagaagtacaaggaaggaaaattcatatttgag

SEQ ID NO: 5200 - DNA, 673 bp, Artificial; identical to SEQ ID NO: 2344
  Synthetic

SEQ ID NO: 5201 - DNA, 735 bp, Artificial
  Synthetic
aagtgcaacattgacaaacttttaatccatatctttcttaactgggttgttttaattttcaaccttaattctgagtcttcaatttaatactgatccaaaagtcttctaaggcaaagatggggagactatttgtgttgactcttgaaggcaagatctatagctgcaagcactgtggaactcatcttgctctttctgaaagcattgtttctaagtctttccactgccgacatgggaaggcttatctcttcagtaaggtagtgaatgtcacttctggcgagatagagaatagaatgatgatgactggtatgcacactgtggccgacattttctgcgtctgttgtgggtcaattgttggatggaaatatgagaccgcccatgagaagagccaaaagtacaaggaaggaaaatccgtgcttgagcggtttaagatttctggccctgatggaagccattactgggccagtcatgaaactcatgttgcaggaagtgatgctgatgatgtttgatcacctcaccatcagataaaatagttctatcccaaatgtacattctttaacctaccaccccactatattctttatggaccattggattcttgaattgcttgctcactcagcagcttcttctacctgacctctatcatgtataataatatggaagtagccatataatattgcagcctaacatgaccatctcccctatatttgtttgtaatgacagtctttactatactag

SEQ ID NO: 5202 - DNA, 550 bp, Artificial
  Synthetic
  misc_feature (174)..(174): The residue at this position can be any nucleotide.
catcttttgtaatcataaactcaccaaactccgacacccctctttgctttaccccactgtacagacagccccgcaaaacacacacactctcactctctctctctgtggcaaccagctgatcaatctgcgattgcttaccttgacactatgaccagataaaaacagatacacttntttggtcaaagaagaaaggctgtgtagataacagattgtagttttttgaaggatataaagaagagtgtcacagctattgagaaaacttgtgcttattttgatcatcaaatggctgaaattattggccctagattgtacagttgctgcaattgtaaaaatgaagttgcactacacgatgacatcatttctaaggcttttcagggaagaaatggtcgagcatttttgttttctcatgcaatgaacatagtcgtggggccaaaagaggatagacagctaatgacgggcctccatacagttgctgatgtccattgctgcgactgtcgtgaggttcttggctggaaatatgaacgcgcttatgaagagacgcagaagtaca

SEQ ID NO: 5203 - DNA, 657 bp, Artificial; identical to SEQ ID NO: 3083
  Synthetic

SEQ ID NO: 5204 - DNA, 552 bp, Artificial
  Synthetic
agagaaagagagagaatgggaagactattcttgatccaccttgagggtaagatatacaaatgccgcatctgcaactgccacttggcaaagtgcagcgaccttttttcgaagaactttcactccaagaatggaaaggcttatctgttcaacacagtagtaaatgtctcagttgggccaaaagaagatcggatgatgactactggcttgcatacagtattggatattcactgctcttcctgtaatcagattgttggttggaaatatgaaacggcctatgaaaaaagccagaaatacaaggaaggaaagttcattttggagagggctaaggtgatagatggacatgggcggactaatttatcggcggaaattaatcttatttgaatcgatgctgacgattcatgatacgtcggtaactaagcacccatttgtaaataatcttctaatttttttgccattgcactgcctcaattttttggtgggcgaatttggttcgagaaaaatagaagcattttttctcattcaatgccaaatgattcaaacttgtaaatggtg

SEQ ID NO: 5205 - DNA, 603 bp, Artificial; identical to SEQ ID NO: 2346
  Synthetic

SEQ ID NO: 5206 - DNA, 681 bp, Artificial; identical to SEQ ID NO: 2348
  Synthetic
  misc_feature (118)..(118): The residue at this position can be any nucleotide.

SEQ ID NO: 5207 - DNA, 346 bp, Artificial; identical to SEQ ID NO: 3097
  Synthetic

SEQ ID NO: 5208 - DNA, 317 bp, Artificial; identical to SEQ ID NO: 912
  Synthetic

SEQ ID NO: 5209 - DNA, 634 bp, Artificial
  Synthetic
ctcacagagccgatcaaataccgccaaaatgcccaaggaagtcgctgacatcaagaagttcatcgagatctgccgtcggaaggacgcttcctccgcgcggatcaagaagaacaagaaggcccacaacatcaagttcaaggtccgatgccagaagaacctctacactctggtgctgaaggacaatgacaaggccgagaagctcaagcagagcctgcctcccaacctgcaaatcgcagaggtccccaagaagaactaaggaaatgaattggtggtaaaataggggtggctttgggcgtgggaagggtttacatgcacaactgggcgtctcgggataccttgcatttcatgtgctcagaacgcacgctcgcaatagagctcaaaaaataacgatttgagacacaaaaagcaacaatcgcacaccaaaatctggtgagcccgatgtctttcttgtgccggctatgctacctgaagaaagggagcccccccggttactcggtgatgcctatttacacgacgtgcctgaagcggcgatgatctttcttgagggcgaggctcgccaatccttccagtcgtttcttcggaacatcgccagtccagaatacaatcaaatcttccttgtcttcctcaaaaaaaa

SEQ ID NO: 5210 - DNA, 395 bp, Artificial; identical to SEQ ID NO: 2467
  Synthetic

SEQ ID NO: 5211 - DNA, 66 bp, Artificial
  Synthetic
gatagcggatggatacttgcagtaatatggggtaagtgagtgagtgagtgagtgatattggataca

SEQ ID NO: 5212 - DNA, 203 bp, Artificial; identical to SEQ ID NO: 598
  Synthetic

SEQ ID NO: 5213 - DNA, 543 bp, Artificial; identical to SEQ ID NO: 3100
  Synthetic

SEQ ID NO: 5214 - DNA, 625 bp, Artificial; identical to SEQ ID NO: 3101
  Synthetic

SEQ ID NO: 5215 - DNA, 474 bp, Artificial; identical to SEQ ID NO: 3106
  Synthetic

SEQ ID NO: 5216 - DNA, 506 bp, Artificial; identical to SEQ ID NO: 3135
  Synthetic

SEQ ID NO: 5217 - DNA, 637 bp, Artificial; identical to SEQ ID NO: 2560
  Synthetic

SEQ ID NO: 5218 - DNA, 117 bp, Artificial
  Synthetic
ggctgcaaatccagaggcgagacattgttagaaccaactcagcgggagtccgattccatacgagtactcgtatgaggacacttgctcactgtcatatctgaagtcttgaagtgctgc

SEQ ID NO: 5219 - DNA, 779 bp, Artificial; identical to SEQ ID NO: 3142
  Synthetic

SEQ ID NO: 5220 - DNA, 841 bp, Artificial
  Synthetic
  misc_feature (796)..(796): The residue at this position can be any nucleotide.
cccacgcgtccggtcggatcctccattgcttcagcgatcacaccgatgctggagtgtcaacgacaaagcagagagagggtttaatgggcaaaaccgaaaatctataattcttcaaatttctggattttgatttaagtggtatttcagattggggatcgtatattgaaatttcgagtggttgattgggtttacaggaggatggtgctggtattagcattgggcgatcttcacatcccgcatagggctgctgatcttcccgctaagtttaagtctatgcttgttcctggaaagatccaacatatcatctgtactggtaacctatgcattaaagaggttcatgattacttaaagactctttgtcctgacttgcatattgctagaggcgagtatgatgaggagacacgttaccccgagaccaagacgctaacaattggtcaatttaagcttggattatgccatggccaccaggttattccatggggtgatttggactcattagccatgcttcaaaggcaattggatgtagacatacttgtgactggccatacccatcagttcacagcctacaaacatgaagcaggggttgttataaatccaggatctgctactggtgcctacagtagcatcacatatgatgtcaaccctagctttgttctaatggacattgatgccctgcgtgttgtggtctatgtttatgaactcatcgatggagaagtcaaagttgacaagattgatttcaagaagacaacaacacagaatgctaattgaatagcataacttgaaattcagctgattntagtggaatcctgaagtcgataagacattatattcctctgtctgc

SEQ ID NO: 5221 - DNA, 265 bp, Artificial; identical to SEQ ID NO: 940
  Synthetic

SEQ ID NO: 5222 - DNA, 970 bp, Artificial
  Synthetic
ggtgatctgaagagaatgggtcgaccagcgctacttgtacagtatcgaatgcacgatgcgtcttatgatcagcgcgtgtcttgcacatatgcatacgtcaaacaatgcatcctccacaatcttcatcatcactccacaaatagcttccatgttactttccgcattctaggtaccgcctcagtgttggctgaggtttgccacatgcacaccattgttgacgtaccatgtggctcagttcagccatcgacatctccagacaagcctaccaaagaaagtcagcctcagccttaactgctctcgagggtttcagtcatcaattagccctacagctccgccttccctcggcccgtgcggcaaaagacgactggagatctagattgtgagaaatacgaagatattagtggatttctcgtaccaggaacgaggacagacattggtgtgttgatgaaaatagaaacttgaaccggcgaaaccttgaacggtgagtacgagatatggaagacgaatagcagcgtatgagtcaagttgcagcactagacttcttggttaggcccttttctcttcccattttcccgccatgagcgtggatagatgcatctacatggtgataggcgagccgaaatcgaatcatttctcacgtctccaaaggcccagccctacgttacagccggccatcgctaagcagatcgcctactcggtgctaaattctgacttctcaggcagcacgagatgccgtccagtcgctgcttgttcacgggcacaagggggggatctctcccttgatgcctacttgtatacgagaagagagacgacggacattagccgcatgcaagattacgaacgggtcatctcgccaagagaaagcttgtgttgtatgttaccgcttctttggaattaatcgctatcgaaaggaacagggcctagaacttagtagcttcccatcgaaattctcgtgctattgtttccttga

SEQ ID NO: 5223 - DNA, 308 bp, Artificial; identical to SEQ ID NO: 3161
  Synthetic

SEQ ID NO: 5224 - DNA, 502 bp, Artificial; identical to SEQ ID NO: 3162
  Synthetic

SEQ ID NO: 5225 - DNA, 768 bp, Artificial
  Synthetic
gggcgaagatacgcaattccacaatcgccatggcgaagccgtatgtgccgcatgacgtccttgacgagacggccaagacttcattggtcggcctgggcagcggcttcttcattgccgccatccagaatgccctgtcgaagcgcaacgtgggcgctatgagcgtctttacgcggggagctcccatcattggcatttgcgctgccggtcccggtgcctacgccttcttctcccggacgatgatgaacctgcgggagaaggatgatgcttgggccgccgcctttggaggcttcatgtgcggcagtgtcctcggacttcctttccgacgcacacccatcgtgctggctcttggtgctttcgttggcactgcccagggccttttccacgtcaccggaggaaaactggacagcttctacaaggaggaggatgagtttgagcgcaaggagactgttagacggacaacccggttgcccgttgagcagactattgccgagctgggcgagggacgaggcatccgtcctcctggatatgaggagagaagacgagagcgcatcaaggaaaagtatggcttcgaagttaaccctgtgagcgccaccgctgagggtagccaataaaatgatatcaaaaaaaaatatgaaagaattaaagtcagctgccagagatttttgaggtgagttctgcgggcagcttgtacatatatcccatcgcattccagtgcggaagagatgcgatgctagataatcggattttttttttgttttccaaaaaaag

SEQ ID NO: 5226 - DNA, 432 bp, Artificial; identical to SEQ ID NO: 2370
  Synthetic

SEQ ID NO: 5227 - DNA, 473 bp, Artificial; identical to SEQ ID NO: 3165
  Synthetic

SEQ ID NO: 5228 - DNA, 341 bp, Artificial; identical to SEQ ID NO: 3168
  Synthetic

SEQ ID NO: 5229 - DNA, 92 bp, Artificial
  Synthetic
tcctcctccctggttccagactgttacccgtctcggaatacagcgagacacggacgacggagatcgggaatgtggggccggagaatccgatg

SEQ ID NO: 5230 - DNA, 614 bp, Artificial; identical to SEQ ID NO: 3169
  Synthetic

SEQ ID NO: 5231 - DNA, 499 bp, Artificial; identical to SEQ ID NO: 3170
  Synthetic

SEQ ID NO: 5232 - DNA, 476 bp, Artificial; identical to SEQ ID NO: 3171
  Synthetic

SEQ ID NO: 5233 - DNA, 415 bp, Artificial; identical to SEQ ID NO: 3172
  Synthetic

SEQ ID NO: 5234 - DNA, 256 bp, Artificial
  Synthetic
tgcggacgcgtgggcggacgcgtgggtccggacgcgtggggactagataggtagagatggtttggcggtcaatgctgtgctcgttagatgtctcacgggggcccgcatgtatctccatgtagttcctcgcacgcagcaagaaagaggcaaaacccgcgcggtgttagtagcgtttgccatcggaagacgatcgcccagcacgtcaaagaggccatttgatcagttactcgattggtgctcgcacgggttggttacg

SEQ ID NO: 5235 - DNA, 875 bp, Artificial
  Synthetic
agtgaacattaagaatggcggaaaaaggaggaaaagggttttctctaccaaaaaatggaaagtctgccctcaaatctcctgcatccaaagggaaggatgatatctcagcaaaatcgaaaagaggaaggaaagttcagtttgatcctgaaggatcactggataccaatctcacaaaatcgaatggaaaagctgatcaaccatcttccaaagatgtttccggcaaaggcgggaaaggagaaaaagctggcagtggtagtaaaagtcaaacagcaaaagcacctggtccgttggagcttagagttgaacaagaacttccggacaatacaacatgtctgatggactgtgaagctgctgatattttgcaaggaatccaagagcaaatggtggttttgtctgaagatccagctataaaactacctatttcatttgacaggggattgatgtatgcacaaaggaacaggctttacgataatcccgatacggttaaacaaatactcaaacctctaaaagagcacggtgtttccgatggggagctctgcatgattgccaactttgccgtggaatctgttgatgaagtattttctcttgttccctcatttaagactaaaaagagcaagctgagagttcccctcgagaatgtcttgggtgaactagccaaacttagaaggccagcgtaaagggggctcaaaacgagcattatatggtatatgtacagagggttctgcatgtatcgctaaagggcatgtccgacagttaggcgaccagcaacagaagttttctttcttattttacctgtcttttgttctggttatttgctaggattttccgcggcagtgtaaatctgttgatcgcgtcgttcttctcttttgattccc

SEQ ID NO: 5236 - DNA, 469 bp, Artificial
  Synthetic
  misc_feature (455)..(457): The residues at these positions can be any nucleotide.
  misc_feature (461)..(461): The residue at this position can be any nucleotide.
tcgaagacagatgttggagagagctttgaccaggtaaacggattaccttcagtggaaaatcctgagaatggtggcacatctcctacaaagccacaaagtcagaagaagaagaaacctttgcttcataaatttggaagcctactgaagaagaaaggcaccaacagccagaagtaatagacccaccggttgtcacctatcatgtgcctgacgtgtagagaggtatactaaattcaagagtaaatgttggacttaattgtgtttgctcaaaatctttgcttttcttttctttttctttttttttggttatttgtttgtctcaaataggtgtttacataagaaaaagattgtatcatcggtagtgttccattcttattagttctggggttcagtttctcaatgtggttttatcatgttgggcaatatcctttatttttatattattctttttagctttnnnaaanaaaaaaaa

SEQ ID NO: 5237 - DNA, 337 bp, Artificial; identical to SEQ ID NO: 4623
  Synthetic

SEQ ID NO: 5238 - DNA, 633 bp, Artificial; identical to SEQ ID NO: 4621
  Synthetic

SEQ ID NO: 5239 - DNA, 627 bp, Artificial
  Synthetic
cccccctgcagctgaagggcttgattgaggcttacgttgaaaaaacaggcagcgagaaaggtgccacgattttgagagaatgggaggcatatctgccactcttctggcaactggtaccaccaagtgaagaagactctcctgaagcttgtgccgagtttgaacgagtacttgccaagcaagcaacaacagtacaatcggcgaagtgatctactgcaattcccaagtgatcagattagacaacaggaaggtgttctttggtactttccaggtgattttttcctgggaccgcatcaaggaaaacaaaataacaactggcatacttgtgaagcaccgaagtgcccccaaagactgcgattttgtggaagctctgcccaaggcatcttttgaaacgaagtttcacatgatcgtggaggattcttctttgcgcccttgcacttgcacgccctagttaaccacccccctgtaaattggtttgctgacgctaggttgctatttgcagaggcagtgaagacacacttctaaacttctccattcctgtacaggattcgtgtcctatgtaatcgtatttttggttctggacacattagttcttacatttatacccgtccagtgggggcatgcgagtcg

SEQ ID NO: 5240 - DNA, 624 bp, Artificial
  Synthetic
tcgctgaagcagtagttgaaggcactggagaccattgctgtgagtacatgactggtggctgtgtagtcgtgcttggaaaggtgggaagaaacgttgctgctggtatgacaggagggttagcttaccttcttgatgaagacgacactcttcttcctaagattaacagagagatagtgaagatccaaagagtaactgcgcctgctggggaattgcagctgaagagcttaattgaagcacatgtggaaaaaaccggaagcagcaaaggcgcaacgattctgaatgagtgggaaaagtatctacctctcttctggcaactggttccaccgagtgaggaagacactcctgaagcttctgctgcttacgtaagaacatccaccggggaagtcacatttcaatcggcttagagatcattcaagagcaggttgtggcagttgaaacacaaggattgatatacatcaatggtggaggactatggagagcagattaatggaaaatcattatcattcacatgtagatcaaatgtgtgggacaatattcttattgtcttgtgatctttacaacaataccatggttgctataactgtacagtaaattcagtaaaataactgctttcaactgtcaaaa

SEQ ID NO: 5241 - DNA, 833 bp, Artificial
  Synthetic
cccacgcgtccggttttctgacacctggaatgaacataagacttattggagaagctaacgactatgtcggaaagggcatggctggaggagaattggttgttactcctgttgaaaatactggattttgtccagaggacgccaccatagtagggaacacctgcttatatggagcgacaggtggtcaagtatttgtcagaggtaaagcaggggagcgttttgctgtaaggaattctcttgctcaagctgttgtagaaggcactggggaccactgttgtgagtacatgacaggagggtgtgttgtggtgcttggaaaggttggtagaaatgtagctgctggtatgactgggggtttggcatacattcttgatgaggatgatacccttatatctaaggtaaacaaggagattgttaagatccagagagtggttgctccagtgggtcaaatgcagctaaagagcctaatcgaagcccatgtggaaaaaacgggcagcacgaaaggcgcaactattctcaaggagtgggacaaatatttgccactattttggcaattggttccacccagtgaagaagacactccggaggccagtgctgaatacgagcaagctgctgctgggcaggtcactttgcagtctgcagagataccattgaagtaaatctcacatgagcacagcaatgaccatgattctaagcaggagacagtttgtacaggaaagaatgatattgtctccacggaaggactcggtgaagtctgagagatcagaactcttaaaggtgcaagcaactatctttgttgaacaaaaggctgatctttgtgatgcttcagcagctgtaca

SEQ ID NO: 5242 - DNA, 197 bp, Artificial; identical to SEQ ID NO: 3520
  Synthetic

SEQ ID NO: 5243 - DNA, 555 bp, Artificial
  Synthetic
attcaatgtggatagggcagtttgtggccggatcgctggtgtgatagccaagaagtatggtgacacaggctttgcagggcagcttgatctcaagttcattggaagtgctgggcaatcttttgcctgtttcttaacaccagggatgaatgttaacctgattggtgaggcaaatgattacgtcggcaagggaatggctggtggggagattgtaatctgtccaaatgagaatgctggttttgttcccgaggaggctacaatcgttggaaatacctgcttatatggagctactggtggtcaagtctttgcaagggggaaagctggggagcgctttgcagtgaggaactcctttgctgaagctgtgattgagggaactggtgaccattgttgtgaatatatgactggcggctgtgttgttgttcttggaaaggtgggtagaaatgtgggagcaggtatgacgggtggactggcttaccttcttgatgaagacgatactctgcgacctaaggttaacacggagatagttcggatgcagagagtagttgcacctgctggaga

SEQ ID NO: 5244 - DNA, 600 bp, Artificial
  Synthetic
gtcaagatgtccacagtagtggccctgttcttgacgagacaatccttgccgatcctgatatatccgatgcgattgagaatgagaaggaggtttccaagacatttcaaatttacaatgttgacagggctgtctgtggtcgagtagcaggtgtcattgccaagaagtatggtgacacaggatttgcaggccagctcaacattacgtttactggaagcgcagggcagtcctttggatgtttcctaactcctggaatgaatattcggctagttggagaggccaacgattatgtgggaaagggtatggctggtggagagctggttgtagttcctgtagaaaaaacaggatttgttcctgaggatgctgctatagttggtaacacttgtctgtatggagctactggtggtcaggtatttgtgagaggcaaaacaggtgaaagatttgcagttagaaactcccttggtcaagcagtggttgagggcactggagatcattgctgcgagtacatgactggtggctgtgtagttgtacttggcaaagttgggaggaatgttgcagctggaatgacgggtggccttgcctatattctagatgaggatgata

SEQ ID NO: 5245 - DNA, 599 bp, Artificial
  Synthetic
gaattcaagggcatggccggaggcgaagtgggtgtaactcctgtagagaatactgggttcgttcctggaatgaacattcgacttgttggagaagctaacgactatgtaggaaagggcatggccggaggcgaagtggttgtaactcctgtagagaatactgggttcgttcctgaagaagcgactattgttggaaatacatgcctctatggtgctaccggaggtcaaatatttgttcgaggaaaagctggggaacgttttgctgtaagaaactctcttgctcaagccgtggttgaaggtactggagatcattgttgtgagtacatgactggtggttgtgtggttgtacttggaaaggttggacgaaatgtagctgcgggaatgactggtggtttggcatacatgcttgatgaggatgacacactcatctccaagataaacaaggagatcgtgaagattcagagagtgattgcacctgcagggcaagtacaattgaagagtctaatagaagctcatgttgagaaaactggtagcagcagaggcactcttattttgaaagagtgggaaacataccttcctctattctggcaattagtaccacc

SEQ ID NO: 5246 - DNA, 88 bp, Artificial; identical to SEQ ID NO: 3534
  Synthetic

SEQ ID NO: 5247 - DNA, 225 bp, Artificial; identical to SEQ ID NO: 3557
  Synthetic

SEQ ID NO: 5248 - DNA, 394 bp, Artificial
  Synthetic
cttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcagttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaacc

SEQ ID NO: 5249 - DNA, 89 bp, Artificial
  Synthetic
caacaggccagagagaagaaagaagagaaaaatatgggcatattgagaggcggcgcagattgttttccaggaggatggggtgcggcggc

SEQ ID NO: 5250 - DNA, 446 bp, Artificial
  Synthetic
tgttcttctcatgttcattcacctccttgctgagacatcacactttacagtggattggagtaaatcaagacaattaccagaattgggagcaatacattcagtggatcataaccaagtctaaagggaaatctggtcgagctcaaatgatgaaaatggtctttgctgaaatgctttacagtatttggttagaaagaaactccagattgttcaatcacacttcatgttccagtggacatctacttagaagcattgcttatacatgtcatgttaggagtccccctaaagttaatgtacacctactgcattatctcctgtaattagaaacataggtatagtaatgtagatgctagctagtttttatcatagatgatagtcagctgtgtatagctgaactatggctttgtaaagatatacctttggtgattaatacaacaaatttaattacc

SEQ ID NO: 5251 - DNA, 673 bp, Artificial
  Synthetic
  misc_feature (577)..(577): The residue at this position can be any nucleotide.
tcgacccacgcgtccgtatcttgaaaaaggaaagaggagagagagagtgatggactttcaaagctagttatcacctaatgcataacaaagaataatcaaagcagaatggtgtcggcgttgaacctgagcatctccatggccggattcggcatcctgttggtgttggtaattggaagccgtttgcttctctcttggttgcggcgtagggataattccggaagccaggccgagcaaagcactgatgcgaatttggtaaaacggaacatccatggcctagaacctacagtagtggcttcttttccaaccatattatacaaatcacaacaagtttttacatttccaaaggaaaaccatctgtgctcggtgtgtctaggagactataaggagaaagagatacttcgagtgttaccacattgcggacattccttccacattacctgcattgatgcatggcttcgtcaacactccacctgccccatctgccgcatctcattgcgctctcttcttcctgacattcaacgggaccctccactccaagatgtcatcaccttgtagtaccacagaacttcgaaaaatntggagacgactactttgggtacatgtcaaggtttgatgcatcaatgacacgagaaaaccgaaaactcaagtgctaaacccgaaccatatcctcctt

SEQ ID NO: 5252 - DNA, 470 bp, Artificial; identical to SEQ ID NO: 3648
  Synthetic

SEQ ID NO: 5253 - DNA, 663 bp, Artificial; identical to SEQ ID NO: 4223
  Synthetic

SEQ ID NO: 5254 - DNA, 644 bp, Artificial
  Synthetic
gcagatactttacaatttcgcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgactttgccggtgtggtccgggacgacgtgaccctgttcatcagcgcggtccgggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgatatcgcgg

SEQ ID NO: 5255 - DNA, 644 bp, Artificial
  Synthetic
gatatctttacaatttcgcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgatatctgcagc

SEQ ID NO: 5256 - DNA, 596 bp, Artificial
  Synthetic
gttctttatcacagagtagagaaaacaaaaatgacggaggcaatgattaggaaaaaagccggtatggctagtgtgaaagacatgccgttgttgcaagacggtccaccaccgggcggttttgcaccggttcgattcgctcgtcggatccctaacaccggtccaagtgctttggccattttcctcactgcttttggtgctttctcttggggtatgtaccaagtcggcgttggaaataagaagcgtagggtaataaaggaagaaaagtatgctgctcgaagggctatcttgcccatgcttcaagctgaagaggatgaaagattcgttaaagagtggaagaagtatcttgaagaagaggctagaatcatgaaggatgttcccggttggaaagttggtgaaagtgtttacaactctggaaaatggatgcctccagcaaccggagagcttcgtcctgatgtctggtaatatgttggcaggagacaacgaaaactgctttgtttcagcggagttcatacttacctttggatttctttcctcattggaataaaatgtatctgcaaaatctgtacacatgtttagaatgaagttacatgatttgc

SEQ ID NO: 5257 - DNA, 697 bp, Artificial
  Synthetic
cccacgcgtccgtctcagaatccctagaacacactctgattaacgaatcaaagatcgatttgggattgtgatcgatcgaggaagaagatgacggaggcgatgataaggaagaagccaggaatggcgagtgtgaaggatatgccgttgcttcaggatggtccaccaccgggtggattcgcaccggtccgatatgctcgccggatctccaacacgggtccaagcgccatggctattttccttaccgtttcaggtgcttttgcttgggggatgtaccaagtcggtcagggcaacaaaatccgcagggcgttgaaggaagagaaatacgctgctcgtagagcgattctaccaattcttcaagctgaagaagatgaaaggtttgtgtctgagtggaagaagtatctagaatacgaggcggatgtgatgaaggatgttcctggatggaaagtcggtgaaaacgtgtacaattctggtcgttggatgcctccagctactggagagcttcgtcctgatgtctggtaaattatcaatggctccttttgatgatgatgaatgaatgtttgtttaagcattttagaaccttgatgtttcttgtctctctttttccatcgtataataagagaattgatacatacacagttcatgtattgctggtacggtactgaggaacattttctgtttttttccctcaaaaaaaaaa

SEQ ID NO: 5258 - DNA, 595 bp, Artificial
  Synthetic
cccccgatcgtcgtctcgccttgccccgtccactaaccctagcggcaactgcgatctccaaccgctcgatctctcgccggaggctccagatctgcgggaggtagtcgacctcgtcgccggcggtggggtttccgaatcgggggcgaagatgacggaggcgtgggtgcggcacaagcccgggatggcgagcgtcaaggacatgccggtgctgcaggacgggccgccgccgggcggcttcgcgcccgtgcgctacgcgcgccggatccccaccaaggggcccagcgccatcgccatcttcctcactaccttcggcgccttcgcctgggggatgtaccaggttggccaggggaacaaggtccgccgtgcactcaaagaggagaaaattgctgcccgcaccgctttagtgccagtgctccaagctgaagaagatgaaagatttgtcaaagagtggacaaagtctcttatgtgggaggaaataattatgaaagatgtccctggatggaaggtcggccaaagtgtctataattccgggaaatggatgcctcctgccaccggcgagctgcgtcgtgaagattgatgaaatccaaggggcttg

SEQ ID NO: 5259 - DNA, 761 bp, Artificial; identical to SEQ ID NO: 4674
  Synthetic

SEQ ID NO: 5260 - DNA, 683 bp, Artificial; identical to SEQ ID NO: 4676
  Synthetic

SEQ ID NO: 5261 - DNA, 675 bp, Artificial; identical to SEQ ID NO: 4677
  Synthetic

SEQ ID NO: 5262 - DNA, 613 bp, Artificial; identical to SEQ ID NO: 4678
  Synthetic

SEQ ID NO: 5263 - DNA, 598 bp, Artificial
  Synthetic
cccccccccccggaagagctcggcggtggaacagctcgctcgatcatggccgccgccgccgccgcctcaagggcgctctgggcttgccgcaccgcctcctaccttcggatctcctccttccccagggctttctccaccgtccttaaagatctaaaatatgctgatactcatgagtgggtgaaggttgagggtgattcagcaaccataggggtcacagaccatgctcaggaccatttgggtgatgttgtgtatgttgagcttccacaagttggttccacagtatcacaaggaacgaactttggtgcggttgaaagtgtgaaagcaaccagtgatatcaatgcaccagtatctggagagattattcaagtaaatgatgaactaagtgaaaaaccaggatttataaatggaagtccatatgagaagggatggatcatcaaggttaagataagtgatccaagtgagttaaactcgctgatggatgatgagaagtacaagaagttttgtgaggaagaagatggcaaacactgatcaatcccctaactgctggatttcaagaaactatgcagcaactcaccatcatgacaatgagccatctcgc

SEQ ID NO: 5264 - DNA, 596 bp, Artificial; identical to SEQ ID NO: 4680
  Synthetic

SEQ ID NO: 5265 - DNA, 675 bp, Artificial; identical to SEQ ID NO: 4682
  Synthetic

SEQ ID NO: 5266 - DNA, 756 bp, Artificial; identical to SEQ ID NO: 4681
  Synthetic

SEQ ID NO: 5267 - DNA, 755 bp, Artificial; identical to SEQ ID NO: 4683
  Synthetic

SEQ ID NO: 5268 - DNA, 730 bp, Artificial; identical to SEQ ID NO: 4675
  Synthetic

SEQ ID NO: 5269 - DNA, 629 bp, Artificial; identical to SEQ ID NO: 4684
  Synthetic

SEQ ID NO: 5270 - DNA, 1038 bp, Artificial
  Synthetic
agtagcactccaacaaagagcacttctgcacttgcaagctctgttgcctatttttccagagaagagaaaaatatgggtgctgacaaagggaagaagcaaaaagttgatgaagagaacaacatcattgatggtgagctcgttttttccattgagaaattgcaagaaatacaagacgagcttgagaagatcaatgaggaagcaagtgataaagtattggaagtggaacagaagtacaatgagatccgcaagcctgtctatgacaaacgaaatgacatcattaaagctatcccggacttctggttgactgcttttttgagtcatcctgtcctaggtgagcttctaactgaagaagaccaaaagatcttcaagtttctaagttctattgaagttgaagactctaaagatgtgaagtcgggctactcgataacctttaacttcaatgcgaatccttattttgaaaatacaaagctggcaaagacctataccttccttgaagatggacccacaaagatttctgctacaacaataaaatggaaagaaggcatggccattcctaatggagttgcacatgagaagaaaggaaacaagcgatctcatgctgaggaaagcttcttcacatggttcagtgaagtcaatcaaaaagatgaggatgaggatgaggccctagagattcaggatgaggtcgctgacataattaaggatgacttgtggccgaaccctctcacctattttaataacgagcctgatgaagaagattttgatggtgacgagggaaaggacagtgaaggctctgaagaagaagaggaagaagtggaggatgaggatggtgatgaagaatgaaggcagataaactgttcaagacccctattttgggatctcgtcttcagcggttttaatcatcagggtttagtgtctgtaaaaaggctttgaatgttgccaaagaacaaaataactgtggtgactataccttttcttctcttgtatggttataacctatgagcaaaatatctaattccggaggttaacaaaaaaaaaaaa

SEQ ID NO: 5271 - DNA, 1068 bp, Artificial
  Synthetic
ttttttggcaagatttaggacatggatgatgaaatggttgggacaaacagaatgtagctattgatagtaaataaactaaatattccaaaagagaaagcttagtctcatcattgctaaaattgagaacctcataacacaaactttacacatctgttatagaagcaagccagcaatgtgttatctttgggctcccatcattcctcaccatcttcctcctcttcatcgtcatcgtcttcttctccctcttcgtcaccatcatcatctccatcaaaatcctcttcatcagcatcattgttgaagtaggtgagagggttggaccagagatcttccttgataatatcagcaacctcatcatgaatctcatccccagcatcttccttatgttgagcatcagtaaaccaagtaaagaaactctcctctggcaatgcacgtttatttcctttcttatcatcatggttcactccatttggcaagcccttgccctccttccatttgataggagttgcagtgatttttgttgttccttcttcaaggaaagtaaatgtcttggtaagcttggcatcctcaaagaacgggtttgaagtgaagtgaaaagttatagagtatccagatttcacatctttggcatcctccacttccagagagttcaagtacttaaaaatcttttggtcttcttcagtcaagaggtcgcctaaggcaggatgactcaaaaaagcagtcatccaaaagccaggaatcgattggataacttcattgcgcttgtcatagacaggtttccgtatcacgttatatttctgctctacttccaagacctcgtcactggccttttcgttaatcttctcgaggtcgtcttgaatctcctgaagcttctcaattgagagaacaagctctgcgtcgatttgctccaagttttcttcttcgcctttctcttcaattttcgacttcttgctcttgtccgcgaccattttcagttcacttcctttgaggaaaccctaattccaaagaaagagaggattttggctcctcctttttggtctcttctcttcttgtggttcccggacgcgtggg

SEQ ID NO: 5272 - DNA, 726 bp, Artificial
  Synthetic
aaagaagaggagacagaagaagaagaagaagaagaaaagaagaaagagagatggcggcaatctcgtcgtctctgggcctcagcaaggcacagttcttcggctcattcgatgctagcgatgcggcgagaggctcttcttctcgcgttggaatcgcgagatcgaagtgtgtgatccgcgcgatgcagcaagaacacgatccgtcgagacgagcagcagtctttggcctggtcgcagtggccgcgggcgtactggccgtggaggaatcgcgagcagtgagtggaatcaagatcaatgggccacctccaccatccggaggacttcctgggacggagaacgccgatcagccgcgcgacttggatctgccactcaaagagcgatttttcatccagccgctgtcgccagccgaggcagtggatagaatcaaggacgcgtcgaaggacattgtgggagtaaaggagctgatcgagaagaagagctggccgtatgtccgcaacgatcttcgcagcaaggcgacttacttgaggtatgacatcaaaaccatcctggatgccaagcccaaggcccagcgcaaagagctcaagaaatacacggacagtctcttcgacacaattgacaagcttgactatgcagctcgagcaaaggatcccgcagccgcgagcaagtgctacagcgacaccgtagctgcattggacactgttattgccaaaatctcggcataaatatata

SEQ ID NO: 5273 - DNA, 886 bp, Artificial
  Synthetic
tctaaatcaaggatatcagaggtgctagtggtgctatcgttgtaaagggaagatggctcaagcagtagcgatggccgggctttgctcatccctctcctcggccgcttcctcgctcgacggggccggctctcgcctcttggcctcctccccttcttcctctgccccctctaaaccatcccttcgcctccctttaatccgcgctagctcgtcgaatccctcagaagacgcttctgctaaatctagtactagacgccaaatcttgtccctcgttgctgtctctgctttgcttgtctctaaacaagccctcgccgaccctagccctatcaagctctttggccctcccgccccttctggtggcctccctgggactgaaaatgccgacgaagctcgagatctagacttgccattgaagaatagattttacctgcaacctcttcctcccgtggaagcgatcgccagggcgaaggaatctgccaaagagattgtgaatgtgaaggcattgatcgacaagaaggcttggccctatgtccagaacgggctccgatcacaggcttcctacctgcgctttgacctcaacactgttatcgcttccaagccgaaggatgaaaagaaagctcttaaaagccttagcactaagctctttaacactatcaataatctggactatgctgctagaagcaaaagtaccacccaggcggagaaatattatggagaaactgtttcggcattgaatgatgttcttgctaagcttggatgattattctggtttccctttgtaatatcttttagtctctagttttatccaacttaagaagattatgagtggaatgatgtaacatttgagagaacctgcccaccttattggaatttaatcacttgtaatcgc

SEQ ID NO: 5274 - DNA, 820 bp, Artificial
  Synthetic
gaattcaatggcgcaagctatagcatcagtatctggcttaagcagcttctcgcaaggtacaaacagattgaatgtggctactaccaacagccgaacggccagaagtcgtgttggtttcagcgttagatctgagaagaagtcggaatcggagactgctcagagtagccgtagagcactattgggtgtcttagctgtgggactaaccactggatctttcgtgaagaatgtgcttgctgatgctaggcctattgtaatcgggccacctcccgctccttccggtggtttaccggggactctaaattctgatgaagcaagggacttagatctacccctaaaaacaaggtttttcctacagcctaagactccagaagaagcagctcaaagagtaaaagaatcagcgcaagcgatcctaggtgccaaggcacagatagacaaaaaggcatggccgtatgtccagaatgaactacgatccagcgccgaatatcttcgttacgatctcagaactatcatctctgcaaagcccaaggatgagaagaaaccactcaaagaactgtctgacaagcttatccaaaacctcaatagtctggactatgctgcaaaggttaagagcactcctgaagcagagaagtactatgccgaaacagcagcatcattaaaagaagttctagcaaagattggttaagagatacttgtcaagagctgaacatcaattattttattcttcttcctgatgaaactgagtgacgattttgtcattcccgaacaatcattgctgtattacttttttttggtatgatcaaaggatgaatataaccatata

SEQ ID NO: 5275 - DNA, 540 bp, Artificial
  Synthetic
tggtatcaacgcagatggccattacgccgggggcctgaaacaaatttcagaaagttcaccaaaatggctcatgctatggcttcaatgggtggcctaattggttcttctcaaactgtgttggatggtcagctcagtggctcagcccgtttgagcactgttagcaccagcagaattgccttggctagaccaggactcagcattagagcccaacaggggtctgctgacactgaaactagccgtagagccgtcatcggtcttgttgctgctggccttgctggttcctttgctcaagcagcctttgctgcagctaaatcaatcaagattgggggcgctcctcctccctctggtggattacctggaactttgaactcggatgaggcaagggactttggtctaccattgaagaagaggttttaccttcaaccattgactccagctgaagcagcccagagagttaaggattcagccaaggagattgttagcgtcaagaatttcatcgacaagaaggcctggccatatgtccagaatgaccttcgtctc

SEQ ID NO: 5276 - DNA, 1136 bp, Artificial
  Synthetic
gtaatttatttcttagtttctcaatatcactaatggcttctcttggacttggtttaatccttgtaataatgttctttctatctatattccaagcattttcagcttccacttcccatattggtggtgactatgctaatctttatccacaattctaccaattcacatgtcctcaagctaatgatattgtcatgtctgttttagaagaggccattgctaaagattcaagaatggctgcttctctacttagacttcacttccatgactgctttgtccagggatgtgatgcatccatattattggatgggaataaagaattcaaaagtgaaaaggatgcttcaccaaacaagaattctgctaagggatttgaagtgattgatgagattaaagctaaactggaacatgtttgtcctcacacggtctcctgtgctgatattctagcccttgttgctcgtgactctgtcctcctgagcggtggaccattttgggaagtgccactaggaagaaaggactcaaagatagcagacttcaacagagcaagtatcgacatccctggaccaaactcaacaatccaaaacctcataaatcttttcaacaaacaaggcctaaaggaagaagaccttgtttctctttctggagggcacaccataggggtggcaagatgtgtgtcatttaggcaaaggctatacaatcaaaatggtgacaatttgccagatgcaactctagaaagagattactactatgatttgaaatcaatttgtccaacaaagggtggagacaataacatttctcctctagatgttgcttcccctgtcaaatttgataattcatatttcaagcacttgttaaatggcaaaggtcttttgaactcagatgaagtacttttcactggaaatgtacaaaagactacagaattggtgaagaattatgctgaaaatgagggacttttcttccaacaatttgcaaagtctatggtgaaaatggggaatattaatactctgaatgaattgaagggtgaaattaggaagaattgtcgcatagttaactaaaataaattagtactactctgtatttatgaataattgcatgatcatgtttagttcctgagttttcttttgaataaagctttggttagatgg

SEQ ID NO: 5277 - DNA, 1168 bp, Artificial
  Synthetic
cccacgcgtccgcaagtaacaaaaatggctatctcaaagcttattcctactcttgtgctctttgttttgttctcttttgatgttagtgttgctcatccaggtctaggatttggatggggaagtaatagtcccattggaggatctttttactcaaatctttacccacaattttaccagttctcttgtccacaagctgatgagattgttatgacggtgctcgaaaaagccatagctaaagaaccaagaatggcagcatctttactcagacttcacttccacgactgcttcgttcagggctgtgatgcatcaatcttgttggatgatagtgcaaccataagaagtgaaaagaatgctggaccaaacaagaactccgttagagggtttcaagtaatcgacgagatcaaagccaaacttgagcaagcttgtcctcaaactgtctcctgcgccgacattctagctctagctgctcgtggctcaactatactgagtggtggaccatcatgggagcttccactagggaggagagactcgaggaccgctagccttaatggcgcaaacacgaacattcctgcacctaactcaactattcaaaatctcttaaccatgttccaacgtaaaggtttgaacgaaaaaaaccttgtttccctatcaggaggacatacgattggagtagcgaggtgcccaacgttttaacaaagactataccatcaaaacggtaataaccaaccaaacgagacgctaaaaaggtcttactactatggtctcaggtcaatttgtccccccacaggcggtgacaacaatatttcacctttagacttagcctttcctgcaagatttggcaacacatacttcaagctccttttatggggcaaagggttattgacatcaaatgaagtgcttttccctggcaatgtaggcaagactggtgccttagtgaaagcttatgccgaaaacgaaagactttttttcccacaatttgcaaagtcgatggttaacatgggaaacattcagcctcttactggttttaatggtgagatcaggaaaagttgtcatgtgattaactaaaaaaactgtgtgtttttgcattattattgtattaaggggtgattaaaaataagtcgtgttatgtttttcgatatgttagtgatttaattaacgtctttgaccg

SEQ ID NO: 5278 - DNA, 490 bp, Artificial
  Synthetic
cccggcgccaccaaacaaccccagcctccggggattcgaggtgatcgacgccgccaaggccgccgtcgaggcggcgtgcccgcgcgtcgtctcctgcgccgacatcctcgccttcgccgcccgcgactccgtcgcgctcaccggcaacgtcacctataaggtccccgccggccgccgcgacggcaacgtctccatcgcccaggacgcgctcgacaacctgccccctcccaccttcaacgccacggagctcgtcggccgcttcgccaacaagtcgctcaccgccgaggacatggtggtgctctccggcgcccacaccatcggcgtctcccactgggactccttcaccccgcgcctctacaacttcaccggcgtcggcgacgccgacccggcgatcagccccgcctacgcgttcctcctccgcgccgtgtgcccctccaacagcagccagttcttccccaacacgacggtggacatggacgtgatcaccccg

SEQ ID NO: 5279 - DNA, 785 bp, Artificial
  Synthetic
ctcttcttcaccttcctcgtggccttcttccccggcgccgccgtcggcggggggctgaaggtcgggttctacaacaagacgtgcccgtcggcggagcgcctggtgcagcaggcggtggccaccgcgttcaagaacaacagcggcgtcgcccccggcctcatccggctgcacttccatgactgttttgtcagaggctgcgacgcctcggttttgatcgacgggaacgacaccgagaagaccgcgccaccaaacaaccccagcctccggggattcgaggtgatcgacgccgccaaggccgccgtcgaggcggcgtgcccgcgcgtcgtctcctgcgccgacatcctcgccttcgccgcccgcgactccgtcgcgctcaccggcaacgtcacctataaggtccccgccggccgccgcgacggcaacgtctccatcgcccaggacgcgctcgacaacctgccccctcccaccttcaacgccacggagctcgtcggccgcttcgccaacaagtcgctcaccgccgaggacatggtggtgctctccggcgcccacaccatcggcgtctcccactgcgactccttcaccccgcgcctctacaacttcaccggcgtcggcgacgccgacccggcgatcagccccgcctacgcgttcctcctccgcgccgtgtgcccctccaacagcagctagttcttccccaacacgacggtggacatggacgtgatcaccccggcggcgctcgacaacaagtactacgtcggggtcaccaacaacctgggcctcttcacgtc

SEQ ID NO: 5280 - DNA, 581 bp, Artificial
  Synthetic
gatggctagcatagaagttcatgctaatatgttaacgtgcttgcattttttgcttgttcctggcagccgtcaaagcgcagctcactccaggtttctacgacaagtcatgcccgacattacttcccactatccgtgctgttcttgaaaagggcgtcgctcaagagccccggatcgctgcctcgctgctgcgcctgcatttccacgactgcttcgtcaatggatgcgacgcttctctcccttcctggacgaatacccccgggcttcactgggcgagaaaaccgcagctccaaacaaaagatccgcccgtggcttcccggtggtggacagggcaaagttcgcggtggagaaggcatgtccgggagtggtgtcctgcgcagacattctcgccatcctagctcgtgaatccgtcaccttgatggatggaccgagctgggtggtgcaacttggtcgccgcgacagcaccactgccaaccgcagcgcggccaacaatgacatccctccgccaaactccacactggcgattctcctctccaagttccaagccaaaggcctcaacgccaaagatctcgtcgctctgtctg

SEQ ID NO: 5281 - DNA, 585 bp, Artificial
  Synthetic
ttctacgcctccatttccatgacttgcttcgttcaggggtgcgatgcgtcggtgctgctagatgataccccaactttccaagggagagaagacggccgggccaaacaacaactccatacgaggattcgaagcgatcgatgcgatcaaatcttctttggagagtagctgcaagggggtagtgtcatgcgcagacattctagctctggcagctcgcgactcggtggtcttgagcggtggaccatcgtgggaagtgccactgggacgacgagacagcaccacagctagcttctccggagctgggaatcggttgcccagcttcttttccgacgtgaatggattgatcaagtctttcacagacgttggtttacaagcagaagacatgtttacgctatctggggcgcattcaatcggtcatgctagatgccttgcttttgcgtctagaattttcaatgatagtggcagtggaagtccagatcccagcattcgcgtcagctttctctccatgcttcagtccaaatgcccgcagagtggagatgttaacgctctccagccactggatgcgacgactatcaccaagtttgataa

SEQ ID NO: 5282 - DNA, 360 bp, Artificial
  Synthetic
tagtcgaccacgcgtccggggctactcccggtgcctcttcttccgcaggcgcctctacaacgagaccgacacgctggacccggcctacgccgcggcgctcgaggagcagtgccccatcgtcggcgacgacgaggcgctcgcctcgctggacgacacgccgaccaccgtggacaccgactactaccagggcctcacgcagggccgcgcgctgctgcacacggaccagcagctgtaccagggcggcggcggcggcgacagcgacgagctggtcaagtactacggcgagaacccggacaagttctgggaggacttcggcgccgccatggtgaagatgggcaacatcagcccgctcaccggcga

SEQ ID NO: 5283 - DNA, 613 bp, Artificial
  Synthetic
cccacgcgtccggtgcttttggactcgtcggggaacatgtcggcggagaaggacggcccacccaacgcgtcgctgcacgccttctacgtcatcgacaacgccaaggccgccgtcgaagccctctgccccggcgtcgtctcctgcgctgacatcctcgcgctggccgccagggacgcagtcgccatgtccggtggtccttcttggcaagtgccggtgggtcgtcgtgacgggcgcgtgtcgctggcgagcgagacgacgacggcgctaccggggccgacggcgagcttcgaccagctgaagcaggcgttccacgggcgcgggatgtcgaccaaggacctggtggtgctgtcggggggtcacacgcttggcttcgcacactgctcctccttccagaaccgcatccagccgcagggcgtcgaccccgcgcttcacccctccttcgccgccaccctccgccgctcctgcccacccaacaacaccgccaggtctgccggctcctccctcgagcccacctcctccgccttcgacaacttctactatcggatgctgctctccggccgtggccttctctcctccgacgaggcgctgctcacccaccccaagacgcgcgccc

SEQ ID NO: 5284 - DNA, 578 bp, Artificial
  Synthetic
tgtactattggacgatactagtacattcacaggagaaaagaatgcgcctggtaatcgaaattcagccagaggatttgaagtcattgatgcaataaaagcaaacgtggagaaagcttgcccgtctacagtttcatgtgctgatatactgactctagcagctagagaagctatctatctcactgggggcccatattggtcactttctttgggccgtcgagatagtcttatcgcaagtcagagtgcagctaatgctcaaattccatcaccttttgagcccttacaaaacattactgctaaatttgtttcaaagggtcttgacgtaaaagatgttgtggtgctatcaggtgctcacaccattggatttgctcaatgtttcaccttcaagcaaaggctgtttgattttgatggatctggaaatcctgacccgacactggattcatcattactgggcaatctgagaagcgtatgtcccaaccaaaatgattcagattccaaccttgcccctttagatgcagtcacaatcaacaagttcgataatgtatatttcaagaatctgatgaacaattctgggcttcttc

SEQ ID NO: 5285 - DNA, 747 bp, Artificial; identical to SEQ ID NO: 4687
  Synthetic

SEQ ID NO: 5286 - DNA, 360 bp, Artificial
  Synthetic
tggtatcaacgcagagtggccattacggccggggaccaagcaaaaactcaaaacttcacatctttagtagtagcatcaatattcaagatggttctccaaactcaacttgggttgaacaagccccaatcctacgctcacgagcaaaattattattccgacggcagccatggcggctctatgcaaatgacaaggccatcgggctattccaccatgccatatggccagtccactcacaatcacatgatgatgggtcatggtggccaacatcatggcggacactatggtggtcatggccatggctacggcggtcatgaacatcatggggcgcatatgccccatgactccactaacttttcaagc

SEQ ID NO: 5287 - DNA, 334 bp, Artificial
  Synthetic
  misc_feature (105)..(105): The residue at this position can be any nucleotide.
tggtatcaacgcagagtggccattacggccgggggtggtcctacgcatgtgcaaagcaattgattgagaggttgatctatgctgagggtgctgagaatggcttanaattcaccattgttaggcccttcaactggattggtccgaggatggatttcatacctgggattgatggtcctagcgaaggtgttccgagagtgttggcttgctttagtaataatcttttaagacatgaaccactaaagctagtggatggcggacactcgcaaagaaccttcatatatattaaggatgctattgaagctgttctcctgatgattgaaaatcctgcacgggc

SEQ ID NO: 5288 - DNA, 1255 bp, Artificial
  Synthetic
cccacgcgtccggaaactcgaatttttagagagagaaagtgcaatttttacaggggaaaaatggcaggagggagagtagatctggacggcaatgttataaagccgatgaaaatatgcatgatcggcgccggtggtttcattgggtcccacttatgtgagaagctgatgaatgaaacgccgcacacggtgctcgctgtcgatgtttacagtgataaaatcaagcatctacttgaaccggctgatctcccttggaccggtcgaattcagttccatcgaattaatattaagaatgattctcgtcttgaaggtctcatcaaaatggcagatctggttgtaaatcttgctgcgatctgcacgccagctgattacaatactcgtccacttgacacaatctacagcaacttcattgacgctttaccagtggttaaatactgctcagaaaatggaaagcgtctcattcacttttcaacttgtgaagtttatgggaaaaccataggtgcctttttacccgaagacagcccattgcgacaggatcctgcttactacgtccttaaggaagatgtctctccttgtatttttggatctattgagaagcaaaggtggtcctacgcatgtgcaaagcaattgattgagaggttgatctatgctgagggtgctgagaatggcttagaattcaccattgttaggcccttcaactggattggtccgaggatggatttcatacctgggatcgatggtcctagcgaaggtgttccgagagtgttggcttgctttagtaataatcttttaagacatgaaccactaaagctagtggacggtggacactcacaaagaaccttcatatatattaaggatgctattgaagctgttctcctgatgattgaaaatcctacacgggctaatgggcagatctttaatgtcggcaatcccaataatgaagttacagttaggcagcttgctgaaatgatgactcagatgtattcaaaggtgagtggagaatctcctcctgaaacacccaccattgatgtaagttctaaagaattttacggcgaggggtacgatgacagtgacaagcgaattccagacatgaccataattaacagacagctcggttggaacccgaagacatccctatgggacttgcttgaatccacgctgacataccaacataggacttatgctgaggctgtcaagcaggcaatgtcacagacaactggaaattgaatttgaaatcagagcagtggttagtgtgtgc

SEQ ID NO: 5289 - DNA, 824 bp, Artificial
  Synthetic
gaggagcaaatgggtcagtcgctttgctgcttccaggtcccccagtccaaggtggcgatcaaggaacgatggggcaaattcgacgaggttctagatcctggatgccacttcgtcccctggtgctttggcagcaacattgccggctctctcaacctccgcattcagcagctggatgtgcgctgcgagaccaagtccaaggataacgtattcgtcacggttgtagcttcggtccagtatactgttgtccaggccgacgccatggatgcatactacaagctttctaacccgagggaacaaatccaagcttatgtctttgatgtcgttcgtgcttgcgttccaaagatgaacttggacgatgtgtttgaacagaagaacgaagtagccaaggctgtcgaggacgagctcgaaaaggcaatggctacatacggatatcgcatcgtccagactttgattgtcgacgttgagccggacaaacatgttcgcaacgcgatgaacgagatcaatgcagctgcgaggatgagggtggcggccaacgagaaggccgaggccgagaagatcctccaggtgaagcgagccgaggccgaggccgagtccaagtacctctcgggagttggtgttgcgaggcagcggcaggcgatcgtagatggcctccgcgagagcgtcttggcgttctcgcacaatgttccagggacgagtgccaaagacgtgatggacatggtgctactgacgcagtatttcgacaccatgaaggagattggcgctgcttccaagtcttccaccgtcttcctcccgcatggaccaggcgctgttcgtgacgtcgcgga

SEQ ID NO: 5290 - DNA, 986 bp, Artificial
  Synthetic
ggaaatggcttgctgtgtgtgcatcgatcaggctagcgtcgggatcctggagaaatggggcaagttcgtgcgcgtgctggagcccggattcagctgcgtcgtgccgtgctttggccagttcgtggctgggacgctgtccctcaaggtgcagtacttggatgtgcggtgcgagaccaagacaaaggacaacgtgtttgtgtccctcgagtgctccatccagtaccgcgtggtgcgggagaacgcggacgatgctttctacgagctgcaaagccccgagcaacagatacgttcctacgtcttcgatggtcagtatctcatatacgtcggtagtctaggcccattgtgatatgttactggcagtgatccgggcgtctgttcccaagatgtcgctggacgaggtctttgagcagaagagcgacattgcgaaggcggtttcggatgagctagagaaggttgtaaaaaggtttcctatattgctctcgctcacaattgtcaaacaggtgatgagcgcgtatggttactcgattgagcagatactcatcatcgatattctccctgatgctgcggttcggaaagccatgaacgagatcaacgcagcccagagaatgagaatggcggcagtcgagaagggagaggctgagaagatcctgcaagtcaagagggccgaagccgaggccgagtccaagtatttgtcggggctgggagtggccaggcagcggcaggctatcaccgacgggctgagggagagcgtgctgaccttctcgcaggatgttcccgggacttctgccaaggaggtgatggaccttgtcatgatcactcagtacttcgatacccttaaagacattggtgccagctccaaaaacactgctatgttcatacctcacggacccgcgcacgtcaacgacatcgcccagcagctccgggacggggttctgcaagccaacactgctgcgtccttgatggattgaatggaatctcatgcttat

SEQ ID NO: 5291 - DNA, 541 bp, Artificial
  Synthetic
gtagagtacacaatgggtcaagctctttgctgtgtgcaaattgaccagtctactgtgggtatccgagaaaggtgggggaaatatatagaattactccatcctggatgccattgtgttatgtggtgtcttggaagcaatgttgctggtattctttccttacggcttcaaaagcttgatgtccgttgtgaaacaaaaaccaaggataatgtttttgtgacaatagttgcttctgtacaatatcgggctgtgatagaccacgccgatgatgctttctacaagttgtcgaacccccgcgagcaaattcaggcatatgtctttgatgtgattagagcaagtgtgccaaagatgaatcttgatgatgtatttgaacaaaagactgaagtagccaaaagtgttgcagatgaactagagaaagcaatgtcaacgtatggatatgaaattgtccaaacattgattgttgacatagatcccgatgaaactgtaaagcgagctatgaatgaaatcaatgcagctgcaaggcttagagtagcgacgctagaca

SEQ ID NO: 5292 - DNA, 585 bp, Artificial
  Synthetic
atcagctttttgagaccttggagtagagtacacaatgggtcaagctctttgctgtgtgcaaattgaccagtctactgtgggtatccgagaaaggtgggggaaatatatagaattactccatcctggatgccattgtgttatgtggtgtcttggaagcaatgttgctggtattctttccttacggcttcaaaagcttgatgtccgttgtgaaacaaaaaccaaggataatgtttttgtgacaatagttgcttctgtacaatatcgggctgtgatagaccacgccgatgatgctttctacaagttgtcgaacccccgcgagcaaattcaggcatatgtctttgatgtgattagagcaagtgtgccaaagatgaatcttgatgatgtatttgaacaaaagactgaagtagccaaaagtgttgcagatgaactagagaaagcaatgtcaacgtatggatatgaaattgtccaaacattgattgttgacatagatcccgatgaaactgtaaagcgagctatgaatgaaatcaatgcagctgcaaggcttagagtagcgacgctagacaaagcagaagctgagaaattact

SEQ ID NO: 5293 - DNA, 747 bp, Artificial
  Synthetic
agttaatatgggaaatttgttctgttgtgttcaagttgatcaatccacagttgcaattaaggagcaatttggcaagtatcaggatgtgcttgagccaggttgccactgtgtgccttggttccttggaagccagttggctggtcatctctccctcagggtgcagcaactagatgtgcgctgcgaaaccaagacaaaggacaatgtatttgtcaatgttgtcgcatcaattcagtatcgtgccctggcggacaaagcaaatgatgctttctacaaactaagtaacactaagggtcaaattcaggcttatgtttttgatgtcataagagcaagtgttccaaaactcaatctggataatgtctttgagcaaaaaaatgaaattgctaaggctgttgaagaggaacttgagaaagctatgtcagcttatggatatgaaattgttcagacacttatagttgatatagtaccagatgagcatgtgaagagggctatgaatgaaatcaacgctgctgctaggttgagggtggctgctaatgagaaggcagaagctgagaagattttgcaaattaagagggctgaaggggaggccgagtctaagtatctcgcaggcttaggtattgcacgacaacgtcaagcaattgtggatggtctgagagacagtgtgctaggattttcagtcaatgtgcctggaactagtgcaaaggatgttatggacatggtcctcgtaacccagtactttgacacaatgaa

SEQ ID NO: 5294 - DNA, 605 bp, Artificial
  Synthetic
tggtatgaacgcagagtggccattacggccgggggaaagagagatacaaagtcgccgttggtgttgctgaggcattagaatatcttcacagcagagatgctcaaccagtgatccaccgtgatgtaaaatcgtcaaatatactactctctgatgattttgagccgcagctctctgactttggacttgctaaatgggcaacaaccacctcatctcatattacatgcactgatgtagctggaactttcggttacttggctcccgaatatttcatgtatggaaaggttaatgacaagattgatgtctatgcatttggagtagtacttcttgagcttctttcaggaagaaagccgataagtaacaattgcccgaagggtcaagagagcctggttatttgggcaaagccaattctgacttgtgggaagtatacccaattactagacccacagttgagttctgactatgatcatgaacaagtagaaagcatggtgctagctgctgccctttgtatcagacgtgctccacgagctcgaccacaaatgagcattgtttcgaagctgctcaaaggtgatgctgaaacaaccaagtgggcaaggttacaagtcaat

SEQ ID NO: 5295 - DNA, 755 bp, Artificial
  Synthetic
cccacgcgtccgtgaagatcgctctcggtgctgctaaaggggtagcctttctccatggaggtcccaaaccagtaatttacagggattttaagacatcaaatattcttcttgatgcggagtacaatgcaaaactttcagattttgggttagcgaaagctggtcctcaaggcgataaaactcatgtctctacacgggttgtcggtacctatggttatgctgcacccgagtatgtaatgacaggacacttgacatccaagagcgatgtatatagcttcggagtagtgttactcgagatgttaaccggtagacgatcaatggacaagaagcagcctactggggagcagaacctagtggcatgggcgaggccgtatctaagtgatcggcgaaggctctaccagctcgtagatcctcgcttggggctgaactattcagtaagaggggtgcagaaggttgctcagatctgctaccactgcctcagccgtgacaccaagtctcgtccgacaatggatgaagttgtcaagcacctgacgccgttgcaggacctaaatgacatggcgtctgcatcatatagacctcgatcatctcagcgtggaaaggcacgtcggtgatggccggatccactgctaaaaagcagcgaaatttgatgatttttaaggtcatttccgggtgctttgttttggttttaattgtatagtgaaactaggcttgataatcctcaaatccctggagatgtgacgccccctgatgtctaatct

SEQ ID NO: 5296 - DNA, 662 bp, Artificial
  Synthetic
gaattcaggctatcacaaagttcatgtcaaattgaacaagagttcaggaatgaagttatcttagtagctaaacttcaacacagaaatcttgtaaggcttcttggcttttgtctagctggtgaagaaaaattacttatctacgaatttatgccaaatgcaagccttgatcagttcatattcgatccaattaaacgcacatatctgaattgggaaagacggtacaagataatagaaggaatagcaaaaggcctcctctatcttcatgaagagtcgcaccttaaaattatccatcgagatctcaaagctggtaatatattactcgacatcgacatgaatccaaaaattgcagattttggcacggctaggctttttgtgcttgatcaaactcacgctagtacaaaaagagttgtgggaacacatggctacatggccccagagtatatattacatgggcatttctccgagaaatcagacgtctatagttttggtgtcttaattttagagatcctcagtggacagaagattagcaattttcagaattcagaaatggctcgggaccttctcagctatgcatggagacattggaagaatggatctgctttagagttgttagatccagtcgtgaaggacgcatgttcaggaaatgacgcgatgagatgcat

SEQ ID NO: 5297 - DNA, 336 bp, Artificial
  Synthetic
tggtatcaacgcagagtggccattacgccgggggaaagacagatacaaagtcgccgttggtgttgctgaggcattagaatatcttcacagcagagatgctcaaccagtgatccaccgtgatgtaaaatcgtcaaatatactactctctgatgattttgagccgcagctctctgactttggacttgctaaatgggcaacaaccacctcatctcatattacatgcactgatgtagctggaactttcggttacttggctcccgaatatttcatgtatggaaaggttaatgacaagattgatgtctatgcatttggagtagtacttcttgagcttctttc

SEQ ID NO: 5298 - DNA, 666 bp, Artificial
  Synthetic
tagtggaggtgcttatgcttagtcttcttcatcatcctagcttggtgaacttaattggttattgtgctgacggggaccagaggcttcttgtctacgagttcatgcctttgggatcactagaggatcatcttcatgatctccctcctgataaataaccagtagattggaacacgagaatgaagatagcagctggtgcagcaaaaggtttggagtaccttcatgataaggcaaaccctcctgttatttatagggacttcaagtcatccaacatattgctcgaggaaaattttttcccgaagctttcagattttgggcttgctaaacttggtcctactggagacaagtcacatgtgtccacaagggtcatgggaacttatggttactgtgcccctgagtatgccatgactggacaattgactgtaaaatctgatgtctatagttttggggttgtcttcttggagcttatcactgggcgtaaggctattgacagcaccatgcctcagggagagcaaaaccttgtcgcatgggctaggccactgtttaatgatcgtaggaagtttgcaaaattagcagatccaaggctgcaaggacaatttccaatgagaggtctataccaggctttagctgtggcgtccatgtgtatccaagaacaggctgctgctcgtc

SEQ ID NO: 5299 - DNA, 414 bp, Artificial
  Synthetic
gctcattgcatgacatacttcatgggaggaaaggtgtgaaaggtgctttgcccggtcctgtgctggattgggcccaacgcgtgaagatcgcggtaggggctgcgaaaggactggagtatttgcatgaaaaggtctctccaccacttattcaccgcgacatcaaatccagcaacgtcctgctctttgacgactacacggccaagatagcagacttcaatctctcaaatcaagctccagacatggcagcacggctccactcgactcgtgtgcttggaaccttcgggtaccatgctccagaatatgctatgacgggtcagctcacacagaagagtgatgtgtatagcttcggcgtcgtcttgctggagctgcttactggaagaaagccagtggatcattcaatgcctcgtggacagc

SEQ ID NO: 5300 - DNA, 506 bp, Artificial
  Synthetic
gaatccagcaacattatgctctttgacaacgatgttgcgaaagtaggagacttcgatgtatccaatcagtccccggacatggcggctcgcctccactccactcgtgttcttggcaccttcggttatcatgctcctgagtacgcgatgacagggcagcttagcacgaagagcgatgtctatagcttcggagtcgtgttgctggagcttttaacaggtcgcaaaccggtcgatcatacgctgccccgtggccagcagagtcttgtgacatgggctactccaaggctaagtgaagacaaggtgaagcaatgcgtggatccaaggcttgaaggggattatcctcccaaggctgttgccaagatggctgccgtagctgcgctgtgcgtgcagtacgaggcggacttcaggcccaacatgagcatcgtcgtcaaggctctgaacccactcctcaacaagccgcccgaacaatcgccccgcctccttcaccgacgccggcgagcgatccggat

SEQ ID NO: 5301 - DNA, 561 bp, Artificial
  Synthetic
gaattcaggctctgacggacaggaaatagccgtgaagaggctatcgagaaattcaggtcaaggtgcacaagagttcaaaaatgaagttaccttagtagctaaacttcagcaccgaaatcttgtgcgacttctaggcttctgtatagatggtgaagaaaaattactcgtctatgaattcatgccaaatggaagccttgaccaactcctattcgatccaaataagtgtacacatctggactgggaaagacgatacaagataataggagggatagcaagagggcttctctatcttcacgaggagtctcgactaaaaattatccaccgagatctcaaagctagcaatattttattagacacagatatgaatcctaaaattggagatttcggcatggctaggctttttgtggttgaccaaacacaagctaatacaaacagagttgttggaacttatggctacatggctccagagtatgcaatgcatggacaattctctgtgaaatcagacgtatttagtttcggtgttttagttatagagattctcagtggacagaaaaacaattg

SEQ ID NO: 5302 - DNA, 649 bp, Artificial
  Synthetic
tactcttcaaaggatatcatcaaaaagctggagactctgaacggggaacacataattggttctgggggatttggaactgtatacaagcttgcaatggatgacggcaatgtatttgccttgaagagaattatcaagatgaatgaaggttttgtttggttcttcgagagggagcttgaaattcttggaagcattaagcaccgatatctggtaaatctgcgaggatattgcaattctccaacgtcgaagttgttgatatatgacttcttatccggaggtagcctagatgaagttctgcacgagagatctgagcaactagactggggtgcacggctgactgtaatcatgggagctgcgaaagggttggcatatttacatcatgattgttcccctcgagtaatccaccgtgacataaaggctagcaacattttgcttgatggcaattttgaggctcgagtatctgattttggactggccaaattactcggagatgaggagtctcacatcacaacaattgtagctggcacatttgggtatttagctccagagtacatgcagagtggtagggctacagaaaagactgatgtttacagttttggagttctggttcttgaagtcataagtggaaagaggccaactgatgcatcatata

SEQ ID NO: 5303 - DNA, 590 bp, Artificial
  Synthetic
taggtttacgttatcttcacaaagaatgcagagtgggctgcattgtccaccgagatatgagacccaacaacattctcatcacccatgacttcgaaccactagttggagactttggtttagctaggtggcaacctgatggtaacacaggtgttgagacgagagtaattggaacatttgggtacttggcgccggagtatgctcaaagtggccagattacagaaaaagctgatgtttactcatttggagtggtactggtggagcttgttacaggacgcaaggcagtggatcttacaaggcctaaaggccagcagtgtctcacagaatgggctcgtccattattggaagaatgtgcagttgatgagctaattgacccccggctggagaactgctattccgaacatgaaatatactgcatgttgcatgcggcgtctttgtgcatacgacgggatcctcaggccaggcctcgcatgtctcaggtactgcggatacttgaaggcgacctcatcgtggaatctggtaaactgtcagcaacacctgcttatgatttggaagccaaagcggaagaattttgtcagattcgctgcaacagt

SEQ ID NO: 5304 - DNA, 654 bp, Artificial
  Synthetic
cttcatcaaatctcacaaatcttcaacacttaatcacaaatctcaaagcttcggataccaaatggctcgtaccaagcaaaccgcaaggaaatccaccggaggaaaagccccaaggaaacaactcgcaacaaaggcggcgaggaaatcagctccggcgaccggaggagtaaagaagccacacagattccgtcctggaactgttgccctaagagaaatcaggaagtatcagaagagcactgagcttctgatccgcaagcttccgttccagcgtttggttcgtgagatcgctcaggatttcaaaacagatctgcgtttccagagcagcgccgtcgcagcacttcaggaagcggctgaagcatacctcgttggattgtttgaagacaccaatctttgcgcgattcatgctaagagagtcactatcatgcctaaggatattcaattggcgaggagaattagaggcgagagggcttaagaaggagattgaagtactctagactgtgatcgttatgcttatgtatatctttcgttttccctaatttcgtgttttagggttggattaggttttgcgtttatgttgttcgatatctaacggatcaaaatctctccttccttagcaaagtttgaaaactccctccacattttcaaaaaaaaaac

SEQ ID NO: 5305 - DNA, 1105 bp, Artificial
  Synthetic
tgcttttggccacagacctactcacgattggcagttgatcacaagcctcttccgcaatggagcatggcattccacaactgtgtccaacgattccattcagggcgcatttttgcggttccaatagatacttcttgtaaagttccaatctcttatttcttgtttcagaatatacatgctttcgctcacatctcttaccacagtaagtacttgtagttaaggtaccacaacacacacaagagaaagtagccattctagacctaggaccagggttagattccacgtcacccgccaacttcagcaaatcaaaattcaacagctgtttgtagagctcggcataatccggaacatcatacggataagcggccgcaccgcgctcaccacggaggcggcgggccagctggatgtccttggactggatggtgacacgcttggcgtggatggcgcaaaggttggtgtcctcgaagagggagacgaggtaggcctcaacggactcctggagagcgccgatggcagaggactggaagcggagatccgacttgaagtcctgagcgatctcacggacaagacgctggaagggcagcttgcggatgagaagctcggtagacttctggtaacgacggatctcacggagagcgacggtaccaggcttgtacctgtggggcttcttgacaccgccggttgagggggcggacttgcgagcagccttggaggcgagctgcttacggggagccttgccaccagtggacttacgggcggtctgcttagtgcgagccatgcttaattaatgcgaaggtaaatacagtagatttaaacatcaggacctagagttcaccactcgaagtcttttctcagcttcttatccacaaatttcccttcacaattaaacagcaacttaaacttattaaagtcaaagatatgataacataaagaaaccaaagcagaaatagcactataaggggatcgatatctatccactaaagccttatccaaagcatcaagcaccttaaagtctttgtaagatttgtaattgtcattgatagagatataaatctcactcaaaacttctacatctctcacatcagttctacctaattttgtgataaat

SEQ ID NO: 5306 - DNA, 695 bp, Artificial
  Synthetic
agccccaccaagtcttttttcaagcatcttcacagtcaacacatcacaacaactcatcatggcccgcaccaagcagaccgcccgtaagtccactggtggcaaggctccccgcaagcagctcgcttccaaggctgcccgcaagagcgctccctccaccggaggtgtcaagaagcctcaccgttataagcctggtaccgtcgctctccgtgagattcgacgataccagaagtcgactgagctcctgatccgcaagctccccttccagcgtctggtccgtgaaatcgctcaggacttcaagagcgatctccgcttccagtcttctgccatcggcgccctccaggagtccgtcgagtcttacctcgtctccctcttcgaggacaccaacctttgcgccatccacgcaaagcgtgtcaccatccagagcaaggacatccagctcgcccgccgcctccgtggtgagcgcaactaagttggagagactttgggaggaacgttgcagacatgacttttgcttttcacacgagtgtttctggggtcaagggataatcaggcgttacaaatgagagtttttattcccctttatggttcggaatgtatattaccagtgcgtcagggaaaaagcactgcataaatgcaaacgaggttcacggcctcacgggttaacgaactataataactgcatcactctaaaaaaa

SEQ ID NO: 5307 - DNA, 590 bp, Artificial
  Synthetic
gaggggaaagatttcgtcgcgctagggttttctgattcgtcgtccatggcgcgtactaagcagactgctcgcaaatccacgggaggcaaggcgcccaggaagcagctcgcgaccaagtgaaatccgcaagtaccagaagagtaccgagctgctcatccgcaagctgcccttccagaggcttgtgcgtgagattgctcaggacttcaagacggatctgaggttccagagccacgcggtactggcgctgcaggaggcggcggaggcatacctggtgggtcttttcgaggacacgaacttgtgcgcgatccatgccaagcgggtgaccatcatgcccaaggacatccagctggctcgccgcattcgtggagagagggcgtaagccacagggtgctattcatgacccgttcgctactactgatgaaggacatcgaaaagtcttagaaggatcactttgttttgtaatatactattagaacagcaattcaagttgcttttgctgtgatttagtcaaataaatttcgtggtgtatgataatagagcgcattagctcaaatcgttatatttgtcacactacttaatcaccaaaaaaa

SEQ ID NO: 5308 - DNA, 688 bp, Artificial
  Synthetic
acaacaacaaccatctccatcacccaccacaactacttctccatctaccaacaacatggcccgcactaagcagaccgcccgcaagtccactggtggcaaagccccccgcaagcagctcgcatccaaggcagctcgtaagagtgcgccatctaccggtggtgtcaagaagcctcaccgctacaagcccggaaccgtcgctctccgtgagatccgtcgctaccagaagtcgactgagctcctcatccgcaagctgcccttccagcgccttgtccgtgagattgcccaggacttcaagtccgatctccgcttccagtcctctgccatcggtgctctccaggagtccgttgaggcctacctcgtctccctcttcgaggacaccaacctctgcgccatccacgccaagcgtgtcaccatccagagcaaggacatccagctcgcccgccgcctccgtggtgagcgtggttaagtttctcaacaacacatcgacacgacatgacaacttcttcgggtcagtgattggattgggtctttagtggttaggatatcaaggcgtctatagggtttcatggttcacggtcttcaactcggtttatgagtgcacacgagcggtgctgagcatgtagtatatccaggttaatcagtgatggtcactggcgatattatctcgaaatcaacagatttctacttc

SEQ ID NO: 5309 - DNA, 513 bp, Artificial
  Synthetic
acgcgtcgcaagtagtaggctgcaatggctcgcaccaagcaaactgctcggaaatcgacaggagggaaggctcctcgcaagcagttggccaccaaggcggctcgcaagagcgcccctgctacaggtggagtgaagaagcctcacaggttcaggcctggaactgtcgcccttcgtgagattcgaaagtaccagaagagcactgatctcctcattagaaaactcccattccaacgcttggtccgtgaaatcgcccaagactttaaaaccgacctcagattccaaagctctgctgtcttggccctccaagaggctgctgaagcctacctcgtcggcctctttgaagacacaaacctgtgtgcaatccatgccaaaagggtcaccattatgcctaaggatatccagctcgctaggcgtatcagaggggagcgtgcttaaacagtttccccccctcaggtccctctctttaaacgttgtatacatacaccactttcagtttcgaaaaaaaaaaacaaa

SEQ ID NO: 5310 - DNA, 630 bp, Artificial
  Synthetic
aattcctcctgcacttcgacgactcttctgatttcctgcgatggctcgtaccaagcagacagctcgtaagtctactggtggaaaggcacccaggaagcagcttgctactaaggctgcaaggaaatctgctcccactactggcggagtaaagaagccccacagatacaggcctggaactgttgctcttagagagatccgcaagtaccagaaaagcacagagttgctgattaggaagcttcctttccagaggcttgttcgtgagattgcccaagattttaagactgatttgcggtttcaaagccatgctgtgctggcattgcaagaggcagcagaggcatacctggttggactctttgaggacaccaacctctgtgccatccatgcgaagagggtcaccattatgcctaaagatatccagcttgccaggaggatccgtggggagagagcttaacccgtcttccttatcttttgctgaaagaactgtagttattttagttatttaattgttgtcatcttgtcttgtgctcgaagtaactgccttgttacttcgctgttgggctcgttcccaagaaacttgtggtcttattggccaattgtactagcttaatatacactgcttgttttcgaaaa

SEQ ID NO: 5311 - DNA, 752 bp, Artificial
  Synthetic
ataaagttcctcttctccttctgtagtttcctctctaatttcaaggtttcctcacacccttcaaactcgagcaatcttaaggaactcagatggctcgtacgaagcaaacggctcgtaaatctactggaggcaaggctccaaggaagcaacttgcaacaaaggctgcccgtaagtctgccccaacaacaggaggagttaagaagcctcacagatacagacctggaaccgttgctcttcgtgaaattcgcaagtaccagaagagtactgagctgttgatcaggaaattgccattccaaaggcttgttcgtgaaattgcacaggacttcaagactgatttgcgtttccagagtcacgctgtattggctttgcaagaagcagctgaggcctaccttgttggattgtttgaggacacaaatctgtgcgccattcacgccaagcgtgtcactatcatgcccaaggatatccagttggcccgaagaattaggggagaaagagcttagaatgatctgttctgccgtatcgtgcttagattgttgattttttttttgaattgccgtctttctgcatttttcttcttctttgttcttcatataggtagtttttactagatatgaatggctgtggcatactggaaatttgatactctctattatatagtcgaattttattggaactcttttttacatttgaagggaagaaaattaatttcatatgcttttattaaaaaaaaaaacatgtcggccgccttggcc

SEQ ID NO: 5312 - DNA, 623 bp, Artificial
  Synthetic
cccacgcgtccgcaaacactcatatattctttcatccaaatcctttgagccctaattcccaaatggctcgtacaaagcaaactgcccgaaaatccaccggagggaaagctccgagaaagcaattagccacaaaagctgccagaaagtcagctccggccaccgggggagtgaagaagcctcacagattcaggccagggactgttgcgcttcgtgaaatccgcaagtaccagaaatcaactgagcttttgatccgtaagctcccgttccagcgtttggttcgggagatagctcaggacttcaagaccgatctccgtttccagagttcggctgtggctgcgctccaggaagctgctgaggcttatctcgtcggtttgtttgaggacacaaacttgtgtgctattcatgctaagagggttactattatgcctaaggatattcagcttgctaggagaattaggggtgagagggcataagtgtgaacctacggtagctatgggagcttgtaactgagcatatggtagatgagtttctaggcttttactgtattttggtccaaaattttctcaattctggatatgtagtcgtattaaaagtattttaatgaaatatcagttcttctttgc

SEQ ID NO: 5313 - DNA, 50 bp, Artificial
  Synthetic
attcgctacacaaaagcagatagaagaaagaagaaggagaaaagaaaaaa

SEQ ID NO: 5314 - DNA, 587 bp, Artificial
  Synthetic
aacacattctctctctctagaaactgtactctttctttctctagaagatctgaagcaatggcaagaacaaagcaaacagcccgaaaatccacaggaggaaaggcaccaaggaagcaattagccacaaaagccgcaaggaaatcagcaccagcaacaggaggagtgaagaagcctcaccgtttccgccctggtacagtggctcttcgtgagatccgaaagtaccagaagagcactgagcttttaatccgaaaattaccttttcaaagactggtcagagaaattgcacaggatttcaagacggatcttaggttccagagcagtgctgtagctgcactacaagaagctgctgaggcttacttggtgggtctctttgaggatacaaatctgtgtgctattcacgctaaaagggtgactattatgcctaaggatattcagttggctaggcgtattaggggtgaaagggcttaatgtttcattgttgtgttttttgtgtttagggttatggtgaatgtggtatgtaacggtgtttagttgttttttgcttgaaatgtaatgataacttttgttaatgaaagtccaagttcctc

SEQ ID NO: 5315 - DNA, 738 bp, Artificial
  Synthetic
cgctccacaaaagcagagagcagagagcagagagaagaaagaagaagaaggagaacaagaaaaaagagaagatggctcgtaccaagcaaactgctcgtaagtctactggaggaaaggcacctaggaagcaacttgctactaaggctgctcgtaagtctgctcctactactggtggagtaaagaaacctcacagataccgccctggtactgttgctcttcgtgaaatccgtaagtaccagaagagtactgagctcctgatcaggaagctcccattccagaggcttgttcgtgaaattgctcaggatttcaagactgatctgcgtttccagagtcatgctgtgttggctctgcaggaggctgctgaggcttacttggttggtctctttgaggacacaaatctttgtgccattcatgccaagcgtgtcactatcatgccaaaggacattcagctcgctaggcgtatcaggggcgagcgtgcttaatttgatcaagtgtggtagctttgttggtgctttagatccttttcttaaaagactgatggtattaaaaaatagtggtaggaacgatgttctatgttgatcttattttgtggtggatggaggtgtgctgtaattgttgttctgtttggggaagtggagaaacatagtacttgttgaatctttctaatgttttattgtcacaccactggtgttgaacaagtttcagaatttgcatctaatgtttagttcaactgtttgg

SEQ ID NO: 5316 - DNA, 656 bp, Artificial
  Synthetic
gccattacggccggggaaccaaagcaatttccaatctacaaaactctttcttatggctcgtaccaagcaaactgctcgcaaatcaacaggtggaaaggctccaaggaagcagctagcaaccaaggctgcaagaaagtcagctccggcgaccggaggagtgaagaagcctcaccgtttccgtccaggaactgtggctctcagggaaatcaggaagtaccagaagtctactgagttgttgataaggaagctgccatttcagaggctggtgagggagatagctcaggatttcaagacagatctgaggttccagagcagtgctgttgctgctcttcaagaggcagctgaagcttacctagttggactctttgaagacaccaatctctgtgccattcacgcgaagagggtcaccataatgcctaaggacattcagttggccaggaggattcgtggagaaagggcttaggacgataatttcttatggttatggttatggttaatgtcctgttctctgtattagagttttgtttgcatcttttgttaaatgtcagggttagtgatgtaaataaaatggctggttttgatcaaagtacatgtaacacctctggtttactagtatttgattaatgaaatctgtagttcattttgtttcaaaaaaa

SEQ ID NO: 5317 - DNA, 701 bp, Artificial
  Synthetic
tgtttgcggagttcttctcttcttcccgccctttcgtatttctctgtctggttaaaagatggctcgtactaagcagaccgcccgtaaatccaccggagggaaggcccctaggaagcagcttgccacaaaggctgcaaggaagtctgcccctaccacaggtggagttaagaagcctcaccgatacaggcctggaactgttgctctgcgtgagatccgtaagtaccagaagagtactgagcttttgataaggaagttgccatttcagaggcttgttcgggagattgcacaggatttcaagactgatctaaggtttcagagccatgctgtcttggctctgcaagaggctgctgaggcctaccttgttggcctgtttgaggataccaatctctgtgctatccatgccaagagggttacaattatgcccaaggacatccaacttgcgaggaggatccgaggggagagggcttgatttcttcttttgctcctctttaaactaatatgaccttcattcgaacacttcttttgttttgaatctgaaagctctagcaatagacgctaattgcacccttttaacaatgtattgcttcaaatgcctataatagacctatgttgcccttttgtgttctgtaaataattggcagcttgattcaaatgtgggatgattttttctgactagtaaccttacattttgggtttcctca

SEQ ID NO: 5318 - DNA, 639 bp, Artificial
  Synthetic
tacaatcagagcatttctcaatctacaaaatggcccgtactaagcaaacagctcgcaaatcaacaggtggtaaggctccaaggaagcagttagctaccaaggctgcgagaaagtcagctccggcgaccggaggagtgaagaagcctcaccgtttccgtcctggaactgtggctttaagggaaatcaggaagtaccagaaatcaacagagttgttgataaggaagctgccatttcagaggctggtgagggaaatagcacaggatttcaagacagatctgaggttccaaagcagtgctgttgctgccctacaagaggctgcagaggcttaccttgttggcctctttgaagatacaaatctctgtgccattcacgccaagagggtcactatcatgccaaaggacattcagcttgctaggaggattcgcggcgaaagggcttagaatgaagcttgttatgcttatggttatggttaattcgtgttctctgatctagggcattgtttttgtgtgtttttgctgaatgttagggttagtgatgtaaatcaagcgacttgttccaatcaaaatcaaaatatatgtaaaacctctggtttattagtattttgaaatcttatgaatgaaatttgtactcattttgccg

SEQ ID NO: 5319 - DNA, 670 bp, Artificial
  Synthetic
aaaaggttcctcttctacttttgcagtttcctctctaatttcaagccatcctcatcagccttcaaaatcaagcaatcctaaggaaatcagatggctcgtacgaaacaaactgcccgtaaatctactggaggcaaggctccaaggaagcagcttgcaaccaaggctgcccgtaaatctgccccaacaacaggaggagttaagaagcctcacagatacagacctggaaccgttgctcttcgtgaaattcgcaagtaccagaagagcactgagctgttgatcaggaaattgccatttcaaaggcttgttcgtgaaattgcacaggacttcaagactgacttgcgttttcagagtcacgctgtgttggccttgcaagaagcagctgaggcataccttgttggattgtttgaggacactaatctgtgcgccattcacgccaagcgtgtgactatcatgcctaaggatatccagttggccagaagaattaggggagaacgagcttagaatgattttttctgctttctcttgcttagattattgaagttttttctttagcgttttctgtttttttcttcttcatataggtagttttactagatatgaatggatgtggagtactggaaatttgatactctattaaatagtcgattttcagctttagccaaaaaaaaac

SEQ ID NO: 5320 - DNA, 657 bp, Artificial
  Synthetic
agggcctaatctacaaagtctttcacattatcataatatattcgaaatggctcgtaccaagcaaactgcccgcaaatccactggtggaaaggctccaaggaagcagctagctaccaaggccgcgagaaagtcagctccagcgaccggaggagtgaagaagcctcaccgtttccgtccaggaactgttgctctcagggaaatcaggaagtaccagaagtccactgaattgttgataaggaagctgccatttcagaggctggtgagggaaatagcacaagatttcaagacagatctgaggttccaaagcagtgctgttgctgctcttcaagaggctgctgaggcttaccttgtcggactctttgaagataccaatctctgtgctattcacgcgaaaagggtcaccataatgccaaaggacattcagcttgctaggaggattcgtggagaaagggcctagaatgatgctatgttaatcttatggttattgttaattttgtgttcttctgatttagggctgcttttttctgtcgttcgtggaatgttagggctagtgatgtaaatcaaatgacttgtttccgtcaaactatatgtaaaacctctggtttaccagtattctaagatttgatcaatgaaatctacgttcatttcctttcaatc

SEQ ID NO: 5321 - DNA, 559 bp, Artificial
  Synthetic
aataaaattcgactatataatagagagtatcaaatttccagtatgccacagccattcatatctagtaaaaactacctatatgaagaacaaagaagaagaaaaatgcagaaagacggcaattcaaaaaaaaaatcaacaatctaagcacgatacggcagaacagatcattctaagctctttctcccctaattcttcgggccaactggatatccttgggcatgatagtgacacgcttggcgtgaatggcgcacagatttgtgtcctcaaacaatccaacaaggtaggcctcagctgcttcttgcaaagccaatacagcgtgactctggaaacgcaaatcagtcttgaagtcctgtgcaatttcacgaacaagcctttggaatggcaatttcctgatcaacagctcagtactcctctggtacttgcgaatttcacgaagagcaacggttccaggtctgtatctgtgaggcttcttaactcctcctgttgttggggcagacttacgggcagcctttgttgcaagttgcttccttggagccttgcctcccccggccgtaatggc

SEQ ID NO: 5322 - DNA, 741 bp, Artificial
  Synthetic
gcaatttctcaaatggcagtctcatccatagccaatctcttctccttcttcaccccctccaaacccccaccccccagagcttcccccctccaattctctcttcctgctgttgattccctctcttcttcaacacctatcaacaatcacaaatacccattatcactatcgtgttctaattctgatgttacggccgtcgtttacccctcacttgcaaatgcaaacactctttacttcaggtcgggatacaatgttcaggtaattgtggatgataatgagcacgaagagaagcttgttggacggtttcgtagggaggttatgagagctggagtcatacaggaatgcaagcgtaggagatatttcgagaacaagcacgacaaattgaagcgcaagtcacgtgaggctgctaaacgcaaccgcaagagacgtggcccaccaagaaatttctcagatgataagcaagaggcatctaagagcaagagggatgacgaaggggaagataactgggaacttcctgatggaggtcttccctattgattttattgtagttcctttttccttttttttggggtcctgtagaaatgtggtttatttccactttggagagaatctattcatataattccccatgggaatcattttccttgatttttccaactgcatttacctgattcctttgatactagatgctcgtgaagatgtaattgttaagcctgcttcatagtgtacgagcttcaactacta

SEQ ID NO: 5323 - DNA, 681 bp, Artificial
  Synthetic
aaagggtataggaaatggtctgccacttggagctgttgtcacaactccagaaattgcaagtgttatggctcaaaagatacagtttaatacatatggggggaaccctgtttgctctgctggtggacatgcagtactcagagtgatcgataaggaacaacgccaaaagcattgtgctgaggttggctcacacttgattgggcggctgagggatctacagaaaagacacgacataattggagatgtgagaggaaggggtttaatggttggtatcgaactcgtcactgacacaaaagaaaaaacacccgccaaggcagaaactggagttctctttgagaagcttagagaacttggtgttcttgtagggaaaggtggtttacatggaaatgttttcagaataaagcctcctatgtgttttggcaaggatgatgcagactttctagttgatgcattggactattcaatttcaaagttgtgaaaatctctcaagagtaggcagaacagattgttgtgaattgctcagttgattctccttcaaccaaaggacacaccttattttccagtacaataactacgtaaaagaaagcaagaaagtgttctacaaaaatcgagggaacagaggattaaaatatgcatggatgcagaatgtggtttgacaatttcagtttaattatagttgatgat

SEQ ID NO: 5324 - DNA, 347 bp, Artificial
  Synthetic
cccacgcgtccgaagttccaatactattggactaactgctcttaacacatggaagtacccattacctcagggggaaatccatcacgtagtaaatccagatccataccgtggagtttttggctctgatggttctctttatgctaaagatgttcaagaccacatcgagtatggtacctctggaaaagtagctggatttatcgcagagaccatccagggggtcggaggagctgtagaattggctcctggttacttaaagtcggtttatgaaattgttcgcaacgctggtggtgtatgcattgctgatgaagtccaaactggatttgggcgaacaggaagccactattggg

SEQ ID NO: 5325 - DNA, 641 bp, Artificial
  Synthetic
gcccaccgagtgcatgtcgttcaccaactgcttccatggcaggaccatggggtcgctcgcgctcaccagcaaggtccaataccgggagccattcgcgccggtgatgcccggcgcgacgttcgccgagtacgggaacctagaggaggccaagaaggtgatacagtctggcaaaattgctgccgtgttcgtcgagcccgtgcagggcgagggtgggatccatagtgccaccaaggagttcttgcaggggctgcgggatgcctgcgatgaggctggagctctcttggtctttgatgaggtgcaatgtggtctgggacgcacaggttacctctgggcgtatgaagcctatggagtactacctgacattatgaccttggcaaagccattggccggtggtctccccattggtgtagtcttggtcaccgagaaggttgcttcagcaataaacttcggcgaccacggtaccacattcgggggaggccctcttgtttgccaagctgcattgaccacattggataagatccagaaacctggcttcctagcagaggtggccaagaaaggagagaacttcaagcagcttctcagtaccaagctgagcggaaacgcccatgtgaaagagatccgggggatcggtctcattgtcg

SEQ ID NO: 5326 - DNA, 556 bp, Artificial
  Synthetic
aggagagcttttggtagacgctatgggctctggaattcagtgaggaggtacagcgagcacaatccaaaatgtaagttcaccttgaaaggttctagcacggctttaaggatggatgggatacatatagctcaggaaatcaagcaagacatcgcagagacggtaagaaatggcacttcgaggcctggattggcggtgctccaggtgggagacagcacccggtcacaaacttacataaaaaacttacgaacagcgtgcaacgaagttggaatcaagaatttcacgtcgcagttgcccgaaacagctccattgcaaacgatcttgcaagcgctcagagttttaaattcggatgggagcgttcatggcattgtcgtgcagctccctctaccaaagaagattcgaccagaaactgtgcttcaagagatatgtctggagaaagatgtcgacggcctccatcccctcaacttgggaaagctggctctcgagaacttccagccaagtttcgtgccatgcacctcgagagcttgtcttgagcttctaactcgctacaacgtccaag

SEQ ID NO: 5327 - DNA, 368 bp, Artificial
  Synthetic
aattcggcacgagggctcatggcgtcatcatctgatcacacggcgaagataatcgacggcaaggcgattgctcataccatcagatcagagatcgccgaggaagttcgcggtctatctgagaaacacggcagggtcccaggactagctgtagttattgttgggagccgaaaggattcacagacctatgtgaatactaataggaaagcgtgcgctgaggttgggattaagtcatttgacgtgggcctaccagaggaagtttctgaagctgatcttattagcaaagttcatgaactaaattcaaatccggatgtccatggcatattagttcaactcccattgccgaaacatattaatgaggagcatatatt

SEQ ID NO: 5328 - DNA, 682 bp, Artificial; identical to SEQ ID NO: 4779
  Synthetic

SEQ ID NO: 5329 - DNA, 308 bp, Artificial
  Synthetic
cccacgcgtccgctctcttacattttgaaaccctaatttctcttcttttccccaaaaaaaaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctc

SEQ ID NO: 5330 - DNA, 299 bp, Artificial; identical to SEQ ID NO: 4795
  Synthetic

SEQ ID NO: 5331 - DNA, 697 bp, Artificial; identical to SEQ ID NO: 4794
  Synthetic

SEQ ID NO: 5332 - DNA, 651 bp, Artificial
  Synthetic
agcgaagaagatgaaagaagagtatcgatgcttcatcggcggcttggcctggagcaccaccgatcgcggcttggagaccgctttcgagccctatggatccatcgtcgaagccaaggttacaatgagtctgatttgttctttgggtcggtctaggcaccggcttccttgcttgccttcttttgtgcagagtttccacaggtggtgtatgatcgagaacagagccggtcccggggcttcggctttgtgaccttcgcggacgaggaggcgatggaaaacgccatccggaagatgcacaaccaggagctggacggccgatccatcactgtcagcaaggcgcagccgaaaactggcggcggcggcggcggcggcggcggtggcggtggccgtggaggagacagggaccgggacagggacagggacagggacagggaccggggtggcggcggctacgaccgcggacatggcggagctagtggcgactgcttcaactgtggaaacaaaggccactgggctcgtgactgtccagagagcggcggcggtggtggaagagaccgcggtggtggccgagaccgagacaggtatgggagtgatagatacggcagtgaccgcggtgacaggtacggtggcggcgatggtaaccgcggcagcggc

SEQ ID NO: 5333 - DNA, 532 bp, Artificial
  Synthetic
  misc_feature (384)..(384): The residue at this position can be any nucleotide.
gcacgaaaaaatcagtcaaaatgagcaaactttacgtcggaaacctgtcttggaacacctcggacgagaccctccgcgaggccttctcccagtttggccaggtcactgactccatcatcatgcgcgaccgcgagaccggccgagcccgaggattcggattcgttaccttcagcaccgaggacgaggctaaacgccgctgtcgagggcctgaacgagcaggagctcgacggacgacgcatccgagtcaacgttgccaacgcccgttcctctggaggcagcggcggctacggcggcggccgtggtggtggctacggaggtggtgaccgaaacgaccgacagggtggtggcggttacggtggtggctacggcggtggtgatcgccanggcggcggctacagcccaggtggttacggcggcggcggtggcggctacggcggcgaccgcaacgaccgtggcaacaacggtggttactagatgtggtgtactctctccccaaacatcacatggtcggcgacaagactggcagcggaag

SEQ ID NO: 5334 - DNA, 654 bp, Artificial
  Synthetic
aggaggaggagtttcaagaaccacctgaagatgctaagttggttgttggaaatttaccttatgatgtagacagtgaagggctggctcgactttttgagcaggctggtgttgttgagattgctgaggttatttacaatagggacactgatcaaagtcgtggatttgggtttgtgacaatgagtacggtggaagaagctcagaaagctgtggaaatgtacaatcgttatgacgtcaatggaagactcttgacagtcaacaaagctgctcgtagaggcgagcgacctgagcgcccgcctcagacatttgaacagtcctacaggatctacgtcggcaatatcccatggggcattgatgatgcacgccttgagcaactgttcagtgaacatggaaaagtagtgagtgctcgggtagtttatgacagagaaactggccggtcgcgaggttttggttttgttacgatggcaagtgaagctgaaatgagtgatgcaattgctaaccttgatggacagagtttggatgggaggacaatcagggtaaacgctgctgaagatagatccagtcgcaacacgttttgatttgatcaaacgttcatttgttctataaacatagcggtcacaaatctgcaggtacgagtgtttttttcgggaatttttg

SEQ ID NO: 5335 - DNA, 1080 bp, Artificial
  Synthetic
  misc_feature (480)..(480): The residue at this position can be any nucleotide.
ctctcttataaattaaaaaaatcaatggctgaagttgagggccggtgcttcgtcggtgggctcgcatgggctaccactgatcgaaccctaggcgaagctttctctcagtacggcgaggtgcttgaatcgaaggtccgtttgtcggtcgcagagcagagatcggaatccgagccctgatttggcttcgtttgcccctctgttactgttgattcatctgttactgttactatgtctctctgttactgttgattcatctgttactgttactgttactatttgatactattattcgttccctcttaacggtacgttccgtcttacttctcttcttataaaagagatgaagatagatcggttattcttttttgtccaatttgcttggaatgaatgtaacttctcgagcatgctcgtacatagtccttttgctttgttttttcctgtgacggtctagatctggaagatctgatgttgttttggtgntgattttgattttacagatcatcaatgaccgtgaaaccggtagatctagaggatttggctttgttacttttggcgatgagaaatccatgagggacgctatcgaagggatgaacggccaagaccttgatggtcgtaacataaccgttaacgaagctcaatcacgcggaagcggtggaggcggcggcggcggcggtggtttccgcggtggacgtcgtgagggaggcggcggatacggagggggaggatatggaggtggaagacgcgagggcggcggcggcggttacggcggaggcggcggcggttatggcggtggccgtgaccgtggatatggcggtggtggtgaccgtggatatggtggtgatggaggatcacgctactcaaggggtggtggtgactctgatggaaactggaggaattagataattgagaagatgtggattttagttattttgatcgcagtttaagttggttatatcttaatgttagtgtgactcttttttgaccgttatttggctcgttacgttactgtgtttttctattaactgagttcttatggaatgaattaaattaaggtctacaaattaaatctttcttttgcat

SEQ ID NO: 5336 - DNA, 737 bp, Artificial; identical to SEQ ID NO: 4770
  Synthetic

SEQ ID NO: 5337 - DNA, 744 bp, Artificial
  Synthetic
atcgacagcgagcgcctcgcccagctcttcgaacaggccggcatcgtcgaggtctccgaggtcatctacaacagagaaacagatcggagtcgtggatttggatttgtcaccatgagcaccgttgaggaggctgagaaggctgtggagatgttccatcgctacgatgttgatgggaggcttctgactgtaaacaaggcagctcctagaggcgctcgggtggaaagacctccccgtcagtttgggccttctttcaggatttatgtgggcaatctcccttggcaagtggatgactctaggttggtacagctgttcagcgagcatggcaaagtagtcgacgccagagttgtgtatgacagagaaactgggcgttcacgaggatttggttttgtaacaatggcgacacaggaagaattggatgacgctattgcagccctcgatggacagagtttggatggccgtgcgctgagagtgaatgttgcagaggagcgaccaccgcgccgaggcttttaatgggatagcaggctttgtgggggtttaacagcatcggaggcatcatagcacgtctgatactggtttagtccctcaaatagtagctttcttgcgattcttggttctgtatcctcccaagtcctttctcatgcctgctgtttactgctcctttcttgttaactgttggttgtggcccacgagttgatgcacgtaagctactgttatgatgcccctctaccccaatttgtcgatgca

SEQ ID NO: 5338 - DNA, 672 bp, Artificial; identical to SEQ ID NO: 4771
  Synthetic

SEQ ID NO: 5339 - DNA, 620 bp, Artificial
  Synthetic
cccccccccggtgctctctttgaggtgggttggcttctcctccccctctttaccttttcctcctcctcggttcggttccgtggttcgtctagggtttagtgggttgagatggcggcgccggatgtcgagtaccgctgcttcgtcggcggcctcgcctgggccaccgacgaccgctccctcgaggccgccttctccacctacggcgagatcctcgactccaagatcatcaacgacagggagacggggaggtcacgtgggtttggcttcgtcaccttctcctccgagcagtcgatgcgcgacgccatcgagggcatgaacggcaaggagctcgacggccgcaacatcaccgtcaacgaggcccagtcccgccgctccggcggcggcggcggaggcgggggctacggcggcggcggtggcggctacggcggcggtcgtggaggcggcggctacggaggaggtggcggcggcggctacgggcgccgtgagggcggctacggtggcggcggcggctacggcggcggccgtggcggcggcggcggctacggtggcagccgtggcggcggctacggcggcgactccggcgggaactggaggaactgattggtggggcccatcgtggc

SEQ ID NO: 5340 - DNA, 487 bp, Artificial; identical to SEQ ID NO: 4800
  Synthetic

SEQ ID NO: 5341 - DNA, 243 bp, Artificial
  Synthetic
gactgtaaatcttaattcacttcattccagagaactttgtaaatacagatccacaagtaacatcacggtaacaatctcgcggtcaaaacgaggacagtaacaggaaccaaagtaaaccataacggaacttcaaccaaacgtagaaccataaatttcaaacaaaaaaataaatctaaaggcaacggaaatctaactcctccagtttccttcagaaccaccaccgtaacccccggccgtaatggc

SEQ ID NO: 5342 - DNA, 669 bp, Artificial
  Synthetic
atggtttccatgcctgtgatcttcttcgccgttgtcctcctgtccgcagcaggcctcgaggccgcgaccgctcctctctccgtagtcggctacgaccctgctgccctcgcctccgacagggagcttctcgaagctttcgagcaatggctttccacgcatggcaagagctatgcaacgcagcaagagaaggaggcccgccttgaggtcttcaaggacaacctgcgctacatcgacgagcacaatagcaaaggcgagagcggattctggctgtccctcaacaaatttgctgatatgccacatgaggagtttaggtcgaaatacttgggggccaaaattgacaatcctcgtcgcctcagacgtggaaacagcctgaaatccttccgttaccagggagtcaaggatgtgcccacatctattgattggcgagagaagggtgctgtcactgcagttaaggatcaaggcggttgcgggagttgctgggctttctctgccgttgcttctatggagggcatcaaccaaattgtcactggtgacttgatttctctctcggagcaggagcttgttgactgtgatcggtcctatgaccaaggatgcaatggcggtctcatggattacgcctttgactttgtcatttccaacggtgggattgacacagaggatgactaccca

SEQ ID NO: 5343 - DNA, 675 bp, Artificial
  Synthetic
ttttcctttgcattgtcagccatggctaaaaccataatacacactctcttcttcgccctcttttcgtccttatcctatgcaattgacatgtccatcatagattacaaaaataaccactatgctagtaaatggacattgcaaagtgatgaggatcaggtgaagaatgtatacgaactgtggctggcagagcatgggaaagcatataatgttctgggagagaaggaaaaaagatttgagatttttaaggataatttgaggttcattgaggaacataacaattctgggaatcgtacgtacaaggtgggattgaaccagtttgctgatctcacgaacgaggagtaccggaccatgtatttgggcaccagaagtgacgctaggcgccgctttgttaagtccaaaaacccaagccagcgttatgcttctcggcccaacgagctgatgcctcattctgtggattggaggaagagaggcgccgttgctcctatcaaaaatcaagggagttgtgggagttgttgggctttctcaacagtagcagcggtggaaggcataaaccagatcgtaacaggggaaatgatcacactatccgaacaagaacttgtagattgtgatagagtcaaaaactctggttgtaatggtggcctaatggactatgcctttgagttcatcatctctaac

SEQ ID NO: 5344 - DNA, 687 bp, Artificial
  Synthetic
ccacaaagcaggaaaaacacccaatcatggcaaatcatagctccactctcaccatatccctacttctcctcctcttcttcttctccaccttatcttccgcttccgacatgtccatcttaacctacgacgaaaaccaacactttcgaacagacgctgaagtcatgtccttgtacgagtcatggctagtcgaacatggaaaatcctacaacgccttagacgaaaaagacaagcggtttcagatctttaaagataacctaagatacatagatgaacaaaactctgttccaaacaagagttacaagcttggtttaacaaaatttgctgatctgactaacgacgagtacaggtccatgtacttaggtactaagaccactgatcgtcgcaggttgttgaaaaacaaaagcgatcggtatcttcctaaagttggggatagcttgcctgactcagttgactggagagagaaaggtgttcttgttggagttaaggatcaaggaagctgtgggagttgttgggcattctctgcaattgcttccgttgaagcagtgaactcgatagtcactggagatgtgatttcactatcggagcaagagctggttgattgtgatacttcctacaacgacggctgcaatggcggtcttatggactatgcctttgatttcatcattaaaaatggaggaattgacactg

SEQ ID NO: 5345 - DNA, 675 bp, Artificial
  Synthetic
cccacgcgtccgcaaaagaaaaacaaacgtactcaaatggctctttcttcaccttcaagaatcctctgttttgctcttgccttatccgctgcttctctctccctctctttcgcttcttcccacgattactccatcgctggatactcccccgaggatttggaatctcatgacaaactcatagaactcttcgaaaactggatctcaaattttgagaaagcttatgaaaccgttgaagagaagtttcttaggttcgaagttttcaaggataatctaaagcacatcgatgagactaacaagaaagggaaaagctactggctcgggctcaacgagtttgcggatttgagccatgaggagttcaagaaaatgtatttagggctcaagactgatatactgagacgcgatgaagaaagatcttacgcagagttcgcttacagggacgtccaagctgttcctaagtctgttgactggagaaagaaaggagctgtggcggaagttaagaaccagggctcttgtggaagttgttgggcgttttcgacagtagcagctgtcgaaggtataaacaagattgtgacaggaaacttgacaacattgtccgaacaagaactcatagactgtgacacgacctacaacaatggctgcaacggtggtctcatggactatgcctttgagtacatt

SEQ ID NO: 5346 - DNA, 645 bp, Artificial
  Synthetic
ttttcccctttcagcccaatgttgccgacgactttctgaccttctcaaaaacctctgtgtttctctcacatttctggtgccaatctcttgatatttattggagaagacgatggcagctccaccagcgagggctcgagcagattatgattatcttatcaagctcctcctcattggtgatagcggtgtgggaaagagttgtttgctgctgaggttctcagatggttcctttacaacaagtttcatcaccactattggaattgactttaagataagaacaattgaacttgatggcaagcggattaaattacaaatttgggatacagctggtcaggagcgtttccgcactatcacgacagcatattatcgaggagccatgggtattctgctggtgtacgatgtcacggacgagtcatctttcaataacatcaggaactggattcgcaacatagagcagcatgcttctgacaatgtcaataagattttggttgggaacaaggctgatatggacgaaagcaaaagggctgtgccaacttccaagggtcaagctcttgctgatgaatatggcattaagttcttcgaaacaagtgcaaaagacaaacatgaatgtggaagaagttttcttttcaattgctagggatatcaaac

SEQ ID NO: 5347 - DNA, 414 bp, Artificial
  Synthetic
cccacgcgtccgcgatttttcgcctgaacctgcggatttttcgattcttcaaattcaatgtcttatgcttatctcttcaagtatatcatcatcggcgatactggagtggggaaatcatgtcttctgcttcagttcaccgacaagaggtttcagccggtgcatgaccttaccattggtgttgaatttggggctaggatgatcaccatcgataacaaacctatcaagcttcagatctgggatacggctggtcaagaatcctttaggtctattacaaggtcatactatagaggagctgcaggggcattgcttgtctatgatatcacaaggagggagacatttaaccatctagctagctggctagaagatgcaaggcagcatgcaaatgcaaatatgacgataatgctcattgggaat

SEQ ID NO: 5348 - DNA, 303 bp, Artificial
  Synthetic
caatctttcgtcggaaaaaagaagaagaagaagcagagctgggtttagttttttcacgagaagcaaagagatcaataagtcagtgagcttttttctcgtttctgacgatggcggttgcgccggcaagagctcgttcagactatgattacctcatcaagcttcttctcatcggcgatagcggggtggggaagagttgtttgttacttcgattctcagatgatactttcactacaagtttcattactaccattggtattgacttcaagataagaactgttgaacttgatgggaagcgtatcaaat

SEQ ID NO: 5349 - DNA, 1028 bp, Artificial
  Synthetic
cccacgcgtccgctacaatgcctctgtcgctctcaccagttaacagctacagcacaaaactgtaaccacgcttccgatctctaaaacctgagagagagagagagagagagagagacagagagaagtgtttcaatagtttggcgtgaagatggccggaggaggcggatacggcggcgcatcggggaaagttgattacgtcttcaaagttgttctaatcggagattcggctgttgggaaatcgcaactacttgctcgattcgctagagacgaattcagcatggattctaaagccaccatcggcgtcgagttccaaactcgtaccctctccattgaacaaaaaagcattaaggctcagatctgggataccgctggtcaggaaagatacagagccgttacaagcgcatactacagaggagcagttggcgcaatgctggtttatgatatgacgaaacgtgagacctttgagcatattccgcgttggcttgaagaactgagggcgcacgctgataagaacattgtcatcatccttattggaaacaagtctgatctagaagatcaaagagctgttcccactgaagacgctaaagagtttgctgagaaggaaggactctttttcctcgagacctctgctttaaacgcaaccaatgtcgaaaactccttcaacactctaatgactcagatatacaataccgtgaacaagaagaatcttgcatctgaaggcgactcaaataaccccggttcattggctggtaagaagattctcatcccaggttctggacaggagattcccgctaagaccagcacttgttgtacttcttcttgatctgtctcctactcaagcaagattcattttttttcctcctgaaatttgtgatagagaatgctactttcattgtatattctttttcgaatctggcttgtttgctagttcattaaacattggtgtgcaattggacaccgatagaaagtattggaacaaatagcttttgaatgaaatatgaaacaaacagtctttgagagttaaaaaa

SEQ ID NO: 5350 - DNA, 627 bp, Artificial
  Synthetic
acacaatgtcacgcaaagacacggcgccgctctacaagctcattgtgctgggagacggaggcgtcggcaaaacagctctcaccatccaactgtgcctaaaccactttgtggaggaatacgaccccaccatcgaagattcataccgaaagcaggtggtgctcgatggccagaccgccatgttggaaatactcgacaccgccggccaggaggagtatactgctctgagagaccagtggatccgagacggcgagggattcatcttggtctacagtatcacttcgcggtcgtcattctctcgcattcgtacttactacgagcaaatccagcgagtcaaggaggacgacgagggcttcagcgtggtcattgtcggcaataagagcgatcgaaacgctgagcgagtcgtttccactgatgatggacgggctctggctcgagagctcaactctggcttcttcgaggcctctgccaagctcaatgtcaacattgaaaatgccttcttcgactgcgttcgagcgtgccgaatccagcgtaacggaggccaggttgagcagcccgccgacacaggagctgcccagcccctcgtgacgcccggcgttgctgctggaggcgccccagttaacaaccaga

SEQ ID NO: 5351 - DNA, 604 bp, Artificial
  Synthetic
aaaaagagaaccatgctgaaggtcgtcatcctcggcgactccggcgttggtaagtcgtcgttgatgcaacagtacgtcaacaacaagttcagcacacaatacaaggccacgatcggagccgactttctcaacaaagagctgactctcgagggccgaaaagtcaacatgcaaatctgggacacggccggtcaggaacggttccaatccctcggtctggctttctaccgaggcgccgactgttgcgttctggtctacgatgtcaacaactccaagagttttgatgccctgactctgtggcgagatgagttccttctccttgccaacccccgagacccagaaaactttccttttgtggtgatcggtaacaaggtggatgtggaggagagcaagcgggcagtttccgccaagcgagcccaggccttctgcaaggcaaccggcaacattccctattttgagaccagtgccaaggaggacactggtgtagaccaggctttcgagaccgttgctcgaaacgccatggcacaggtggactcagaggactacacggacgatttcgccgacatcatcaacatccatctggataatgagcagtccaactgtgctt

SEQ ID NO: 5352 - DNA, 585 bp, Artificial
  Synthetic
cacgcagacgcgcaccaacccgccggcatgcgcgtccggatgctttgctttgcccgccgcgattcgatccacgcctgagcgagcgagcggggcgagcaacgcgcccttccttcccttgccatggcctcttcaccggcgagcagctacgactggtccttcaagatcctgctcatcggggactcggccgtcggcaagagcagtctgctcgtcagcttcgtctccgcctcccacatcgacgacgaaatcgctcccaccataggggttgactttaaaatcaaatttctcactgtcaatgggaagaaactgaagctaacaatatgggacactgctggccaggaaaggtttaggggaatcacaagttcttactacagaggtgcccatggcatcattctagtgtatgatgtcacaaagagagaaagtttcacaaatttggctgatgtatgggccaaggaaatagaattgcattcgacaaataaagagtgcatcaaaatgcttgtcgggaacaaggtggacaagaatgaggaaaggatggtgacaagggaagaaggtcttgcctttgcccaggaatctggatgtctttttctt

SEQ ID NO: 5353 - DNA, 689 bp, Artificial
  Synthetic
ctctctctctctctccccctccctccgatctcgccgcgtccgtgtcccctcgccgccgcagccagggtcgagggctcggcgaccggaggaggagaggccggaacccgccgccgccgccgccgcctccgcctgtagcgagatcgctcgatccggttcgcctcccgcgcgccagtccgccagcccagttcgatccgttgagggggaggggacgctctagtgtggggattgggggaatcgatggcggcgccgccggcgagggctcgggccgactacgattacctcatcaagctgctcctcatcggcgacagcggtgttgggaaaagttgtctcctcctacggttctctgatggttccttcaccaccagttttattaccaccatcgggattgatttcaaaataagaacaatcgaactggatggtaaacggattaaacttcaaatctgggatacagctggtcaagaacgtttccgaactattacaactgcctactacaggggagcaatgggtattttgcttgtttatgatgtcaccgacgagtcatcatttaataatataagaaactggattaggaacatagagcaacatgcttccgataatgtgaacaagattttggtaggcaacaaagctgacatggatgaaagcaaaagggccgtaccaacttcaaaggggcaagcacttgctgatgaata

SEQ ID NO: 5354 - DNA, 537 bp, Artificial
  Synthetic
aagaattttcaggttttcttctcgctttcaccggagaaggagaaggagaggaaggtgttgatcgaatcctcctccaatcgcgcgcgattcgatccccgttgctggctcgctcgctccgccgatccctcatccgatctgaatccccgatctgatggcggccaaccccggcaacaagatccgcaacgccaagctggttcttcttggagatgtgggcacgggcaagtcgagcctcgttctccggtttgtgaagggccagtttgttgaattccaggagtccaccatcggcgcggccttcttctcgcagaccttggcggttaacgacgagacggtgaagttcgaaatctgggatactgcagggcaggagaggtatcatagcttggctccgatgtactatcgtggtgcggctgccgcaatagttgtctacgacatcacaaatgcggcctctttcacacgtgcaaaaaaatgggttcaagaacttcaagcgcaaggaaacccaaacacgataatggctcttgctggtaacaaggctgatatggt

SEQ ID NO: 5355 - DNA, 360 bp, Artificial
  Synthetic
ccccccgccctttttgcaggttgggtgctcctcctcctcgggagccatatgaaaccctagatcagatctcatccccccaccttcgtcatcccatacgaggaggttattatggattcttcgtcttcatcgtggtccacccagacgcagagccagccggatttggattacctctttaagctgctcctcatcggggactcgggcgtcggcaagagcagtctcctcctccggttcacctcggactctttcgaggatctctcgcccaccataggtgtcgacttcaaggtcaggatggttaacaccgggggcaaaaaactcaagcttgccatctgggacacagctggacaggagcgatttagaacc

SEQ ID NO: 5356 - DNA, 625 bp, Artificial
  Synthetic
gagagagagagagcttggattttttggaaaggagagagagagagagagggtgcacctcttttttttcactcttaagtttatttttgctctatttttatatttcctcttcttcgatccgcatcgctctgctctgctctgctcctccctcgtcagaactttgtgcagaacctagggtcctttcggggggaaaggggggggcagagaaggacccatcatggcctacagagcagatgaagagtatgactatctattcaagcttgtgctcattggagactctggagtgggcaagtcaaacctcctctctagattcactcggaacgaattcagtctcgattccaaatcgactattggtgttgagtttgccacgcgtagtctaaacgtcgacgggaagatgatcaaagcccaaatttgggacaccgccggccaagaaaggtatagagccatcacaagtgcatactatcggggcgcagttggcgcattgcttgtgtttgatgtgactaggcatgtcaccttcgagaatgtcgagaggtggttaaaagagcttaaagatcacactgacgcgaatgcggttgtcatgcttgttgggaacaagagcgatctccgccaccttcgggcggtttcaacg

SEQ ID NO: 5357 - DNA, 775 bp, Artificial
  Synthetic
aattaatttttaaaaatttcccttgctccttccggcagatcgatcccctttccttccttctttttctctttctatctcttcttcttttctctctcccgtctttgctctgccttgttgttgacgagaagaagaagaagaaggagaaggaggtggagagtaaggatcgatggccgcctctggagcagctcgagctcgtgaccatgactacctcgtcaagctgctcctcatcggggatagcggtgttggcaagagttgcttgcttctccgattttctgatgacacgttcactacaagtttcatcacgaccataggaattgattttaagatcagaactattgagatggatggaaaaagagtaaagctccaaatatgggacactgccggacaagagcgctttaggacaattactacagcctattacagaggcgctatgggtatcattcttgtgtatgatgtaacagatgagtcgtctttcaacaatattcgcaattggattaggaatatagaacagcatgcttctgacaatgtcaacaagatattagtaggcaacaaagctgatatggatgagagcaagcgggcagtgtcacatgaacgcggtcaagcacttgccaatgaatataacttgaacttcttcgagacaagtgccaaaacaaatatgaacgtggagcaggtctttttcaccattgcaagagatatcaagcaacggttaacggatgctccttcgaagactgaggcggcggcaatcagcatttcaaagccgaaccaacaagacaac

SEQ ID NO: 5358 - DNA, 595 bp, Artificial
  Synthetic
tctctctctctctcttctctttcgcaaatctgagctggtcatccatggccacccgcaagcgtaccctcctcaaagtcatcatcctcggagatagcggggttggaaagacatctctcatgaatcaatatgtaaacaaaaagtttagcaatcagtacaaggctacaattggtgctgattttctcactaaagaggttcaagttgaatatagacttgtcaccatgcagatttgggatactgctggtcaagagcgctttcaaagccttggagttgctttctaccgtggtgcagactgctgtgttctagtttatgatgtgaatgtcactaagagttttgacaatctagacaattggcgaaatgagtttcttatccaggccaacccttctgatccagagaactttccgtttgtgctgcttggcaataaagttgatatcgacggtggtaatagcagggtggtgtcggaaaagaaagcaaaagcatggtgtgcaaataaaggcaacattccatactttgaaacttctgccaaggaagacataaatgttgacgcagcattccaatgtattgctaaaaatgcattgaagaatgagacagaagagga

SEQ ID NO: 5359 - DNA, 404 bp, Artificial
  Synthetic
cgagttggggagaggagagaaaccgagatcgatccgcacccaccgcgacaaacgctctcccctcccctccccctccgcccttcgctcccatccgctccgccccctcgccgcgcagcgccggcggcgagaaggttgagttcgtggggggtgtgaccgaacgatggcgtaccgggcggacgacgactacgactacctcttcaaggtggtgctcatcggggactccggggtcgggaagtcgaacctgctgtcccgcttcacgcgcaacgagttcagcctcgagtccaagtccaccatcggcgtcgagttcgccacccgcagcatgcacgtcgacgacaaggtcgtcaaggcccatatctgggacaccgccgggcaagaaagatatcgagctattacaagcgcatact

SEQ ID NO: 5360 - DNA, 438 bp, Artificial
  Synthetic
gaattcaaaacacagagcaacaaagtcatcgtactttaaaaaaaaaaaatgcctgcacgaagaagaacccttttaaaggtcataatcctcggcgacagtggggttgggaagacttctctgatgaaccagtatgtgaataagaagtttactaatcagtataaagcaaccattggagctgatttcctgactaaggaagttcaatttgaagataggctttttactctacagatatgggacacggctgggcaggaaaggttccaaagtctaggcgttgccttttaccgtggtgcagactgctgtgatcttgtatatgatggtaatgttgccaagtcatttgaaaatttgaacaactggagggaagaatttcttattcaggctagcccatcagacccagacaattttccctttgttgttgtgggtaacaaggttgacgtggac

SEQ ID NO: 5361 - DNA, 620 bp, Artificial
  Synthetic
gggagagaaaaagtagtgaatcatgccataagcattcacaatacttttactggccgccttctctctctgtatcacattgcactgttacatagtggcactttctttgtgaagtctttttagagagagaaagtacgtattttttttgtatcggaggaacttttggagagagaaagttgagaaaaggagtcgtcggagagttagctgatggcgacgacggggcagagcaatagcagttacgatctgtcatttaagatattgttgatcggagattccggagtaggcaaaagtagcctgctcgttagcttcatttctaatgccgtcgacgatcttgcccctaccattggtgttgattttaagataaagacgctcactgttggtaggaaaagactgaagcttaccatttgggacacagctggacaggagaggttcaggacactgacaagctcctactacagaggtgctcaagggatcattcttgtctatgatgtaacaagaagagagtccttcacaaacttgtctgatgtttgggcaaaagaggtggagttgtacagtaataatcaggattgtgtgaagatgctggttggaaataaagttgacaaagaatctgagagagctgtgac

SEQ ID NO: 5362 - DNA, 565 bp, Artificial
  Synthetic
gcccaagccttgagattcccaagccagatctcagcagctaggcagtagcagcttggcagtgtggaagtcatggcatcagagttcgatcatctatttaagttgcttcttataggagattcgggtgtaggcaagagtagtttgctcttgcgctttacatcgggcacctttgatgacctttcgcctactgttggtgttgattttaagctgaaaacaatgactttggaggggaagaggttaaagctcacaatttgggatacagctggccaggagcgatttcgtacacttacaagctcttattatagaggtgcacaagggataatactcgtttatgatgtgacaagacgggagacattcactaacctttcagatgcatggttgaaagaagttgagctatactctacccaccaagattgtatcaagatgcttgttggtaataaagttgacatggagtcggagcgtgtcgtcaccaaaagggagggtatagcattcgcaaggcaacatggctgcttattcattgaaagcagtgctaaagcaagagttaatgttgagcaatgctttgaggagc

SEQ ID NO: 5363 - DNA, 730 bp, Artificial
  Synthetic
cccaactctctctctctctagatcaccatttccactttctgcctcttcccccgaagactcttacacttttcacaacttcaaaaatggattcatcagatgatgaaagtggtgaggaatatcttttcaagattgtaataattggtgattcagcagttggaaaatcaaatttgttaacacgttatgcaagaaatgaattcaacttgcattcaaaggcaacaattggagttgagtttcagacccaaactcttgaaattgacggtaaagaagtaaaagctcagatttgggatactgctggtcaagaaagatttagagctgttacttctgcttattatcgtggtgcttttggtgctcttgttgtttatgatattactagacgtaccacttttgatagcatccctcgttggcttgatgagatcaaaacgcattctgataccacggttgcaaggatgctcgtgggaaataaatgtgatttggataacataagagctgtgagcgtagaagaaggcaaaagcttggcagaatcggaaggaatgttcttcatggagacatctgccctcgatgcaacaaacgtaaacaaggctttcgagatggtgattcgagagatctacaatagtgttagcagaaaggttttgaattctgattcttataaagctgaattgtctgtcaacagagttagcctcgtcgataatggtaccgatggatcaaaacaaaatcaaggctattcttgttg

SEQ ID NO: 5364 - DNA, 720 bp, Artificial
  Synthetic
gaacaatttgctaagcgcacgcagcacaaagtgcgcagaatagccaattgaggtgtgtgtgtctgtgtgtgcaaatcatatacgaattgattattcaatggcagcaccaccggcaagagctagagcggactatgattacctcataaagcttcttttgatcggcgatagtggtgttggtaagagttgccttcttttacgtttctctgatgggtccttcaccacaagctttataacaaccattggaatcgactttaaaattcggaccattgagcttgatggaaaaaggatcaagcttcagatatgggatacagctggtcaggaacggtttcggactatcactactgcttactatcgtggagccatgggtatattgttggtgtatgatgttactgacgaatcctcctttaacaacattaggaactggattcgtaacattgagcagcatgcctcagacaatgtcaacaaaatacttgtagggaacaaggctgacatggatgaaagcaagagggctgttcctacgtcaaagggccaatcacttgcagatgagtatgggattaagttttttgaaactagtgcaaagacaaatcttaacgtggaacaagttttcttctcaatagcaagagatataaagcaaaggctagcagacacagactccaaggctgagccttcgacgctcaagattaatcaaccagatgcaggagctggaggtagtcaagctgc

SEQ ID NO: 5365 - DNA, 743 bp, Artificial
  Synthetic
ggaggacgagagcgccggggagaggtcatacacgtctgagcagctggaggttgtgcgccaggtcaagaagcacaccagggactactaccagatcctcggcctcgagaaggactgcactgtggaggacgtgcgcaaggcctaccgcaagctctccctcaaggtgcatcccgacaagaacaaggcccccggtgccgaggatgcgttcaaggccgtctccaaggccttccagtgcctcagcgatgccgagagccgcaagcgctatgaccttgttggctcggacgagccggtgacttacaacaggagggctgcctccactgcccgtgcgtataatgggttttatgaggatgaatttgatccggatgagatattcagaaacttcttctttggcgggatggcgcctgccaccaccagacagtttgggcaatttgggacgtttcatttcaggactggcggcatgcaccatggccatggggcgcaaaattccggtggctccactctccggatgcttattcagctgttgcctgttctattgctgctgttgctcaacttcctgccatcttctgaacctgtctactcgctgtcccgctcttacccttatgagcacaaattccaaaccacacgtggagtcacatactatgtcaagttgcctaactttgaggagcagtatccacaccagagcactgagcgtgcaacactcgaacggcatgttgagcgggattacttctcaatactctcacagaatt

SEQ ID NO: 5366 - DNA, 601 bp, Artificial
  Synthetic
aaagcaacagggaggaggcggagcgctgcgtccggatcgcgcgggcggccattgaatccggcgacaagatccgcgcacgtaagttcgcctccatcgcccaccgcctccggccggaggacctagatgtaggagaattggtggccaagctggggctggccgacgaccgcggcgacgacgagcagtcaaaggattccagcgccagcaccaccagcggcagctcgaggaggcggcggaggaacggtgagtacgagtccgaggtcaaggacacggccaccagcggcgccgccaaccccgccgccgccgaggcgacgccggaacagatcgaggtcgtggtccgaatcaaccggacgtccgactactaccagatcttagggctcaagaaggaatgctctgacgaggacgtgaggaaagcctaccgcaagctctcgctcaaggtccacccggacaagaacaaggcctccggggccgaggaggcattcaagtcggtgtcgagagcctttcagtgcttgagcagcccggaactccgcgacagctacgatcgatacgggccggaggagacgaggaacctggcacagcagcatcagcagcagcatggaatgcg

SEQ ID NO: 5367 - DNA, 697 bp, Artificial
  Synthetic
aagaagacgaaacaccagttttcttttctccgactgctcgaccgtcggtcggtcgttcttcagacatcatttccgatagaaggtgaatcgaaattgcgattgcttgtttctctaagtgtattgtgatccgtagaaggttgcttttctgtttcagagccgaaattcagtttaaggtttcttgcggagttgagttgaagttgtgatttgaacgatataatggatagtaacaaggatgaggctttaaaatgcattggtattgccaaggatgcaattgtatctggcaataagcagagagccctcaagtttattagaattgcgcggcgccttaacagtaatttatctgtagatgatcttttggctgcttgtgaaaatctggagtcatcaactgctggatcctcaagtgaggttagaaatgttgaaaatgtgaataatgtcacgagtcgtgtcaagtctgatgatgtatctgacggggagaggaactatacagaagaacacgtgcaattgattaggcaaattaagactaagaaggactattactctattcttggtctagagaagggtagttcagttgaggagatcaggaaagcatacagaaaactgtcattgaaagttcatcctgacaaaaataaggctccgggctctgaagaggcgtttaagaaagtctctaaggcgtttaagtgtttgagtgatgatgatt

SEQ ID NO: 5368 - DNA, 643 bp, Artificial
  Synthetic
gagaagaaatggccgctttatcttagcaccaaaaacacaatcctgaagaaatatgatggaaggttcaaggatattttccaggaggtctatgaagctgggtggaaatccaagtttgaggctgccggaatatggtatgagcatcgtctcatcgatgacatggttgcttatgcacttaagagtgaagggggctatgtgtgggcttgcaagaattacgatggagatgtgcagagtgatttcttagctcaaggctttggttcattgggtttgatgacatcagtattggtgtgccctgatggaaaaacaattgaagctgaagctgcccatggcacggttacccgtcatttccgtgttcaccagaagggaggtgaaaccagcacaaacagcattgcttcaatctttgcttggaccagaggacttgcacacagggcaaagcttgacgacaatgctagacttcttgactttgcactaaaacttgaagctgcttgcgttggaaccgtggaatctgggaagatgaccaaagaccttgctcttcttattcacgggtcttcaaacgtcacaagaagccattacctgaacactgaagagttcattgatgcggttgctgcggagctccggtcaagactggcagccaactgagcttttt

SEQ ID NO: 5369 - DNA, 654 bp, Artificial
  Synthetic
atgatggccggtttaaagatatcttccaggacgtctatgaagccgactggaagaccaagtttgaggaagctggaatctggtacgagcatcgacttattgatgacatggtagcctacgcactgaagagtgaaggtggctatgtatgggcctgcaaaaattacgacggagatgtccagagtgattttcttgctcaaggtttcggctcgctcggtctcatgacttcggtcctgagatgtcctgatggtaaaaccattgaagctgaggcagctcatggcacagtgacacgtcacttcagggtgcatcagaaaggaggagagactagtaccaacagcattgcgtcaatatttgcgtggagccgtggccttggccatagggctaaactggatggtaactcgagactccaagagtttgctgataagctggaagcggctagtattggaaccgtcgaagctggcaagatgacaaaagatcttgctatactcgtccacggctccaaggcttctagagacttgtatctaaacactgaagagtttctagattcggttgcagaggacctcaagcgacgactctcctcccctgttacctccaaactgaaggagccactactccaaggccgatgaaggcaccgcaccactgcacgagaaataatagaat

SEQ ID NO: 5370 - DNA, 447 bp, Artificial
  Synthetic
gatctgaagaaatatgatggaagattcaaggatatatttcaagaagcttatgagcagaaatggaagaccaaatttgaagcagcaggaatatggtatgaacatcgcctcattgatgatatggtagcatactgtttgaaaagtgacggcggctatgtctgggcttgtaaaaactacgatggagatgtgcttagcgaccttcttgctcaaaggatttggctcattaggtttgatgacctccgttttgatttgcccggatgggaaaaccattgaagcagaagctgctcatggaacagtaacacggcattttcgcgtgcatcagaaaggaggagagacaagtacaaacagcatagcttcaatatttgcatggactcgtggtctcagtcatagggccaagttagatgggaatgacaggcttcttgatttcgctctaaagctagaaggtgcatg

SEQ ID NO: 5371 - DNA, 628 bp, Artificial
  Synthetic
agaagtcccaatggcaaaatcagaaacattttaaatgggactgttttccgggagcctatactatgcaaaaacgtccccagaattgttcctggttggaagaaacccatttgtattggtaggcatgcctttggtgaccagtatcgtgccacagatgcaattattaatggacccggaaagctcaaaatggtttttgagccagaaaatggggaagccccttcggaactagatgtttatgattttaaaggtccgggtgttgcacttgccatgtacaatgttgaccagtcaattcgagcgtttgctgaatcatcaatgtcaatggcattttcaaagaaatggcctctttactcgagtacaaaaaatacaattttaaagaaatacgatggaaggtttaaggacatttttgaagaggtatatgaagagaagtggaagcaacagtttgaggaacactcgatatggtatgagcatagactgatagatgatatggtagcttatgcattaaaaagtgagggtggatatgtttgggcttgcaagaactatgatggagatgtccagagtgatatgctcggtcaaggatttggttctctgggcctcatgacctctgtattggtatcttctgatggcaagacat

SEQ ID NO: 5372 - DNA, 642 bp, Artificial
  Synthetic
attcttctctccctttgcgaaacaagctaactttctcccgagtctttttcttcttcctctcaagatgcagatctttgtaaagacactcactgggaaaaccattactcttgaggttgagagttcagacacaattgataacgtgaaggccaaaattcaagacaaggaagggattcccccagaccagcagaggctgatatttgctggaaagcagcttgaagatggccgaactcttgctgattacaatattcaaaaggagtctaccctccaccttgtcctccgtctacgtggtggtatgcagatttttgttaaaactcttactggcaaaaccattactcttgaggtcgagagttcagacaccattgacaatgttaaggccaagattcaagataaggaaggcattccacctgatcagcaaaggctgatctttgctggaaagcaacttgaggatggaaggtccctcgcggattacaacattcaaaaggagtcgaccctacatcttgtcctccgtctacgtggtggcatgcagatttttgttaaaactttaacgggcaagacgatcactcttgaagttgagagctcagataccattgacaatgtaaaggcaaagatccaggacaaggagggtattcctccagaccagca

SEQ ID NO: 5373 - DNA, 629 bp, Artificial
  Synthetic
aaaaaagggaagaaatttttttcttttttttttgttcgcctccgcttcttcctcacgcagctctcgcctcgcctcgccgcccgccactagagaggagagggagaaggagaaggaggcgaatcccagcaaaagaagatgcagatcttcgtgaagaccctgacggggaagaccatcaccctcgaggtggagagcagcgacaccatcgacaacgtcaaggccaaaatccaggacaaggaagggatccctccagatcaacagcgtttgatattcgccggcaagcagctggaagatgggcgcacactggccgactacaacattcagaaggagtcaactcttcacttggtcctcaggctcaggggtggcactatgatcaaggttaagaccctcactggaaaagagattgaaattgacattgagcccaccgacacgatcgataggatcaaggagcgtgttgaggagaaagaaggcattcctcccgtgcagcaaaggcttatctatgctggtaagcagcttgccgacgacaagactgcgaaggactataacatcgaaggtggctctgtcctccatcttgtccttgctctgaggggtggttattagtaaagctaatgtgctagtacttagctcaatac

SEQ ID NO: 5374 - DNA, 1646 bp, Artificial
  Synthetic
cgaaaaatttctccccaatctcgcgaggctctcgtcgtcgaatcgaatcctctcgcgtcctcaagatgcagatctttgtgaagacattgaccggcaagactatcaccctcgaggtggagtcctctgacaccatcgataatgtcaaggctaagatccaagataaggagggcatccccccggaccagcagcgtctcatcttcgctggcaagcagctggaggatggcaggacccttgctgactacaacatccagaaggagtcgacccttcaccttgtcctccgcctccgtggtggcatgcagatctttgtcaagactctgaccggcaagactatcacccttgaggtggagtcttctgacaccatcgacaacgtcaaggccaagatccaggacaaagagggcatccccccagaccagcagcgtctcatcttcgccggcaagcagctggaggatggcaggacccttgctgactacaacatccagaaggagtccaccctccaccttgtcctccgcctccgtggtggcatgcagatctttgtcaagacactgaccggcaagaccatcaccctcgaggtggaatcttctgacaccatcgacaacgtcaaggccaagatccaggacaaggagggcattcccccggaccagcagcgtctcatctttgccggcaagcagcttgaggacggcaggacccttgctgactacaacatccagaaggagtcaacgcttcaccttgtcctccgtctcaggggaggcatgcaaatcttcgtgaagactctgaccggcaagaccatcaccctcgaggtggagtcttctgataccatcgacaatgtcaaggccaagatccaggacaaggagggcattcccccggaccagcagcgcctcatctttgctggcaagcagctggaggatggcaggacccttgctgactacaacatccagaaggagtccaccctccaccttgtgctccgccttcgtggtggtatgcagatctttgtcaagaccctcacaggcaagaccatcaccctggaggttgagagctcggacaccatcgacaacgtcaaggccaagatccaggacaaggagggcatccccccagaccagcagcgtctcatcttcgccggcaagcagctcgaggatggccgcaccctcgccgactacaacatccagaaggagtctaccctccacctggtgcttcgtctccgtggtggtatgcagatcttcgtgaagaccttgactgggaagaccatcactttggaggttgagagctccgacaccattgataatgtgaaggccaagatccaggacaaggaggggattcccccagaccagcagcgtctgatcttcgctggcaagcagctggaggatggacgcaccctcgccgactacaacatccagaaggagtccaccctccacctggtgctccgcctccgtggtggtcagtaatcagccagtttggtggagctgccgatgtgcctggtcgtcccgagcctctgttcgtcaagtatttgtggtgctgatgtctacttgtgtctggtttaatggaccatcgagtccgtatgatatgttagttttatgaaacagtttcctgtgggacagcagtatgctttatgaataagttggatttgaacctaaatatgtgctcaatttgct

SEQ ID NO: 5375 - DNA, 657 bp, Artificial
  Synthetic
agcggcactcctcaccttgataatcttggtgcacatagttgggaaagatgcagatattcgtgaagaccctgacagggaagactattaccttagaggtagagtcatccgacaccattgacaatgttaaggctaagattcaggacaaggaaggcattccaccagaccagcagcggttgattttcgcaggtaagcagcttgaggatggccgaacactagccgactacaacatccagaaggagtccaccctccaccttgtccttcgcctccgtggtggtgccaagaagcgtaagaagaagacttacactaagccaaagaagattaagcacaagaagaagaaggttaagctcgccgtcctccagttttacaaggttgatgattctggtaaggttcagaggctccgcaaggagtgtcccaacgccgagtgtggtgccgggactttcatggctaaccactttgacaggcactattgtggtaaatgtgggcttacctatgtttaccagaaggctggtggtgattagatgagtgttactttgcttattacttttccccacatttcttgccttaaactctcctaatgtcttgtttgtgacaagatgtaatgaatttgaattatggtattgtgttaacagcttatgaaattaaggatttttgtcagtt

SEQ ID NO: 5376 - DNA, 1158 bp, Artificial
  Synthetic
attctcattatctcctcaacttttctctctttattcaaacgcctctcaagatgcagatcttcgtcaaaaccctaactggaaagacgataacccttgaggttgaaagctccgacacaattgacaacgttaaggcgaagattcaggacaaggaaggaattccaccggatcagcagaggctgatcttcgccggaaagcagctcgaagacggcagaaccctagccgactacaacatccagaaggaatcgactcttcacttggtgctccgtcttcgtggcggtatgcaaatcttcgtcaaaaccctaacagggaaaacaatcacccttgaagttgaaagctccgacactattgataacgttaaggcgaaaatccaggataaagagggaatcccaccagatcagcagaggttgatctttgctggcaaacagttggaagacggcagaaccctagccgactacaacattcagaaggaatcaactcttcacttggtactccgtcttagaggaggcatgcaaatcttcgtcaaaaccctaaccgggaaaacaatcacccttgaagtcgaaagctttgacacaattgacaatgtcaaggcgaagattcaggacaaggaaggaatcccaccagatcagcagaggttgatctttgcgggtaagcaattggaagatggaaggaccttagctgattacaatattcagaaggagtccaccctccatttggtgctccgtcttcgtggtggaatgcagatttttgtgaagactttgaccgggaaaacaatcactcttgaagttgaaagctcagatactattgacaacgttaaggccaagatccaggataaggagggtatcccaccagatcagcaaaggctgatctttgctggcaagcagttggaagatggtcgtactcttgctgattacaacattcagaaggagtcgactttgcaccttgtcctccgtctccgtggtggtttctaaagtgtccgtcagtggtggtggtgatgtctgtgtctgtgtcttgggtctttggtctgtttggtgtttgtttgattcatgatttagtactttgtgtagtttctgttagttgttatcatgttatctttccaatagaggcgaggagtcttgttttcttctgtctctgtttgtgaataataaagtcgaattattg

SEQ ID NO: 5377 - DNA, 293 bp, Artificial
  Synthetic
ggcagagagaggagagggagagagagatgcagatcttcgtgaaaaccctaacagggaagaccatcactctcgaagtcgagagcagtgataccatcgacaatgtcaaagccaagatccaggacaaagaagggataccaccagatcaggagaggctgatatttggtggcaagcagcttgaagatgggcgcacactggctgattacaacatccaaaaggagtccacactggatctggtgctgaagttgcgtggagggaccatgatcaaggttaagaccctcaatgggaaggaaatt

SEQ ID NO: 5378 - DNA, 618 bp, Artificial
  Synthetic
ttcgtcaaaccctcaccggcaagaccatcaccctggaggttgaaagctccgacaccattgacaatgtcaaggccaagatccaggacaaggaggggattcccccagaccagcagaggttgatctttgcaggtaagcagttggaagatggtcgcacccttgcggactacaacattcagaaggagtccaccctgcacttggtgctgaggctgaggggaggaatgcagatcttcgtgaagacattgaccgggaagaccatcaccttggaggtggagagctctgacaccatcgacaatgtaaaagctaagatccaggacaaggagggtatcccacccgaccagcagaggttgatctttgctgggaagcagctcgaggatggaaggaccttggctgactacaatatccagaaagagtcaacccttcaccttgtcctccgtctccgtggtggtttctaggttgtctgttgttgatgacgtggtgtcctgttaattggctgtgttgtctgtttctagttgtggtcatgatgtgctttgtttgctgaggtctcaatgatgttccattctgtttctgttcgctgtttcttttatgttctctgttgtgaataaagattccgatttctgt

SEQ ID NO: 5379 - DNA, 627 bp, Artificial
  Synthetic
caataatccgtcatgcagatcttcgtgaaaaccctaacgggaaagaccataaccctcgaagtcgagagcagcgacaccatcgacaatgtcaaggccaaaattcaggacaaagaagggatacctcctgatcagcagaggttgatttttgctggaaaacagttggaagatggtcgaactctggctgattacaatatccagaaagaatcaacacttcacctggttttgaggctcaggggaggaactatgattaaggtgaagactctcactggaaaggaaattgagattgatattgaacccacagacaccattgatcgaattaaggaacgagttgaggaaaaagaaggaatacctcctgtgcagcaaaggcttatttatgctggaaagcagctagctgatgacaagaccgctaaggattacaatattgaaggaggttctgttcttcatctcgttcttgcattgatgggtggtagtctttagaatgctccgaatttgggtaaaaatgtgcaacctttatccacgaatttatcatgacagttctcttttgttttctttttaccttttctcatgtaaaacatgaaaacttggttaaagctgactagctgagattgatttccccttataaaaaaa

SEQ ID NO: 5380 - DNA, 1439 bp, Artificial
  Synthetic
cccaaaatcgcagagaagaaaaaatctcccctcgaagcgaagcgtcgaatcgccttctcaagatgcagatctttgtgaagaccctcaccggcaagaccatcaccctcgaggttgagtcctcggacaccattgacaatgtcaaggccaagatccaggacaaggagggcatccctccggaccagcagcgtctcatcttcgctggcaagcagcttgaggatggccgcaccctggccgactacaacatccagaaggagtccaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccagaccagcagcgtctcatcttcgccggcaagcagcgggaggatggccgcacccttgctgactacaacatccagaaggagtccaccctccaccttgtgctcaggctcaggggaggtatgcagatcttcgtcaagaccctgaccggcaagaccatcaccctcgaggtcgagtcctcggacacgatcgacaacgtgaaggccaagatccaggacaaggagggcatccccccggaccagcagcgtctcatctttgctggcaagcagctggaggatggccgcacccttgccgactacaacatccagaaggagtccaccctccaccttgtgctcaggctcaggggtggtatgcagatcttcgtcaagaccctgaccggcaagaccatcacgcttgaggtcgagtcctcggacacgatcgacaatgtgaaggccaagatccaggacaaggagggtatccccccggaccagcagcgtctcatcttcgccggcaagcagctggaggatggccgcaccttggctgactacaacatccagaaggagtccacccttcacctggttctcaggctcaggggtgggatgcagatcttcgtgaagaccctgactggcaagaccattacccttgaggttgagtcgtccgacactattgacaacgtgaaggcgaagatccaggacaaggagggcatccccccggaccagcagcgtctgatctttgctggtaagcagcttgaggatggccgcacccttgcggattacaacatccagaaggagtccacactccacctggtgctccgcctccgtggtggccagtaagtcctcagccatggagctgctgctgttctagggttcacaagtctgcctattgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtcc

SEQ ID NO: 5381 - DNA, 1390 bp, Artificial
  Synthetic
cttgaggtcgagtcctcggacacgatcgagaatgtgaaggccaagatccaggacaaggagggcatccccccggaccagcagcgtctcatcttcgctggcaagcagctggaggacggccgcacccttgccgactacaacatccagaaggagtccaccctccaccttgtgctcaggctcaggggtggtatgcagatcttcgtcaagaccctgaccggcaagaccatcacgcttgaggtcgagtcctcggacacgatcgacaacgtgaaggccaagatccaggacaaggagggtatccccccggaccagcagcgcctcatcttcgccggcaagcagctggaggatggccgcaccttggctgactacaacatccagaaggagtccacccttcacctggttctcaggctcaggggtgggatgcagatcttcgtgaagaccctgactggcaagaccattacccttgaggttgagtcgtccgacactattgacaacgtgaaggcgaagatccaggacaaggagggcatccccccggaccagcagcgtctgatctttgctggtaagcagcttgaggatggccgcaccctggccgactacaacatccagaaggagtccaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccggaccagcagcgtctcatcttcgctggcaagcagcttgaggatggccgcaccctggccgactacaacatccagaaggagtctaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccagaccagcagcgtctcatcttcgccggcaagcagctggaggatggccgcacccttggtgactacaacatccagaaggagtccaccctccaccttgtgctcaggctcaggggaggtatgcagatcttcgtcaagagcctgaccggcaagaccatcaccctcgaggtcgagtcctcggacacgatcgacaacgtgaagggcaagatccaggacaaggagggcatccccccggaccagcagcgtctcatcttcgccggcaagcagctggaggacggccgcacccttggcgactacaacatccagaaggaatccaccctccaccttgtgcttaggctcaggggaggtatgcagatcttcgtcaagaccctgactggcaagaccatcacacttgaggtcgagtcctcggaca

SEQ ID NO: 5382 - DNA, 1210 bp, Artificial
  Synthetic
tcatcaattaggtttcttcgatagcaagtagcgatgcagatcttcgtcaagactctcaccggcaagactatcaccttggaggtggagagctccgacaccatcgacaacgtcaagaccaagatccaggacaaggaagggatccctccggatcagcagcggttgatctttgccggcaagcagcttgaggacgggcgtaccctcgccgactacaacatccagaaggagtctacgctgcatcttgttcttcggctgcgaggaggtatgcaaatattcgtcaagaccctaacgggtaagacgatcaccctggaggtggagagctccgacaccatcgacaacgtcaagaccaagatccaggacaaggaagggatcccgccggatcagcagcgtctgatcttcgctggcaagcagctcgaggatggccgtaccctggccgactacaacatccagaaggagtcgacccttcatcttgtgctgcgtctgcgaggaggcatgcagatcttcgttaagaccctcactggtaagacgatcaccctggaagtcgagagctcggacaccatcgacaacgtgaagactaagatccaggacaaggagggaattcctccggaccagcagcggttgatcttcgcgggtaagcagctcgaggatgggcgcactcttgccgactacaacattcagaaggagtctacactccatttggtgctgcgtcttcgcggaggcatgcagatcttcgtcaagaccctcacgggtaagacgatcaccctggaagtcgagagctcagacaccatcgacaacgtgaagaccaagatccaggacaaggagggaattcctccggatcagcagcggttgatcttcgcgggtaagcagctcgaagatgggcgcactctcgccgactacaacattcagaaggagtctactctccatttggtgctgcgtcttcgcggaggcatgcagatcttcgtcaagaccctcacgggtaagacgatcacgttggaggtggagagctcggacacgattgacaacgtgaagaccaagatccaggacaaggagggaattcctccggaccagcagaggctgatcttcgccgggaagcagctcgaggatggccgcactcttgcggactacaacatccagaaggagtctactctccatttggtgctccgtcttcgtggaggccagtagatagcatgtagcgcgttagcgcgtgaagtat

SEQ ID NO: 5383 - DNA, 1274 bp, Artificial
  Synthetic
cgacccacgcgtccgcttttgtgggcgattcctgggtaatttcatacagcggcaactatgcagatcttcgtcaagacactgactggcaagacgatcactctggaggtcgagagctcggacacgatcgataatgtgaagaccaagatccaggacaaggaagggatccccccggaccagcagcgtctcatcttcgccgggaagcagctcgaagacgggcgaatcttggctgactacaacatccagaaggaatccactctccatctcgtcctacgtcttcgcggaggcatgcagatctttgtcaagacgctgaccggcaagaccatcactctggaggtcgagagctcggacacgatcgataatgtgaagaccaagatccaggacaaggaagggatccccccggaccagcagcgtctcatcttcgccgggaagcagctcgaagacgggcgaaccttggctgactacaacatccagaaggaatcgactctccatctcgtcctacgtcttcgcggaggcatgcagatctttgtcaagacgctgaccggcaagaccatcactcttgaggtcgagagctcggacacgatcgataatgtgaagaccaagatccaggacaaggaagggatccccccggaccagcagcgtctcatctttgctgggaagcaactcgaagacgggcgaaccttggccgactacaacatccagaaggagtcgacccttcacttggtgctgcgtctccgtggaggcatgcagatcttcgtcaagaccctgaccggcaagaccatcaccctcgaggtggagagctccgacacgattgacaacgttaagacgaaaatccaggacaaggaagggatccctcctgaccagcagcgcctcatcttcgccggcaagcagctcgaggatggacgaactctcgccgactacaacatccagaaggaatccacccttcacctggtgctgcgtctccgcggaggcatgcaaatcttcgtcaagaccctgaccggcaagaccatcacgctcgaggtcgagagctccgacacgatcgacaacgtaaagaccaagatccaggacaaggaagggatccccccggaccagcagcgactcatctttgccgggaagcagctcgaggatggcaggactctggccgactacaacatccagaaggaatccacccttcacctggtgctgcgtctccgcggaggcatgcaaatcttcgtcaagaccctgaccggcaagaccatcactctggaggtggagagctcggataccatcgacaacgt

SEQ ID NO: 5384 - DNA, 636 bp, Artificial
  Synthetic
ggtgatttctaaacatgcagatctttgtgaagaccttgaccggcaagactatcaccctcgaggtggagagctcggataccatcgacaacgttaagaccaagatccaggacaaggaagggatcccaccggaccagcaacgattgatcttcgccgggaagcagcttgaggacggacggacccttgcggactacaacatccagaaggaatccacgcttcacctggttcttcgtctccgcggtggcatgcagatatttgtgaagaccttgaccggcaagaccatcaccctcgaggtggagagctcggataccatcgacaatgtcaagaccaagatccaggataaggaggggattcctccggaccagcagcgacttatcttcgccgggaagcaactcgaggacggacggacccttgccgactataacatccagaaggagtcgactctccacttggttcttcgtctccgcggtggcatgcagatatttgtgaagacactgaccggcaagaccatcaccctcgaggtggagagctcggataccatcgacaatgtcaagaccaagatccaggataaggaggggattcctccggaccagcagcgtttgatcttcgctgggaagcagctcgaggacggacggaccc

SEQ ID NO: 5385 - DNA, 782 bp, Artificial
  Synthetic
gaattcagattctctttttgcgatctaaaggatcttcttcaattctccttcaagatgcagatctttgtgaaaactcttactggtaagaccatcacccttgaggtcgagagctcagacacaattgacaacgttaaggctaagattcaagacaaggaaggaattcctccagaccaacaacgtttgatcttcgccggaaagcagttggaagatggaagaactttagctgactacaacatccagaaggaatcaactctccatcttgtccttcgtcttagaggtggtatgcaaatctttgtcaaaaccttgactggtaagaccatcactttggaagtcgagagctctgacaccattgataacgttaaggctaagattcaagataaggaaggaattcctccagaccagcaacgtttgatcttcgccggaaagcagttggaagatggtcgtactcttgccgactacaacatccagaaggagtctactctccatttggttcttcgtctcagaggtggtatgcagattttcgtcaagacccttactggaaagaccatcaccttggaggttgagagttccgacaccatcgataatgtcaaggctaagattcaagataaggagggtatccccccagaccagcaacgtttgatcttcgccggaaagcagctggaagatggtcgcactcttgccgactacaacattcagaaggagtctaccctccatttggtgcttcgtcttagaggtggtatgcaaatcttcgtgaagaccttgaccggaaagaccatcactct

SEQ ID NO: 5386 - DNA, 641 bp, Artificial
  Synthetic
cccggaccttgctccacacccgcagcagcagcagcagcaaggggaagaagaagagccaagatgcagatcttcgtgaagaccctaacggggaagaccatcacgctcgaggtcgagagcagcgacaccatcgacaatgtcaaggccaagatccaggacaaggaaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaagtgctatgctcggctgcaccccagggctgtcaactgccgcaagaagaagtgcggccacagcaaccagctgaggcccaagaagaagatcaagaactagagtttgagatatcatttccgcggatcattgaaatcaacaggaagatcagagtttaagtttttttgtagtgtaatgcctcatgttgtatgccgaactttctgtttatcctgtggtatgttaaccttggttacgctggagagtactccagcttattttgatgacataattgactacaaagtcaaggttatatg

SEQ ID NO: 5387 - DNA, 733 bp, Artificial
  Synthetic
cccacgcgtccgctcaaaatcttaaaaactttctctcaattctctctaccgtgatcaagatgcagatctttgttaagactctcaccggaaagacaatcaccctcgaggtggaaagctccgacaccatcgacaacgttaaggccaagatccaggataaggagggcattcctccggatcagcagaggcttattttcgccggcaagcagctagaggatggccgtacgttggctgattacaatatccagaaggaatccaccctccacttggtcctcaggctccgtggtggtatgcagattttcgttaaaaccctaacgggaaagacgattactcttgaggtggagagttctgacaccatcgacaacgtcaaggccaagatccaagacaaagagggtattcctccggaccagcagaggctgatcttcgccggaaagcagttggaggatggcagaactcttgctgactacaatatccagaaggagtccacccttcatcttgttctcaggctccgtggtggtatgcagattttcgttaagacgttgactgggaaaactatcactttggaggtggagagttctgacaccattgataacgtgaaagccaagatccaagacaaagagggtattcctccggaccagcagagattgatcttcgccggaaaacaacttgaagatggcagaactttggccgactacaacattcagaaggagtccacactccacttggtcttgcgtct

SEQ ID NO: 5388 - DNA, 1204 bp, Artificial
  Synthetic
cccacgcgtccgctctcccaaagcctaaagcgatctctgcaaatctctcgcgactctctctttcaagatgcaaatcttcgtgaaaacactcactggcaagactatcactctcgaggttgagagctctgacaccatcgacaatgttaaggcaaagattcaggacaaggaaggcattcctccggatcagcaaagattaatattcgccggtaaacagctagaagatggccgtaccttggccgattacaacattcagaaagaatcaacccttcatttggttctccgtttaagaggtggtatgcaaatctttgtcaagactctgactggcaagaccattactttggaggttgagagctctgacactattgacaacgtcaaagcaaagatccaggacaaggaaggaatccctccggatcagcagagacttatctttgccggtaagcagcttgaagacggaagaactcttgctgactacaacattcaaaaggagtcgacccttcatttggtgcttcgtctcagaggtggtatgcaaatctttgtcaagaccctcactggtaaaacaatcacccttgaggttgagagttcagacaccattgacaatgtcaaagctaagatccaagataaagagggaattcctccggatcagcagaggcttatctttgccggtaagcagctcgaagatggacgcacccttgcagattacaacatccaaaaggagtcgacacttcatcttgtgcttcgtctccgtggtggtatgcagatctttgtgaagacccttaccggaaagaccattactctggaggttgaaagctcagacaccatcgataatgtcaaggctaagattcaggacaaggaagggatcccaccagaccaacagagactcatcttcgctggaaaacagcttgaggatggtcgcacacttgcagattacaacatccagaaggagtcgactcttcacttggttcttcgtcttcgtggtggaagcttttaagctttttgtgatctgatgataagtggttggttcgtgtctcatgcacttgggaggtgatctatttcacctggtgtagtttgtgtttccgtcagttggaaaaacttatccctatcgatttcgttttcattttctgcttttcttttatgtaccttcgtttgggcttgtaacgggcctttgtatttcaactctcaataataatccaagtgcatgtttacc

SEQ ID NO: 5389 - DNA, 728 bp, Artificial
  Synthetic
tttatttttttaagaagaagttcgacttgtcattagaaagaaagagataacaggaacggaaacatagtagaacacttattcatcagggattatacaaggccccaaaacacaaaccaccaaagttttacatgaaacgaaacattgaacttcttaagcataacagagacgagatttaaaaaccaccacgaagacgcaggaccaagtgaagagtagactccttctggatgttgtagtcggccaaagtacgtccatcctcaagctgctttccagcgaagatgagacgctgctggtccggaggaataccttccttgtcctggatcttggccttgacgttgtcaatggtgtcggagctttccacttcaagggtgatggtctttccggtcaaagtcttgacgaagatctgcatacctccacgcagacgcaacaccaagtgaagggtcgactccttctggatgttgtaatccgccaaagtacgaccatcctccaattgttttccggcaaagatcaacctctgctggtccggagggattccttccttatcctggatcttggccttcacgttgtcaatggtgtcagagctctctacctccaaagtgatagtctttccggtgagagtcttcacgaagatctgcatacctccacgcagacgcaagaccaagtgaagtgtggactccttctgaatgttgtagtcagccaaagttcttccatcttcaagttgctttccggcg

SEQ ID NO: 5390 - DNA, 595 bp, Artificial
  Synthetic
cccacgcgtccggggtaaactgaagagtgcgccgcaaaatgcagatcttcgtgaaaaccctaaccgggaagacaatcacgctcgaggttgaatcgagcgacaccattgataatgtcaaggctaagattcaagacaaagaaggtattccaccggaccagcagcggttgatattcgccggaaagcagctcgaagatggacgtactcttgctgattataacatccagaaagagtcaactttgcatttggttttgaggcttcgtggagggattattgagccttctctgatggctttggctaggaagtacaaccaggataagatgatttgtcgcaagtgctatgctcgcctgcatcctcgtgctgttaactgcaggaagaaaaaatgtgggcacagcaaccagctgaggccaaagaagaagatcaagtagacgtgatgtcttttctaagcttagatcaattttgcgcgttgcagctatatattgccagtccgttgtttttacagttttcagtcctgcttcaatttgatgtcatggataacaaacatgtcttaaacatctaattattggataagatatctttgtgcactcaatatatgtct

SEQ ID NO: 5391 - DNA, 313 bp, Artificial
  Synthetic
aaaaccctcaccggaaaaaccataaccctagaggtcgaaagcagcgacaccatcgacaatgtcaaagccaaaattcaggacaaagagggaataccacctgatcaacagaggttgatatttgctggtaagcagcttgaagatggtagaacattagcggattacaacattcagaaagaatcgactcttcacttggtattgaggcttaggggtgggactatgattaaggtgaagactctcacagggaaggaaattgagattgatatcgaaccaaccgatactattgatcggattaaggaacgtgttgaggagaaag

SEQ ID NO: 5392 - DNA, 853 bp, Artificial
  Synthetic
cgcggtatgcagatcttcgtgaagactctcaccggaaagactatcactttggaggtagagagctctgacaccattgacaacgtgaaggccaagatccaggataaggaaggaatccctccggaccagcagaggttgatctttgccggaaaacaattggaggatggtcgtactttggcggattacaacatccagaaggagacgacccttcacttggtgttgcgtctgcgaggaggtatgcagaaattcgtcaagactttgaccggaaagaccatcacccttgaagtggaaagctccgacaccattgacaacgtcaaggccaagatccaggacaaggagggaatcccccctgaccagcagcgcctcatctttgccggtaaacagctcgaagacggccgcacccttgccgattacaacatacagaaggagtctaccctccaccttgtccttcgcctcaggggcggtatgcaaatcttcgtcaaaaccctcactggcaagaccattacccttgaagtcgagagttctgataccatcgataatgtgaaagccaagatccaagataaggagggaattccccctgaccagcagcgccttatctttgctggtaaacagcttgaagatggccgcaccctcgctgattacaacatacagaaggagtctaccctccaccttgtccttcgcctcaggggtggtatgcaaatcttcgtcaaaaccctcaccggcaagaccattactcttgaagtcgagagttctgacacaattgataacgtgaaagccaagatccaagataaggagggaattccccccgaccagcagaggctcatctttgctgggaagcaacttgaagatggtcgca

SEQ ID NO: 5393 - DNA, 644 bp, Artificial
  Synthetic
ttacaatatccagaaggaatccaccctccacttggttctcaggctccgtggtggtatgcagattttcgttaaaaccctaacggtaaagacgattactcttgaggtggagagctctgacaccattgacatcgtcaaggccaagatccaagataaggagggtattcctccggaccagcagaggttgatcttcgccggaaagcaacttgaggacggcagaactttggcggattacaacatccagaaggagtctacgcttcatttggtcttgcgtctgcgtggaggtatgcagatcttcgtaaagactttgaccggaaagaccatcactcttgaagttgagagctccgacaccattgataacgtgaaggctaagatccaggacaaggaaggcattcctccggaccagcagcgtctcatcttcgctggaaagcagcttgaggatggacgtactttggccgactacaacatccagaaggagtctactcttcacttggtcctccgtctccgtggtggtttctaaaccttgtctctctctcttatggttactgaaccaagttcatgtatcgtttcatctagtactttggtggtttatgttttggggccatgtacagcctctgataaataattgatcgactatgtttccgtta

SEQ ID NO: 5394 - DNA, 344 bp, Artificial
  Synthetic
cgacaatgttaaagccaaaatccaggacaaagagggcataccacctgatcaacagaggctgatttttgctggtaagcaattggaagatggccggaccttagctgattacaacatccagaaagagtctactcttcatcttgtcctcaggctcagaggtggaaccatgatcaaggtgaagacactcactggaaaagaaatcgagattgatatcgaaccaaccgacactattgatcggatcaaagaacgtgttgaagagaaagaaggcatccctcctgttcaacaaaggctcatatatgccggaaaacagcttgctgatgacaaaacggccaaagattatgcgatag

SEQ ID NO: 5395 - DNA, 661 bp, Artificial
  Synthetic
gccattacggccggggatagaagaggagtagaagatcgctggtgaggggcggagaaaatgcagatcttcgtgaaaactctgacgggtaaaactataacccttgaggttgaatccagtgacacaattgacaatgtcaaggccaaaattcaagacaaggaaggaattccaccggaccaacaaaggctgatttttgctggtaagcagcttgaagatggccgcacccttgctgactataacattcagaaagagtcgactctgcatttggtactgaggcttcgtggtggaattattgaaccatctttgatggctttggctaggaagtacaatcaggacaaaatgatttgccgcaagtaggtgctatgctcgtttgcatcctcgtgctgtcaattgccgcaaaaagaagtgtggccacagtaaccagttgaggcccaagaagaagatcaagtagatggtgattttgaagtcccggcaacatgtagctgctaatgttgagatccttaagaaaattattagatatgttgttgggttgcctgttcaatttactctgaaacattgaaggatttgtgtttgagctacttcaatatttcttaatgagctagattctgttggttacattacataagttttgctcgatgtgtagttctatgtgcttttatccagc

SEQ ID NO: 5396 - DNA, 383 bp, Artificial
  Synthetic
cccacgcgtccgtatggaaaagatctggcatcacactttctacaatgagcttcgtattgctcctgaagagcaccctgttcttcttaccgaggctcctcttaacccaaaggccaacagagagaagatgactcaaatcatgtttgagacctttaactctcccgatatgtatgtcgccatccaagctgttctctccttgtacgccagtggtcgtacaaccggtattgtgctggattctggtgatggtgtgtctcacactgtgccaatctacgagggtttctctcttcctcatgccatcctccgtcttgaccttgctggacgtgaccttactgattacctcatgaagatccttacagagagaggttacatgttcaccacaacagcag

SEQ ID NO: 5397 - DNA, 998 bp, Artificial
  Synthetic
tccttacagcgtttcaacagagtgttgtagagagagaaagcgagccggccttcgtctttggttggctttgcttctcggatcgatcttcctctcttttttcctcttttgttttcaggtgaattaagatggccgacggcgaggatattcagccccttgtttgtgacaatggaactggaatggttaaggctggatttgctggtgatgatgctcctcgagcagtgtttcccagtattgtgggtcgtcctcggcacactggtgttatggtcggaatgggacagaaggatgcttatgtgggtgatgaagctcaatccaagagaggtatcttaaccttgaaatatcctattgagcatggtatagtcagcaactgggatgatatggagaaaatatggcatcatactttctacaatgagcttcgagttgctcctgaagaacaccctgttctcctgactgaggcaccccttaatcctaaggccaacagagagaagatgacccagattatgtttgagacatttaacgttccagctatgtatgttgctattcaggctgtgctctcattgtatgctagtggtcgtactactggtattgtgttggactctggtgatggtgtgagtcacactgtccctatctatgaaggttatgctttgccccatgccattcttcgtttggatcttgctggtcgtgaccttaccgatagcctgatgaagatcctcactgagagaggatacatgttcaccaccaccgctgaacgggaaattgtccgtgatatgaaagaaaagcttgcctatgtggctcttgactatgagcaggaacttgaaactgccaggagcagttcctccattgaaaagaactatgaattgccagatggacaggttattactattggtgctgaaaggttccgttgcccggaagttctcttccaaccatcgatgatcgggatggaagctgcaggtatccatgagactacctacaactccatcatgaaatgtgatgtggatatt

SEQ ID NO: 5398 - DNA, 649 bp, Artificial
  Synthetic
gaggttttagggtttttccgggcgcgatgtatggtggagatgaggtatccgccattgtcgtcgatctgggatcgcattcttgtaaagcgggctatgccggagaggatgcgccaaaggcagtgtttccatcggttgtaggagctgtgggggaaaagcccaacagcacttactatgttggaaatcaggcaatacaatataggcgtgattttatggaggtttgccctgcattgaaagatggtctcgtagcagattgggacatagttgagggcatctgggatcacgctttcaaggaacggctcctgattgacccgaaagagcatccaatgcttctcgctgaggcatcattcaatcctcagcaacacagggaaaagactgtagagctcatgtttgagaaatatggtgtacctgcggtctttctcgctaagaatgctgtgcttacgtcgtttgcgtctggacgagctacatctctggttgccgactgtggtggtggctcaactactgttgctgcagtccatgatggctatgttttgcacaaggctgttttcaggtctcccatcggcggcgaagtcctcactgattgcctcttaaagatcttagagtcgaagaatgttaatatcaggccgaggtattcgttcaagaagaaagaacc

SEQ ID NO: 5399 - DNA, 652 bp, Artificial
  Synthetic
actgagcgaatatgagcgaacaaccaattgtgctagatcaaggaaccggctttgtgaaaatcggctacggaggcaccaacttccccgaacacaccttcccgtcgatggtgggtcggcccattctgcgggctgaagagcgggccacagacacatacggcgacgtggccatcaaggacattatgtgtggagacgaggctgccgcggcacgaaacatgctgcagatctcgtacccgatggagaacggagtgattcgaaactgggaagacatgggtcacctgtggaaccactcgttttacgacaagatgaagattgacacccggggtcgaaaggtgctgctcacagagcctcccatgaaccccctcaagaaccgggaaaagatgtgcgagatcatgtttgagcactacggcttcaatggcgtttatgtagccatccaggccgtcctggctctgtacgcacagggcctgtcgtcaggagtggtggtggactctggagacggtgttacccacgtggtgcctgtctacgagtctgtggtgctcaaccacctgacccgtcgtctggacgtcgctggtcgagatgtcaaccgacagctgattgctctgctactgcgacgaggatacgccttcaaccgaactgccgacttcgagaccgtgcg

SEQ ID NO: 5400 - DNA, 689 bp, Artificial
  Synthetic
atttcatcgacaaatctctttgctaccaacaaccacacaaattaaaaatggaagacgaaactgttgccctcgttatcgataacggatccggtatgtgcaaggccggtttcgccggtgatgacgctccccgagctgttttcccctccatcgtcggtcgaccccgacatcagggtgtcatggtcggcatgggccagaaggactcctatgttggtgatgaggcccagtccaagcgaggtatcctgaccctccgataccccatcgagcacggtattgttaccaactgggatgacatggagaagatctggcaccacaccttctacaacgagctccgagttgctcctgaggagcaccccgtcctgctcaccgaggcccccatcaaccccaagtccaaccgagagaagatgacccagatcttcttcgagactttcaacgctcccgctttctacgtctctatccaggccgtcctctccctgtacgcctctggtcgagtcaccggtatcgttcttgactctggtgatggtgtcacccacgttgtgcccatctactctggtttctctctcccccacgccatcatgcgactcgatatggctggccgagatcttaccgactacctcatgaagattctctccgagcgaggttactctttcaccaactccgccgagcgagaaatcgtccgagacatcaaggag

SEQ ID NO: 5401 - DNA, 1056 bp, Artificial
  Synthetic
atagccaaccgtggacaccactaatttactcctcctaaagctccctcttttttacacaaagtagataaaacatggcagacggtgaggatattcagccactcgtctgcgataatgggactggaatggtcaaggcagggtttgctggagatgatgctccaagagcagtatttccgagtattgttggtcgcccacgccacacaggtgtgatggttggcatggggcaaaaagatgcatatgttggtgatgaagctcaatccaaacgtggtattctaactttgaaatatccaattgaacatggtattgttagcaactgggatgatatggagaaaatctggcatcacacgttctacaacgaacttcgtgttgcaccagaggagcatcctgtactactcactgaagcacctcttaacccgaaggctaatcgcgaaaaaatgactcaaatcatgtttgagacatttaatgctccttctatgtatgtcgccattcaagccgttctgtccctttatgctagtggtcgtacaacaggtattgtcctggattctggtgatggtgttagccacactgtcccaatctatgagggatatgctttgccacatgctatcctccgtcttgatttagccggtcgtgacttgaccgatcacctaatgaaaatcttaacagagcgcggttactcgttcactactagtgctgaacgagaaattgtgagggatgtgaaggaaaaactctcctacattgcgcttgactttgagcaggaaatggacacgtcgaaaactagctcttctgttgagaagagctacgagttgcccgatggtcaagtgattaccatcggtgctgagcgtttccgatgccctgaagtccttttccaaccttcaatgattggaatggaagctgcaggcattcacgaaacgacttacaactcgatcatgaagtgcgacgtggatatcagaaaagatctgtacggaaatattgtactcagtggcggttcaactatgtttcctggaattgctgatagaatgagcaaggaaattactgcattggcacctagcagtatgaaaa

SEQ ID NO: 5402 - DNA, 587 bp, Artificial
  Synthetic
aacaaggaatccacatctagggttcgctttctttgcctctctcagctcaatatcctccctcctggagttatactaaagccagaagatggcagacgctgatgaggtgcagccccttgtctgtgacaatggaacaggaatggttaaggctgggtttggtggtgacgatgctcctcgtgcagtctttcctaacattgggggaagggccaggcatactggtgtcatggtaggcatggggcaaaaagatgcatatgtgggtgatgaggcacaatcgaaaagaggaatattgacactcaagtatcccatcgaacatggcatagttaccaattgggatgacatggagaagatatggcaccataccttctataatgagctccgagtgtgccctgaagagcaccccgtcctacttactgaggcccctatgaaacctaaagccaatcgtgagaagatgagccagatcatgtgcgagaccttcaatgtgcccgcgatgtatgtatctatccagacagtcttgtgcctttatgccagtggacgaactactggtatagtgctggattcacgagatggtgtgtctcacacggtccctatat

SEQ ID NO: 5403 - DNA, 908 bp, Artificial
  Synthetic
ctaaactctttttctctctacaatttcgaaggaagtagcatgagatggcagatggagaggatattcagccacttgtctgtcacaatggaacaggaatggtcaaggctgggtttgctggagatgatgctccacgagctgtattccctagtattgttggccggccccgccatactggtgtgatggtgggtatgggtcagaaagatgcctacgtgggagatgaagctcaatcaaaaagaggtattttaactcttaaatacccaattgagcatggaattgtcagcaactgggatgatatggagaagatctggcatcatactttctacaatgagcttcgtgttgcgcccgaggagcatccagtcctcttaactgaagcgcctcttaacccaaaggctaatcgtgaaaagatgacccagattatgtttgagacttttaataccccagctatgtatgttgctattcaggctgtcctctcactgtatgccagtggtcgtaccaccggtattgtgttggactctggtgatggtgtcagccacaccgtcccaatttatgaggggtatgccctcccacatgccattctccgtcttgacttggcaggccgtgacctcactgatagtttgatgaagatccttaccgagcgtggttacatgttcaccacctcagctgagcgggaaattgtcagggacgtgaaagaaaagcttgcttacatagctcttgactatgaacaggaactcgagactgcaaagaccagctcttctgtagagaagaactatgagctaccggatgggcaggtgatcaccattggtgctgagcgtttccgttgtcctgaggtccttttccaaccatcaatgattggaatggaagctgcaggaatccacgagactacatacaactctatcatgaagtgtgat

SEQ ID NO: 5404 - DNA, 796 bp, Artificial
  Synthetic
ggccggttttgctggtgatgaggcacccagggctgtctttcctagcattgtaggcaggccacgccacactggtgtcatggttggtatgggccagaaggatgcctatgtgggtgatgaagctcagtcgaaaagaggtatactgacattgaaatacccaatcgagcatggtattgtcaacaactgggatgacatggagaagatatggcaccacaccttctacaatgagctccgtgtggctcctgaagagcatcctgtattgctgaccgaggctcctatgaaccccaaggcaaacagagagaagatgacccagatcatgttcgagaccttcaactgcccagcgatgtacgttgccatccaggccgttctttcgttgtatgccagtggtcgaacaactggtattgtacttgactctggtgatggtgtaagtcacactgttccaatatacgaaggatttacactcccgcatgctattcttcgactcgatcttgctgggcgtgaccttaccgacaaccttatgaagattctcacagagaggggttactccttcaccacaactgctgagcgggaaattgttagagacataaaggagaagctcgcctatgttgctcttgattatgaacaggagcttgatactgccaggagtagctcctctattgagaagagctatgagctgcctgacggccaggtcatcaccatcggagcagaaaggttcaggtgcccggaggtgctcttccagccatcttttattggtatggaagctcctggcatccatgaagccacatacaactccatcatg

SEQ ID NO: 5405 - DNA, 758 bp, Artificial
  Synthetic
cggaggagcaccccgtcctcctcaccgaggctcctctcaaccccaaggccaatcgtgagaagatgacccagatcatgtttgagaccttcaacacccctgctatgtacgtcgccatccaggccgtcctctctctgtatgccagtggtcgtaccacaggtattgtgttggactctggtgatggtgtcagccacactgtccccatctatgaaggatatgctctcccccatgctatccttcgtctcgaccttgctgggcgtgatctcactgattacctcatgaagatcctgacggagcgtggttactcattcaccacaacggccgagcgggaaattgtgagggacatgaaggagaagctttcctacatcgccctggactatgaccaggaaatggagactgccaagaccagctcctccgtggagaagagctacgagcttcctgatggacaggttatcaccattggtgctgagcgtttccgctgccctgaggtcctcttccagccttccttcataggaatggaagctgcgggtatccatgagactacatacaactccatcatgaagtgcgacgtggatattaggaaggatctatatggcaacatcgttctcagtggtggtaccactatgttccctggcattgctgacaggatgagcaaggagatcactgccttggctcctagcagcatgaagatcaaggtggtcgcccctcctgaaaggaagtacagtgtctggattggaggatccatcttggcatctctcagc

SEQ ID NO: 5406 - DNA, 981 bp, Artificial
  Synthetic
cttcacccgctattcagtcaaacagcaaaaagggtttgatttcaatcaagtccttagaagatggctgaaggtgaggacattcaaccactcgttgttgacaatggaactggaatggttaaggctggctttgctggagacgatgctccaagggctgtatttcctagtatagttggtcgtcctagacaccaaggagtaatggtcgggatggggcaaaaagatgcctatgttggtgatgaagctcagtctaaaagaggtattctgactttgaaatatccgattgaacatggtattgtcagcaactgggatgacatggagaaaatttggcatcatacattttacaatgagcttcgtgttgctcccgaggagcatcctgttcttcttactgaggcaccacttaaccccaaggcaaaccgagagaaaatgacccagatcatgtttgagaccttcaatgtgccagccatgtatgttgcaatccaggccgttctttctctgtatgctagtggtcgtactactggtattgtgcttgattctggtgatggtgtgagccacactgtccccatctatgagggatatgcacttccccatgccatcttgaggttagatcttgctggtcgtgatcttactgattatctcatgaagattctcactgagagaggttatatgtttaccacatctgctgaacgggaaatcgttcgtgatgtgaaggagaagcttgcctatgtcgcattggattttgaacaggagcttgagacagcaaagagtagctcatcagttgagaagagctatgagcttcctgatggacaagtaattactattggtgctgagaggttccgttgccctgaagtcctcttccagccatcattgattggaatggaagcagcaggaattcatgaaacaacctataactcaatcatgaaatgtgatgtggacattaggaaggatttatatggaaatattgtactcagtggtggatcaactatg

SEQ ID NO: 5407 - DNA, 728 bp, Artificial
  Synthetic
tggtatcaacgcagagtggccattacggccgggggggtttcatttgaatttttcttgtttttgcatttggaactcatagccaaccgtggacaccactaatttactcctcctaaagctccctcttttttacacaaagtagataaaacatggcagacggtgaggatattcagccactcgtctgcgataatgggactggaatggtcaaggcagggtttgctggagatgatgctccaagagcagtatttccgagtattgttggtcgcccacgccacacaggtgtgatggttggcatggggcaaaaagatgcatatgttggtgatgaagctcaatccaaacgtggtattctaactttgaaatatccaattgaacatggtattgttagcaactgggatgatatggagaaaatctggcatcacacgttctacaacgaacttcgtgttgcaccagaggagcatcctgtactactcactgaagcacctcttaacccgaaggctaatcgcgaaaaaatgactcaaatcatgtttgagacatttaatgctccttctatgtatgtcgccattcaagccgttctgtccctttatgctagtggtcgtacaacaggtattgtcctcgattctggtgatggtgttagccacactgttccaatctatgagggatatgctttgccacatgctatccttcgtcttgatttagccggtcgtgacttgaccgatcacctaatgaaaatc

SEQ ID NO: 5408 - DNA, 625 bp, Artificial
  Synthetic
gcgtggacagggcgcaagggcggcggcggtcatcgcgcggcggcccggatctttaccgaaatccattctttctccgcgctaagaggcagccatgtcggaaaccgaggatgtccagccgctcgtctgcgacaatggatccggaatggtcaaggccggatttgccggagacgatgccccccgtgcggtgtttccaagcatcgtgggtcgcccacggcacactggggtcatggttggaatgggtcataaggatgcctatgttggagacgaggcccagtccaagcgtggaatcttgaccctaaagtacccgatcgagcatggcattgttaccaactgggacgatatggagaagatatggcaccataccttctacaatgagctccgtgtcgcccccgaggagcacccggttctcctcaccgaggcaccgctcaaccccaaggccaaccgcgagaagatgacgcagatcatgttcgagaccttcaacgttcccgcaatgtacgttgcgatccaggcggtgttgtcgctctacgccagcggtcggacaactggtattgtgctcgattctggtgatggtgttacgcacactgtgcctatctacgagggatatgctttgccgcatgccatttta

SEQ ID NO: 5409 - DNA, 559 bp, Artificial
  Synthetic
tttcgacctctttcttcccccttcaagctaaccctcgagatcctgggatcgcgcgagcttcttcttttgtctcttaccaacttttccatcagcttcatacattaatcagtcacaatggaggaagaagttgctgccctcgtcatcgacaatggttccggtatgtgcaaggccggtttcgccggtgatgacgctccccgagctgttttcccctccattgtcggaagaccccgtcaccatggtatcatgatcggtatgggtcagaaggactcctacgtcggtgatgaggctcagtccaagcgtggtatcttgacactgagataccccatcgagcacggtgtcgtcaccaactgggacgacatggagaagatctggcaccacaccttctacaatgagctgcgtgttgcccccgaggagcaccccgtcctgctcaccgaggcccccatcaaccccaagtccaaccgtgagaagatgacccagatcgtcttcgagaccttcaacgcccccgccttctatgtctctatccaggccgttctgtccctgtacgcttccggtcgtacca

SEQ ID NO: 5410 - DNA, 578 bp, Artificial
  Synthetic
tccacgaattcaggggagaaaaacttctcctccacaatctgctccctctctcaataaaggcaaggtataaattatggcgggcgctgacgacattcatccacttgtatgtgacaatggaactggaatggtgaacgctggatttgctggtgatgatgctccaagggctgtattccctagtattgtcggtaggcctaggcacacaggtgttatggttggaatgggtcagaaggatgcctatgttggggatgaggcacagtctaagagaggtattcttactttgaagtaccctatggagcatggaattgtgagcaactgggatgacatggaaaagatctggcatcataccttctacaacgaactgcgtgtggctcctgaagaacatcctgttctccttactgaagcccctctgaaccctaaagccaacagagagaacatgacgcaaatcatgtttgaaactttcaatgtccctgccatgtatgttggtattcaagctgtgctttccctttatgccagtggccgtaccacaggtattgtgctccactctggtgatggtgtcagccacactgtccccatctacg

SEQ ID NO: 5411 - DNA, 656 bp, Artificial
  Synthetic
agaaaagatcaaagaaatcaattctataccatggtcttttcttcggttccggccgtctatcttgatccacccaattggaaccagcagcaacagcaagctcaccacggtcagcttccaagtggcggcaacggcggcggcggcggcggcggcggaggtggagtggacgcgcaccaccaccaccaccaccaccaccaccagctgccgccgatgccgccgtatcacggcggcctcatggcgcctcggcctgacatggtagcagcggccgtcgcggcgagcggcggcggcggtggcggcggcggcccgaccggcggcacggcggtgcggccgggctcgatgacggaacgggctcggctggcgaagatcccgcagccggagccggggctcaagtgcccgcgctgcgagtccaccaacaccaagttctgctacttcaacaactactcgctctcgcagccgcgccacttctgcaagacgtgccgccgctactggacgcgcggcggagcgctccgcaacgtccccgtcggcggcgggtgccgccgcaacaagcgcaccaagtcgtccaagtcgtcctcgtcgacgtcggccgccggctcggcctccgccaccggcggcacgtcgtcgtccacatcgtcgaccgccacgggtggcagcagcagcgc

SEQ ID NO: 5412 - DNA, 620 bp, Artificial
  Synthetic
tcagtttttctccgctctgttcatagccagatcggtccatgggttattattattattacccggttcggttctcctcaaacccaaacccatacccggatgatcccaacccgacccgtcaagcatgatccctcctcctccaagaccaagctgcatattattcgccaacaacgagctaaagcttccaccaatctccatacccttcacgtcttggtcaccgatcggaaacccgtaaagcatccgggtcggatccaaatccggtttttgagaattacgtggatcaggatccggatccgggtttttcgtcttcttgttttggctactgttggaaggagaggaagcagaagaagaagaagaagtggatcgtttggttgcgttcttacgagaaccaccaccgacgggaacgttacggagggcgccgcctttagtccagtaacgacgacagcttttgcaaaagtgacgaggctgtgagagattgtagttgttgtagtaacagaatttagtgtttggtgagtcacaacgaggacactttaactgttcttgctctgcaaactgtggttgttgttgttgttgttgcttcgccatcatcgtctggtaatatgctgctggatcctgcatgctgc

SEQ ID NO: 5413 - DNA, 699 bp, Artificial
  Synthetic
gggaagaatcatatatcaggagagctcagcaaaaccaagtcagaggagaaagatcaaaatcaaatgatggaaggttcagaagatcctaagctttcatcagaatctgacaacaatccaaaaactcctaatattgatgaagattcacctgcaataaaaacatccaagactaaaaatgatccgaatgatgcatcaaattctcaggagaaacctcttaagaagccagataaaattcttccatgcccccgttgtaatagtatagataccaaattctgctactataacaattacaatgtcaaccagcctcgacatttctgcaagagctgccagagatattggactgctggtggtaccatgaggaatgtgcctgtcggagctggtcgtcgcaagaacaagaattctgcaccgcattgtcgtcacatcacaatccctgaagccctccaagcggaaagaatcgatcctccaaatggatttcatcatccaacgttcaaacccaatggtattgtactatcctttgggcctgactcacccctttctgaatctatggcttctattcttagcctttcagagaaaaaggtaccaaacgggattcataacggtttctatgggcctgaaaacaagaactcgtttcgcgaaggtggagaaaatggggatgactgttgtggtggatcttcagtcactacatcaacttcaatggtcgat

SEQ ID NO: 5414 - DNA, 405 bp, Artificial
  Synthetic
ccctcgacccacgcgttcgagataaacctctctgctttaaaagaatctgctatactcagagttgcaggttttaaagttggcaaatgtgaaatctcgccggaaatttcaccggaaaacgttaatataagttgctacattcatttttacagtattttttgagaaatgcaagatatacatccgatcggggcggtggaggacggttttttggtggtggaggagacaggaggttaaggcctaaccatcaccaaaaccagcaagttttaaagtgtccacgttgcgattctccaaacaccaaattctgttactataacaactacaatctctctcagccgagacacttttgcaaaagttgccggagatactggactaaaggcggcgtccttcgtaacgtccccgtcggtggtg

SEQ ID NO: 5415 - DNA, 353 bp, Artificial
  Synthetic
gtgagcagcatgttggcaaagggcttcatcttgggcaaggatgcagttaacaaagcaaagacatttgatgagaaacaccagttcatatccactgcctcagccaaagttgcttcactagaccaaaaaattggacttagtgagaaaatcaatatgggaacaactattgtgaatgacaaagtgaaagaaatggaccagaagttccaagttactgaaaagacaaaatcagctttagcagctgctgagcagacagttagcactgctggatctgccatcatgaagaacagatatgttttgacaggggcatcttgggttactggtgctttcaataaggtcaccaaggctgcaggggaagt

SEQ ID NO: 5416 - DNA, 679 bp, Artificial
  Synthetic
gctgaacaggatcgcctctcattctctctcttcccctggagatctgttgattccccccatccagccaacatgcgtgagatattgcacatccagggtgggcagtgtggcaaccagattggtgccaagttctgggaggtagtatgtgcagagcacggcattgatcccactggcaagtacacagggaactcagatctgcagctggagagggtgattttgtactacaacgaggctagtgggggtcgctatgttcctcgagcagtgctcatggatctggagcctggcaccatggacagtgtgcgcactggcccctttggccagctcttcccgccctgataacttcgtctttggccagagttggggctggcaacaattgggctaagggcccttacactgagggtgccgagcttattgattctgtccttgatgttgtccgcaaggaggcagagaattctgactgtcttcaagggtttcaagtatgccactctctaggtggaggcactggatcagggatgggcactttgctgatatcaaagatcaggcaagagtaccctgaccggatgatgcttacattttctgtcttcccctctcccaaagtgtcggacacggttgtggagccatacaatgctaccttgtccgtccaccagcttgtggagaatgcagatgagtgtatggtgcttga

SEQ ID NO: 5417 - DNA, 128 bp, Artificial
  Synthetic
tagccctatcaccatgagggagtgcatctcagtccacattgggcaggccggtatccaggtcggcaatgcctgctgggaactctactgcctcgagcatggcatccagccggatgggcagatgccaagcg

SEQ ID NO: 5418 - DNA, 190 bp, Artificial
  Synthetic
aaggtttctgaggggcgtcttaataaacgcctacacagaagcctctctctctctctctattgtatcttgtaaggatgagggagtgcatctcgatccatatagggcaggctggtattcaggttggcaatgcctgttgggagctctactgccttgaacatggcatcaagcccgatggtcagatgcctagtga

SEQ ID NO: 5419 - DNA, 701 bp, Artificial
  Synthetic
gtcggcaaagataaaaccaagacccccccctagtagtagtactactgcccatcactctccctcctttccttgttgtttgtagtgcttgtgttggggcaccataaaccctaggaatttgctgagccttgtgggaagcaaagatgagggagataatcagtgtgcacatagggcaggccggaatccaggtggggaatgcatgctgggagctgtactgcctcgaacacgggatccagcctgatggtcgtatgcccagtgacaagtccgtgggggttgcggatgacgcgttcaacacgttcttcagtgagacgggaggtgggaagcacgtgcccagggccatctttgtggatctggagcccactgtgattgatgaagtccgcactgggacttaccgccagctctttcacccggagcagctcatctccggcaaggaggatgctgccaacaactttgcccggggccattacacggtgggcaaagagattgttgatctatgcttggaccgagtgaggaagctggcggacaatttgtactggcttgcaaggcttcttggtcttcaatgctgtgggaggcggcactggatccggtcttggttccctcttactagaacgcctctctgttgactatggcaaaaaatcgaagcttggattcacaatctatccctcccctcaagtgtcgactgcggttgtggagccatataacag

SEQ ID NO: 5420 - DNA, 609 bp, Artificial
  Synthetic
cgcagagaaaggcgtcttcgtactcgcctctctccgcgcctccgcgcttttcctcctcctctcccctctctcccttctccgccgccgtcgcagcatcaacccaatccgccgccatgagggagtgcatctcgatccacatcggccaggccggtatccaggtcgggaacgcgtgctgggagctctactgcctcgagcatggcatccaggctgatggtcagatgcccagtgacaggactgttggtggaggtgatgatgctttcaacaccttcttcagtgagactggtgctgggaagcatgttccccgtgctgtatttgttgatcttgagcctactgtgattgatgaggtgaggactggttgctaccgccagctcttccaccctgagcagctcatcaatggcaaggaggatgcagctaacaactttgcccgtggtcactacaccattggcaaggagattgttgatctgtgccttgaccgcatcaggaagcttgctgacaactgcactggtctccaaggtttccttgtgttcaacgctgttggaggtggaacgggctctggtcttggttcccttctcctggagcgcctttctgtggactatggcaagaagtcca

SEQ ID NO: 5421 - DNA, 1101 bp, Artificial
  Synthetic
cccccgctaccacaccgcagagaaaggcggggtcgtactcgcctctctccgcgccctcctccgccgccgctcgccgccgttcgtctccgccgccaccgccgccgccatgagggagtgcatctcgatccacatcgggcaggccggtatccaggtcgggaacgcgtgctgggagctctattgcctcgagcatggcatccagcctgatggacagatgcctggtgacaagaccgttgggggaggtgatgatgcttttaacaccttcttcagtgagactggtgctgggaagcatgtcccccgtgctgtcttcgtcgatcttgagcctaccgtgattgatgaggtgaggactggtgactaccgccagctcttccaccctgagcagctcatcagtggcaaggaggatgcagccaacaactttgcccgtggtcactacaccattggcaaggagattgttgatctgtgccttgaccgcatcaggaagcttgccgacaactgcactggtctccagggcttccttgtgttcaacgctgttggaggaggaacgggctccggtctcggttcccttctccttgagcgtctctctgtggactatggcaagaagtccaagctcgggttcaccgtgtacccgtcccctcaggtctccacctctgtggttgagccatacaacagtgtcctctccacccactccctccttgagcacaccgatgtcgctgtcctgctcgacaatgaggccatctatgacatctgccgccgctccctcgacattgagcgcccaacctacaccaacctcaacaggcttgtgtcccaggtcatctcctcactgactgcctccctgaggttcgatggtgctctgaatgtggatgtcaacgagttccagaccaacctggtgccctacccgaggatccacttcatgctttcctcctacgccccggtgatctcggccgagaaggcctaccacgagcagctctccgtggcggagatcaccaacagcgccttcgagccgtcctccatgatggccaagtgcgacccgcgccacggcaagtacatggcgtgctgcctgatgtaccgcggcgacgtggtccccaaggacgtgaacgccgcggt

SEQ ID NO: 5422 - DNA, 590 bp, Artificial
  Synthetic
cccacgcgtccgcccacgcgggcgcccacgcgtccgcccacgcgtccgctgtcttcctctgaaccctgaaccaatcccgaactctgaactctgaaggctgcagagacaggcagagagatatgagggagataataagcatccacatagggcaggcgggcatccaggtggggaattcttgctgggaactatactgcctcgagcatggcatccagccggacggcctcatgcccagcgacacaactcctggaattgcaagggatgcattcaacacgttcttcagcgagacgagttcaggcaagcacgtcccaagggcgttgttcgtcgacctggagcccacggtgattgatgaggtgaagaccgggccataccgccagctcttccacccagagcagctcatctcctacaaggaagacgctgctaacaactttgctcgtgggcactacacagttggaagagaggtggtagatctttgccttgatcgactaagaaaactggcagataactgcactggtctccaaggttttctggttttcaatgctgttggtggaggaaccggctctggacttggttcattacttttagagcgccta

SEQ ID NO: 5423 - DNA, 709 bp, Artificial
  Synthetic
gaattcatccttcttctttctctggtctcaccgtctcagatcctctctttttctccatcgaaatacccaaaaaatgagggaatgcatctcaatccacattggccaagcagggatccaagttggaaacgcctgttgggaactttattgccttgaatatggaatacagcctgatggacaaatgccgagtgacaaaactgtcggcggaggagacgatgctttcaatacgtttttcagtgaaacgggtgcaggaaaacacgtacctcgtgccattttcgtagatcttgaacctactgttatcgatgaagtacgaactggtacttaccgtcaattgttccatcctgaacaacttattagcggcaaagaagatgcagctaataactttgctagaggccattacacaattgggaaggagattgtggatctatgccttgataggatcagaaagcttgccgataattgcactgggctacaagggtttttggtatttcatgctgttggtggtggtacaggatctggtcttggatctctacttcttgagagactctctgttgattatggaaagaaatcgaaattggggtttactgtttacccgtctccacaggtttcaacttctgtggttgaaccctacaacagtgttttgtctactcattctcttttggagcacactgatgtatctgtactacttgataatgaagctatttatgatatc

SEQ ID NO: 5424 - DNA, 1001 bp, Artificial
  Synthetic
  misc_feature (861)..(861): The residue at this position can be any nucleotide.
cccccccccccggtccctacatttatctgggtcttcaatctttcactcttctctgccgcctctcatttctgagatctacgcatttttcttcaaatttctgcatcttcttttccagatctcagtttaaaaaatgcgtgaaatccttcacattcaaggtggacaatgcggcaaccaaatcggtgccaagttctgggaagttgtttgtgccgaacacggcattgattccaccggccgttacaacggcgattcagatctccagcttgagagaatcaatgtctattacaatgaggctacctgtggaaggtttgttcctagggctgttcttatggatctggaacctggtaccatggacagtatcagatctggtccgtacggtcagatctttaggcctgataacttcgtgtttggtcagtctggtgctggcaacaattgggctaaaggacattacactgaaggcgctgaattgattgatgctgtccttgatgttgttcgtaaggaagctgaaaattgtgactgccttcaaggatttcaagtgtgccactcattgggtggaggtacgggatctggaatgggaacccttctgatatcaaagatcagagaagaatatcccgatagaatgatgcttacgttctcagttttcccgtctcctaaggtttctgacactgttgttgagccttataatgctactttgtcggtgcatcagttggttgagaatgcggacgaatgtatggtccttgataatgaagctttgtatgacatctgcttcagaaccctcaagcttacaacccccagctttggagatttgaatcatttgatatcagctacaatgtctggtgtcacatgttgtttgcgtttccctgngcagttgaactctgatcttagaaaactagctgtgaatctgatcccgttccctaggctccatttcttcatggttggttttgcaccactgacttcacgtggttctcagcaatacagggccttgacagttcctgaacttaccc

SEQ ID NO: 5425 - DNA, 674 bp, Artificial
  Synthetic
gcgtcctcaacacgcgaattgcagagcggaatctggaacctcgaactctcgacctcggacctttcagagcagaagaagaaaaatgagggagataatcagcatacacatcgggcaggccgggatccaggtcggcaatgcctgctgggagctctactgcctcgagcatggtatccagcccgatggccgcatgcctagtgataaatcggtgggggtggcggatgatgctttcaacacgttcttcagtgagacgggggcaggaaagcatgtccctcgggccatctttgtggatctggagccgacagtgattgacgaggtccgcacaggcacctacaggcagctcttccacccggagcaactcatctccggcaaggaggatgctgccaacaactttgcccgtggccattacaccgtgggcaaagagattgtggatctgtgcctggatcgagtgaggaagcttgcagataattgcacgggtctgcagggtttccttgtgttcaatgcggtgggaggcggtaccggatccggtcttggctccctcttgcttgaacgactctctgttgactacggcaagaaatcaaagctcggtttcaccatctacccttctcctcaagtctccactgcagtggtggagccatacaacagcgtcctctccactcattccctcctggagcaca

SEQ ID NO: 5426 - DNA, 1330 bp, Artificial
  Synthetic
gggcggacgcgtgggctgagaaccacattcacaattcgaatttcgaaaactcatctctttctgtttaaacggcgtcttgataaacgccgctttttctcctctttgaaatttgaatttttagggtttcggtgaaaatgagagagtgcatttcgatccacattggtcaggctggtattcaggtcggaaatgcctgctgggaactttactgcctggagcacggcattcagcctgatggccagatgccaggtgacaagactgttggagggggtgatgatgcattcaacaccttcttcagtgaaactggagctggaaagcatgtccctcgggctgtctttgtagatcttgagcccactgtcattgatgaagtgaggacaggaacataccgacagctctttcaccctgaacagctcataagtggcaaggaagatgcagccaataactttgcccgtggtcactataccattgggaaagagattgttgatctttgcttggatcgcatccgaaagcttgcagacaactgtactggtcttcaagggttcctggttttcaatgctgttggtggtggtactggttcaggtctggggtcgcttcttctggagcgtctctctgttgactacggaaagaagtcaaaacttggtttcacaatttacccttcaccacaggtctcaacttctgttgttgagccttacaacagtgtcctctcaactcattccctccttgagcacactgatgtttccatccttctggacaacgaagccatttatgacatttgcaggcgctcactggacattgagcgccctacttacaccaaccttaaccgccttatctcacaggttatctcctcactcacagcatctttgaggtttgatggtgctttgaatgttgatgtgaatgaattccagaccaatcttgtgccatatcccaggatccattttatgctttcctcatatgctcctgtcatttctgctgagaaggcctaccatgagcagctctcagttgcagagatcaccaacagtgcttttgagccatcttctatgatggttaagtgtgaccctcgtcatggcaagtacatggcttgctgtctcatgttccgtggtgatgtggtgcccaaggatgttaatgctgctgtggccaccatcaagactaagcgcaccatccaatttgttgactggtgccctactggattcaagtgtggtattaactatcagccaccaactgttgttcctggtggcgaccttgctaaggtgcagagggctgtttgcatgatttccaactcaaccagtgttgctgaggtcttctcacgcattgaccataagtttgatctgatgta

SEQ ID NO: 5427 - DNA, 633 bp, Artificial
  Synthetic
cccacgcgtccgaaaaccttcactttcctcactcctaaaaaacaaaagcacagaaaaattcaaaatcacttaaaaaatgcgtgagattttgcacattcaaggaggccaatgcgggaaccaaatcggagccaagttttgggaagttatctgtgccgaacatggcattgattccactggaaggtatgcaggagacaatgatcttcaactggagcggttgaatgtttactataacgaagcgagttgtggaaggtttgttccacgcgctgtcctcatggatttggagcctggaactatggatagtgtcagatctgggccatatggtcagattttccggcccgataattttgtttttggacagtctggtgctggtaataactgggccaagggtcactacactgagggagccgagcttattgattcggttctcgatgttgtgaggaaggaggctgaaaactgtgactgtctacaaggtttccaggtttgtcactctttgggaggtggaactggatcaggaatgggaactctccttatttcaaagatcagggaggagtacccagatagaatgatgcttaccttctctgttttcccttcccccaaggtttcagacacagttgttgagccctataatgctac

SEQ ID NO: 5428 - DNA, 411 bp, Artificial
  Synthetic
cggacgcgtggggtcactcccatctttcatattccttcaccatctctctctctctcgatcttgtgaaccactacacacactaacacaatgagagagatccttcacattcaaggtggtcaatgcggtaaccagattggttccaagttctgggaagtcatctgcgacgagcacggcatcgattccaccggacgttacagtggagacactgcagatctccagcttgaacgtatcaatgtctattacaatgaagcttcaggtggaagatacgttcctcgtgctgttcttatggatcttgagcctggtactatggatagtatcagatccggaccgtttggtcagatcttccgtcctgataactttgtctttggtcagtctggtgctggtaataattgggctaaaggtcattacact

SEQ ID NO: 5429 - DNA, 1120 bp, Artificial
  Synthetic
aaatatctcaaatccccacccctctaaattcacacattctgtttctctcttaccctagttccatttgccatttcagtttttcaaattcctccaaaaaagagagaaaatgagagaaatcttacacattcaaggcggccaatgcggtaaccaaatcggttccaaattctgggaagttatctgtgatgagcacggcgttgatcctacaggccgttacaaaggcaccgccgctgagtcggatcttcaacttgaacgtattaatgtgtatttcaatgaagcttctggtggacgttatgttcctagggctgttcttatggatctggagcctggtactatggatagtatcagatctggtccgtacggacagatctttaggcctgataacttcgtttttggtcagtccggtgctggtaataattgggcgaaaggtcattacactgaaggagcggagttgattgatgctgttctcgatgttgttcgtaaagaggctgagaattgtgattgcttgcaaggatttcaggtttgtcactcactcggtggtgggactggatctggcatgggaactctattgatttccaagataagggaggagtatccagacagaatgatgctcacattctctgttttcccatctccaaaggtgtctgacactgttgtagaaccatacaatgctacactgtctgtgcaccaactggtggagaacgctgatgagtgtatggtccttgataatgaagccttatatgatatttgtttcaggactttgaagctcactactccaagttttggtgacttgaaccatttgatctctgcaaccatgagtggtgttacttgctgtttgagattccctggtcagctgaactcagacctgagaaagttggctgtgaatttaattcccttcccacgtcttcatttcttcatggtgggctttgcaccattgacctctcgcggatcgcagcaatacatttccctcacagtgccagagcttactcaacaaatgtgggatgcaaagaatatgatgtgtgctgcagatccccgtcatggacgctacctgacagcttctgcaatgtttaggggaaagatgagcacaaaggaagtggacgaacaaatgatcaatgtgcagaac

SEQ ID NO: 5430 - DNA, 1025 bp, Artificial
  Synthetic
aactactctctcgatcgagtgagtagttctacttctctctcgatcaatttctagatttcttcagttgccttcccgattttaaagaaaaaatgagagaaatccttcacattcaaggtggacaatgtggaaaccagatcggatcaaagttctgggaagttgtatgtgatgaacacggaattgatcctactggacgctatgttggaacctcagatctgcagttggaacgtgttaatgtgtattacaatgaagcgtcatgtgggaggtttgttccccgtgcagtgctcatggatcttgagcctggcacgatggacagcgtgaggactggtccttatggccagatctttaggcctgataactttgttttcggtcaatccggtgctggaaacaattgggctaaggggcattacactgagggtgctgagcttattgattctgttttagatgttgtcaggaaggaggctgagaattgcgactgtcttcaaggattccaggtgtgtcactcacttggtggaggaacaggttctggaatgggaaccttgctgatctcaaagatcagggaggaataccctgaccgcatgatgctcacattctctgtgttcccatcaccgaaggtttcagatacagtggttgagccatataatgctaccctttcagtgcatcagcttgttgaaaatgctgatgagtgtatggttcttgacaatgaagctttatatgacatctgtttcaggactctcaagcttaccacacccagctttggagatttgaaccacttgatttctgctactatgagtggggtcacttgctgcctcaggttcccgggtcaattgaactctgatcttcggaagctagctgttaacctgatccccttccctcgtttacacttcttcatggttggatttgctcctctcacttctcgtggttcacagcaataccgtgcactaacagtcccggagctgactcagcaaatgtgggatgccaagaacatgatgtgtgctgctgatccacgccatggtcgttacctcact

SEQ ID NO: 5431 - DNA, 359 bp, Artificial
  Synthetic
cccacgcgtccgatctcactctcaccgccttcatttcctcgatctccgtcttcctccttctccgtctgtcgcagagcatcgctcgaattagggtttctgctgagagaagatgagggaaatcattagcattcatatcggacaagccgggatccaagtcggaaattcctgctgggagctttactgtctcgaacatggaatccagcccgacggaatgatgccgagtgatactacagttggtgttgcacacgatgcgttcaatactttctttagcgagactggtgcagggaagcatgttcctagggctgtcttcgttgatcttgagcctactgttatcgacgaagttcgtactggtacttacc

SEQ ID NO: 5432 - DNA, 973 bp, Artificial
  Synthetic
cgttatttattatgcatcttgactacccctcgaccacgcgtccgcccacgcgtccgcccacgcgtccgcccacgcgtccgaaaagaggctggttgttcattaggtttttattgtgaagagaattattgaaattggggacaatgagagaaataataagcatacacatagggcaagctgggattcaggtgggaaattcatgttgggagctctattgccttgaacatgacatacaccctgatggcatgatgcctagtgacaactcccctggtgtaggacatgatgctttcaataccttctttagtgaaaccagtgcagggaagcatgtcccaagagctatttttgtcgatctcgaacccactgttattgatgaggtgagaactgggacttatcgccagcttttccatcctgagcagctcatttcaggaaaggaagatgctgcaaataattttgcgagagggcattatacagttgggaaggagattgtcgatctatgccttgatcgggtaaggaaattggctgacaattgcacgggtttgcaagggtttttggtgtttaatgccgttggtggtggtactggttctggattggggtcattgttgctggaacgtctatctgtggattatggaaaaaagtctaagcttggatttactatctatccttctccccaggtatctactgctgttgttgagccttataacagtgttctttcaactcattcccttcttgaacacaccgatgttgttgtcatgttggacaatgaagccatttatgatatctgtaggagatccctagacattgagaggcctacatataccaatttgaatagactgatctctcaaatcatttcatccttgaccacttcattacggtttgatggagccattaatgtggatattactgagttccagacaaacctggtaccatatcctcgcatccactttatgctttcatcctatgccccagtgatctcagc

SEQ ID NO: 5433 - DNA, 583 bp, Artificial
  Synthetic
ggcagggcagggttttcggacgggcgtcggcacacacgccggaacgaagccttagatctcttttcttctctccctctccgatcaatctctagccaagatgagggaatgcatctcgatccacatcggccaggctggaatccaggtcggcaatgcttgctgggagctctactgcctcgagcacggcatccagccggatgggcagatgcccagcgacaagactgtgggcggcggcgacgatgctttcaacaccttctttagcgagacgggtgccggcaagcacgtcccccgcgccgtgttcgtggatcttgagcccactgtcatcgatgaggttcgcactgggacttacaggcagctcttccacccggagcagctcatcagtggcaaggaagatgccgcgaataacttcgcccgtggtcactataccattggcaaggagatcgtggacctttgcctcgatcgcatcaggaagctggccgataactgcactggactgcagggattcctggtcttccacgctgtcggtggtggaacaggatccggcctgggctcgctgctgctcgagcgcctgtcggtcgactacgga

SEQ ID NO: 5434 - DNA, 669 bp, Artificial
  Synthetic
ggttggggtttggaatcgagggcgtcttcgcaaacgctctagggtttcatcgatcaagctctagattctcgtcgattgtctcgcgccgctccatccacgatgagggaatgcatctcgatccacatcggccaggccgggatccaggtcgggaacgcttgctgggagctctactgcctcgagcatggcatccagcccgatgggcaaatgcccagtgacaagacggtcggaggaggagacgatgcgttcaacaccttctttagcgagactggcgctgggaagcacgtcccccgtgccgtcttcttggatctggaacccaccgtcatcgacgaggtccggactgggacctatcgccagctcttccaccctgagcagctcatcagcggaaaagaagacgctgctaacaactttgctcgcggccactataccatcgggaaggagatcgtggacctttgccttgatcgcatcaggaagttggcggacaattgtaccggcttgcaaggcttcctcgtcttccatgctgtgggcggtggcaccggctcgggtcttggttccttactgctagagaggctgtccgtggactacgggaagaagtccaagctcggcttcactgtctatccctctccccaggtgtcgacgtccgttgtggagccctacaacagtgtcctctcc

SEQ ID NO: 5435 - DNA, 536 bp, Artificial
  Synthetic
atttgaggaggctgttcttcccggctgtgaaggcgctgcttctcaaaggcaatcgaagatgcgtgagattctccacatccagggtggacaatgcggcaaccagatcggtgccaagttctgggaggtgatctgcgacgagcacgggatcgatcccaccgggaactaccacggtgactcggatctccagctcgagaggatcaatgtctactacaatgaggccactggtgggcgcttcgttccccgcgccgtgctcatggatctggagccgggcaccatggacagcgtgagatctggggtttttgggcagatcttccggccggataacttcgtgtttggtcaaaccggcgctggcaacaactgggccaaggggcattacactgaaggggccgagctcatcgattccgtgctggatgtggtgaggaaggaagccgagagctgtgactgcctccaaggtttccaagtgtgccattctcttggaggtggtaccgggtctggaatgggtacactgctcatctccaagattcgagaagagtacc

SEQ ID NO: 5436 - DNA, 519 bp, Artificial
  Synthetic
gtcaagccggttgccagattggtaactcgtgctgggaactttactgcctggaacacggtatccagcccgatggatacctcgaccccgaccgaaagacgggatcccgggaggagggattctccaccttcttctccgagactggctccggcaagtacgtgccccgaaccatctacgtcgatctcgagcccaatgtggtcgatgaggtgcgaaccggaaagtacaagaacctgttccaccccgagcaactcatcactggcaaggaggacgccgctaacaactacgcccgaggtcactacaccgttggaaaggagctgatcgaccaggtcatggaccgagtccgacgagtcgccgacaactgtaacggtctccagggcttcctcttcacccactctttcggtggaggaaccggttccggtttcggagctctgctgcttgagcgactctcggtcgacttccccaagaagtccaagctcgagtttgccgtctaccctgccccccaagtctccacctccgttgtcg

SEQ ID NO: 5437 - DNA, 661 bp, Artificial
  Synthetic
cccacgcgtccgggcgtcttcgtactcgcctctctccgcgccctcctccgccgccgctcgccgccgttcgtctccgccgccaccgccgccgccatgagggagtgcatctcgatccacatcgggcaggccggtatccaggtcgggaacgcgtgctgggagctctattgcctcgagcatggcatccagcctgatggacagatgcccggtgacaagaccgttgggggaggtgatgatgcttttaacaccttcttcagtgagactggtgctgggaagcatgtcccccgtgctgtcttcgtcgatcttgagcctaccgtgattgatgaggtgaggactggtgactaccgccagctcttccaccctgagcagctcatcagtggcaaggaggatgcagccaacaactttgcccgtggtcactacaccattggcaaggagattgttgatctgtgccttgaccgcatcaggaagcttgccgacaactgcactggtctccagggcttccttgtgttcaacgctgttggaggaggaacgggctccggtctcggttcccttctccttgagcgtctctctgtggactatggcaagaagtccaagctcgggttcaccgtgtacccgtcccctcaggtctccacctctgtggttgagccatacaacagtgtcctct

SEQ ID NO: 5438 - DNA, 558 bp, Artificial
  Synthetic
agatgtcatatagagcttcattgtcaagtaccatgcactcatcggcattctcaacaagctgatggacagatagtgtggcattgtaaggttccaccacggtatcagaaacctttggtgaggggaaaactgagaatgtcaacatcatcctgtccgggtactcctccctgatctttgagatgagcagggtacccataccagaaccagttcctcctcctagagagtggcagacttgaaatccttggaggcagtcgcagttctcggcctccttgcggacgacgtcgaggacggagtcgatgagctcggcgccctcggtgtagtggcccttggcccagttgttgccggcgccggactggccgaagacgaagttgtcggggcggaagatctggccgaagggaccggagcgcaccgagtccatggtgcccggctcgaggtccatgagcacggcgcgcggaacgaacctgccgccgctggcctcgttgtagtagacgttgatccgctcgagctggaggtcggagtcgcccgagtacttgccggtgtggtcgatcccgtgctcgtcgc

SEQ ID NO: 5439 - DNA, 532 bp, Artificial
  Synthetic
gaattcaggtgcatccctctctctctctctctctgaaatctcttgttcgcttctcaaaccctagaaacaaaatggggaatgagagagattcttcatatccagggaggacaatgtggtaatcagatcggagctaagttttgggaagtagtctgtgctgagcatggaattgatcaaactggaagatatgaaggcgattcagagcttcaattggagagaatcaatgtctattacaacgaagcaagttgtggtagatatgtaccaagagctgtactcatggatcttgaacctggtactatggattcacttagatctggtccctttggtcagatcttcagacctgataacttcgtctttggtcaatctggtgctggtaacaactgggctaaaggtcattacacagaaggagctgagttgattgattctgttcttgatgttgtcagaaaggaagcggaaaacagtgattgtttacaaggtttccaagtatgtcactctttggggggaggaactggttctggaatgggaactctattga

SEQ ID NO: 5440 - DNA, 548 bp, Artificial
  Synthetic
actacgacgagcagctcccggagaagaagcggcgcctcacgccggagcaggtgcatctgctggagaggagcttcgaggaggagaacaagctggagccggagcggaagacggagctggcgcggaagctagggctgcagccgcggcaggtcgccgtgtggttccagaaccgccgcgcgcgctggaagaccaagcagctcgagcgcgacttcgaccgcctcaaggcgtcgttcgacgccctccgcgccgaccacgacgccctcctccaggacaaccaccgcctccactctcaggtcatgtcgttgaccgagaagctgcaagagaaggagacgacgaccgagggcagcgccggcgcggccgttgacgtcccgggcttgcctgcggcggccgacgtgaaggtcgccgtcccggacgccgaggaaccggcgctggaggaggcggcggcggcgttcgaggagcagcaggagcagcaggtgaaggccgaggacaggctgagcacgggcagcggcgggagcgcggtggtggacacggacgcgcaactggtggtcggg

SEQ ID NO: 5441 - DNA, 500 bp, Artificial
  Synthetic
gcagcatggaatccaattcgtttttcttcgatccatctgcttcacacggcaacagcatgttcttccttgggaatctcaatcccgtcgtccaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggttacttccctgaccgaaaagcttcag

SEQ ID NO: 5442 - DNA, 546 bp, Artificial
  Synthetic
taattgtactgttctgatcaagccatggccaaaaaccagaatggtcatccattgcacagaacatgttactgatactattctcttctttaaccatactctgtcctgaagatgagttttgaaagaactgcattgttgtagtagttgtcgttgcggtggctggcgacggtgggaagaagtgtcgaccaactgtctgtggtggcggtgggtggccaccggttaatgtactgtcgtttgatggcggcgcagttgagatatctagtctgagattatctgaactgttatcacttctgttactgcaagatccttcagtttctttgtttagatttattgattctgtttgttctctgttttttaatcccattatctcagcttggagtttctgattatgagtttgaagaagatcattttcagctttaagtgtatcaaactgtcgtttaagagtatcataatctttctctagctgctttgtttcccaacgagctcttcgattttgaaaccaaatcccgatctgtcttggttgcaaacctaaggcacgagctagctgca

SEQ ID NO: 5443 - DNA, 663 bp, Artificial
  Synthetic
ttgaagaaaatcatctctttgtattagtgaatgtctgaatgactttagggacaaattttaaatctattcagacaaagagaaacagatcaaacgaaacaaaacagagacaagactatatatattggaatcttgtctgcgtcgaaacagaatcagacccatgagggtgatgaagatccatgtccattgctaacaaagcaagcgtaaagctcgtcgaataccaccacttgatcatcatgatcttcatcacaagaaccaagattagaattatcaacaggagaatcttgatttgtgaacagagcaagctgattccttgctctcttcagctcatcttggagaaactgcacttgatgctctaactttgccttgtcggagagagctgcttcgtgcttggactgaagagtgcagtgttggacctcaagagactgagtcttgaacctggctcgcttgttttggaaccagacagcgacttgtctttgaggtagaccaagctggttcgacagttgaagtttcagatctggctcaagcttcttggtcatagtgaagcacttctccagttgtctaacttgatcttgtgttagcctcttcttcttgtttttaccctgactctgagaattctccatttttctcttcttttttggtttttcttttggtcggacgcgtggg

SEQ ID NO: 5444 - DNA, 555 bp, Artificial
  Synthetic
acaacaaaaagaggctaaatcaagaacaagtcaagaggttagaggaaagttttgattcaactaagaagcttgagccagagcaaaaaatccaacttgctaaagagttaggtgttcctccgcgacaaattgctatctggtaccagaacagacgagctagatggaagaaccagagcctcgagctggactacaatgctcttcagcttcagcttgacactgcattagctgagaagaggaagattgagaaagaaaacgaacgtcttcgaggcgagttgaagaaggtaaacgggatgttagttgcttgtaaaaaagcacaaggacatgaagaaacacaaggatttgttcctttaaatgcaactaatcccatttctagtggttgtgaggaaggagtagtgagttcaaactaccaagaagatgtgagttgtttattgataaaaaataatagtgactctaatttgcaatttgatgagctttatgcttgcttgatgggtgcagaagaaggatcaaattgtcgtttaagttggcaaaatggaaaagatctttgggtgtggaaaagtt

SEQ ID NO: 5445 - DNA, 66 bp, Artificial; identical to SEQ ID NO: 4168
  Synthetic

SEQ ID NO: 5446 - DNA, 718 bp, Artificial; identical to SEQ ID NO: 4808
  Synthetic

SEQ ID NO: 5447 - DNA, 691 bp, Artificial; identical to SEQ ID NO: 4811
  Synthetic

SEQ ID NO: 5448 - DNA, 433 bp, Artificial
  Synthetic
aaaataattttttttaattaaaaaaatggcttctaacaaggttttctctactcttgctattttccttacttttaacctaatttttttcacatttgtttctggttgtggaacttgtcctaaaccaaaaccgccaccaaaacctaagccttcttgtcctctaccccatccaccccatccaccccatcatcaaagggtaagtgcccaaaggacacacttaagctaaaagtgtgtgccagcttattgaatgacttagtgcaccttggtataggaagtgatccagccaagactccatgttgttctctaattcatggacttgctgatcttgatgctgctgtttgcctttgcactgcaattaaagccaatttattgggaattaacctcaacgtacctctttccctcagtttgttgctcaacaattgtggaaagtatgttc

SEQ ID NO: 5449 - DNA, 258 bp, Artificial
  Synthetic
cccacgcgtccgcggttttcaaaggatacagaatcaagggataacgatccttggagatttggttcttaaagacaagatctttgtctatgatctggtcggtcagagaatcggatgggcaaactacgactgttcgacgtcggtaaatgtctcagcgactagcagcagcggaagaagcgaatatgtgaacgcaggacagtttagtgagaatgctgcagcaccgcagaagatatctttggacattgttggaaacactctaat

SEQ ID NO: 5450 - DNA, 624 bp, Artificial
  Synthetic
atactctctctctctctcactcacacacacacacacacacacacagtctctctctctctctctctctctctctgaccttgcggagtttaggagtggagtgcaaccccccggaagtcccagttggctgcggcgccctctctctcagggaatccttcgcagatgtgtgttgaaggaatggaatattctccggaacaacaacaggaggaggaggaggaggaggacccgagcgacctcgagacagacatcgaggagcttgagaagcggatatggagggaccgcgtccgtctccgccgcttgaaggagcggcggaagtctggtagcagcccgaatccgaggccagagcactcgcaacagcaaggccggcggaagaaaatggcccgggctcaagatggaatactcaagcactttctgaagatgatggaggtatgcaaagcacaagcgtttgtgtacggaatcataccagaaaaaggaaaaccgacaagcgggtcctccgacaacatccgagcttggtggaaagaaaaggtccgattcgatcggaacggcccggcggcgattgccgcctacaacaaagagaacggggttccaatttccgccattgagaattcagctatggccacttcgaca

SEQ ID NO: 5451 - DNA, 680 bp, Artificial
  Synthetic
agcaatagcaatagtgataatagtaatagtaataatcagttggccttcttttcttccatctgcaagatcatttctgttcttctcctcgttgttgctcaattcgattcccctcgtttttgttttgcgatggctcttcctggtcaacagcaggtggactgtccaagctttaagcttgtaattgtgggtgatggcggaacaggcaagacaacttttgtgaagcgacatttgacaggggagtttgagaagaaatatgaacccacaattggagtggaagttcatcctcttgatttcttcacaaactgtgggaaagtccgctattattgttgggacactgcagggcaggagaaatttggtggacttcgggatggctactatatacatgggcaatgcgcaattatcatgttcgacgtgacgtcccgtttgacgtacaaaaatgtcccaacgtggcatcgggatctttgcagggtgtgtgagaacatccccgtcgttctttgcgggaacaaggtggatgtcaagaacaggcaagtgaaggcgaagcaggtcactttccacaggaagaaaaacctgcagtactacgagatctctgccaaaagcaactacaatttcgagaagcattcctttatctcgcaaggaaacttgcaggggatccaagtctccactttgtggagtctcctgcattg

SEQ ID NO: 5452 - DNA, 904 bp, Artificial
  Synthetic
ttaaaaccctcgcagtattctcctcaaaacaaacatggctcttccaggtcagcaagccgtggattatcccagttttaaacttgttattgttggcgatggtggaactggaaaaactacatttgtgaagaggcatcttactggtgaatttgaaaagaaatatgaacccaccattggagtggaggtgcatccattggatttcttcacaaattgtgggaagattaggttttactgctgggatacagctggtcaagagaaatttggtggccttagggatggatactacattcatggtcaatgtgctatcatcatgtttgatgtgacagctcgattgacatacaaaaatgtccccacatggcatagggatctttgccgtgtctgtgaaaatattcccattgttctttgcggaaacaaggttgatgtgaagaaccgtcaagttaaggctaagcaggttactttccaccggaagaagaatctgcaatactatgagatatcagcaaagagtaactacaactttgagaagcctttcctttaccttgccaggaaacttgctggggatcctaacttgcactttgtggagtctcctgccctcgctccccctgaagtacagatcgacttggctgcacaacaacaacatgaggctgagcttgctgctgctgccagtcaacccctcccagatgatgatgatgagacatttgattaagagagagtaatcaggcttctcggacagcatttgtggatgcggctatgatttttcttttttcctatgtactggtgtcccatttttttccaccattgatgggggcttctgaggactctctgttccagaatatgtaggctttttgaactctgctcttgttctattttctttctggcttgtgagaacgatatgaagtttttattcata

SEQ ID NO: 5453 - DNA, 782 bp, Artificial
  Synthetic
tggtatcaacgcaaagtggccattacggccgggggcagtattctcctcaaaacaaacatggctcttccaggtcagcaagccgtggattatcccagttttaaacttgttattgttggcgatggtgggactggaaaaactacatttgtgaagaggcatcttactggtgaatttgaaaagaaatatgaacccaccattggagtggaggtgcatccattggatttcttcacaaattgtgggaagattaggttttactgctgggatacagctggtcaggagaaatttggtggccttagggatggatactacattcatggtcagtgtgctatcatcatgtttgatgtgacagctcgattgacatataagaatgtccccacatggcatagggatctttgccgtgtctgtgaaaatattcccattgttctttgcggaaacaaggttgatgtgaagaaccgtcaagttaaggctaagcaggttactttccaccggaagaagaatctgcaatactatgagatatcagcaaagagtaactacaactttgagaagcctttcctttaccttgccaggaaacttgctggggatccgaacttgcactttgtggagtctcctgcccttgctcctcctgaagtacagatcgacttggctgcacaacaacaacatgaagctgagcttgctgctgctgccagtcaacccctcccagatgatgatgatgagacctttgattaagagagtaatcagccttctcggacagcatttgtggatgctatgatttttcttttttccta

SEQ ID NO: 5454 - DNA, 965 bp, Artificial
  Synthetic
tcgctagagggcggctgctcatcagtgcatcgtcgcggcggattcgcgatggtaagctttgtgttcttcgatttctccgtgtgattgatcgatttgtggcgctgaggcaggccttgcccggtcaagtgacacctggagatgtggtttcgttcaagcttgtcatcgtcggcgatggcggcacggggaagacgacgtttgtgaagcgccacttgactggtgaattcgagaagaaatacgaaccgactatgggtgtcgaggttcatcctctcgatttctttacgaactgtggccgtctacgcttttattgctgggacacggccggtcaagagaagtttggtggtcttcgcgacggctactatatccatgggcagtgcgctatcatcatgtttgatgttactgcccgcctgacgtacaagaacgtcccaacctggcaccgggacctttgcagggtttgcgagaacatccccattgttctgtgcggcaacaaggtcgacgtgaagaacaggcaggtcaaggccaagcaggtcaccttccatagaaagaagaacctgcagtactacgagatctctgccaagagcaactacaacttcgaaaagcccttcctttacctcgccaggaagcttgccggagacccgaatctccactttgtcgagacccctgcgctggcaccgcccgaggtgcacatcgatcttgctgctcagcaactgaatgagcaggagatgcacaatgcggctgctcagcctctaccagacgacgaggacgacgcattcgattaaatcttttgcggtggtttgagcgatgataggagagaagaattgagagggatgtgtcattgcctgtgaactttgtcattgagaggtttcgtgttttatccgtcccagaaggaagaaatgtcatcgtctaggtagtaagtatactttcatgtacgtgagtctaaaggaaagaaaaagaaaaataagagttat

SEQ ID NO: 5455 - DNA, 791 bp, Artificial
  Synthetic
ggttgagttaaccagaggttagggttgagttaaccagagggttggccttcctaacataagtcccgctctttcgcttggccatatctctctcgccttctctctctctctctccgtttcgcgttgccgatcgcagtccttccgctatggctctccctggacagcaggtagctgattgcccaaactttaagctggtcattgtaggcgatggaggaacagggaagaccacattcgtgaaaaggcatttgacaggagagtttgagaagaaatatgaacctaccattggagttgaagttcatcctcttgatttcttcaccaactgcgggaagattcgattctattgctgggatacagctggtcaagaaaaattcggagggctccgagatggttactacattcatgggcagtgtgctatcataatgtttgatgtgacatcgcgattgacctataaaaatgtcccaacatggcatagggatctctgcagggtttgtgaaaacataccaattgtcctatgtggaaatacggtcgatgtgaagaacaggcaagtgaaagcaaagcaggttacattccataggaagaagaatctccagtactacgagatctcagccaaaagcaattacaattttgagaagccttacctataccttgcgaggaaattggcaggtgatcagaatctgcactttgtggaatctcctgctcttgcacctccggaagtgcaaatcgacctggcacaacagcaacagtatgaagctgaactggctgctgctgcagctcagccattgccagatgatgat

SEQ ID NO: 5456 - DNA, 586 bp, Artificial
  Synthetic
gttagtttagaggaaggagggtagataggaggagaaggagatggcgccaaaagcaccgaaatcaggcattgcagcgggtctcaaccgaggccatgtcgttaccaacagggacctcgcccctaagccttctgctaggaaagggaagcttggaaagaggacggccttagtgcgaagcttgatcagggaagtagtagggtttgctccttacgagaagagaatcactgagctgctgaaggttggaaaagacaagagggcattgaaagtggccaagagaaagcttggcacccacttgcgagccaagaagaagagagaagaaatggccaatgtcttgcggaagatgaggtctgggggaggagcagagaagaaaaagtgacaggctcgtatgatttaccagattttgtctcaatctttggattatatggtggctctatttatatctttgtttctttgctaagcataggttaatatcagcaagacattctcaagtagaattgaatttttacatacaaattcccaacggaaattttcttataatggatcttggtgtcatgtgagctgttggatatcaaaatctcatcaaatttta

SEQ ID NO: 5457 - DNA, 586 bp, Artificial
  Synthetic
agagaggggaggagagagaagaagggcagcgatggcaccgaaagctgcgaagtcagggatagcagcgggtttgaaccgcggccacgcggtgaccaacagggaccttgccccacgcccatccgccaggaaagggaagcttgggaagaggaccgccctcgtgcgtagcttgatcagggaggtggtcgggttcgccccgtatgagaagaggatcacggagctgcttaaggttggcaaggacaagcgtgcgctcaaagtggcaaagcggaagctcggtacccacctgcgcgccaagaagaagagggaggaaatggctaatgtcttgcgtaagatgaggtctggtggaggagcagagaagaagaaatgataaattctttagatttgcagtttcccagatttttgcagtattctcatcatgaatcattcagtgaagcggaggccttacttgtgaagacttccttttggtatctgaactctgcaaactaattttgtttttttggagattttcttaaagtagggcccttaactgtatgcttactgtgaggaaatggaaacatttgaatttctggcatcctatctagttcatggc

SEQ ID NO: 5458 - DNA, 551 bp, Artificial
  Synthetic
cctaattcctcaccgtttcttccgtatcgaactaattgaagaggtgatggctccgaagcagcctaatacagggctatccgttgggctaaacaaaggacatgttgtaaccaagaaggaattagctccacgtccttctgacagaaaagggaaaacaagcaaaagagtccactttgtgaggagccttatcagagaagtcgctggatttgctccatatgagaaaaggattactgagcttcttaaagttggaaaggacaagcgtgccttgaaggtagccaagaggaagttgggcactcacaagagggcaaagaagaagagagaagagatgtctagtgttctccgtaagatgagggctactggaggtggtgaaaagaagaaatgaaacctgtatggttgatgattgaagaacccagttagttaattcacttgcttttatgtttgcaatgtatttttgttttcaagaaagaagacttgtgattaaaagctcccggtttatgtcccatgaagattttgaaattagtgatattttagacatttttgccaagtgcatgttt

SEQ ID NO: 5459 - DNA, 542 bp, Artificial
  Synthetic
tctaagatcgagcaaatcgaaggtaagcttttggaatggcgccgccgaatacaggtttagctgtaggattaaataaaggccatgttgtgaccaagaaggagttagctcctcgcccttctgacagaaaagggaaaacaagcaaaagggtccatttcgtaagaagcctcatcagagaagttgctggatttgcaccatatgagaagagaattactgagctgcttaaggttggaaaggacaagcgggctttgaaggtagccaagaggaagttgggtactcacaagagagcaaagaagaagagagaggagatgtcaagcgttctccgcaagatgagggccaccggcggtgctgaaaagaagaagtgaagacttaatcctcatactgatgattgaggaactgagttcattagatatacatgatctttttgatttagctatgtaattctctcttttctagaaagaaaacttgttatcagactagtagaaagaaaatatggttttgaatttcatcaagattattatgacattttgctcaactttcaagtc

SEQ ID NO: 5460 - DNA, 375 bp, Artificial
  Synthetic
acgatggcgcccaacgttgcgagcagcgggatcgcgatcgggctcaacaaggggcatgtcgtcaccaagcggacgccggcgaagcggccgatcgccatgaaagggaaagggcagaagaggacgctattcgtgaggaagctgatccgggaggtggtgggattcgcaccctacgagaagaggatcactgagctgctcaaggttgggaaagacaagcgcgcgctcaaggttgccaagcgaaggctcgggactcatcttagagccaagaagaaacgcgaggagatgtctacggttctaaggaagatgaggtctgcgaagtaggataatctcttttgtattggttcttttaaaatcgaattgataagtatttcaaccaag

SEQ ID NO: 5461 - DNA, 386 bp, Artificial
  Synthetic
gaggaaggagggtagaaaggaggagaaggagatggcgccaaaagcaccgaaatcaggcattgcagcgggtctcaaccgaggccatgtcgttaccaacagggacctcgcccctaagccttctgctaggaaagggaagcttggaaagaggacggccttagtgcgaagcttgatcagggaagtagtagggtttggtccttacgagaagagaatcactgagctgctgaaggttggaaaagacaagagggcattgaaagtggccaagagaaagcttggcacccacttgcgagccaagaagaagagagaagaaatggccaatgtcttgcggaagatgaggtctgggggaggagcagagaagaaaaagtgacaggctcgtatgatttaccaga

SEQ ID NO: 5462 - DNA, 424 bp, Artificial
  Synthetic
accaagagggtgacctttgtcaggaacttgatcagggaggttgctggatttgctccctatgagaagcgtatcactgagcttctcaaagttggcaaggacaagcgtgcactgaaggtggcaaagagaaagcttggcacccacaagagggccaagaagaagagagaggagatggctggtgtcctcaggaagatgaggtctggtggcggtcacgctcacaccgagaagaagaaatagagtatctccaagttcatgaagtccatggcaatattgtcttgttgagtttactcttgtagaaccctactactagaattgcactctattatccagctaaacatcatggtgttagttctgtgttaaaaacctcctgtcttgtgtttttgatcctttcaatgcatggtttgccaccttaaatttgcttgattaa

SEQ ID NO: 5463 - DNA, 609 bp, Artificial
  Synthetic
cccccccgggacgcagccggcggcttagggttgggtagctgtcgccgatccaaggtccgaggagcgaggaggagatccgccatggcgccgccgcagcccaagtcggggctcttcgtcggcatcaacaagggccacgtcgtcaccaagcgcgagctgccacctcgcccgtccgaccgcaaggggaaaagtaccaagagggtgaattttgtcaggggcttgattagggaggttgtgggatttgctccatatgagaaacgaatcactgagcttctgaaggttggaaaggacaagcgtgcactgaaggtcgctaagagaaagctcggtacccacaagagagcaaagaagaagagagaggagatggtgggtgtcatcaggaagatgaggtctgctggtactactgacaagaagaaatagaagtttcaagttgaagatctttttgcaatccttattgtaattcatttatatggacctatagtaagctctagatcgaggtgctgtattgccgttgagaacattgcaatgctattgaggagcattgaaattttggcacatgtttcgatacatcggttttgtcacaatttctcagggttgtattgcccttgattctgt

SEQ ID NO: 5464 - DNA, 654 bp, Artificial
  Synthetic
gggagagatttggagaggaggaattcacagctttcaatcgagcaatccatcaatcaatcaatcaactcaagttcgaaagcaatccccggtcaatcgatcaaggtttgggtctctgctttagctctctagatcccgcattggtcgctagcaaaatagcgcggatcaaggcagcatcgtcgccgccaatgacggcggccaggaggtacaagggggtgaggatgaggagttgggggaaatgggtgacagagatcagggagccgaagaagagatcgcgcatttggctgggatcgtacgccacggcggagatcgcagccagggcgtacgacgcggcgctcatgtgtctccgcggcccgtccgcccaattcaacttcccggccttggctccacggcatctcccctacaacccgcagtgctccccggcattcgtccagcaggcggcggcggaggcggcggcggaggcagcggaggcgctggggacatccagccccgaggaggaacactccaattcgtcgtcgcatccttcttcattcgagacgagctcgatatccacatccggcgagaacaattgctcgtcgatatcgtcggacgaggaggtgagcactgccaaggggggatcgaccgcgatccagcagcagggatcactggcgtacgagg

SEQ ID NO: 5465 - DNA, 420 bp, Artificial; identical to SEQ ID NO: 4614
  Synthetic

SEQ ID NO: 5466 - DNA, 440 bp, Artificial
  Synthetic
cccacgcgtccgccagatccagtctcagatccatcatcctcttcctccgacgcatcacaacaacaacaactctttctcgaatcttctcagcccgaaaccgttactgatgaagcaatctggagtcgctggatcttgtttcgcttacggttctggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatctcacatcggaggcgatttcggtgaatataaacctcttcactcctcagtcgacgctaagcttgaagctattt

SEQ ID NO: 5467 - DNA, 538 bp, Artificial
  Synthetic
aatggagcagctaggctcaatcggattgaatcaattaacggcagctcagatccaacaaatccaagcccaaatcaatttccaaacccaacaacaacaacaacagatgatgttccataatggctcccaccaccatacttctactatgaacatgttgggcccaaagcccgttcaaatgaagcaatcgggctcaccaccaaagcccactaagctctacaggggcgtcagacaacgtcactggggaaagtgggtagctgagatccgattgcccaagaaccggactcggctttggcttggcaccttcgacactgctgaagaagctgcgttggcctacgacaaggcggcgtatatgctacgtggcgactttgctagactcaacttcccccatctccgccataacggctcccttatcggcggcgaattcggagagtacaatccattgcactcctctgttgatgctaagttaaaggagatttgcgagagcttggcccagggaaagagcattgactctaagaagaagaaggcgtccaatgtgtcttca

SEQ ID NO: 5468 - DNA, 609 bp, Artificial
  Synthetic
ggctagagatggctagtctaaccctaagttgccttctcttggtactcttccccttggcctctttcgcccacgttttcttcgaagaacgcttcaatgatggatgggagaacggatgggtgaaatcggattggaaaaaggatgaaggtgctgcaggagactgggtacacacggcagggaaatggagtggtgactccgaagacaattgggattcaaaccagtccagacttacgattttttgccatatcagctgagtttcctgaatttagcaacaagggcaaggatttggttgtccagttttctgtaaagcatgaacaggatcttgattgtggtggaggttatatcaagcttttaagtggtgatgtggatcagaaaaagtttagtggtgataccccgtacagcatcatgtttgggcctgacttctgtggctatagcacaaagaaagtccatgttattttgaactacaatgacaagaatcaccccattgagaaggaaatttcttgtgaaaaggatcaactgacacatgtctacactcttgtgataagacctaacaacacctacagtgttctaattgataatgaagagaaacaaaacggcagtctgtacaaggac

SEQ ID NO: 5469 - DNA, 695 bp, Artificial
  Synthetic
gccattacggccggggctcttcagtttttggtggatagagggagggccgtgaagatcgacaccgtccgcaatgtcgaagcgaggacgaggaggttccgctgggaacaagttcagaatgtcgctgggtctgccggtggcggcgacggtgaactgcgccgataacacaggtgctaagaacctgtacatcatttcagtgaaagggatcaaaggaaggcttaacaggttgccttcagcttgtgttggtgacatggttatggctactgttaagaaaggtaagccagatcttaggaagaaggttatgccagctgtcattgttcgtcagcgcaagccctggcgccgaaaggacggtgtttttatgtacttcgaagataatgctggtgtgattgtgaaccccaagggtgaaatgaaagggtctgccatcactggccctattggaaaagaatgtgctgatctttggcctaggattgcaggtgctgccaatgctattgtgtaggagtagggttgctaagtagtttacagttctcgttttgttgggttttcatcaagtttctgaatatctgagggctttgtcttaataagaattattgctcggaattttgcagtactaaatggttttcacctatcaaacaaacaacaacaacaacccagtataatcccataatcccacttagtggggtctggggagggtggtgtgt

SEQ ID NO: 5470 - DNA, 584 bp, Artificial
  Synthetic
attttggggaggtatccgtcgggacgcgaagaagttctgaagccatgtcgaagcgaggacgaggagggtcctccgggaacaagttccggatgtctctggctcttccagtggccgctgttatgaactgcgcggacaacaccggagccaagaatctctacatcatctcggtcaagggcgttaagggaagactcaaccgtctccctgcggcttgcgttggtgatatggtcatggccaccgtcaagaagggaaagcctgacctcaggaagaaggttatgccggctgtcgtcgttaggcagcgcaaaccctggaggcgaaaggacggcgtcttcatgtacttcgaagacaatgccggagtcattgtgaatcccaagggggaaatgaaaggctcggccattacaggacccattgggaaagagtgcgctgatttgtggcccaggattgctagcgcagccaatgcaatagtctaaccctgcacttgcgcatcagtttttgtcattagggtcaatgcggatctttagtaatacaaagtgggctactggttttgtgggctatataaatgctatatctttgaaagatttgagtac

SEQ ID NO: 5471 - DNA, 598 bp, Artificial
  Synthetic
aacaagggcagtgcttgtttggctcacaaaaaaggtgtctcgagaggtcgccaagacaaggaagcccagcggaggaggagcagcagcagcattagcagcaacaggagggacaggaggaagctcaatggggaccgtcgcaaacaactggaagctggaagcccatccaaacatgcctaaaggaaagattgtggctttgattgttttggatggatggggcgagcagatcaaggacgagtacaacgccatccatgtcgcccctaccccctgcatggactcgttccgagagactgcccccgacaggtggagacttgtcaaagcccacggacctgccgttggacttccaaccgaggacgatatgggaaatagtgaggttggtcacaatgctttgggagcgggacgtatttttgctcaaggtgcgaagctggtcgatgcggctattgcatccgggaagttgtttaaaggagagggatttaattacatcaaggatgcttttggtactggcactctccaccttattggattgttgagtgatggtggtgttcattcgagatacgaccagcttcagggtttcatgaaaggagctgtcgagcagggctgc

SEQ ID NO: 5472 - DNA, 617 bp, Artificial
  Synthetic
cggacgcgtgggttctcataatgacttcgaacgtcggaagcagcgtcatcgagaagggtggtcggaagataggttttgatctcgattacgatgagaaggacagcagctacagcaggatcaagagccttgtcgtcgaggagatgaagcagtacttccgccccgagttcctcaaccgtctcgacgagatgatcgtcttcaggcaactcaccaagctggaggtcaaggagatcgctgagatcatgctcaaggaggtctttgacaggctcaaggccaaggacattgatctccaggtcaccgagaagttcaaggagcgtatcgtcgacgaaggcttcaacccgagctatggtgcgaggccgctaaggagggccatcatgaggctcctggaggacagcctcgcggagaagatgctatggggaggtgaaggagggcgattccgccattgtcgatgtggattcggaggggaaggtgattgtactgaatggccaaagtgggttgcctgagctttcaactccggctgtcactgtgtagtttcatatatgctgcagtgttctttatccagatacatttctccatagttagcaacttagcataactgtatatatagtgtatacaaatca

SEQ ID NO: 5473 - DNA, 624 bp, Artificial
  Synthetic
tggtatgaacgcagagtggccattacggccgggagatagggtggttgacgaaggatacaacccaagctacgggcacggcctctgagaagagctatcatgagactgctagaggacagcatggcggagaaaatgcttgcaggtgagatcaaagaaggtgattcggttattgtggacgtggattcagacggcaatgtgactgttctcaatggcagtagtggtactccctcaaaccccactccggagcctatccctgtgtagatcaagtgatcatgttttagagttcatttctgttggccactaagctctgggcatatgaagcaatttgtgggtttatctttggggcctctgggtaaaatcttaccacgttgagaaggcagcatcctttctatgttgagcttcaaggattttacaaaatatacgctgttggattaattggatcaagattgtagttcttcccaagaaagtgttgtattagcaagacactcctcaccaaatacattctgattattatgggtggcagttaacattgtcctcagctttggtcttgctgtcctcatttgtgatcatgtgattttctttcttctttccctcttttcattatattttggctcaggtcacaatggc

SEQ ID NO: 5474 - DNA, 621 bp, Artificial
  Synthetic
ccctgctacaataggattaagagcttggtgactgaagaggtgaagcattacttccgacctgagttcttaaacagattggacgaaatgattgtgttccggcagcttaccaagctggaggttaaggagattgctgatattatgctcaaagaagtgtttgacaggctcaaggcaaaggacatcgacctccaggtgacagacaagttccgggatagagttgtcgacaaaggttacaacccaagctatggtgccaggcctctgcggcgtgctattatgaggcttctggaggacagcttggcggaaaacatgttggctggcgaggtcaaggaaggtgactctgctattgttgatgtggattcaaagggcaaggggatagttcttaacggtggtaggggtgttccggaaccactggcacctgctctgagtgtctaattgaaggataatatcgccgttctggaattatggccttttctcttctctcagctggggcgctcatgatggtaaaactagatggcataaattctcccttcatttaagcgctttcacttttcctctttttttccaacagaggcagtacgaatgttatggaaatgaatcaacagagatgcatttagcaaacaaact

SEQ ID NO: 5475 - DNA, 611 bp, Artificial
  Synthetic
ctgtcgtacaattcttgcttatgatgtgtgacacatggatggcttcatatgttactggactatctctagaaactccttttaatttttttttaaaaaatgcgagtaggatctcaatggaaggctattgacagtcaacaaagctgctccaagaggatcacggccagaacgtccacctcgaacatttcagcctacttacagaatctatgttggcaacatcccgtgggacattgatgatgcacgccttgagcaagtcttcagtgaacatggtaaagtagtaagtgctcgggtggtttttgacagagagtctggacggtcacggggctttggttttgtgactatgtcaagtgaagctgaaatgagtgaagcaatcgccaaccttgacggacagactctggatgggaggacaatcagggttaatgctgctgaagaaagacctaggcgcaactcatactgaattgatcatacatttatttgttccattgacatagcagtcatgcagctatgagcagctagattttatcagacctattcgatttagctctctacttctttgtttttattccttgattgcttatatataggtacgggacttcttttttcttttggttctt

SEQ ID NO: 5476 - DNA, 538 bp, Artificial
  Synthetic
cccacgcgtccgccattatatataaaaaatatcaatggctgaagttgaataccgttgcttcgtcggtgggctcgcatgggctaccactgatcgaaccctaggcgaagctttctctcagtatggcgaggtgcttgaatcgaaggtccgtttgtcggtcgcagagcagagatcggaatccgagccctgctttggcttcgtttacccctctgttactgttgattcatctgttactgttactatgtctctatctgttactgttgattcatctgttactgttactatttgatactattattcgttctctctaacgatcatcaacgaccgtgaaaccggtagatctagaggatttggctttgttacttttggcgatgagaaatccatgagggacgctatcgaagggatgaacggccaagaccttgatggtcgtaacataaccgttaacgaagctcaatcacgcggaagcggtggaggcggcggcggcggcggtggtttccgcggtggacgtcgtgagggaggcggcggatacggagggggagga

SEQ ID NO: 5477 - DNA, 316 bp, Artificial
  Synthetic
cccacgcgtccgcactactctcactgtaatcccttagatcttcttttcaaatttcaatggcgtccggtgatgttgagtatcggtgcttcgttggaggtctagcatgggccactgatgacagagctcttgagactgccttcgctcaatacggcgacgttattgattccaagatcattaacgatcgtgagactggaagatcaaggggattcggattcgtcaccttcaaggatgagaaagccatgaaggatgcgattgagggaatgaacggacaagatctcgatggccgtagcatcactgttaacgaggctcagtcacg

SEQ ID NO: 5478 - DNA, 638 bp, Artificial; identical to SEQ ID NO: 4769
  Synthetic

SEQ ID NO: 5479 - DNA, 416 bp, Artificial
  Synthetic
ggggtttcagctgctccttctcagttccggttcgtttcttggtctgttttttgtgttctgatactgcaatggccgctgccgtagagtatcgctgcttcgtcggaggtctgtcatggggcacagacgaccgcgccctcgagcgcgccttcagcacctttggggaggtcatcgattcgaaggttgttaacgatcgtgaatcggggagatctcgtgggttcggattcgtgacattcactcaagaacagtctatgcttgacgcgattgaggggatgaacgggaaagagctcgacgggaggaacatcactgtgaatcaagcacaagaacggaactccggaggtggtggaggtgggtttcgaaggtccgaaggccgttacggcgggggcgggggcggatacggcgggggcggttacagatcc

SEQ ID NO: 5480 - DNA, 608 bp, Artificial; identical to SEQ ID NO: 4783
  Synthetic

SEQ ID NO: 5481 - DNA, 472 bp, Artificial
  Synthetic
gtgttgttgtttagttcgggtttcctgtttcgttctttgtgggccgtggatctagcggaagacaccccgccgttctcgagcttcgaacagccgacgttgcctagctgggatacatggcggcagtggagtattcctgtttcgtcggaggcctggcatgggccaccgacgaccgcagcctcgagaccgccttccgccccttcggaaatgtcacagactccaagattatcaatgatcgtgaaactggaaggtctcgtggctttgggtttgttaccttctctgaggagcaatccatgctggatgcgatagagggtatgaatgggaaggagctcgatggaagaaacattactgtaaaccaagctcagagccgtggttctggaggtggaggtggtggtggcggtggtggattccgcagatctgaaggtggccgatcaggaggaggagggggatatggaggaggagggtatggaggagg

SEQ ID NO: 5482 - DNA, 388 bp, Artificial; identical to SEQ ID NO: 4785
  Synthetic

SEQ ID NO: 5483 - DNA, 605 bp, Artificial; identical to SEQ ID NO: 4793
  Synthetic

SEQ ID NO: 5484 - DNA, 805 bp, Artificial; identical to SEQ ID NO: 4791
  Synthetic

SEQ ID NO: 5485 - DNA, 551 bp, Artificial
  Synthetic
cggacgcgtgggcaacgcgaagctctcgtcgcgcacaaccaactcgagaccgcggggaggcgaaccaacgggcggcgtgggcatggggaggtcgccatgctgcgagaaggcgcacacgaacaagggggcgtggacgaaggaggaggaccagcggctgatcgcctacatcaaggcgcacggcgagggttgctggcggtcgctgcccaaggcggcggggctcctccgctgcggcaagagctgccgcctccgctggatgaactacctccgccccgacctcaagcgcgggaacttcaccgacgacgacgacgagctcatcatcaagctccacgcccttctcggcaacaagtaagttgtaaacggatttcaatgcgctgtcatctgttcttgtgttcttggtgctgatcgatcgtttggttggttggcgcaagtggtcgttgattgcggggcagctgccggggaggacggacaacgagatcaagaactactggaacacgcacatcaagcgcaagctcctgagccggggcatcgacccgcagacgcaccggccggtc

SEQ ID NO: 5486 - DNA, 515 bp, Artificial
  Synthetic
atgggaggagtacgcggcggatcatcgtcgctgccatcctctccttcgagttcggcgtcttcgccatccaattcttgcacttgctgcgctgaatcgcagctgcggcgggggccatggacgtcggaggaggatgcgctgctgctgcggcatatgagagtgcttggggatcgagggaattggcgcaaggtcccaaaggcagcaggcctgatgcgctgcgggaagagctgccggttgcgatggctcaattatcttcgtcctgatctcaagcgaggaggtttcaccgaggatgaggacgcgttgatcatcaagctgcattctctgctaggaaacaggtggtcgcttatagcgggtcgaattcccggtcgcagcgacaacgagatcaagaactactggaatttccatctgggaaagaagctcctgaaggtgggcatcaatccaaagacacacaagccactgagcagcagcccagtgcctgccaagaccgagatgccatccaggagaacttccaagttctg

SEQ ID NO: 5487 - DNA, 640 bp, Artificial
  Synthetic
gcagcatggggagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctgacttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaagatga

SEQ ID NO: 5488 - DNA, 303 bp, Artificial
  Synthetic
atttataagaacaagatcaagaatcaagaatcaagatgatgggaagagcaccgtgttgtgataaggccaacgtgaagaaagggccttggtctcctgaggaagacgccaaactcaaagattacatcgagaatagtggcacaggaggcaactggattgctttgcctcagaaaattggtttaaggagatgtgggaagagttgcaggctaaggtggctcaactatttgagaccaaacatcaaacatggtggcttctccgaggaagaagacaacatcatttgtaacctctatgttactattggtagca

SEQ ID NO: 5489 - DNA, 791 bp, Artificial
  Synthetic
aagctgggtgggattgacaagaggacccagcttgtagatgagatgacccgtggtggtagacttgccggagtcgacatgaccaatcaccacaatgttgatgtgaaccttctcctcgaggttgaggaggttgaaaagaaaatttgtagatcttgtgtggcactggtggaggaagcgctcgccatcgctagatccttgatatttcgatcgattctcgcccatggccgccgcaacgatgatgaaatccacactggcagcgagctgttcgtcgctagatcgagtcgccgccacgaatgcgtcgccggcagcgtcttgtaccatggtcgcgtcgccaaaggcaaaggcttttaagatgtccagtttctttgccggatccgaggtgggcttgtactcggctccattgtcgagtcgtgtggccaagggttccatggttccagtgagggcagcgcttgcggaggccccgaccaagccaaaatctgctgggacgaaagagaagactcgaattgccatcaatggctttggacgcattggcagactggttctccgggttgcgttgacaagagacgacatcgaggttgtcgcagtaaatgatccattcaccagttcgaagtatatggcttacctctttaagtatgattccactcacgggatcttccacgaggaagtgaaagccgtcgatgacagcacgcttgaagttggtggtcacaagatcaaggttttcggacagcgtgaccccgctgatattccatggggtgatgccggcgtcgacttcgtcgtggaggcctctggtgtct

SEQ ID NO: 5490 - DNA, 873 bp, Artificial
  Synthetic
cggacgcgtgggttttcactaagcaattttctctcctaatttctttaaacccctttttttctcccctaagccatggcatctgacaagaagatcaagatcggaatcaatggatttggaaggattggtcgtttggtggcaagagttgctctgcagagagatgatgttgaactagttgcagtgaacgatccatttatctctactgattacatgacatacatgtttaagtatgattcagttcatggacaatggaaacaccacgagcttaaagtcaaggatgaaaagacccttctttttggtgagaagtccgtcagagtcttcggaattaggaaccctgaagaaattccatgggctgaagctggtgctgatttcgttgtggaatccactggtgtcttcactgacaaggacaaggctgctgctcacttgaagggtggtgccaagaaggttgtgatctctgctcctagcaaggatgcccccatgtttgttgtgggtgtcaacgagaaggaatacaagccagaatatgacattgtctccaatgccagttgcactaccaactgccttgcacctttggctaaggtcatcaatgataggtttggcattgtggagggtctcatgactactgtccactcccttactgccacccagaagactgttgatggtccatccatgaaggactggagaggtggaagagctgcttcattcaacatcattcctagcagcactggtgctgccaaggctgttggaaaagtactcccagctcttaatggaaaattgactggaatggccttcagagttccaactgttgatgtttctgttgtggaccttactgtaagactagagaaagaggcctcttatgatgagatcaaagctgcaatc

SEQ ID NO: 5491 - DNA, 698 bp, Artificial
  Synthetic
acgcgtcgcgcagagcgataggtgtggtgtggagaggtagatggccatgttgagtcgggtgctgaggcgagtgcctgcttccttcactgggagatctccgcggcagcctctcgaggaggtttctaagcgcctcgaggaggccctagacgcccagactccgtccaaggctgcctccattgtggggtcacaaagccgggactattcaagagaatcagcagggtcaaagagtatcagagctttggcattagctggagctggtgttaccggtttacttgggttgacaggcttagcgtatgccgatgaagctgagcacggattagcttgtccagattatccttggcctcattctggagtcctcagctcttatgatcatgcatcaattcgacggggccatcaagtgtatcagcaagtttgtgctgcttgccacagcatgcagtatgtgaaatatcgggatttgattggtgtttcgtacacagaagaagaggtgaaggctctggcagccgaaattgaagtcgaagatggacccaacgacgaaggggaaatgtactcacgcccaggcaagcccagcgatgccttcccgagcccctatactaatgagcaagcggcccgatatgctaatggtggagcttaccctccagatctaagcttgattacaaaggctcgtcccaacgggcaaaattatgtgttctctttgctta

SEQ ID NO: 5492 - DNA, 879 bp, Artificial
  Synthetic
tggttttccggatctcgcaggacctgttgtcctatcgccgtcgatcaattctctctacaatccctgtccgagggcttgactaaaaatgttgggaggtagagcaatccatcggttattaggcaggaaatttcaatctgaatcctcggcctctccaattttatcatccattgtttccaaacaagcccaagaagaatttggatcttttggcatgaagtccctcagatcattggcactcattggagcaggtgtatctggactcttaggttttgcgacagtagcatctgctgatgaagctgaacacggattggaatgtccaagctatccttggcctcacgcaggcattcttagttcatatgatcacgcttcgattcgtcgtggtcaccaggtttatcaacaagtatgtgcttcttgtcattcaatgtcacttgtttcatatcgtgacttggttggggtagcatatacagaggaggaagtaaaggccatggcagctgagattgaagtggttgatgggcctaatgatgagggtgaaatgttcactcgtcctggtaaactgagtgatcgttttcctcagccatattcaaatgaagcagctgctagatttgctaatgggggagcctaccctccggatttaagtcttgttacaaaagcacgtcataatggtcaaaactatgtgtttgcccttctaactggctatcgtgatcctcctgctggtgtttcgattcgcgaaggacttcactacaatccttacttccctggtggagctattgccatgcctaaaatgcttaatgatggcgctgttgaatatgaagatggtacccctgcaactgaagcacagatggggaaagatgtggtgtcatttttaacttgggctgctgaacc

SEQ ID NO: 5493 - DNA, 720 bp, Artificial
  Synthetic
cccacgcgtccggatgttgacccgccctggtaaactcagtgaccggtttcctcagccatatgcaaatgaatcatctgcaaggtttgctaatggtggagcgtatcctcctgatctaagtcttataactaaggcacgtcacaatggtccaaactatgtctttgcgcttctgactggttaccgtgatccccctgctggcatatcgattagagaggggttacactacaatccttatttccctgggggagcaattgctatgcccaaaatgctcaatgatgaagctgttgagtatgaagatggtgtccccgccacagaggcacatatgggtaaagatattgtatcattcttggcctgggcagctgaaccagaaatggaagagaggaaactgatgggtttcaaatggatattcctactctctctcgctcttctccaagctgcttactacaggcgactaaaatggtcggttctcaagtcccgcaagctggttcttgacgtggttaactaaagcgccgctgaaaagcttttgcattggcctggccacacacagtcgtattttcaacaaaggatgttaaatagagaagagcctttctctgggtaataacgtatcatcatttttatgtgtcataaaaatctttgatgagaccagttctcacctgaaggtgaaaagacctcatcggtcttctttttccttcgattattactagagagttttatgaggataat

SEQ ID NO: 5494 - DNA, 970 bp, Artificial
  Synthetic
ccgagatcgagaccatcgccctcactctttgattgcggctccccctgcggcttcgctacagcttgccaattatgttggcaaggtcgtctttgcgcccggcgcgcctcctcaatgggcttcgaaatggcgccgtcaacgtccccaagcgtgctgcctcgacgagctcggaagctcccaccgcgcgcatgaacctcgccgctattgcttccaccaccctcgccgccggctccatggcctggtactaccatctctacggacccgtcgcttttgcttcgtcccctgctgaggagggtctccacgctactcagtacccttgggttcaccagcagttcttcaagacttttgaccaccaggctctccgacgtggtttccaggtctaccgtgaggtctgcgccagctgccactccctgtcccgagtcccctaccgagctctcgtcggtactgtcctgaccgtcgacgaggccaaggccctggctgaggagaacgaataccccgatgagcccgatgagcagggtgagatccccatgcgacccggaaagctggccgactacattcctcctccctacaagaacgacgaggctgctcgatttgccaacaacggtgctcttcccccggatctgagcttgatcgttaaggctcgccacggtggctgcgactacatcttcagcttgttgactggttaccctgaggagcccccggctggtgtccaggtcgcccccggcatgaacttcaacccctacttccccggcactggtattggtatggctcgtgttctgtacgacggcctcgtcgagtatgaggatggcactcccgccagcacctcccagatggccaaggacgttgtcgagttcctcaactgggccgccgagcccgagatggacgaccgcaagaagatgggcatgaaggtcttggttgccaccaccgctctgtgggccatcagcgtctacgtaaagcgatacaagtgggcttg

SEQ ID NO: 5495 - DNA, 356 bp, Artificial
  Synthetic
ccccccgagaattcaaaccggatcaacctcgctcgcttactcgtgtttaggcatggacgtttctgctgcgctcagcagcgactactcgtcggggacgccgtcgccggtggcggccgacgccgacgacggctcctccgcctacatgacggtgtcttcggcgccgcccaagcggcgagcggggcggaccaagttcaaggagacgcggcaccccgtgttcaagggcgtgcgccggaggaaccccgggaggtgggtgtgcgaggtgcgcgacccgcacggcaagcagcggatatggctcgggacgttcgagacagcagagatggcggcgcgcgcgcacgacttcgccgcgctcgcgctcc

SEQ ID NO: 5496 - DNA, 319 bp, Artificial
  Synthetic
ccctggctcaaactcaaacaccaacaccttcttcctcttcttcttcttccagcagcagcaacacacactactgacatggagtactacgagcaggaggagtacgcgacggtgacgtcggcgccgccgaagcggccggcggggaggaccaagttcagggagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctcc

SEQ ID NO: 5497 - DNA, 781 bp, Artificial; identical to SEQ ID NO: 4609
  Synthetic

SEQ ID NO: 5498 - DNA, 484 bp, Artificial
  Synthetic
ccacactcgagcagagcaaatacagttcaggaatcaggagcaagcagaaacacacacacaaatccgaagatgtgcgggatcaagcaggagatgagcggcgagtcgtcggggtcgccgtgcagctcggcgtcggcggagcggcagcaccagacggtgtggacggcgccgccgaagaggccggcggggcggaccaagttcagggagacgaggcacccggtgttccgcggcgtgcggcggaggggcaatgccgggaggtgggtgtgcgaggtgcgggtgcccgggcggcgcggctgcaggctctggctcggcacgttcgacaccgccgagggcgcggcgcgcgcgcacgacgccgccatgctcgccatcaacgccggcggcggcggcggcgggggagcatgctgcctcaacttcgccgactccgcgtggctcctcgccgggccgcgctcctaccgcaccctcgccgacgtccgccacgccgtcgccg

SEQ ID NO: 5499 - DNA, 714 bp, Artificial
  Synthetic
atcccaatttgccaatcgccggagtttgctctaatttcatccactggttgcatcatggcagcggctactggtcttgcatcactgcaatctctctctctcagttctgtaggactaagagagaagaagattgtgtcacttcctgcatccacctctgcatttctcggccatcagattggaagatttcctttatcagctaagaagcccatttcgaagggtataagagcccaaactgtagcagctcctccacccccagcagcagcagcaccagtggaggttgccgagtcttctgaggctaaaaagatttccacgaagagcatcgtggtgatcactggagcatcatctggtcttgggctggccacagccaaggcattagcggatagtggtgagtggtatgttgtaatggcatgcagggacttcttgaaggcagagagagcagccagatccgtgggattaccaaaggacagctaccgtgtcatgcatttagacttggcatcccttgaaagtgtcagacagtttgtagataacttccgccgatccgggctgcctctggataccctcgtctgcaatgctgcagtctactttccaactgcaaaagagcccaggttttcagcggaggggtttgagctaagcgttgcaaccaatcaccttggccattttctcttgactcgcttgctccttgaggatatggaaaaatcaaatcatgaatcgaggcgc

SEQ ID NO: 5500 - DNA, 711 bp, Artificial
  Synthetic
gctcgtctctgaagccgccacaccactctgacaaggaggaagcatggcagctgtggcaggtcttacctcagtgcagtttctcagctcatcatctatcaaagagaatgtgtcacttccttctacttctctgcgggactcggcatttatcggccttcgcaataagattcacagttttggtagctcagtctcatcactaaacaagggaatatgcaaaagaggggatgttatttctaggtctttgagagtccaggcggtggctgccccagtggagacactgaagtcctcagagccgaaaaagacatcgttgaagaatacggtcgtaatcacgggtgcctcgtcaggtttgggcctagcaactgccaaggcgttggcagacagtggtgagtggtacgtcatcatggcatgcagagacttcttgaaggccgagaaggcggccaagtccattgggatccccaaggatagctaccgcatcattcatctggacctcgcctcctttgatagtgtaaaacaatttgttgataacttccggaggctggagctccctctagatgcccttgtttgtaacgctgctgtgtacttcccgactgacaagcagccccgattctcggccgagggctttgagctaagtgttgcgaccaaccaccttgggcatttcctcctagctcgcttactcctggaggatttggagaaatcgacctttgaatcgaagcg

SEQ ID NO: 5501 - DNA, 1067 bp, Artificial
  Synthetic
gaattattatttaattctttagctgacaatttagatagtaaaactcaattccttatattcatggctcttcaggctgctgcactacttccttctgctttctctattcccaaggagggcaaagctggtgcaattttgaaggattctaatctctttggaatttccctctcagaccatattaaatctgattttcgctcctcttcatttaaagtgaagagccaaagaaggttgtcccatggatctattagagccgagacaatggttgcaactccaggtgttaccaacgccacagtatcaggaaagaaaactttaagaaaagggtgtgtagtagttactggagcctcttcaggattaggcctagccacagcaaaagctctagctgagacaggaaaatggcatgtgattatggcatgtagagactttctaaaaactgaaagagcagcaaaatccgcaggcatgcctaaggagaactacacaataatgcacttagaccttgcgtcgctcgacagtgttcgccagtttgtcgataacttccggagatcaggtcgccctcttgatgtattggtttgcaatgcagcagtttatcaaccaactgctaaagagccttctttcactgctgatggatttgagctcagtgttgggactaaccaccttggtcatttccttctttcaagattgttgcttgatgatttgaagcagtctgattacccttcaaagagactcatcattgttggttccattacaggaaacacaaatactttggccggaaatgtgcctccaaaagcaaaccttggggacttgaggggcttggcaaggggactcgacgggctgaacagctcggccatgatcgatggtggagactttgatggtgcaaaagcatacaaagacagcaaagtttgcaatatgctcactatgcaggagttccacaggcgataccacgaggaaactggcattacatttgcctctttataccctggctgcatagcaacaacagggcttttcagggagcatatcccattgtttagactccttttccctccattccagaagtatattaccaagggattcgt

SEQ ID NO: 5502 - DNA, 672 bp, Artificial
  Synthetic
tactaagcaaaaggacaccagaaacatagtacacttgagctcactccaaactcaaacactcacaccaatggctctccaagttcaggccgcactcctgccctctgctctctctgtccccaagaagggtaacttgagcgcggtggtgaaggagccggggttccttagcgtgagccagaaggccaagaagccgtcgctggtggtgagggcggtggcgacgccggcggcgccggtggcgagccccggcgcgggcacgtcgaaggcggacgggaagaagacgctgcggcagggggtggtggtgatcaccggcgcgtcgtcggggctcgggctcgcggcggcgaaggcgctggcggagacggggaagtggcacgtggtgatggcgtgccgcgacttcctgaaggcggcgacggcggcgaaggcggcggggatggcggcggggagctacaccgtcatgcacctggacctcgcctccctcgacagcgtccgccagttcgtggacaacttccggcgctccggcatgccgctcgacgcgctggtgtgcaacgccgccatctaccggccgacggcgcggcagccgacgttcaccgccgacgggtacgagatgagcgtcggggtgaaccacctgggccacttcctcctcgcccgcctcatgctcgacgacctcaagaaatccga

SEQ ID NO: 5503 - DNA, 636 bp, Artificial
  Synthetic
ccagaaacatagtacacttgagctcactccaaactcaaacactcacaccaatggctctccaagttcaggccgcactcctgccctctgctctctctgtccccaagaagggtaacttgagcgcggtggtgaaggagccggggttccttagcgtgagccagaaggccaagaagccgtcgctggtggtgagggcggtggcgacgccggcggcgccggtggcgagccccggcgcgggcacgtcgaaggcggacgggaagaagacgctgcggcagggggtggtggtgatcaccggcgcgtcgtcggggctcgggctcgcggcggcgaaggcgctggcggagacggggaagtggcacgtggtgatggcgtgccgcgacttcctgaaggcggcgacggcggcgaaggcggcggggatggcggcggggagctacaccgtcatgcacctggacctcgcctccctcgacagcgtccgccagttcgtggacaacttccggcgctccggcatgccgctcgacgcgctggtgtgcaacgccgccatctaccggccgacggcgcggcagccgacgttcaccgccgacgggtacgagatgagcgtcggggtgaaccacctgggccacttcctcctcgcccgcctcatgctcg

SEQ ID NO: 5504 - DNA, 691 bp, Artificial
  Synthetic
agagattcttcttccttcttcccggggagctggctatggctgccatcgtcgcagcagcagcatcgtcctcgggcctcgcggcgaagaaagagattctagccacatcctcgagcaatgcgggtgtttcttcttcttttctcgggtccaagctgcgctgtagcccagcaatccagggtgtaaggcaatgcaatgcttcgaccacgacgacgagcatcagagctgttgctgcgccggtggagacggcccgagcgaaggaggggaagaagacggccaggcagtcgacggtggtgatcaccggtgcctcttccggcctcggactcgccacggccaaagtcctggccgacaccggggagtggcacgtcgtcatggcttgtagagactttctcaaggccgagaaggctgcccggtcggctggaattcccaaaggaagctacaccgtcatgcacctcgacctggcttcgttcgacagcgtgaggcagttcgcggagaacttccggcgatccgggaggcctctcgattgcctggtctgcaatgcggcggtctacttcccgacagcgaaagagcccacgtatagcgcggaggggttcgagctcagcgtggcgacgaatcacttgggacacttcctgctgtcccggttgcttctcgaggatatggagaagtcagatcatgcgtcgagacgcatgataatcgt

SEQ ID NO: 5505 - DNA, 593 bp, Artificial
  Synthetic
atttgccaatcgccggagttgctctaatttcatccactggttgcatcatggcagcggctactggtcttgcatcactgcaatctctctctctcagttctgtaggactaagagagaagaagattgtgtcacttcctgcatccacctctgcatttctcggccatcagattggaagctttgctttatcagctacgaagcccatttcgatgggtataagagcccagactgtagcagctccacccccagcagcaccagtggaggttgccgagtcttctgaggctaaaaagatttccacaaagagcatcgtggtgatcactggagcatcatctggtcttgggctggccacagccaaggcattagcggatagtggtgagtggtatgttgtaatggcatgcagggacttcttgaaggcggagagggcagccagatccgtgggattaccaaaggacagctaccgggtcatgcatttagacttggcatcccttgaaagtgtcagacagtttgtagataacttccgccgatccgggctgcctctggataccctcgtctgcaatgctgcagtctactttccaactgcaaaagagcccaggttttca

SEQ ID NO: 5506 - DNA, 560 bp, Artificial
  Synthetic
gctgacaaggaggaagcatggcagctgtggcaggtcttacctcagtgcagtttctcagctcatcatctatcaaagagaatgtgtcacttccttctacttctctgcgggactcggcatttatcggccttcgcaataagattcacagttttggtagctcagtctcatcactaaacaaggcaacatgcaaaagaggggatgttatttctaggtctttgagagtccaggcggtggctgccccagtggagacactgaagtcctcagagccgaaaaagacatcgttgaagaatacggtcgtaatcacgggtgcctcgtcaggtttgggcctagcaactgccaaggcgttggcagacagtggtgagtggtacgtcatcatggcatgcagagacttcttgaaggccgagaaggcggccaagtccattgggatccccaaggatagctaccgcatcattcatctggacctcgcctcctttgatagtgtaaaacaatttgttgataacttccggaggctggagctccctctagatgcccttgtttgtaacgctgctgtgtacttcccgact

SEQ ID NO: 5507 - DNA, 1057 bp, Artificial
  Synthetic
attttttgctgactttagaccaaccccttttcttttcttgaacattttcatggctcttcaggctgttgctttggttccttctgctttatccatttccaaagaggtaatattttccgtccagaaaatatattgctcgtgagacaaaaagggttgctacgatggtaagcaaactccacttccaaccaagaggtggtgagtttaccaagaggtggtgagtttgagtaacagcctccctaccttaggggcaaagctagtgcaaacttgaagaattctagtctttttggagtctctctctctgactatactaaatctgatttccgctcctcttcattcaaagtcaagagccaaagaagattgtccaatggagcagtaagggcaacaatggttgcatctccagatgtaaccactaattctccagcaggaaagaaaactttaagaaaagggtgtgtaatagtcactggagcctcttcaggattaggcctagccacagcaaaagcactatccgagaccggaaaatggcatgtaattatggcttgtagggactttctaaaagctgagaaagctgcaaaatcagtaggcatgcctaaggagaattacaccatcatgcatttagacctcgcgtcgcttgacagtgttcgccagtttgtcgataacttcaggaggtccggtcgccctcttgatgtgttggttgctaatgcagctgtgtatcaacctactgctaaagagccttcatttacagctgaaggatttgagcttagtgttggcacaaatcatcttggacatttccttctttcaagattgttgcttgatgacttgaagcaatctgattacccttctaaaagactcataattgttggttcaattacagggaacacaaatactttggctggaaatgtacctccaaaggcgaatctcggtgacttgagaggtatggccgggggtttaaatggtattaacagttcagcgatgatcgatggtggggaatttgatggcgccaaagcatacaaagacagcaaggtctgtaacatgctcacaatgcaggaattccatcgtcgat

SEQ ID NO: 5508 - DNA, 628 bp, Artificial
  Synthetic
gaattcggctaaaagtttcttcttctttttttcgttttctagaaatggctcttcaagcaacctctatccttccatccagtctttccatccacaaggagggtaaatcaaatttgtcagggaaggatttctatggagtttcttttgctgaattcagtcctctcgtcataagaaacaagagagaattgaagagccaaaggttatctgttggacaaatcagagcccagacagcagcaacaactccaggggtaaatcaatctacacaaggaaaaaaaactcttaggaaaggaaatgtgataataacaggagcatcatcagctggaattgacaaagagaatttcactgttatgcacctcgacctctcttctcttgatagtgtcagacagtttgttgacaacttcaagcggtcaggtaaaccgcttgatgtgttagtatgtaacgctgctgtgtatcagccaacagcaaaggaaccatcattcactgctgacggatttgaacttagtgttggtactaaccacttagggcactttcttcttgctcggttactccttgatgacttgaaaacttctgattacccatctaagcgcctcatcatcgtaggttcaataacagggaatacaaacacattggc

SEQ ID NO: 5509 - DNA, 564 bp, Artificial
  Synthetic
cggacgcgtgggcggacgcgtgggcccccgaagcctcactcacttcgctgcagaggaaaaaaaagagagaaaaatctccgatggctctccaggcggccaccaccacctccttcctcccctccgcgctctccgcccgcaaggagggagcggtgaaggactcggcgttcttgggcgttcgtctcggcgacgggctcaagctggagaccagtgctctcggccttcgcaccaagagggtgagcacgtcgtcggtggccatccgcgcgcaggcgtcggcggcggtgtcgtccccgacggcgacgccggcgtcgccgtcgggcaagcagacgctgcgcaagggcacggcggtcatcaccggcgcgtcgtccgggctcggcctcgcgacggcgaaggcgctggcggagacgggcaggtggcacgtcgtgatggggtgccgcgacttcctcaaggcgtcgcgcgccgccaaggccgccggcatggagaagggcagctacaccatcgtccacctcgacctggcgtcgctcgacagcgtcaggcagttcgtcggcaacgtccggcggctgggga

SEQ ID NO: 5510 - DNA, 759 bp, Artificial
  Synthetic
actttcgaaggtataggcaaggtagaggcaggcttctctctctcgtcgtctcgttctcaggacagagggaggacacacacagctacagacaatgtcgggcaggaagaaggtgagagaggtgaaggaggagaacgtcaccctcgggcccgctgttcgagaaggggagcacgtcttcggggtcgctcacatcttcgcatccttcaatgacacctttgtgcatgtgactgatctctctggaaaggaaacccttacccgtgtcacaggaggcatgaaggtgaaggcagaccgagatgagtcctccccttatgcagccatgcttgcagcccaagacgtggctcagaagtgcaaggagttgggaataactgcattgcacatcaaacttcgggctactggtggcaataaaacaaaaacacctggaccaggtgcacagtctgccctccgtgcccttgctcgttctggcctgcgcattggacgcattgaggatgtgactcccattcctacagacagcactaggagaaagggaggtagaagaggaaggaggctctagagagtgtgcctttatttatttcagatcttgagagcgtatggagttcaaggcctggctctcttgaaggagtagttgtggaacttcaaatgttttgcagagttttgttacgtacattttcttgctaatgattgctattgacagacagatgtagttgcagtttaaattgcaccctggatacctattttgagatatccgagttttattgttttcat

SEQ ID NO: 5511 - DNA, 319 bp, Artificial
  Synthetic
gcgaactatgcgttcgggcatggtaaaggcaggattgtctctctcgtcgtctcgttctcatgacagagggaggacacacagagctacggacattgtcgggcaggaataaggtgagatgggtgtaggaggagaacgtcatcctcggtatctctgatcgagaaggcgagcacgtctgcgtggtcgtgcacatcttcgcatccttcgatgacagcttagtgcatgtgagtgatctctgtggaagggaaagccttatccgtgtcacaggaggcgtgtaggtgtcggcagaccgagatgagtcctccccttatgcagccatgct

SEQ ID NO: 5512 - DNA, 559 bp, Artificial
  Synthetic
cccccccccccgggagctagggttggatcgccgccgccgccgccgccgccgccgcttctccactctcccctgcccccgtcgccgtcgccaccgccgccgccatgtccgggaggaagaagacacgggagcccaaggaggagaacgtcaccctcggcccgaccgtgcgcgagggcgagtacgtcttcggcgtcgcccacatcttcgcctccttcaacgacaccttcatccatgtcaccgatctgtccgggagggagacgctcgtccgcatcactggtggcatgaaggttaaagctgatcgcgacgaatcttccccttatgctgctatgcttgcttcacaggatgttgctcaaagatgcaaggagcttggaataactgctttgcatatcaagctccgtgctactggtggtaacaagacaaaaacccctggtcctggtgctcagtccgcacttagagcacttgctcgatctggcatgaagattggtcgtattgaggatgttactccagtgccgactgatagcacacgcacaaagggtggtataaggggtaggaggctgtaatc

SEQ ID NO: 5513 - DNA, 661 bp, Artificial
  Synthetic
ccactctcccctgcccccgtcgccgtcgccaccgccgccgccatgtccgggaggaagaagacacgggagcccaaggaggagaacgtcaccctcggcccgaccgtgcgcgagggcgagtacgtcttcggcgtcgcccacatcttcgcctccttcaacgacaccttcatccatgtcaccgatctgtccgggagggagacgctcgtccgcatcactggtggcatgaaggttaaagctgatcgcgacgaatcttccccttatgctgctatgcttgcttcacaggatgttgctcaaagatgcaaggagcttggaataactgctttgcatatcaagctccgtgctactggtggtaacaagacaaaaacccctggtcctggtgctcagtccgcacttagagcacttgctcgatctggcatgaagattggtcgtattgaggatgttactccagtgccgactgatagcacacgcagaaagggtggtagaaggggtaggaggctgtaatcttcatgcggcctcaaaccgacaacactctgctctcctagatgttaccgtctgcattggactattttgtttctgtgcttttcattcggtggattatttaaaccagttttgaactctgtttctgcatcaattcatgctgtcctcaatgtaaccaacgttatct

SEQ ID NO: 5514 - DNA, 941 bp, Artificial
  Synthetic
cccacgcgtccggtctcggaccgcctctctctcggtatctgagatttggatcgggcgcgaggccggcggctccagtcggcatggcgcttgtgttgcattgcggaagtggcaacaaaaatgcctttaaggcacttattgctgcagagtacactggagtcaaggtcgagctgaccaagaattttgagatgggtgtctcaaacaagacccctgagtttctcaagatgaacccccttgggaagattcctgttctggagactcctgaaggtgctgtttttgagagcaatgctatcgcacgctatgttgctcgcttgaaggacaacagctctctttgtggttcttctcttatcgactattctcacattgaacaatggatggacttctcagcaacagaggttgatgccaatattggaaggtggttgtacccaaggcttggttttggcccttatgttcctgcacttgaggaatttgctattacttcattgaagaggtcattgggtgctctgaacacacaccttgcttcaaacacataccttgttgggcattcagttactctagctgatattgtgatgacatgtaacctatattatgggtttgttcggatcttgatcaagagtttcacctccgagttccctcatgttgagcggtacttctggacaatggttaaccagcccaacttcaagaaggtcattggtgatttcaagcaagcagagtctgtgcctcccgttcagaaaaaggctgctccccctaaggaatcaaaagcaaaggaggccaagaaggaggctccgaaggaggcccctaaaccaaaggttgaggcttcagaggaagaggaggcaccaaagccaaagccaaagaatcctcttgatctactgccaccaagcaagatgattcttgatgagtggaagaggctatactcaaacacaaaaaccaacttccgtgaaatt

SEQ ID NO: 5515 - DNA, 657 bp, Artificial
  Synthetic
gaattcacgaacaaaaatgccttcaaggcacttatcgttggagagtactctgggatcaaagttgatcttgctaaggattttgaaatgggggtttccaacaaagctccagagtttcttaagatgaatcctcttggaaaggttccagtacttgaaacacctgaaggtgccatatttgggagtaatgctattgctcgttatgttgcttctttgaccgaaaacagtccactcttaggatgttcagccattgacaaggctcatattgatcaatggatcgatttttctgccatggaggttgatgctaatatcttgcgctggtttatcccaagaattgggtttgctccatacgtccctcaagctgaagaacatgccgtgaccagtttgaagagggcattggatgccttgaacactcaccttgcttccaacactttccttgtcgggcatgctgtgactcttgctgacatcataatgacatgtaacctggtattgggattcagtaaagtcatgacctcaagcttcacaaaagatttccctcacgttgaaaggtatttctggaccatggtcaatcaaccaaatatcaagaaggtgttgggtgaagtaaagcagacagattccgttccaccagttcaagctgcccaaaagccaggtgctgcaaagcct

SEQ ID NO: 5516 - DNA, 331 bp, Artificial
  Synthetic
gggtttgttcggatcttgatcaagagtttcacctccgagttccctcatgttgagcggtacttctggacaatggttaaccagcccaacttcaagaaggtcattggtgatttcaagcaagcagagtctgtgcctcccgttcagaaaaaggctgctccccctaaggaatcaaaagcaaaggaggccaagaaggaggctccgaaggaggcccctaaaccaaaggttgaggcttcagaggaagaggaggcaccaaagccaaagccaaagaatcctcttgatctactgccaccaagcaagatgattcttgatgagtggaagaggctatactcaaaca

SEQ ID NO: 5517 - DNA, 690 bp, Artificial
  Synthetic
cccccggctgctacttccactagggtttcgtcttgcttctcccgctgctcgcctcgcctcctcgacgatctgagatcatcgagatcgattgagtggagctaggcggcggctagggcgagatggcgctcgtattgcatgctggcagtggaaacaagaatgcattcaaggcactcattgctgccgagtactctggtgtcaaggttgagttggtgaagaactttcagatgggtgtctccaacaagacacctgagtttctcaagatgaatcctattgggaagattcctgttctagagactcctgatggtcctgtttttgagagcaatgcgattgcacgatatgttacccgctcgaaggctgacaacccactctatgggtcttcactgattgaatatgcccacatcgagcagtggaatgacttttcggccacagaggttgatgctaatattggaaaatggctctacccacggctaggaattgctccctatgttgctgtgagtgaggaagcagctattgctgctttgaagagatcattgggtgccctcaacacacaccttgcatcaaacacataccttgttggccattcggtgactcttgctgatattgtgatgacctgtaacctctacatgggctttgctcggatcatgaccaagagttttacttctgagttccctcatgttgagaggtacttct

SEQ ID NO: 5518 - DNA, 711 bp, Artificial
  Synthetic
gggggacctcgcttcgccctcagagttggagaaagtctgaatttggaagctcataaaatggccctggaaatctactgctctcctataaacaagaatgggctgaaatctatgatcacagctgagtataatggggttaaaattgagtatgttcctgatttccaaatgggggttacaaacaagactccagaatatttgaagttaaatccaatgggcaaggtccctcttctcttttgaccccggagggtccaatttttgagagcaatgcgattgccagatatgtgtgcaggcttaaggaatgctctcttcttggaacttctctttatgaacaagctctcattgatcagtggattgactttgccactactgagattgatccatacatgctggcctggtatgctcctatattgggttttcgcccatttgttccagagttgcatgagatagccatcactgcattgaaaagggcgctgactgcgctgaatcagtctcttgcttcaaggacgtttttggttggagattcagtaactcttgctgacatagtagtcacttgcaacttgtctagcggtttcaggatgtgcatggacaaggagttcacatcggagtttcctcacgttgagaggtacttctggactcttgtcaatcagccagagttccgcaaacactatgtggacttcaagcaggttgacaaaaccccttctcccaaagctcccc

SEQ ID NO: 5519 - DNA, 363 bp, Artificial
  Synthetic
tggtatcaacgcagagtggccattacgccggggaaagagcttaagaaggaagaaccaaagtttgaagaggaggaagaagcacccaagcctaaggcaaagaatcctcttgatctcttgcctccaagtaagatgattctggatgagtggaagaggctttactccaacaccaagaccaacttccgtgagattgccattaaaggtttctgggacatgtatgatcccgaaggatattctctctggttctgtgattacaagtaccaggacgagaacacagtttcctttgtaaccttgaacaaggttggcggttttctgcagagaatggatctggcacgcaagtatgcttttggtaagatgttggtaatt

SEQ ID NO: 5520 - DNA, 1440 bp, Artificial
  Synthetic
ccccctttttctctctttctgcctctctttgcttaattttgggtgtaaaggggtgagcaagtttcaactgtgcaaccatggctctggttttgcactcaacaaataacaacaaaaatgcctcaaaggcactcattgctgctgagtacacaggtgtaaaggttgaacttgcaaagaatttcgagatgggtgtatcaaacaagacacccgagtttatcaagatgaatccaattggaaaggttcctgtgcttgaaacacctgatggacctgtttttgagagcaatgctattgcacgctatgtaactaaattgaagcccggcaatcctctctttggctcttcgttgatcgaatatgctcaaatcgagcaatggaatgatttttctgctactgagattgatgcaaacattgggcaatggttgtacccgcgccttggctatcgtgcatatattcctccagccgaggaagctgcagtagctgcattaaagagagctcttgatgctttgaacacccatctggcatctaacacttacttggttggacaatcaattacattggctgacatcataatgggctgcaacttgagcattggttttaggatgataatgactaagagctttaccgaggaattcccacatgtagagcgatacttctggactgtggttaatcagccaaatttctgcaagatattgggtgaggtgaaacaagctgaatctgtcccagctccctcatccaagaagcctgcaccggcaaaggaagctgcgaaacccaaagcgaaggaggagccaaagaaagagcttaagaaggaagaaccaaagtttgaagaggaggaagaagcacccaagcctaaggcaaagaatcctcttgatctcttgcctccaagtaagatgattctggatgagtggaagaggctctactccaacaccaagaccaacttccgcgaggttgccattaaaggtttctgggacatgtatgatcctgaaggatattctctctggttctgtgattacaagtaccaggacgagaacacagtttcctttgtaaccttgaacaaggttggtggttttctgcagagaatggatctggcacgcaagtacgcttttggtaagatgttggtaattggttcagaggccccatataaggtgaagggcttgtggcttttccgtggaaaagaaattcccaagtttgttatggatgaatgctatgacatggagctctatgaatggaaggaagtagacatcaacgatgaagcacagaaggagcgtgtcaaccaaatgattgaggattgcgagccctttgagggagaggctctgttggacgcaaagtgcttcaagtaaacgtttgtgttgcattcggctttggttttgtcctcccaaatttacttagattcttgttttgaaaactatcttgtcttttttgagaaaggttaaaacgtatgttgtctta

SEQ ID NO: 5521 - DNA, 712 bp, Artificial
  Synthetic
gagaaggaagcgagcgtgatggcgggactgctactccatgcgaatcccggcaacaagaatgcgctcaaatcgctcatcgcggcggagattgtgggcgtcaaggtcgatcttgtgcccgatttccagatgggcgtcagcaataagacgcccgagttcttgaagctgaatccgatgggaaaggttccagtgcttgagacaccagacgggccaatctccgagagcaatgccattgccagatacgtggcgaatctcaaaggaaaactgaccggatcgacattgtacgagactgccctgatcgatcagtggattgacttcgccaccactgagatcgacgcctgtctgggaaggtggatctatccgcgcttcggttatattccgtacgcaccagaggttgaagagcatgcaattcaggtgctccagcgtgctttcggcgctctcaacgcttacctcgcctctcggacgtacctcgcggggcacttcgtcacgctggccgacgtgatcacaatctgcaacatgtccttcggctaccggactggagccttctcggaggagttcatgtccgcattccctcacgtcgagagatacttctggacgctctgcaaccagccagcattcaagaagcacttgggagaggtcgtccggggctcggtcgaagtccctggccccggtgccaagccagcagctgctcaggcaccccgggcgtcgcagacgc

SEQ ID NO: 5522 - DNA, 608 bp, Artificial
  Synthetic
cccacgcgtccgcttgcagccatgaagatcgagcgagatttccacatgatgaaaggggacagtgagttcagttatgccaagaattcaaggatccaaaaaagagttgttcttgctgccaaaccaatagttgagaaagctgtacgggaagtgtgcatagatcttcatcctcaatcaatggtcattgctgaccttggctgctccttcggtgcaaacacactcctcttcatctctgaggtgatcaccacaatatgtgaggactataacaacaccatcaaggagagccccatggaggtccagttcttcctcaatgacctaccaagcaatgactttaaccacatcttccaatcactagagcagttcgagcagttgataatgcaagattgcgcttgcaaagggttacaacctcccccgcactttgtcgcaggcctgccaggttcctgagcagcttgatggcagcatgaatgaggggaacattcacataggagcgactacaccaccatccgtggcaaagctctaccaaaatcagtttgagaaagacttctcacggttcctccagatgagatgcatggagatggtgcccggaggccggatggtgctgacggttgctg

SEQ ID NO: 5523 - DNA, 800 bp, Artificial; identical to SEQ ID NO: 4835
  Synthetic

SEQ ID NO: 5524 - DNA, 1031 bp, Artificial; identical to SEQ ID NO: 4836
  Synthetic

SEQ ID NO: 5525 - DNA, 783 bp, Artificial
  Synthetic
tcatccttatcttaacaccattctctcttagcgtctttctccaaaaaccaaaaaccaagtgctctctgctgcagaaaatcaacaaaaggaaggggaagatccacaaaagaccatttttgttttctgtaaaacttgctcatattagccatggcatttgcaggaaccacacagaaatgcatggcatgtgacaaaactgtttatctggttgacaaattaactgcggataatagaatctatcacaaagcttgtttcagatgccatcactgtaagggcactctcaatcttggcaactacaattcctttgagggagttctatactgtagaccacactttgatcagctcttcaaacaaactggcagtttggataaaagctttgaaggtacaccaaaaattgtgaaaccacagaaacccattgacagtgagaaacaacaggtagctaaagtgacaagcatgtttggtggaacaagagagaaatgttttggctgcaagaaaactgtctacccaacagaaaaggtatcagttaatggtacgccatatcacaagagctgcttcaaatgtagccatgggggttgtgtaattagcccttctaactatatcgcacatgaggggcgcctctactgtaaacatcaccatattcaacttatcaaggagaaaagcaacttaagcaagcttgagggtgaccatgagacgaattccacgacaacaacagaagttactgcagagtcataaacagcgaccgagttgattgctcctcagctcatgtcttacctatcttgctttatg

SEQ ID NO: 5526 - DNA, 723 bp, Artificial
  Synthetic
tggggcagcaaggcgaaggcgatcgattcgatcgatcgatctgtcgaggcaggggcccggcagcagctgttctacgatgtcgtccttctctttcgccggcacgcagcaaaaatgtaaggcatgcgacaagactgtctacttggtagaccagctcactgccgatggtgtcgtctatcacaaagcgtgctttcgatgccatcactgcaaagggacactaaagcttagcaattatgcttcgctggaaggggtcttgtattgcaagccccatttcgatcagctcttcaagcttactggaagtttcgacaagagctttgagacaggactattgcacagacaacctagcgaagaagcgagtaagacgccatcgaagacatcgctcttgttctctgggactcaagaaaaatgtgttgcttgtgggaaaactgtgtaccccatagaaaaggtgactgtcgagggtacaccgtatcacaaatcttgtttcaagtgttctcacggcggctgtacgatatcgccatcgaattatcaagctcacgaaggccagctctactgcagacatcactacactcagctcgtcaaggagaaaggagacttcagcaatctgtccaagacaccggggaaggcagcagcgaaatagaaattggattttgggtgtaagggagtctactacgatcttcaaaggtttggtgatgagaaaacgttgcctgaggtgaatggaggatttga

SEQ ID NO: 5527 - DNA, 627 bp, Artificial
  Synthetic
aaggcgaaggcgatcgattcgatcgatcgatctgtcgaggcaggggcccggcagcagctgttctacgatgtcgtccttctctttcgccggcacgcagcaaaaatgtaaggcatgcgacaagactgtctacttggtagaccagctcactgccgatggtgtcgtctatcacaaagcgtgctttcgatgccatcactgcaaagggacactaaagcttagcaattatgcttcgctggaaggggtcttgtattgcaagccccatttcgatcagctcttcaagcttactggaagtttcgataagagctttgagacaggactattgcacagacaacctagcgaagaagcggtaatatcaatatcaaagaatgatttttttctttttctaaatccaactcgtggttaatatgtttttacagagtaagacgccatcgaagacatcgctcttgttctctgggactcaagaaaaatgtgttgcttgtgggaaaactgtgtaccccatagaaaaggtgactgtcgagggtacaccgtatcacaaatcttgtttcaagtgttctcacggcggctgtacgatatcgccatcgaattatcaagctcacgaaggccagctctactgcagacatcactacactc

SEQ ID NO: 5528 - DNA, 571 bp, Artificial
  Synthetic
tggtatcaacgcagagtggccattacggccggggagagagggtgccttttttgtttgtttaatctcaataacaaagcaggttagatataaaaaggcagaagagctttgttgataaaagtattttttttcatctgccatatttctaactctgattagttattgagattgaggattttcaggcttctgtaaataataataaggagaaaaaaattaaataaaagataaaaatggcattcacaggaactttggataaatgctcagcttgtgacaagactgtttactttgttgatttgttgtctgcggatggtgttacttatcataaatcctgcttcaaatgtagccattgcaaaggcactcttgtgatgagcaattattcctcaatggatggagtcctctactgcaagccacatttcgaacaactttttaaggaatctggaaattttagcaaaaactttcagactgcttccagacctgagagggaaaattcgctgacaaaggctccgaccaaactctcagccttgttctctggaactcaagacaaatgtgctgcgtgcaacaaaactgtttaccc

SEQ ID NO: 5529 - DNA, 681 bp, Artificial
  Synthetic
attagaaaagtatgtcttttattgggacacaacagaaatgcaaggcctgtgaaaagacagtttacccggtggagctgttgtcagctgatggggttaattatcacaagtcttgtttcaaatgcagccattgcaaaggaacacttaagctgagcaatttctcctcaatggaaggtgttctgtattgcaagccccattttgagcagcttttcaaggagtcgggcaacttcagtaagaactttcagtcacctgcgaagtcagctgagaagttaactcctgagctgacaaggtcgcctagtaaagctgctggcatgttttctggcacgcaggaaaaatgtgcaacttgtggtaaaacagcttacccacttgagaaggtgacagtggagaaccaaagttatcataagacatgtttcaagtgttctcatggtggatgctctttatctccttcgaattatgccgccctaaatgggattttatactgcaaacctcatttttcacagcttttcaaggaaaaaggcagctacaatcatttgatcaagtctgcctcgatgaaacgtccagctgctgcaaccgttccagattcttaaactccatgtttcagtcaactactgtatccattcacatggacttgatatttcttgagtgtgtttcttgctttttctctgttcattggctggtaacctc

SEQ ID NO: 5530 - DNA, 623 bp, Artificial
  Synthetic
ctcatatatagccatggcatttgcaggaaccacacagaaatggatggcatgtgacaagactgtttatctggttgacaaattaactgcggataatagaatctatcacaaagcttgtttcagatgccatcactgtaagggcactctcaagcttggcaactacaattcttttgagggagttctatactgtagaccacactttgatcagctcttcaaacaaactggcagtttggataaaagctttgaagaaacccattgacactgagaaacaacaggtagctaaagtgacaagcatgtttggtggaacaagagagaaatgttttggctgcaagaaaactgtctacccaacagaaaaggtatcagttaatggtacgccatatcacaagagctgcttcaaatgtagccatgggggttgtgtaattagcccttctaactatatcgcacatgaggggcgcctctactgtaaacatcaccatattcaacttatcaaggagaaaagcaacttaagcaagcttgagggtgaccatgagacgaattccacgacaacaacagaagttactgcagagtcataaacagcgaccgagttgattgctcctcagctcatgtcttacctatcttgctttatg

SEQ ID NO: 5531 - DNA, 584 bp, Artificial
  Synthetic
ccccccccccggggcgtcgacgcgagttgagggttgagacgcccaaaaaatcctcaaaatcccattgctcacccgcgttatataaccgcggccggccattgggagggacgccgcgaggggtgctcgtttcagcgcgggaggagatcagatcgggctcagatcttccagctcgccgcgccgcctccgccgccgcagcaggaagagagagggtgaggagaggaggaggctacgatgtttagcgggacgcagcagaagtgcaaggtgtgcaccaagacggtgtacccgatggaccagctctccaccgacggcgtcgtcttccaccgctcctgcttcaagtgccaacactgcaagtccaccctctcccttggcaactactcctcgattgaaggagtgccatactgcaagccccatttcgagcaactgttcaaggagaccgggagctacaacaagagcttccaatcacccgcgaaacccgcatcggagaagttgactcctgagctgacaagatcacctagcaaagccgcacgcatgttttcagggacacaggagaagtgtgccacttgcagtaaaacagcgtatcctct

SEQ ID NO: 5532 - DNA, 523 bp, Artificial
  Synthetic
cccccccccccggcgaggggtgctcgtttcagcgcgggaggagatcagatcgggctcagatcttccagctcgccgggccgcctccgccgccgcagcaggaagagagagggtgaggagaggaggaggctacgatgtttagcgggacgcagcagaagtgcaaggtgtgcaccaagacggtgtacccgatggaccagctctccaccgacggcgtcgtcttccaccgctcctggttcaagtgccaacactgcaagtccaccctctcccttggcaactactcctcgattgaaggagtgccatactgcaagccccatttcgagcaactgttcaaggagaccgggagctacaacaagagcttccaatcacccgcgaaacccgcatcggagaagttgactcctgagctgacaagatcacctagcaaagccgcacgcatgttttcagggacacaggagaagtgtgccacttgcagtaaaacagcgtatcctctagagaaggtgacagttgaaggacaggcctaccacaagtc

SEQ ID NO: 5533 - DNA, 616 bp, Artificial
  Synthetic
gaattcgatcatttttcagggtttgattggggatattcattagtcaaatggagaataatgaaagagaaaatttgacagattttgatctaaatcttgatacatttggattaccagctgaacttgaagataatttatattattcattaagaggtggacaaaatccaatccaaggaatatctcctagacctaggaatcgatggagaaggagaagaccaagtattacttcatctgaaactagaaatttttcattggatttcattgtaaaccctagttccgctagtgagagagtgtctcaagttggtgaaggaagtttggctgttactgacactgatgagagaacagctgagagcagtaaatcagggaaaggtctcgccgttgatcttttaggtgatgagttgaataaagatgaggataaggagaagaataacgaggatgaaatgagtttctttgattgtaatgtatgttttgagatggcgaatgagccagttattaccttttgcggtcatttgttttgttggccatgtttgtatcaatggcttcatgtttattctaaggttaagttatgccctgtgtgtcaaacagaacttactgatgccaatataaccccaatttatgg

SEQ ID NO: 5534 - DNA, 601 bp, Artificial
  Synthetic
tttctccatctaaaaacctccattttttttagcttcaaggcttcaactcagtcagcataacaatacaaaggagaatattcttgatttaaatatattcaggcgttaatagcaatctagaaaattacatcgaaaagtagggtatggccctagatcttcatttacaagagcaaacagcagaggctgcctttgacgagtgtcctactcccttagagaagtggaagacgacgtttgattatgagagtgaagacaatctctctggtggttttgagtgtaacatatgcctggatcttgtgcacgatcctgttgttacattttgtggtcacctctattgttggccttgcatctacaagtggattcaattccagagcatcccttcagaaaattcggatcaccaacagccccagtgccctgtttgcaaggctgaagtttcacaaaaaaccttgattccactctatggccgcggccaagctacaaaaccatctaaagacaatgttccaagtaaaggcatggccataccacaaaggcctactagtctaagatgtggcggtcacacactgatggcaacgaccgattcaaatccatcttagcaacttcactatcg

SEQ ID NO: 5535 - DNA, 578 bp, Artificial
  Synthetic
ggcggcatcggggctagcggcgccaccgggggcaccggctccactggcagcggcggcggcagcgatggcggatcaggtagctatgactgcaacatttgcctagagctcgcacaggaccccgtggtcacgcactgcggccatctcttctgctggccctgcctctaccgctggctggcctctcgatccagctgcaccgagtgtccggtttgtaaatccgcagtagaggaagccaaggtcatcccgatctacggccgcggcaagggctccacggatccacgcacaaagggagtggacaagatccccaaccggccgccggggcagaggacagatctgccacaccagcacaggcaaaactcccatccccagggtggaggaggaggtcccttccagcagatgggctttagcttcttcacggggccgacgacgcagtttggaaacgtgaccctcggcttcgggctgtttccgtttttgttcggtttctccgcaaccagcggcgggtttcccgatcttgggtttgggagcggcggacgaggcggaggaggcggcggacaacttggtggtggtggagggaatggtgg

SEQ ID NO: 5536 - DNA, 733 bp, Artificial
  Synthetic
  misc_feature (613)..(613): The residue at this position can be any nucleotide.
agaaattagagacgaaatacataagaaatttgggagagagggtgaaaagccctagaatcatctttgttgggatcagtacttgttcaatactaattgaagggctcgaattaccgcttttgtatcttcgatccattaattgcctccgaattccccttgcttttcttcagaaacgatatatctgagggagatgcaggactcaactaccagggtatttgaaagctcttcttcttcctctggggatgggagcaatgatgctggtgattttgaatgcaatatctgttttgaattggcgcaagatcccattgtgacactctgtggtcacctctactgttggccatgcctttatagatggctacatcttcactcacaatcctatgaatgccctgtttgtaaggcccttattcaggaggagaaattggttcctctttacggcagaggaaggacttctactgatcccagatcgaaaccaatcccaggccttgaaattcctaacaggcctgcaggacaacgacctgaaacggctcctcaacctcaatcaaacaatattcctaatcttggatttggtcatatgggaggatttttttccaacagctactgctagatttggtaactntacaatgtcagctggttttggtggattgttcccttcgttactcagcttccagtttcatggattctctgatccgacagcgtatcctaccacatcaaattacccatttggatatactcctgc

SEQ ID NO: 5537 - DNA, 638 bp, Artificial
  Synthetic
tctctctctccctatctccccctctatctcaacactcgccggaatcaagaacccgtctgtatctccggcgaaagttctctatccgacaaagggtttttctcttttttgaacttttcttctctttacccatcaaacaaatagtaatccctttaattctgtttatagaaatatagattttctcttgaagtttcagcagggaaaccttctaaaagaagcttttactgggtatccatttgttttctttgtttttttaaatttagaacttggcttgaatagcgatggctgattcagacaacgagtcaggaggacacaacgctggaaacgaaggatcaactagggaacaagacaggtttttaccaatagcaaacgtgagcagaattatgaaaaaagccttaccagcaaacgcaaaaatctcaaaagacgctaaagaaacagttcaagaatgtgtatctgagttcatcagtttcattaccggagaagcaagcgataagtgtcagagagaaaaaaggaaaacaatcaacggtgatgatttgctttgggctatgacgactttagggtttgaagaatacgttgagcctttgaagatttatttggctaagtatagggagatggaaggggaaaagactactatgggggga

SEQ ID NO: 5538 - DNA, 494 bp, Artificial
  Synthetic
ttattaagaaaaatgatgggaaaattgatgtcccatcgtagtcaccatgccaccaccgtacatcggagctcctccacttccacttccagctccaccgcctcctcctccaccttccttatcgccttgtctccctgccgtagtagtcttctctccttccacctccctatacttttgcagataaaccttgagaggctccacgtagtcctcaaaccctggcgtagtcatcgcccaaagaagatcgtcaccgttgattgtcttcctcttctctctctgacacttgtcagaagcctcaccggtgatgaaacttatgaattccgatacacactcttgaaccgtttctttagcatccttagagatttttgcgttcgcaggaagtgctttcttcatgatcctgctaacgttagcgatcggtagaaacctatcttgctcacgtgtcgaagcatttccaccgtctttgtgtcctcctgaatcgttgtccgaatccgccatgctgc

SEQ ID NO: 5539 - DNA, 576 bp, Artificial
  Synthetic
atgcacgtcgccctattttgaacgttcggttctgtttcttccccacttctctctgccgtccgatctctgtgtgtaacgcagtcaaacaccaagctatagaagccatcacaaagcgcgccaaatacaaaataaacctccttttctcctcctcttacttgtcctctctactgatacagaaaacatacgaattttttttttttttagaaaaaaactcaatttttctcattcagctgtagggtcatctgtcaagtaactaagggttttgatagtagtgtttgaggatggcggaagcaccggcgagtccgggaggtggtggaagccatgagagtgggggtgagcggagccctcaatcgaatgtgagggaacatgataggttccttcctatagcaagcattggtcgcatcatgaaaaaaggattgcctgctaatgctaagattgctaaggaagctaaagacactgttcaggaatgtgtctctgagttcatcagtttcatcaccagcgaggcaagtgacaagtgtcagacagagaagagaaagacaattaatggagatgatttagtatgggcactgaccacct

SEQ ID NO: 5540 - DNA, 601 bp, Artificial
  Synthetic
actttctccagcgtccgatcctcacttttctccttcaatccttcattctcctctcctcgcgcccaaattacaaatccccaggtatggcggatggtcaaggatcgtcaaggtcaccggcgagtccaaacggaggaggaagtcacgagagcggtggagaccaaagccctagatctaatgtacgtgaacaggacaggtttcttcctatcgctaatattagtcgaatcatgaaaaaggcgcttcctgctaatggaaaaattgctaaagatgctaaggagactgttcaggaatgtgtttccgagttcattagcttcattaccagcgaggcaagtgacaagtgccagaaagagaaaagaaagactattaatggtgacgatttgctatgggcaatggaaactctaggttttgaagattatattgagccactcaaggtgtacctcgctcggtacagagagatggagggtgacacaaagggatctgccaagactgctgatgggtccgctaaaagagatgggatgcaaccgagtcctagttcacagcttgcacatcaaggttcattctcgcaagtaatgaattacggaaactctcagggtcagcatatgat

SEQ ID NO: 5541 - DNA, 525 bp, Artificial
  Synthetic
ccacgcgtcgtgatctatgcagcgttagcgaagcgatcgatcgaatctcctcgaaatcatgggtgatcgaagcccggacaacagctccgacgaatccggcaatccaagctcgctgtcgccgcgagagcaggatcgcttcctcccgatcgcgaatgtgagccggatcatgaagcgcggcctgccagggaacgccaagatctccaaggatgccaaggagacggtccaggaatgtgtgtcggaattcatcagcttcgtcaccggcgaggcgtcggacaagtgccagcgagagaagcgcaagaccgtcaacggggacgatctgctgtgggcgatgagcacgctgggattcgaggactatgttgagccgcttagggtttatctccacaagtaccgggagatcgagggggagaaggcaatgctggccaaggctggcgagcgcgatggccagtgcgatctgatgctcgccaggcccggcgctgtgatggctggctatggattccaccaccgctaagaaggcggcgctgctgg

SEQ ID NO: 5542 - DNA, 549 bp, Artificial
  Synthetic
  misc_feature (467)..(467): The residue at this position can be any nucleotide.
agcataagcacagggggaggcgggagcaagcaaaatttaagccctgatcggattgtggaggtttatgctatttgagaagccaaaaagctactacgcccgtttttccagaagataatgtccgtgactttgcatacgaatctgggagacatcaagtgtgaaatcttctgtgacgaagtccccaagacggctgagaactttctggccttatgtgccaataattattacgatggaaacatcttccaccggaacatcaaaggattcatgattcaaggtggcgatccaacagggacgggaagaggaggcactagcatatggggacgcaaattcagtgatgaaatccgggaatctctcaagcataatgcgaggggtattctttccatggcaaatagtggtccaaataccaatggaagtcagttcttcatttcatatgccaagcagcctcatctaaatggcatttacactgtgtntggacgggttattcacggttttgaagttttagatctgatggaaaagactccaacgggagctggagaccgtcctcttgctgag

SEQ ID NO: 5543 - DNA, 586 bp, Artificial
  Synthetic
gcggcaaaaaatccaaaggttttctttgacatattgattggcaaggccaaggctgggagagttgtgatggaactgtttaaagataagactcctaaaactgctgaaaatttccgtgctctctgcaccggtgaaaaagggattgggcagttagggaagcccttacattacaagggctcggtgtttcatcgtatcattccacacttcatgtgccagggtggagatttcaccaaaggaaatgggactggaggagaatcgatatatggtgcaaaatttgctgatgaggacttcagtgtgatacatactacacccggccttctttcaatggcaaatgctggaccaaacaccaatggatctcagttctttatcaccacggtaccaacgccttggcttgatgggaaacacgtcgtatttggcaaagttgtagacggctatagtgttgtcaaggaaatggaaaatgtgggttcagatagtgggaaaacatcatgcactgtctccattgaagactgtggggagctaaaggagaactaaatgaggagataatgtagtttttgagcaacatgtcatggtactggagttctactcacct

SEQ ID NO: 5544 - DNA, 658 bp, Artificial
  Synthetic
atctccatcttctctcccctcccctccatagctccggtagtaaggtatggctaatcccagagtgttcttcgacatcaccatcggcggcaactccgcggggcgcatcatcatggagctgtttgcggacactgtgcccaagacggcggagaacttccgggcgctgtgcaccggcgagaaaggaatcggcaagagcggcaagccgctgcactacaagggatccaagttccaccgcgtcatccccgactttatgtgccagggcggcgacttcaccgccggcaacggcaccggcggcgagtccatctacggcatgaagttcgcggacgagaacttccagaggaagcacgcggggccgggcgtcctgtccatggccaacgccggggccaacaccaacggatcccagttcttcctgtgcactgttccctgctcctggctcgacggcaagcatgtcgtcttcggcaacgtggttgaaggcatgaacgttgtcaaggacatcgagaaggtggggagcccctcgggcaggacgagcaagcccgttgtcgttgccgactgcggccagctctcttagatctatgtgtttgtctgtcgctcccgttggggatggcgatggtgttcctgctttcgtttctccttcaaatcaatgaaaaagcttattatctct

SEQ ID NO: 5545 - DNA, 704 bp, Artificial
  Synthetic
ggaaattttctgcccttgcaagcgctcgtctttctccgtcgtcgttttccggtgaacagctgtttaggaatggcgaacccccgtgtgttttttgacatcaccatcggcggcaaccctgcaggccgcatcataatggagttgtatgcggacaaggttccaaggacagcggagaacttccgtgccctctgcacaggggagaagggaattggaaagagtgggaagccactccactacaagggtagctccttccacagggttatcaacgacttcatgtgccagggtggtgatttcacgcggggggatggaacaggtggagagtccatctacggggccaagtttgccgatgagaacttttcgtgcaagcacactggtccaggcatcctctccatggccaatgcaggaccaaacaccaatggctcccagttcttcctttgcaccgtcccctgtgcatggcttgatggaaagcatgttgtcttcggcaaggtcgaaaatggaatggacgttgtcaagactattgagaaatacggatctgggagcggcaagacaaaagcccctgttgtcgttgctgactgtggccagctctcttgaagtatggttggtggctccccttagaagaataacctcttccccccctctaataagttttggagcctattcttcgctaagctttatagtatgaaggtacagggtgctcagagtaatga

SEQ ID NO: 5546 - DNA, 703 bp, Artificial
  Synthetic
gggcgcgagcaacagccgtcacctgcttcaggtgggggaagcaaaagaaagaagagcctggaggagctgcgtttggaacgactgcagagggaggagagcgaacgggccaaggcccgcaagttactgccgtcaggtggcactcggaagcactacaactcgagctttggcaacaggagttagtgattttagggttgtgttttgtaatggaagaaggcgcaccgttagtcactctggagacgtccatgggctccttcactctagagctctaccataagcatgctcccaaaacgtgccgtaattttggcgagctggccaggcagggctactacaacgacgtcaagtttcaccgcgtcatcaagggttttatgattcagggtggtgatcccactggcacaggcaggggcggagagtccatctacgggcacaagttcgaggacgagctaacgcgggagctcaagcacacgggagcgggtgtcttatccatggccaactcggggcctaacaccaacggcagccagttcttcgtaacgttagcccccacaccgtggctcgacggcaagcacaccatattcgggagagtctgcaaagggatggaagttatcaagcggctgggaaacgtacagacggacaagagcgacaggccggtgcacgacgtcacgattctcaaggccaccgtggaagactgagtcaagagctcctcaga

SEQ ID NO: 5547 - DNA, 956 bp, Artificial
  Synthetic
gcgaatcctagaaacaaattgtctccttaccttcttatcggggtcttggttttattcggaaccctaattttcattctgaaccgattgggtgataccggagtcacgtcggataaagacattaaaatcgagcaaaatgatgaggcgaaaccatcagaggatttggagcacgtgacgcataaagtgtactttgatgtcgaaattaatggaaagcctacaggtcgtattgtcatgggcctctttggaaaaattgtcccgaagacagcagaaaacttcagagctctttgcacgggggaaaaaggaactgggaaggctggaaagcctctccattacaaaggtagcactttccacaggatcataccgagcttcatgatccagggaggcgatttcactcgtggtgatgggcgaggtggagaatctatatatggtgaaagctttgcagatgaaaacttttatctaaaacacactgtacctggtattctgtcaatggcaaatgctggaccggacaccaatgggtctcaattctttatcacaactgtaaccactggctggttggatgggcatcatgttgtctttggcaaggtgctgtctggcatggatgttgtctacaaaatcgaagcagaagggagaggaagtggaaccccaaaaagcaaagttatgatatcaaatagcggtgaactccttaatgatccaactttccatgtatcaaaacacctcagatgttttgataatgcttgccctcgagcaaaagtcagtttcatatgctgtcaagaaatctgttatgcgactattgcggcctgtaaagttaaaacaatcctctcaaaagaggatcaagactgctgtgcttagaatagacggctcgttttatgaaaattgttataaaacctttgcttctatatgtatttcataaaagattttgaatgaattcatggtaatatataccagaggtatattgaaaa

SEQ ID NO: 5548 - DNA, 738 bp, Artificial
  Synthetic
cccgaggcgtccgcttcttcagtcttttagagatctcacgtttcaaacaacaagaatggcgttccctaaggtatacttcgacatgaccatcgacggccagcccgcgggaaggatcgtgatggagctgtacaccgataagactcccaggactgccgagaatttcagagctctctgcaccggagagaaaggtgttggcggtaccggaaaaccccttcacttcaagggatctaagtttcaccgtgtgatccctaacttcatgtgccagggaggagatttcaccgccgggaacggaacaggcggtgagtcgatctacgggagcaagttcgaggacgagaatttcgagaggaagcacaccggaccggggatcctgtcgatggcgaacgccggtgcaaacacgaacggatctcagttcttcatctgcaccgtgaagaccgattggcttgatgggaagcacgtggtgtttgggcaggtcgtggaaggcttagacgtggtaaaggccatcgagaaggttggatcatcatctggaaagccgacgaagcctgtggttgttgccgattgtggtcagctctcttaggatcttcctatcatcatccttaatttagcatcatcgtcgtcattgtggtgtctctttatgcttttgcttttgttatggagtcgttttaaaatttgtagtcataagtttggtgtgtgttctcatgggaacatatataaacttgcccctttaatattaactccccc

SEQ ID NO: 5549 - DNA, 391 bp, Artificial
  Synthetic
cccacgcgtccgacagaacctaatcttcttctccaatcaatctcagagaaaaaaagaaatggcaacaaaccctaaagtctacttcgacatgaccgtcggtggcaaatccgccggtcgtatcgtgatggagctttacgccgacacaacaccagaaaccgccgagaatttcagagcactctgtaccggagagagaggaatcggtaaacaaggtaagccattacactacaaaggatcaagctttcaccgagtgattccgaaattcatgtgtcaaggaggtgatttcacagccgggaatggtaccggaggtgaatctatctatggatcgaagttcaaagacgagaactttatcaagaaacatacaggaccaggtattttgtctatggctaacgct

SEQ ID NO: 5550 - DNA, 393 bp, Artificial
  Synthetic
tcgatttctctcttccaaatctcccaaaagatgtcgaaccctagagttttcttcgacatgagtctcagcggtactcccatcggacggatcgagatggagcttttcgctgatacaaccccaaacacggcggagaatttccgtgctctctgtaccggcgagaaaggaatgggaaagctaggtaagccacttcacttcaaaggatcgatcttccaccgtgtgattcccggattcatgtgtcaaggaggtgatttcaccgccaagaacggaaccggtggtgaatcgatctacggtgctaagttcaaggacgagaactttatcaagaagcatacaggagctgggattctctcaatggctaactctggtcctaacactaacggatctcagttcttcatc

SEQ ID NO: 5551 - DNA, 746 bp, Artificial
  Synthetic
cccacgcgtccgcacaacaaacctcttcttcagtcttttagagatctcacgtttcaaacaacaagaatggcgttccctaaggtatacttcgacatgaccatcgacggccagcccgcgggaaggatcgtgatggagctgtacaccgataagactcccaggactgccgagaatttcagagctctctgcaccggagagaaaggtgttggcggtaccggaaaaccccttcacttcaagggatctaagtttcaccgtgtgatccctaacttcatgtgccagggaggagatttcaccgccgggaacggaacaggcggtgagtcgatctacgggagcaagttcgaggacgagaatttcgagaggaagcacaccggaccggggatcctgtcgatggcgaacgccggtgcaaacacgaacggatctcagttcttcatctgcaccgtgaagaccgattggcttgatgggaagcacgtggtgtttgggcaggtcgtggaaggcttagacgtggtaaaggccatcgagaaggttggatcatcatctggaaagccgacgaagcctgtggttgttgccgattgtggtcagctctcttaggatcttcctatcatcatccttaatttagcatcatcgtcgtcattgtggtgtctctttatgcttttgcttttgttatggagtcgttttaaaatttgtagtcataagtttggtgtgtgttctcatgggaacatatataaccccgcccctttaatattaactcc

SEQ ID NO: 5552 - DNA, 611 bp, Artificial
  Synthetic
  misc_feature (166)..(166): The residue at this position can be any nucleotide.
atggcgccgaatccgcgctgctacatggacatcaccattggaggcgagctggaggggcggatcgtcgtggagctcttcgcggatgtcgtgccgcggactgcggataatttccgggcgttgtgtactggcgagaagggcgctggctccactggatgcccgctgcatnattttggcgtgactttccatcgcgtgatcaaaggtttcatgatccagggaggcgacttcaccgccggcgatggaaccggcggcgagtccatctacggcctcaagttcgacgacgagaacttcaagctcaagcacgaacgcaaaggcctgctgtccatggccaactccgggcccaacacgaacggctcccagttcttcatcaccaccgctagagcgtcacatctcgacggcaagcacgtcgtcttcgggaaagtcctcaaaggcatgggtgtggttcgtagcatggagcatgccatcaccgacgacaaggaccggcccgtgaatccgctggtggtggccgactgtggagagcttccacaaggagctgacgatggtgtgtcgctcttctggaaggatggcgatgtgcttccggactggccggctgacttgcccgagcagccggagga

SEQ ID NO: 5553 - DNA, 695 bp, Artificial; identical to SEQ ID NO: 4857
  Synthetic

SEQ ID NO: 5554 - DNA, 643 bp, Artificial; identical to SEQ ID NO: 4855
  Synthetic

SEQ ID NO: 5555 - DNA, 656 bp, Artificial; identical to SEQ ID NO: 4854
  Synthetic

SEQ ID NO: 5556 - DNA, 652 bp, Artificial; identical to SEQ ID NO: 4849
  Synthetic

SEQ ID NO: 5557 - DNA, 838 bp, Artificial
  Synthetic
cccacgcgtccggaagaaaatatactactttttggggatatcaagaaaccaaaaaaggagatttgagatagacaagaaagagaggccaaagttaagcaataagcatacaccgccagccccaaaaatctaagcatcggccaaatggcagcagcagcttctacttcaatggcagctactgccgtctttgcttctcgtttcccactttcctccaccaccaaagccgcccctgttcgctgctccgccttgccttacctcccaccctgtctttctgctactgccttctcatcttctctcaagtttgctgaacccaagagggcttcgctactccaggtcaaagcctcttcatcagaagaatccggtgctgttgataccagtgaattgttgacagatctaaaagaaaagtgggatgctgttgaaaacaagtctacagttatagtatatggaggtggggcaattgttgcagtttggctgtcttcaattgttgttggtgctatcaactcagttcctttgctcccgaaaataatggagctggtgggccttggatacaccgggtggtttgtctaccgctatcttctattcaagtcaagtagaaaagaattggcagaagacattgagcaattgaagaagaagattgcaggaactgaataaatgcacataaatggcaatgccagttcagactgttaaattttctgtacaagaggcatctgctcgtgtgaagtagagtagattttgttgtaattttcttctattctgagcaaatcttcaaataaaataatgtatttaccttacagttcattgtgcttataaattatatagcagtatccactctgtttctatg

SEQ ID NO: 5558 - DNA, 754 bp, Artificial; identical to SEQ ID NO: 4859
  Synthetic

SEQ ID NO: 5559 - DNA, 226 bp, Artificial
  Synthetic
ggacataaaattcccagaagaaaatatactactttttggggatatcaacaaaccaaaaaggagatttgagatatacaagaaagagaggcccaagttaagcgtacacagccagccccaagaatctaagcatcggccaaatggcagcagcagcagcttctacttcaatggcggctactgccgcctttgcttctcgtttcccacttttctccaccaccaaagccgcccc

SEQ ID NO: 5560 - DNA, 672 bp, Artificial
  Synthetic
ggcactcgcacggagagagagagagagaaaggaagaggagatagatagatagatagatagatagagagagagagaagagccatggccacagcttccatggtttccttgcaggccacagccatggccttccccttttcaccttcaacatctcgccactcccactcccattccccttcacttgccttcacaagaatgcccccccccgccaaccctctcaagccctccctcttcatcccgtcaggcagtgtaagattttcaccgctatctataaaagcggtatcgacggaggaaaaacagtcaatgtcggaaactacagccccagcagaggattttttggcggacttacaagaaaagtgggataaattggagaacaagtcgactgtttttatctatggcggaggtgctttggccaccatatggatatcatcaatagtcgctagtgctgttaattcggttccattgcttcctaaggtccttgaactcgttggtcttggctacactgcatggtttgtgtataagtaccttctgtttaaggaaaacaggaaagagctagtctccgacattgaggatttgaagtcaaaaataatcggtgggtcccgtaaagaggagtaagccgaaaagatttagtccttgtctaggggtcagccattccctcctttagttcctttattt

SEQ ID NO: 5561 - DNA, 654 bp, Artificial
  Synthetic
tcttcaaaattactccaaaccttctcttaacctaaaatctccatttctctcctcaaatggcaccaaaagctgagaagaaacacgccgagaaaaagccggccgctgagaaaaccccggtcgccgagaaagcaccagcagagaagaagcccaaggccggaaagaagctcccaaaggacgctggtgctgccggagacaagaagaagaagagggcaaagaagtcagttgagacctacaagatttacatcttcaaggttctgaagcaggttcaccccgatatcggtatttcaagcaaagccatgggtatcatgaacagtttcatcaacgatatctttgagaagcttgctcaggaatcttctagactcgctcggtacaacaagaagccaactatcacttctcgggagattcagactgctgtgagacttgtacttcctggtgaattggctaagcatgctgtctctgaaggaactaaggccgttaccaaattcactagctcttgaacaattttatggtttcaatgtttaattttactgtctttagggtttgtgttaggtgtaaaaacagttgcttttaattaattagtgtctagtttcctttgatctgtaacgcttgttatgtaatcgatagctaaacatctatgaaattcataagcttttt

SEQ ID NO: 5562 - DNA, 733 bp, Artificial
  Synthetic
ccccccccgacaaaatccaatctccaaatcagaaacacactcgcctcgcctcctttcgctcgtttcgtccaacaccaccaccaccaccaccgatctcgatggcgcccaaggccgagaagaagcccgcggagaagaagccggcggaggagaaggccggcgagaaggcgcccgcggccgggaagaagcccaaggccgagaagcggctgccggcgtccaagggggagaagggcggcgagggcaagaaggagcgcggcaggaagaaggccaagaagagcgtcgagacctacaagatatacatcttcaaggtgctcaagcaggtgcacccggacatcgggatctcctccaaggccatgtcaatcatgaactcgttcatcaacgacatcttcgagaagctcgccggcgaggccgccaagctcgccaggtacaacaagaagcccaccatcacctccagggagatccagacctccgtccgcctcgtcctccccggcgagctcgccaagcacgccgtctccgagggcaccaaggccgtcaccaagttcaccagctcttaggcgctctagtgtagtaggtgtttggtgattttctcttcgttttcgtcgtagcgagtccatggcagcggtggtagttgccctgtcgatctctgatttctttctcttgtgtctagtgttcctgtctagtgcttgctgattactgtaagaatctcttggttgtgcccgttgagttctgatcttaa

SEQ ID NO: 5563 - DNA, 713 bp, Artificial
  Synthetic
gcccttttgccattttgattatcaacacttgaaatctacatcgattgcatcaacttaatccaaaatgcctcccaaagctgccgacaagaagcccgccgccaaggccccctcaaccgccagcaaggctcccgagaagaaggacgctggcaagaagaccgccgcttctggcgagaagaagaagcggtcaaagactcgcaaggagacctacagctcctacatctacaaggtcctcaagcaggtccaccctgacaccggtatttccaaccgtgccatgtccatcctcaactcgttcgtcaacgatatcttcgagcgcgttgctaccgaggcttccaagctggctgcctacaacaagaagtccacaatctcttcccgagagatccagacatctgtccgattgatcctgccgggtgaattggccaagcacgccgtctctgagggcaccaaggccgtcaccaagtactcttcatccacgaaataaagggtcaagatggctggttctgatttcaaatctgaaaacttgggtttttgtttgcgtgactttagtgtctttactcgagacgatgggtgactgtgtttcgcctttgggatctcttaatgcgttacggatggtttgctttatgggggcaatgtcttcacggtcaatggggttcgcggttgtacaatagctatcgaggatatctcgaagcaatggtttctgcacattatgctattat

SEQ ID NO: 5564 - DNA, 248 bp, Artificial
  Synthetic
cccccccccgaaccgcaaatcttgcgatccacacacagcaaaagaaccaccaccgtttccccttcccgagaagaagagagcagcatccatggcgcccaaggcggagaagaagccggccgcgaagaagcccgcggaggaggagcccgcgggggagaaggccgagaaggccccggcggggaagaagcccaaggcggagaagcgtctccccgccggcaagggcgagaagggcagcggcgaggggaagaagg

SEQ ID NO: 5565 - DNA, 735 bp, Artificial
  Synthetic
ccccgacaatccaatctccaaatcagaaacacactcgcctcgcctcctttcgctcgtttcgtcgaacaccaccaccaccaccaccaccgatctcgatggcgcccaaggccgagaaaaagcccgcggagaagaagccggcggaggagaaggccggcgagaaggcggagaaggcgcccgcggccgggaagaagcccaaggccgagaagcggctgccggcgtccaagggggagaagggcggcgagggcaagaaggagcgcggcaggaagaaggccaagaagagcgtcgagacctacaagatatacatcttcaaggtgctcaagcaggtgcacccggacatcgggatctcctccaaggccatgtccatcatgaactccttcatcaacgacatcttcgagaagctcgccggcgaggccgccaagctcgccaggtacaacaagaagcccaccatcacctcccgcgagatccagacctccgtccgcctcgtcctccccggcgagctcgccaagcacgccgtctccgagggcaccaaggccgtcaccaagttcacctccgcttaggcttttcctctgtcctcctgtctcgtcttgtcgctgctaatgctagttgtagttgtggtaggttgcagatttggatagtttggtactgtggtgtatttaccctggctattgactatcttggtggataaggaacactatcattgttattatggagaaatagtagttatgctactttaat

SEQ ID NO: 5566 - DNA, 634 bp, Artificial
  Synthetic
aaattaagtagatttcatagccgtgccataaattaaaaccctaattcccatattacataaccctcaaagatacccaaaagcataaaccctatttcacattccaactactactactacttctcctccattacaaaaccacattccaaatctaagaactcgtaaacttcgtaaccgccttagtcccttcagaaacagcatgtttcgccaactctccaggcaacacaagtctcaccgcagtctgaatctccctagaagtaatcgtcggcttcttgttgtacctcgcaagcttcgaagactcaccagcaagtttctcaaagatatcattgatgaaactgttcatgattcccatggctttgctggagattccgatatctggatgaacttgcttcaacaccttgaagatgtagatcttgtatgtctcaacgttcttctttgatctcttcttcttcttgtctccggcgccggctggttccttcgggagtttctttccggcttttggtttcttctctgccgctgctgctggttcggctgccggagttttctctgccggtttcttctccgctggtttcttatctgccttcgccattttcaaacttttctagggagtgagttttttttgctgcggacgcgtggg

SEQ ID NO: 5567 - DNA, 363 bp, Artificial
  Synthetic
tgctttttcttgttcacccagaaaagtaaaacaaaagtcaaaacaatggcgccgagagcagagaagaagcccgcggagaagaaaccagccgtcgagaaaccagtagaggagaaatcaaaagccgagaaagctccggcggagaagaaaccaaaagccggcaagaaactcccgaaggaagccggggccggcggcgattagaagaagaagatgaagaagaagagtgtggaaacttacaagatctacatcttcaaggttctgaaacaagttcatccagatattggtatttcaagcaaggctatgggtattatgaacagtttcatcaacgacatcttcgagaaattggcatcggaatcttcaaagctc

SEQ ID NO: 5568 - DNA, 336 bp, Artificial
  Synthetic
ggccattacggccgggaagaagctcccaaaggaaggcggagcagcaggagctgacaagaagaaaaagaggggaaagaagagcgttgaaacctacaagatttacatcttcaaagtgctgaagcaagtgcaccctgatattggtatttctagtataataagaagcctactattacttcaagggaaattcagactgctgtgaggcttgtgttgcctggggagttagctaaacatgctgtttctgaagggactaaggctgttacaaagtttactagctcttaggttctcattttgggaattttggatgattgtaaagcttcttttaatgatgtgtctgat

SEQ ID NO: 5569 - DNA, 658 bp, Artificial
  Synthetic
ggaaagtaagtggtagtagaagataggagatagctctagaaggggagaaaagctctcgtctgttttgatcgatcgatccatttccatccatcttttcgacctcgacctcgacctctcacaatggccaaggcggcggagaagaagcccgtagctgagaaggtgccggcggagaagaaggcggcggagaagaagccgcgggcggagaagaagacgccggccaaggacccgtcggcggcgacggacaagaagaagcgcaagatgaagaagagcgtggagacgtacaagatgtacatctacaaggtgctcaagcaggtgcacccggagacgggcatctcgtccaaggccatgggcatcatgaacagcttcatcaacgacatctttgagaagctggcgcaggaggcgtccaggttggcccgctacaacaagaagcccaccatcacgtcgcgggagatccagacggccgtccgcctcatcctccccggggagctcgccaagcacgccgtgtccgagggcaccaaggccgtgaccaagttcaccagctcttgagctctctctctctttttccgtttggaattggaatagttattatagcctctttctttctgtaactcgcttgtatacacgcatgcatttcgcttttgaaatctacttccatcca

SEQ ID NO: 5570 - DNA, 530 bp, Artificial
  Synthetic
tggtttatccatcttcgtcgggctttcttccttgcacctgcagctatggctcctaaagctcccgaggccgagaagacgtctgcctccaaggccgagaagaagcccgccgagaagaagcccaaggccgagagcaagccgaagcctgccgggaagaagcctaaagattcaacccctaaggttaaggacccctccaagaagaagcataagaagaagagtacagagacgtacaagatctacattttcaaggtcttgaagcaggtccatcccgacactggcatctcctccaaggccatgggcatcatgaactccttcatcaatgatatctttgagaagattgcgcaggagtctgctcgccttgctcgctacaacaagaagccaacaatcacatcccgggagattcagacagcagtgagactcatcctgcctggagaattggccaaacacgcagtctctgagggtaccaaggctgttaccaaattcactagtgcatagggtttgggtttccttttcctttccttcccctttttctg

SEQ ID NO: 5571 - DNA, 722 bp, Artificial
  Synthetic
cgaactccacgcgaagggaaaaggtcttcctcctcctcacgaatcccgcctctctctctctctctctctctctctctctctctctctctccatttgagccgatccctcgagaggcagctccgatggcgcccaaggcagagaagaagccggcggagaagaagcccgcagccggcgaggagaagtcggcggagaaggcgccggcggggaagaagcccaaggcggagaagcggctgccggcgtcgaaggcgtcgtccaaggagggcggcgccggcgacaagaaggggaggaagaaggcgaagaagagcgtcgagacctacaagatctacatcttcaaggtcctgaagcaggtgcacccggacatcggaatctcctccaaggccatgtcgatcatgaactccttcatcaacgacatcttcgagaagctcgcgcaggaggccgcccgcctcgcccgctacaacaagaagcccaccatcacctcccgcgagatccagacctccgtccgcctcgtcctccccggcgagctcgccaagcacgccgtctccgagggcaccaaggcggtcaccaagttcaccagcaactaggcctgtctctctagggtttcgatgccatgcttctctccttccctttcccctcgtgtgcagtgtgctaggtggcagtagttgcaaacttgtgcctgctttgtaaattgtgcttgatcataatgggcagcttggatttgaagt

SEQ ID NO: 5572 - DNA, 646 bp, Artificial
  Synthetic
aaaatctttaaatcttctttttctccattactaaacccggatttcggttgtaaaattcagtttcaatggcaccaaaatcagagaaaaagccagcggagaagaaaccagtagcagcggaggagaaaaaggccgaaaaagcaccagcagagaagaaaccaaaggcaggaaagaagcttccagaagcaggcgcatctggtgctgacaaaaagaagaagagattaaagaagagtgttgagacttacaagatctacattttcaaggtgctgaaacaagttcaccctgatattgggatttcaagtaaggcaatggggataatgaatagttttattaatgacatatttgagaaacttgctcaggaatcttctagattggctaggtataataagaagccgacaattacatctagggaaattcagactgcggttaggcttgttttgcctggtgagttggctaaacatgctgtttctgaaggtactaaggctgtcaccaagtttactagttcttagatttgggatttgggcgtctttagggaatgtaaaggttgggtactgttgtgggggttgaaaaatgttaggttgttaagtttttgcttgttcaatgatgtattgaatatgaatatgaatgaaccgttttgatgaaatttctg

SEQ ID NO: 5573 - DNA, 659 bp, Artificial
  Synthetic
gcgattcaagacctcacatttctcctactctctctcatatttcatttctctctctagtgtttccacaatggcaccaaaagccgagaagaaacccgccgagaagaagccagcagctgagaaggcaccagtagcagcaggtgcagcggagaagaagccaaaggctgggaagaagcttcccaaggacggtgccggagcagctgcaggagacaagaagaagaagaggttaaagaagtctgttgaaacttacaagatctacatcttcaaggtgttgaaacaggttcatcctgatattggtatctctagtaaggctatggggatcatgaacagctttattaatgacattttcgagaagctggctcaggaatcttctagattggcccgttacaacaagaagcctactatcacttctcgggagattcagactgctgtgaggcttgtgcttcctggtgaattggctaagcatgctgtttctgagggtaccaaggctgttactaaatttactagctcttaatcaattttagagtttgtgttttgattagggtttgtagatgtaaagaattgtccaattagggttgcatttgacatttgtggcatgtaatggacatctatattatgaatgaagagttttctgttttctttgttaaatttgcttggttatg

SEQ ID NO: 5574 - DNA, 638 bp, Artificial
  Synthetic
tcctcacgatcactccaaaccttctcttaacctaaaatctccatttttctctcctcaaatggcaccaaaggctgagaaaaaacccgccgagaagaagccggccgctgagaaaaccccggtcgccgaaaaagcaccagcagagaagaagcccaaggccggaaagaagctcccaaaggacgcaggtgctgccggagacaagaagaagaagagggcaaagaagtcagttgagacctacaagatctacatcttcaaggttctgaagcaggttcaccccgatatcggtatttcaagtaaagccatgggtatcatgaacagtttcattaacgatatctttgagaagcttgctcaggaatcttctagactagctaggtacaacaagaagccaactatcacttctcgggagattcagactgctgtgagacttgtacttcctggtgaattggctaagcatgctgtctctgaaggaactaaggctgttaccaaattcactagctcttgaagaattttagggtttcaatgtttaattttactatatttaaggtttgtattaagtgtaaaaatagttgcttttaaataattattgtttagcttcctttgatttgtaatagctaattatctatgaaattcaccagcttttt

SEQ ID NO: 5575 - DNA, 701 bp, Artificial
  Synthetic
ccccctgatcacaaatcaagctcacacacccagcgaaatccaagaagagagaagcagccatccatggcgcccaaggcggagaagaagccggcggcgaagaagcccgcggaggaggagcccgcggcggagaaggccccggcggcggggaaaaagcccaaggcggagaagcggctccccgcggggaagggcgagaagggcggcgccggcgaggggaagaaggccgggaggaagaaggggaagaagagcgtggagacctacaagatctacatcttcaaggttctcaagcaggtccaccccgacatcggcatctcctccaaggccatgtccatcatgaactccttcatcaacgacatcttcgagaagctcgccgccgaggccgccaagctcgcccgctacaacaagaagcccaccatcacctcccgcgagatccagacctccgtccgcctcgtcctccccggcgagctcgccaagcacgccgtctccgagggcaccaaggccgtcaccaagttcacctccgcttaggcttttcctctgtcctcctgtctcgtcttgtcgctgctaatgctagttgtagttgtggtagtttgcagatttggatagtttggtactgtggtgtatttaccctggctattgactatcttggtggataaggaacactatcattgttattatggagaaatagtagttatgctactttaatc

SEQ ID NO: 5576 - DNA, 653 bp, Artificial
  Synthetic
attatacttctctatatcaaatctctaaattttactctgtgtctttaaaattttcaatggctcctaaggcagagaagaagcccaccgagaagaagccggctgaggagaaagctccggcggagaagaagccaaaggccgggaagaagcttccggcgaaggatggcgccagtggtgcagacaagaagaaaaagaaggctaaaaagagtgttgaaacctacaagatctatatctttaaggtgctcaagcaagttcatccagacattgggatctcgagcaaggctatggggattatgaacagttttatcaatgatatttttgagaaattggctcaggaatcttctagacttgctaggtataataagaagccgactattacttccagggaaattcagaccgcggtcagattggtgctgcccggtgaattggctaagcatgctgtttctgaaggaaccaaggctgtgactaagtttaccagttcttaatttttttagcttatgttgggtaattcgaaaaattagggttatttttgggaaattagagtaagggttatctggtgaaattccgaaagctagtttctttctttcttttgtgttctgattttctattgtaactaaactgttgttgctaagtgaatgaacaaatctacttttgcg

SEQ ID NO: 5577 - DNA, 682 bp, Artificial
  Synthetic
taacttgccctgccccgttgtgtcatctctatttttctgcatccgacggaattgtcctcgattagctgtagtagctatggcgcccaaagctcccgcagcggctgagcccgagaaggcggccccgtcgaaggccgagaagaagcccgccgagaagaagcccaagatcgagaagaagccaaagcctgcagggaagaagcccaaggattccacccctaaagacaaggacccgtcaaagaagaagcataagaagaagaagagcactgagacctacaagatctacatcttcaaggtcctgaagcaggtccatcctgacactggcatctcctccaaggccatgggcatcatgaactctttcatcaatgacatctttgagaagattgcgcaggagtctgcgcgccttgcccgttacaacaagaagcctacaattacatcccgggaaattcaaacagcagtgaggttaatcctgcctggagaattggccaaacatgctgtctctgagggcaccaaggctgtcaccaaattcactagtgcctagggtacccccctgccttctgcttacatgcgatgttttgtcccttgacactctgccttttttctgtaaagtttttttcccccctgctctttgactctttattagggttactacttggaattctgttaacttgtttaaactttagcaatt

SEQ ID NO: 5578 - DNA, 665 bp, Artificial
  Synthetic
aattcttcaattcactatcaatagattcgctttctctctatcttttcactacagaaagttcagttctcgattccaaagtttcaatggcaccaaaagcagagaaaaagccagcggagaagaaaccagtagcaacagaggagaaaaaggccgaaaaagcaccagcagagaagaagccaaaggccggaaagaagctaccaaaggaagcaggcgcatctggtgctgataagaagaagaagagagcaaagaagagtgttgaaacttacaagatctacattttcaaggtgttgaaacaagttcaccctgatattggaatttcaagtaaggctatgggaataatgaacagtttcattaatgatatatttgagaaacttgcccaggaatcttctagattggctaggtataataagaagcctactattacttctagggaaattcagactgctgttagacttgttttgcctggggaattggctaaacatgctgtttctgaagggactaaggctgtaaccaaatttactagttcttagattttggatttggtggattttggggaatgtaaaggttgggtactgttgttggggctgaaaaatgttaggttttgaagtttttgcttgttcaatgatgtattgttgaatatgaatatgaatatggatgaattgtttttg

SEQ ID NO: 5579 - DNA, 607 bp, Artificial
  Synthetic
ttctcaatactcaagtatctaatccactttctgtgaaatctcacaacaatggcaccaaaggcagagaaaaagccagctgagaaaaaaccagtagcaacagaagagaaaaaggcagagaaagccccagcagagaagaaggccaaagccgggaagaagctcccaaaggaaggcggagcagcaggagctgacaagaagaaaaagaggggaaagaagagcgttgaaacctacaagatttacatcttcaaagtgctgaagcaagtgcaccctgatattggtatttctagtaaggcaatggggataatgaacagttttattaacgatatttttgagaaacttgctcaagaatcatctaaattggctaggtataataagaagcctactattacttcaagggaaattcagactgctgtgaggcttgtgttgcctggggagttagctaaacatgctgtttctgaagggactaaggctgttacaaagtttactagctcttaggttctcattttgggaattttggatgattgtaaagcttcttttaatgatgtgtctgatttgtgtttgtccttgtacgaatgaagtaatgcaaatgaatgaatggttttgtccaact

SEQ ID NO: 5580 - DNA, 714 bp, Artificial
  Synthetic
aaaaagcagcattcaaatttccttcacatttttctctttgtaaacacattttgtttcaatggcaccaaaggcagagaagaagccagcagaaaagaagccggtggaggagaagaaaaccaccgtcgccgagaaaactccggcggagaagaagccaaaggccgggaagaaactcccaaaggacggcggtgccgctgccggagataagaagaagaagaaggccaagaagagcgttgagacttacaagatctacattttcaaggtgctcaagcaggttcatcctgacattgggatttcaagcaaggccatgggtatcatgaacagtttcattaacgatatctttgagaagttggcccaggaatcttctagattggcccgttacaacaagaagcccacaatcacttctcgggagatccagactgctgtgagacttgtacttcctggagaattggctaagcatgctgtttctgagggtactaaggctgttaccaagttcactagctcttgaaattcgtcctgatgggttgttgtgagagtagattatgagtttatggttatttttgccaaggattaaggttcagttaaatcgggtggtactttactgtattttcttttgtttttgcggggttcccatggatcttctcgatccagtttgtagttcatatttggaatacaatcctattaaagttatttcaatttcaatttttcttttggtgc

SEQ ID NO: 5581 - DNA, 1139 bp, Artificial
  Synthetic
  misc_feature (1078)..(1078): The residue at this position can be any nucleotide.
tttaccccatctctaaatctatatttgtttgacaaagatgatagaaaggaatcttggaaaatgtttgttgctccttctttgtttaaacgttgtctcaaatatagtggctgctggggctccaccaacttgtcctgctgatattggtagtgattgtggaagtgattcgggtgaatgggaaggggagttcttccctggaattccaaaaattaagtatgagggtccatctagtaagaatccactttccttcaaatggtacaatgctgaagaggaaattcttggcaaaaagatgaaggattggatgcgatttagtgttgcgttctggcatacgttccgtggcacaggagctgatccatttggtgctcctacaaagttgtggccgtgggaagatggtaccaattccctggctatggccaagagaagattgagagcaaactttgagttcctggagaaacttggagttgatagatggtgtttccatgatcgggacattgctccggagggcaaaacccttgaggaaacaaatgcaaacttggacgaagtggtggctcttgccaaagagcttcagggaaataaaattcatcttttgtggggtaccgctcagttgttcctccaacctcggtacatgcatggtgctgccactagccctgaattaggtgtatatgcatatgctgccgctcaggtcaagaaagctctggaggttacacattatcttgggggagaaaattatgtgttttggggtggtcgagaaggttaccaaagcctcctaaacacagatatggaaagagagcttgaccatatggcaagattcatggaagttgctgtcgcttacaaaaagaagattggcttcaatggaacattacttattgaaccaaagcctcaggagccaacaaaacaccagtatgattgggatgctgcaacatctgctaatttcttgcgcaaatatggacttataggagagttcaaattaaacatcgagtgcaaccatgctactttggctggtcacagctgtcatcatgagcttgaaacagcaagaattaatggtttgcttggaaacattgatgcaaatactggcgatccncaagtcggttgggacacagatcagtttttgatggatgttgctgaagcaacactggtgatgc

SEQ ID NO: 5582 - DNA, 1092 bp, Artificial
  Synthetic
ttagaggggcatgatgatgggagggagaagctgcatagggatcgttgtagggcttttgtgtctgggcattccatttgctacacaggaaaagctggttgcggaccaaacatgtggtttctccggctccgatgccgagttcttccccaacatttccaacatagagtacgaggggccgtcgagccgaaacccattggctttcaagtggtacaatcccgaagaagtcgtctatggcaaacagatgaaggactggctgaggttcagtgttgcgttctggcatactttccgaggggatggaagtgatccttttggatctccgaccaagcagtggccttgggacgatgggacaaactcgctggacatggccttcacgagaatgcgggccaactttgagttcctcaagaagcttggcgtgaatcgctggtgctttcacgatagggatatagcacccgaaggccggactctcgaggaatcgaatgccaacctggataaagttattgctctggctaagcaacttcaggaaggcacagacatcaggcctctctgggggactgcgcagctcttcaagcacccgagatacatgcatggagctgcgacaagtcccgacgctcgaatctatgcctatgccgctgctcaagtgaaaaaggctatggaggtgaccgaagagctcgggggagaaaattacgttttctggggtggccgggaaggatatcagtctcttttgaatactgatctcgataaggagctgaatcacacggcacagtttctaaaatccgctgcggagtggaaaaagaagattggtttcgacggagttctcctcattgaaccaaagccccaggaaccaacaaagcaccaatatgattgggatgctgcaactacaattggcttcctgctgaaatacggtctgaaagacgatttcaagcttaacattgaatgcaatcacgcaacactctctggacacagctgctatcacgagctggaagtagctcgaatcaacggggtcttgggaaacatcgatgcgaacactggcgatgctcagacaggctgggataccgaccagttcctcatggatattgcggaaaccacacaaatcat

SEQ ID NO: 5583 - DNA, 367 bp, Artificial
  Synthetic
cccacgcgtccgtttctctcttgcgttttcgattttattacaagaacttcgttttgggcttcatccatcgttcaaggttcgttgaaaactatgaagaaagttgagttttttatgctccttctctgcttcatcgcagcgtcatctctagtgtctgctgatccaccaacatgtcctgctgatttgggaggcaagtgtagtgattctgatgactggcaaggtgatttcttccctgaaatccccaagattaagtatgagggaccttcgagtaagaacccacttgcttacaggtggtataacgctgaagaagagattcttgggaagaaaatgaaggattggtttagattcagtgttgcgttttggcatactt

SEQ ID NO: 5584 - DNA, 899 bp, Artificial
  Synthetic
gacacacaattcttttgtgctccaaagtatcagaagatgcagccattcagtgcagaagttcaccaacgtattgctagaatttctgctcatctcaaccccccaaatctccagatgggagaggggtctgtgttggaaagatcaagctgcagagcaaaaggtggggctcctggatttaaagttgctatattgggtgctgctggaggtattggccaaccacttgcaatgttgatgaagatgaaccctttagtctcagttcttcatctctatgatgttgttaatgctcctggtgttactgctgatgttagccacatggacacgggtgctgttgtgaggggttttcttgggcaaagtgagcttgaggctgcacttacaggaatggaccttgtgatcatacctgctggtattccaagaaaaccaggaatgacaagagatgatctttttaagattaatgctgggattgtgaggaccctctgtgaaggaattgcaaagtgttgtcctaatgctattgttaatttgattagtaatccggtgaattccacagttcctattgcagctgaagttttcaagaaagcaggtatttatgatccaaagaagcttcttggagttacctcactagatgttgtgagagccaatacttttgtggcagaagttttgggactagatcctagggaagtagatgttcctgttgttggaggtcacgccggggtgacaattttgcctcttctctcacaggtcaagcctccttgctccttcacacaggaggaaacagaatatttgactaagcgcattcaagatggagggacagaagttgttgaggccaaaaaaaggagctggatctgcaactctatcaatggcatatgcagctgtaaaatttgcagatgcttgcctcaagggcttaa

SEQ ID NO: 5585 - DNA, 658 bp, Artificial
  Synthetic
agtgttgttcttggagaagaatggccgcggcggcagcagcagcagcgacgagcttcgtccaggcgccatccagcgccaagcaatgcggcggatctccagcgacctccaccaggccggcgttccagagcttcgtcggcatgaaatccggcggagagtgccgccaggccgcattcttccggggcgatctgacgctgcgggatggcaagccccttgctagagctgcgaggaacggcgatgttcgtccgcgggctgcggcgagctacaaggcggctgtgcttggagctgccggggggattgggcagccgctgtcgctgctgctcaagatgtcgccgctgctctcgcacctaaatctctacgatattgccaacgtcaagggtgtggctgccgatctgagtcactgtaacaccccatcactggtgacaccttataccggagctgaggagcttgccgagtcacttaaaggcgtcgatcttattatcattcctgctggagttcctcggaagccaggaatgacaagggatgatcttttcaacatcaatgccggtatcgtcaagacacttgtcgaggcagcagcggattatgcaccaaaagcatggattaacatcatcagcaatcccgtcaactccaccgtgccaattgcggccgaggtcctcaagaa

SEQ ID NO: 5586 - DNA, 971 bp, Artificial
  Synthetic
aattacttaccttgatttctactacctctctttctcatcatagttcaaacacacaaattctcaagcccaatatgcagaacagtgcagagacctatcgacgaatcgccaccatctcagctcaccttaacccctctccttcttctcatcagatggagggaggtgtgggtttgagccgagctaattgcagggcgaaagggggttctccgggattcaaagtcgcaatcttgggtgctgcaggaggtattggtcagccacttgctatgcttatgaaaacgaatccactggtttcagttctgcatctttatgatgttgccaatactcctggtgtaactgctgacattagccacatggacactggtgccgtggtacgtggttttctagggcctcaacaattggaagatgctctcactggcacggaccttgtaataatccctgctggtgttcctagaaaaccaggcatgacaagagatgatcttttcaacattaatgcaggaattgtgaggactttatgtgaaggaattgccaagtgctgtcctaaggccattgttaacataattagtaatcctgttaactctacagtaccaattgctgcagaggttttcaagaaggctggaacctttgatccgaggagactgttgggcgtgacaatgcttgatattgtcagagccagtacatttgtggctgaagttttggggcttgatcctagggaagtggatgttccagttgtggggggtcatgctggcgttacaattctacctcttctttcccaggttaaacctccttgttcttttacgccagaggaaactgaatatttaacatctcgtatacaaaatgggggaactgaagttgttgaggcaaaagctggtgctggttcggcaactctctctatggcatatgctgcggttaaatttgccgatgcatgtttgcatggattgagaggagatgctggcattgtagaatgtgcctttgtg

SEQ ID NO: 5587 - DNA, 1070 bp, Artificial
  Synthetic
aactcctcgaaactcacgaatctatcgccaataaatgctctcctcatcttcccctctttgaacattttcattttcgactcacattttctccgccgtagcattttccttttccttttctttgttcatcacaaaccaaccaattattcaaccatgttgagatctattgcccgcagaacctcgaccaccggtgcatacctcacgcgccggggattcgcgtcggagtccgctcctgaccggaaagtagcaattttaggggcagctggtgggatcggacagcctctatcacttcttatgaagttgaatcctttagtatcacaactctcactttacgatattgccggtacccctggtgttgccgctgatgtcagccacatcaacaccaggtctcaggtttctgggtttgcaggagacgaacagctaggacaggctttggagggagctgatgttgtcatcattcctgctggtgtgccacgaaagcctggtatgacccgtgatgatctgttcaacattaatgctggtattgttaaatctctttgcacagccatcgcaaagtattgccctcatgcgcttgtcaatatgatcagcaaccctgttaactccactgtcccaattgccgctgaggttttcaagaaggctggaacctatgatgaaaagagactctttggagtgaccacacttgatgttgttagggcaaagactttctatgcaggaaaagctaaagttaatgttgctgacgtcattgtccccgttgttggtggtcatgctggcataaccatcctcccactattttcccaagccaccccaaaggcaaatttgggagatgaagaaattgaggcactcaccaagcgaacccaagatggtggcactgaagttgtggaggccaaggctggaaagggttcagcaaccctctccatggcctatgctggggccatctttgccgatgcttgcttgaaggggctgaatggggttccagatgttgtagagtgttcatttgtgcagtcaactgtgacagacctgcctttctttgcatccaaggtgagacttgggaaaaatggtgtggaggaagtgct

SEQ ID NO: 5588 - DNA, 625 bp, Artificial
  Synthetic
agaaaatcaacgaagattgactcagtctcagacaccattacttggaggggataatcctatgctgcacccctcagatttttctggtgtcactcctaagaaaagggaagttcaaacaccaaacccactcttaactccttcagcgactcctggagccactggccttactcctagaattggcatgacaccttcaagggattcttatggaatgacccccaaaggaactccaatgagggatgagctgcacattaatgaggaaatggatatgcacaataatgctaaacttgggcaacccaattcaaagaaagaattgctttctggtttgaaaagccttcctcagcctaagaatgagtaccagatagtcgtccaacaacctcatgaagaaaatgaagaaccaccagaagagaacattgaagaagacatgtctgataggattgcaagggagaaggcagaagaagaagcaaggcaacaagctttactccggaaaaggtcaaaagtattgcagagagagctccctagacctcccattgcttcactggaactaataagaagttccttattgagagctgatgaagataagagctcctttgttcctcctacactaattgagcaggctgatgaaatgatt

SEQ ID NO: 5589 - DNA, 1350 bp, Artificial
  Synthetic
ccttctccctcttctctctgtcacgtgctcggtctcggtcctttgagcttctctctctgtctctctccgattctcgctccctgctccgatgcctcgacgacctttccctttccttatctctatctctatctctctccttatccttttcgccgtcgccgcgagaccttttgctgctacgacgatctctattgtcgtcctcggcggcgtattcctcgctcccgtctctctcccttcggcgataggctttctcgctcttctccttctcggcgctgctgttgttgttgtctttgctctttgtagaaggaccaccgttgggctcttctacagtcttctccagataatcgtactcatcgaagtccatttgaggtgactttctctgccggacggccgaaggttcgttgttccgcctgtgaagaagtgctggttaggttttgacagaaaccttagatcaaaaaatcagtgtattcctctcagaaaaaaactaagcagcaaaaacatttcaagaaaatagcctaagccatggccaacatgatcatggcttcctccaaagccctaatcacttcttccattccttcatcaccaagaaccaaactttccctgccgcaaatcccaattccaaaactacccatccccaaattacccaaatccccactaaccctttccctcccatcaaatctcaagtccatttcagtcattcttgctagctcattagcctttgcacctccttcacttgctgaagaaattgaaaaagcttcactctttgacttcaatttaactctccctatcataatggctgagttccttttcctcatgtttgctttagacaaactttacttttccccattagggaaattcatggatgaaagagattctgccattaaagagaaattaaacagtgtgaaggacacttcagctgaagtgaagcaattggaagatcaagcagcagcaataatgaaagctgcaagagctgagatatccgctgcattgaacaaaatgaagaaagagacacagttggaagtggaacagaagattgctgaaggaaggaagaaagttgaagttgagttgcaagaagctttagctagtttggaccggcaaaaggaagagactattaagtctcttgattctcagattgctgctcttagtgatgagattgtcaagaaggttcttcctgttagtaactaagtaattaatctcttaaaaatttgtaattcgattttttatttgattaaagttgcataaatgtgacatactttggtactatcttatattgtgaatttatctctactggtgtacatcttgttggagcatcttattgctgctcctgatttaattttcagttgcataatttac

SEQ ID NO: 5590 - DNA, 847 bp, Artificial
  Synthetic
tttaggtcttctccgccggcggtttctccctccgccgccgaaatggtcgcctacaggttccatcagtaccaggtggtgggtcgcgcgctcccgacccccggcgatgagcaccccaagatctaccgcatgaagctctgggccaccaacgaggtccgcgccaagtccaagttctggtacttcctgaggaagctgaagaaggtgaagaagagcaatggacagatgctcgccatcaacgagatctttgagcgtaaccctacaacgatcaagaactacggcatctggctgcgttaccagagcagaacaggttaccacaacatgtacaaggaataccgtgacactactctgaatggtgctgtggagcagatgtacaccgagatggcctctcgtcaccgtgtgaggttcccctgcattcagatcatcaagaccgcaacagttcacttcaagctctgcaagagggacaacactaagcagttccacaactcgaatatcaagttcccgctcgtgtaccgcaaggtcaggccgcccaccaggaagctgaagaccaccttcaaggcatctaggccgaacttgttcatgtgatctaccagtgtgtacccatgttctgcaatttagcccaagaatcaaaagattttgtctgtggaagttttggtgccctgctggttaggcatttccagtttcatatccaaatgatgcttaggcatttccagttacccttccaaatgatgctttgcaaacccttgaatttcctcgtattagtaatcagcagacttcttgttacttcaacctggctcacttggaagtgttgatccctgatgtgctattatttatctctgtaatttgtgatggc

SEQ ID NO: 5591 - DNA, 625 bp, Artificial
  Synthetic
gtcgcggacgcgtgggtccgcctccggtttctccctccgccgtcgaaatggtcgcctacaggttccatcagtaccaggtggtgggtcgcgcgctcccgacccccggcgatgagcaccccaagatctaccgcatgaagctctgggccaccaacgaggtccgcgccaagtccaagttctggtacttcctgaggaagctgaagaaggtgaagaagagcaatggacagatgctcgccatcaacgagatctttgagcgtaaccctacaacgatcaagaactacggcatctggctgcgttaccagagcagaacaggttaccacaacatgtacaaggaataccgtgacactactctgaatggtgctgtggagcagatgtacaccgagatggcctctcgtcaccgtgtgaggttcccctgcattcagatcatcaagaccgcaacagttcacttcaagctctgcaagagggacaacactaagcagttccacaactcgaatatcaagttcccgctcgtgtaccgcaaggtcaggccgcccaccaggaagctgaagaccaccttcaaggcatctaggccgaacttgttcatgtgatctaccagtgtgtacccatgttctgcaatttagcccaagaa

SEQ ID NO: 5592 - DNA, 698 bp, Artificial
  Synthetic
gatcaataagcctttttttccctctcagatcgcgaatcgcttcaataccaattcgaagaaaaaaaaatggcatcgacttttagcggcgatgaaacggcaccgttcttcgggttcctcggtgctgcagctgccttagtcttctcctgtatgggagcagcttatggaacagcgaaaagtggggtaggggtagcatcgatgggagtaatgaggccggaattggtgatgaagtcaattgtgccagttgttatggctggagttttgggtatttatgggttaattatagctgtgattattagtactgggattaatcctaaaacaaagtcgtattatttatttgatggatatgctcacctttcatctggacttgcttgtggtcttgctggcctttctgctggtatggctattggaatcgttggcgatgctggtgttagagctaatgcacagcagccaaagctttttgttgggatgattctgattcttattttcgctgaagccttggctctttacggccttattgtcggcatcatcctctcttcccgcgctggtcaatctagagcagagtagagaaagatcttctcttgttccatatttgtgtagtatctttgtgttcttcctcgttggacgagtgagtttggctgttaaatcacattttgttttgttttgggctccaaggttatgtatttgtttgcgtggctgga

SEQ ID NO: 5593 - DNA, 801 bp, Artificial; identical to SEQ ID NO: 4875
  Synthetic

SEQ ID NO: 5594 - DNA, 947 bp, Artificial
  Synthetic
tctagatcgcgagcgccccaatcccaccaccgatcgatccattcctgctgctcgcggccaccggagaaggagagagagagagctcgacctcgtcggcgggtgaaggatcgcagcagcagcagcggcggtagagcaggaggagaggcgaagatgtcgtcggtgttcagcggcgatgagaccgcccccttcttcggcttcctcggcgccgcctccgccctcgtcttctcatgcatgggggcggcgtacgggacggcgaagagcggcgtcggggtggcgtcgatgggggtgatgcgcccggagctcgtgatgaagtccatcgtgcccgtggtcatggctggtgtgctgggtatctacggcctcatcatcgcagtcatcatcagcacggggatcaaccccaaggccaagccctactacctcttcgacggctacgcgcacctctcatctggcctcgcctgtggtctcgccggtctcgctgccggaatggccattggcatcgttggtgacgccggagtcagggcgaacgcccagcaaccaaagctgttcgtgggtatgatcctcatcctcatttttgccgaagcgcttgctctctatgggctcatcgtcggcatcattctgtcatcccgcgctggccaatctcgtgcggattaggcatgtttcaacacgcaaacccttagtgggttcttgtttcatattcctgaaactacaagctgagctctaggggtttattctgtcttagtttctgttcttctgttgggtcatgaacaaaaaaacatctgtatccaagggatgtttgcccttgtggtgccattctttttcgctatggtggtgctggcggcggtctgaatcttatttatgcacagtttttttgggtctggctagacagtgatgtaatctggtgaataagcaaataattcgtaatgcaatgggagcatgagactcttttgttc

SEQ ID NO: 5595 - DNA, 962 bp, Artificial; identical to SEQ ID NO: 4865
  Synthetic

SEQ ID NO: 5596 - DNA, 662 bp, Artificial; identical to SEQ ID NO: 4872
  Synthetic

SEQ ID NO: 5597 - DNA, 750 bp, Artificial; identical to SEQ ID NO: 4871
  Synthetic

SEQ ID NO: 5598 - DNA, 361 bp, Artificial; identical to SEQ ID NO: 4878
  Synthetic

SEQ ID NO: 5599 - DNA, 429 bp, Artificial; identical to SEQ ID NO: 4877
  Synthetic

SEQ ID NO: 5600 - DNA, 679 bp, Artificial
  Synthetic
aacagagaaaaaaaaaaacaatggcaactcaagccgccgggatcttcaactccgccataacaaccgccgcaacctccggcgtcaagaaactccactttttctcaacaacccaccgtcccaaatccctctccttcaccaaaaccgcaatccgcgccgagaaaacagattcctccgccgccgctgctgcagcccccgccacgaaagaagctcccgtgggattcacgccaccgcagctagacccaaacacaccgtctccgatcttcgctggaagcaccggtggtcttctacgtaaagcgcaagtggaagagttctacgttatcacgtggaactcaccgaaagaacagatctttgagatgccgacaggaggagcagcgatcatgagagaaggtccgaatcttctgaagctagcgaggaaagagcagtgtttagctttggggacaaggcttagatccaagtacaagatcacttaccagttttacagagtgtttcctaacggtgaggttcaatatcttcatcctaaagatggtgtttatccagagaaggcgaatccaggaagagaaggtgttggtctcaacatgagatctattgggaaaaatgttagtcccattgaagttaagtttactggcaaacaaagttatgatttgtaagatctgtaaactaaaaaaaccaaaaactatgt

SEQ ID NO: 5601 - DNA, 728 bp, Artificial
  Synthetic
ggttgtttctcaggcccagcatttgatacatcaaagatgcaggccttggcaatgcaagcgtctccaatgagcctgcgctccacgagcagcgccggcagcagcaccagcagcttcttccaaggtcagtccaagatctccatggcggcggctcctgcgcgagtgagcatgatggcgacggcagataaggcagataaggcagataaggcagctaaggcagataaggcagataaggcagctaaggcagataaggcagataaagcagcacctgcacccgcgggatttaccccaccagagctcaaggccgataccccgtccccaatctttggtggcagcacgggcggactgctgcgcaaggcacagatcgaggagttctacgtcatcacctgggaatcacccaaggagcagatatttgagatgccaaccggaggtgctgcaatcatgcgctccggcccgaacttgctcaagctggctcgtaaggagcagtgcatggcgctgggcacgcagctgcgctccaagctcaagatcaactaccagttctatagggtgttccccaacggtgaggtgcaatacttgcatcccaaggacggagtctaccccgagaaggttaaccccgggcggaagggcgtgggtgtcactctcaggtccattggcaagaattgcaaccccgtcgatctcaagttcacaggcaaggctgcatatgatgtgtaacgcttttgcgcctttggtga

SEQ ID NO: 5602 - DNA, 775 bp, Artificial
  Synthetic
tttttttttttggggggaaattatacagtaatccacatgtttaatggtacctttggaacaggaaaatacaaattaagttcaaacaataatttcattacataaccacacaacctactgcagctcgaggaaatcaactaccccttgaatattccatggctatggcaactcaagcagctctttttaccccaactctttccacctcaaaatcaagcaatttagcatggaaacaatcctcaactgtgtcattcgccagccctaaaccattcaactttgctgcaccacaacgttccattaaggcctcagctgctgaaggaaagacagaagctccagcgaaagaagccccagcaggtttcaccccaccagaattggacccaaacacaccatctccaatattcggaggtagtactggtggattgttgcgtaaagctcaagtagaggagttttacgtgatcacttgggattctcctaaagaacaagtatttgaaatgccaactggaggtgcagctatcatgagacaaggacctaacttgcttaagttggcaaggaaagaacagtgtttagctcttggaaccagattgagatccaagtacaagatcaagtaccagttttacagggttttcccaaatggtgaagttcaatatcttcatcctaaagatggtgtgtacccagagaaggtgaacccaggacgtcaaggagtcggacaaaacttcaggtctatcggaaagaatgtcagccctattgaagttaagttcactggaaaacaagcatatgattt

SEQ ID NO: 5603 - DNA, 809 bp, Artificial
  Synthetic
attctgcacaaatacatctccatttcctccacttttgtaagccaataattctacaatggccatggcaactcaagcttctctcttcactccagctctctctgcctcaaaatcttcagccccatggaaacaatcccttgcttccttctctcctaagcaactcaaatccactgcttccactccccgtcccattagagccatggccgaagaagccgccgccgccgccacaacaaaagcagaggctccagtgggctttaccccaccacaattggacccaaacacaccttccccaatcttcggtggcagcaccggcgggcttctccgcaaggcccaagttgaggagttttacgtaattacttgggaatcacctaaagaacagatctttgagatgccaactggtggtgcagctattatgagggaaggtgctaatttgctgaaattggcgaggaaagagcagtgtttagcacttggtactaggcttaggtcaaagtacaagattaactacaggttttacagggtgtttcctaatggtgaggttcaatacctgcaccctaaggatggtgtgtacccagaaaaggtgaacgctggccgtgaaggagttggacagaacttcagatccattggtaggaacaagagcccaattgaggtcaagttcactggcaaacaagtgtatgatttgtaagctgattatggtattttgtgccttttcgtgtaatgtgatgaatttgtgattatttagtgcatcatttcatgtaattttatttgccactacaaaatacagcatgggattctattattcctcccgtattatc

SEQ ID NO: 5604 - DNA, 872 bp, Artificial
  Synthetic
ccccccccgctcttctctcattctcattccgcacaaatacatctccatttcctccacttttctaagccaataattcttcaatggccatggcaactcaagcttctctcttcactccagctctctctgccccaaaatcctcttccccatggaaacaatccctcgcttccttctctcctaagcaactcaaatccactgtttccacacaccgtcccattagggccatggccgaagaagcagccgccgccacaaaagaagcagaggctccagtgggcttcaccccaccacaattggacccaaacacaccttccccaatcttcggcgggagcaccggtgggcttctccgcaaggcccaagttgaggaattctacgtaatcacttgggaatcacctaaagaacagatctttgagatgccaactggtggtgcggctattatgagggaaggtgctaatttgctgaaattggcgaggaaagagcagtgtttggcacttggtactaggctgaggtcaaagtacaagattaactacaggttttacagggtgtttcctaatggtgaagttcaatacttgcatcctaaggatggtgtgtacccagaaaaggtgaacgctggccgtcaaggagttggacagaacttcagatccattggtaagaacaagagcccaattgaggtcaagttcactggcaaacaagtgtatgatttgtaagctcattatgttgtgcctttttatgtaatgattttgtgattattcaggccatcgtttcatgtaattttatttgccactacaaaatacagcacgggattctattatttctctctcttttttttgctcttatagttactctgttctttgagggtgacaaaggatgggtatgct

SEQ ID NO: 5605 - DNA, 619 bp, Artificial
  Synthetic
aactattattactactactcttcatctctactgattgatagaggaacctcagctatggccatccaggcatcctcccagtcagtcatggcaagagcagtagccccgtccatggcctccaccctccccctctcgcccccctctgtgcgcttgtcggcgtggagtagctccgccgtccatggcatccagctccgcctcccccgccctgcttgccgtgtccgcatggcttctgaaatccctgccccggcacccaaagaagaggagaaagatgaggcgcccaaaggtttcaccccgcctactctcaacccggagacgccctcgccaatcttcgggggtagcacaggtggcctcctccgtaaggcccaagtcgaggaattctacgtgatcacgtgggagtccccgaaagagcagatatttgagatgcccaccggcggcgccgccatcatgagggagggacctaacctcctcaagctcgcgcgcaaggagcaatgccttgcacttggctcccgcctccgatccaagttcaaaatcacctaccaattctaccgcgtcttcccgaatggggaagtgcaatacctccaccccaaggatggtgtctaccccgaaaaggtcaacgctggac

SEQ ID NO: 5606 - DNA, 803 bp, Artificial
  Synthetic
gtcgcccacgcgtcgagaaaggcagtggacgtggcgtccatctagccgttgcctggctcgtctgccctaattatccatcagtgccccagccgccccagtggtttgtccgcgattcaagcttccatcgatcgatcgagagatgtctgatgacgagagcaaggaggagaaagagctggatttgtcgtcgcctgatgtggtgaccaagtataagctcgccgcggagattgccaacaaggctttgcaagctgtggtgactgagtgtaagtcgggagctaaagttgcggacctttgctccataggtgacacatacatcaagacccacaccgcgaacgtctacaagaatgccaagaagaagatcgacaaaggcgtggcatttccgacatgcgtctccgtaaacaacactgtgtgccatttctcgccgctgaatggagacaagacggctctcgttgacggggacatcgtaaagattcgtttggcagcgatctcggctgtcatatcgacggctttgcggccgtagtcgctcacacacacgtccttcagacgggtccggtgactggaagagcagcggacgtcctggcagctgcaaacaccgcagcagaagttgcgctcaggctcgtgagaccaggaaagaagagcagggatgtttccgaagcgatccaaaaggttgctgcggcttacgactgcaagatcgccgaaggcgttttgagccaccagatgaagcaattcgtgatcgatggaaacaaagtcatcctgagtgtgtcgaatccagacacccgggttgacgacgctgagtttgaggagaa

SEQ ID NO: 5607 - DNA, 602 bp, Artificial
  Synthetic
gggcaaaaccctagctcaaccctttcttgcccccactcttcctttccatcagcaaaacccaattttcgcttcggtaagcttcctcttcttctaatcccccccttcctttcatttcttcattcattcattcatttgctcttctgaattcgtttttctccatattcctttttcagcagaaattctgtaattgtatttatagacctgtttggtaactatgtctgacgacgagagagaagagagagaattggatctcaccagtcctgaggtcgtcaccaagtacaagagcgccgctgaaatcgttaacaaggctttgcaattggtgttgtccgaatgcaagccaaaagcaaagatagttgatctttgtgaaaaaggggatgcctttatcaaagagcaaagtggaaatatgtacaagaatgtgaagaagaaaattgagagaggtgttgcatttccaacgtgtatttcagttaacaaccactgtgtgtcatttctctccattgtctagcgatgagacagtactggaagaaggtgatatattgaagattgatatgggatgtcaaattgatggatttattgctgtagttggacatacacatgttcttcat

SEQ ID NO: 5608 - DNA, 648 bp, Artificial
  Synthetic
  misc_feature (131)..(131): The residue at this position can be any nucleotide.
  misc_feature (161)..(161): The residue at this position can be any nucleotide.
ttttcacgtgactctctctctttctgtctctctctctctctctctctctctcgttgtgttgaagtgtgggcatgatgagtgacgaggaggtgaaggaggagaaggagcttgacctgacctctcctgatgtngtcaccaagtataagcttgctgctgatatngctaacaaggcccttcagcttgtcatttccaactgcaaacctggtgccaagttggttgacctctgcgagaaaggcgactcctttatccgagaacaaactgggaacatatacaaaaatgccaagaagaaaattgacaaaggagttgcttttcccacgtgcatctctgtaaacagtgtgatatgccattttgcacctatggtaggtgatgaaactacacttgcagcgaatgatattctgaagattgacctgggatgccatatcgatgggtttgcggcagttgttgcacataccctagttttgcaagatggtcctatcactggaagagtagcggatgttcttgctgctgttaacactgctgctgaggtggctcttcgcttagtcagaccaggaaagaagaacaaggatgttactgaagctttgcataaagttgcagctgcttatgactgcaaggttgtggaaggtgtattgagtcatcaaatgaagcaat

SEQ ID NO: 5609 - DNA, 522 bp, Artificial; identical to SEQ ID NO: 4908
  Synthetic

SEQ ID NO: 5610 - DNA, 335 bp, Artificial
  Synthetic
cccacgcgtccgcaaaaaaacaaatgggagagaaagaggaagtgaaactattaggagtatggtacagtccatacgccataagacctaagatcgctcttcgtctcaaatcagtggattatgattacgttgaggaaaatctgtttggatccaagagtgagcttcttctcaaatcaaacccggttcacaagaaagtccctgttctcctccacaacaacaaaccgattgtcgagtctctcaacatcgttgaatacattgatgagacgtggaactcatctgcaccgtccattcttccttcacatccttatgatcgtgctcttgctcgcttttggtctgac

SEQ ID NO: 5611 - DNA, 845 bp, Artificial; identical to SEQ ID NO: 4913
  Synthetic

SEQ ID NO: 5612 - DNA, 359 bp, Artificial
  Synthetic
tggtatcaacgcagagtggccattaggccggggaaagcaagaatcagcaaatggctgatgagggagtgaaattgctaggacactggccaagcccttttgctctaagggttcattgggctctgaaacttaaaaggggttgattatgattaccaagaagaagatctcccgaacaaaagtcctttgctcctgcagtataatccagttcataaaaagattccagttctggttcataatgggaaacctattgcagaatcattagtcatacttgaatacatcgacgagacttggaagcataatcccctcctccctgaagatccttatgaaagagccaaagcgtttctgggcaaaatttattgatg

SEQ ID NO: 5613 - DNA, 640 bp, Artificial; identical to SEQ ID NO: 4892
  Synthetic

SEQ ID NO: 5614 - DNA, 521 bp, Artificial
  Synthetic
cggacgcgtgggtggcgaacctaccgattcttttggattactggccaagtatgtttgggatgagggctagagttgcgttgcgagagaaagttgttgagtttgaatacagagaggaagatttctcgaacaagagccctttactcctccagagtaatcccattcacaagaaaatcccggttctggtccacaacggtaaaccggtatgtgaatctcttaacgttgtccagtacgtcgacgaggcttggcccgagaagaacccgttcttcccttccgatccttacgggagagctcaggctcgattctgggctgatttcgtggacaagaatttcaccgacgcccaattcaaggtatgggggaagaaaggtgaggaacaagaagcaggcaagaaggaatttattgaggcagtgaagattcttgaatctgagctaggagataaaccttactttggtggagatagctttgggtatgtagacatttccttgattacattctcgagttggttccaagcctatgagaagttt

SEQ ID NO: 5615 - DNA, 609 bp, Artificial
  Synthetic
cgtccgggcttccactcaagaagtgacccttctcagcttttgggcgagccccttcaacatgcgagtcaagttggcactcacactcaaaggcatcgagcatgaagatcttccacaggatttcggcaacaagagcaagttgctgctcgactccaatcccatccacaagaagatcccggtcctcatccacaaggggaagccagtgctcgagtcagtcatcattgtcgagtacattgacgaggtatggcctggaaagtcgccgctgctgcctcaggatccattccttcgtgccgagcaccgcttctgggccgacttcatcgacaagaagatcggcgactgcttgatccgcttcctgaaaactgaggataatgccgacatcaacgaagaattcgtcgagaatcggatgcatctcgaggggccgctagagaagctcggacgcgaggaggggccgttcttcggcggcgagagcatgtcgttcctggacgtgattcttgcccctttcatcgtctggattcctgccgttggcaatgtcctgggcctcaagacgccacatgagaaatgctcgcatctacgcaagtggtttgctgccatctctgagcatcccgacgctaa

SEQ ID NO: 5616 - DNA, 495 bp, Artificial; identical to SEQ ID NO: 4899
  Synthetic

SEQ ID NO: 5617 - DNA, 665 bp, Artificial
  Synthetic
ggaagaagaagagcaatgtcgcactttgggcgatcggggccgccggacatccgcgacacctattcgctcctcgtcctcaacatcacctttcggaccgaagaactggtgactcgcggggatttgcttttgtgcgctacaagcatgccgatgaagctcaaaaggcaatcgagaggcttgacggtaagaatgtagatggaagaaatatcgttgtgcaatttgccaaatatggtcggaacgatgagtcaattcagcgtgggaaaataacatcttccagtcctatctggcgcagccgatctaggagccggagtcctaggagaggaagaagagattatgacgaccaccgagagagagatagagaccgacgacgtagccgaagccgagagagatacgagcgtgaaagataccgcgggcgtgacagtagagattaccgcaggcgtagccttagccgcagtcgcagtcgcagcagaagcagaggccgtggcggccatgactatcccgctcgtgacggccgagatggtcgtgatgctcgcgatggacgcgatgtccgcgacgggcgaaggcgatctcggagcaaatcacccgacagacaaccgtcttcagccgctgaaaggagtccgtcacctcagcctcgccgtagcgcatcgccagctccgagaagcccgtcc

SEQ ID NO: 5618 - DNA, 647 bp, Artificial
  Synthetic
atgagaagaagagcaatgtcgcactttgggcgatcggggccgccggacatccgcgacacctattcgctcctcgtcctcaacatcacctttcggaccagtgccgacgatttgtttcccttgttcgatagatatggaaaagtggttgatatttttattcccagggaccgaagaactggtgactcgcggggatttgcttttgtgcgctacaagcatgccgatgaagctcaaaaggcaatcgagaggcttgacggtaagaatgtagatggaagaaatatcgttgtgcaatttgccaaatatggtcggaacgatgagtcaattcagcgtgggaaaataacatcttccagtcctatctggcgcagccgatctaggagccggagtcctaggagaggaagaagagattatgacgaccaccgagagagagatagagaccgacgacgtagccgaagccgagagagatacgagcgtgaaagataccgcgggcgtgacagtagagattaccgcaggcgtagccttagccgcagtcgcagtcgcagcagaagcagaggccgtggcggccatgactatcccgctcgtgacggccgagatggtcgtgatgctcgcgatggacgcgatgtccgcgacgggcgaaggcgatctcggagcaaatc

SEQ ID NO: 5619 - DNA, 588 bp, Artificial
  Synthetic
gatcatctacagcctctgcaaggacaaccgtgtcgaagaggccaagaaactcatggatcaggcaatgcagaggaagtgcatgcctggagttccagtgtgcacggtgctggtggatggcctctgcaagtctcggcaagtggaggaagcttacgagatcctggaacgaatgctggaatgcggggaccgagctcccagtgtggttacttacagcactatcatcgacgggctttgcaaggcggacagactcgacgatgcctaccttgtgctccagaagatgaggagtagcggctgcgttccggacgtggtgacttacactgccatcatcgacgcgttttgcaaagttggaagactggacgaggctcgcgagctgttccagaggatgcacgagagaggctgtgcatcggacgtggtcgcctacaacatcctgatacgaggctactgccgagcggccaaagtcgacgacgccattgctatgatcgaagagatggccgcgagaggagtccagcccaacgtcgtttcgctcagcaccatcgtcgacgggctgtgcaaggaatcgagagtggaagacgcgcgacttcttatggaaag

SEQ ID NO: 5620 - DNA, 624 bp, Artificial
  Synthetic
ggtttctcacccacaccatgcacatatggccctcttcttgatggcctgttaaaagctggaaggatagaagatgcagaaaatcttttcaatgagatgctggagtatggatgcaaggccaattgcactatctataatatactactgaatggacatcgaatagctggtaatacagagaaggtctgtcatttgtttcaggatatggttgaccagggaataaacccagatataaaatcctacacgattattattgacacactctgcaaggcaggacagttaaatgatggtctaacatattttaggcaattattagagatgggtcttgaacctgatctaattacttacaatttgctcattgatggtcttggaaaatcaaaaagattagaggaagcagtttctctattcaatgagatgcagaagaagggaattgtcccgaacttgtacacttataattcactaattctccacttaggaaaagcagggaaggctgctgaagctgggaaaatgtatgaagagctactgacgaaaggctggaagcctaacgttttcacgtataacgctcttattaggggatacagtgtttccggcagtactgatagtgcctatgctgcctatggacggatgatt

SEQ ID NO: 5621 - DNA, 722 bp, Artificial
  Synthetic
cgttctcagagctcttctgctttttgcgatctctgattttgaaatttcgaactctctctcattctctgcaatttcaactaagaggaaactatgaagggaactaagattgcttccgttgctcacaagaagctcgacactgagacaatgaagaaacgcaaggctgaagcggacttgaaaaagaaggagaaagcaatcaaaaccgctggagctccaaagcgtcctcctaccgcattcttcattttcatggctgattttcgcaagagttacaaggagaattttcctgataataaatctgttgctgtggtcggaaaagctggcggtgagaaatggaaggcaatgtctgaatctgagaaagctccctatgtggaaaaagctgctaagctgaaggctgagtatgagaaaactaaggaagagcatagccagaagcctgttaatggagaagcagcaaaatctgatgattcggaggtgcatgatgatgctgagcagcaagctagctcttagagtggtacatagttcttttgctccaatgctgatatggcaagtgaaagccgctgggaaaattcatatagctaatcaagtgttaatacatagttatagctagttataactctagtattagtatatttcttctgtcgcaagtcctattatcagcttatgctcatgttcgccattttgcactgcaatgcaaagcagattatggattgagtatgcttttgattctg

SEQ ID NO: 5622 - DNA, 744 bp, Artificial
  Synthetic
ttcttttttctactcgaatccaagcttttttttatctccgttcttctccggcagacagacatttcctccgttgttctccgtcgtcctcgacatttccacctctcgtctcgcttaatcggtaaaacaagagaacaaagaaaagggaagtatggcgaaggagaaatctaccggtaagcagaaacgccaggcgaagaaggacaccaataagcctaaacggcctgcctctgctttttttgtattcatggaggagttcaggaaatcatacaaggaagctcatcctgatgtcaaaggagtttccgagattggaagagcctgtggtgaaaagtggagagagatgacagatgaggaaaaagttccttatgtatctcgggctgctgtgagaaaggcggactatgacaaggcaatgtcagcttacaacaacgaagagatgaataggtctgcccaagcgaagaccagtgcatcaaatgggcacgctgggagtgaggatgagtccgaatagcctgcctaagggagtaaatgcaggcgatactctatatatgctgtctcactgttgaccagctaatgtgcttgtggatatagtttacttaactcgttttttagttctctcaaaagatttctgctgttaaacacaaaaaactgtcaagcctcagattttcgagcaaagtttgagtagcctttttaacattttgaaacagctccacttttcttgcctgcccaagaaaattgacatggaaaagaggtaca

SEQ ID NO: 5623 - DNA, 664 bp, Artificial
  Synthetic
ttctcttttggcttttgctctgttttcttcactttcccttcagcccattacttcttagcttcctggcagttctaagttacaatgaagggtggaaaaggaaaaggggcgttgagaaaagaaacaaggtctgcactgaagcctgttgaggaccgaaagatggggaagagaaaggccgcattgaaggatgataaacggaaggccaagaaggacaaaaaggccaagaaagatcctaataagcctaagatgcctcccagtgccttcttcgtatttcttgaagaattcaggaagacatttaaaaaggaaaatcctaacgtgaaggccgtatcagctgtagggaaagctggaggagagaagtggaaatctatgagcgcagctgaaaaagcaccatatgaagccaaagcagcaaaaaggaagtccgagtatgaaaagctcatgcatgcgtacaacaacaagcagccggaaagctcagacgatgatggcgaagaagaatctgagaggtcaaaatctgaggtacatgatgatgatgcagagtgcagtggacagggtgaagaagaagaggaagaggaagaggaagatgatgaaaacgaggacgatgattgaagctatgtgcttcaatcacttggtttttgtacttattgccatctgacaagggttgagtgactct

SEQ ID NO: 5624 - DNA, 797 bp, Artificial
  Synthetic
ccccccccgctcttctcttctctggtggtgtgggtgtgtccctgtctcccctccttcctcctctcctttcccctcctctcttcccccctctcacaagagagagagagcgccagactctccccaggtgaggattcagccatgaagggggccaaatccaagggcgccgccaagcccgacgccaagttggctgtgaagagtaagggcgcggagaagcccgccgccaagggcaggaaggggaaggccggcaaggaccccaacaagcccaagagggctccctccgctttcttcgtttttatggaggagttccgtaaggagttcaaggagaagaaccccaagaataaatctgtcgctgctgtaggaaaagcagccggtgataggtggaaatccctgaccgaagcggacaaggctccctatgtagccaaggccaacaagctcaaggccgagtacaacaaggccattgctgcctacaacaagggcgagagcactgccaagaaggcacccgccaaggaggaagaggaggacgacgaggaggaatctgacaagtccaagtccgaggtcaatgatgaggatgacgacgagggcagcgaagaggatgaagacgatgacgagtgagccttccagtggacaagatgggagcagcaagacgctaagggcggcgggcgtcctaaggagcctatccatcatcatcatcatcgtctactagaattattcagtttcacttcacatcgtgatgttttactttttctctcgtcctataacggatagcgctccttgttggcgccactggtgggtgttgt

SEQ ID NO: 5625 - DNA, 862 bp, Artificial
  Synthetic
cccacgcgtccgcagtccctcacttggaaccttcttatcggtcgccccttcgcttaccgaattcatcacaacgcaccaaaggaatatacatctctttgttttctctctctagaggtttcgctatgaaaggagttaaatctaaggctggagctgattccaagcttggagtaaggaagaaggctacggagacgaagaaagcgaagaaagccacgaaggatccaaacaagcctaagaggcctccaagtgccttcttcgttttcatggaggagttcaggaagacgtacaaggaaaagcacccaagcaacagatctgttgccactgttggtaaagctggcggagatgcgtggaaaaaattgtcagatgctgagaaagcactttaccaggaaaaggctgataaaagaaaggcggaataccaaaagaacatggatgcctataacagaaaacaggctggtgatgctgaagaggaggaatcagacaagtcaaagtctgaggttcatgatgatgacgaggatgatgatggaagtgaagaggaggaggatgatgattaaaaactgaatagctgttgaattgccgaaaattatggcaaagttgatgtagggaatccctttcagccctttccttgataaatagatgccctctttttgatgtttcctttctttttgttttggtatttttcggggtttagttgggacgggataagggaaatttagatgagctgacttgatagctcgaatggcttatgtatttttattttggtggtgtttaatgaaaaattcagctacggattaccctttgttggtagtattatgaatttcatctaatccgtttcgtgatgatgcaagtttgatgccagatatatttt

SEQ ID NO: 5626 - DNA, 761 bp, Artificial
  Synthetic
tgggtgttattattattttaactttgtagggagttagtagtagcagtactggttaacagtttttgtttataatttgaactactttgcaaagaagggagggggaagagagctattacacctaatcacttaccttcaacggggcttgccatctcccgcaggcacaatgaagggagcaaaagggtcagctcttcctgccaagaaggacaacaaaggcctgtcaaagaaggctgaagaaactaacttaaagagaaagaagtcagttgcaacagaagggaaagcgaagaggcagtccaagaaacctgccaaggatcccaacatgcctaagagacctcctggtgctttctttgtcttcatggaggagtttaggaagacctacatggctgagcatcctggaactaaatccgtgtctgcggtgggcaaggctgctggggacaagtggaagtcattgtctgaagcggagaaagccccgtactctgccaaggctttgaagaagaagggcgagtacgagaagtccatgcaagcgtataaccaaaaaaagagtgcggcggaagctaaaaagtctgaggctcaggaagaggaagatgaagaggaagatgacgaggacgaggtcgaggaggatgacgacgagtagccatgttatcttcaacaaatctctctttaacccatcttttattcaaatcaggcgtgccttccttgttattggcaaggaatggaaggtctctgtttgtagaagactataacctcgtagttatcttttgtat

SEQ ID NO: 5627 - DNA, 766 bp, Artificial
  Synthetic
ttcgttgtgttgtgtgctggggtctttctctctctctctctctctctctctttcttcgtatttctcgtaatacgaagggaaactctctatagtttttagtagttacgtttttattactaacaactagtagtactactactacaacgaggcgaagctcgccatctttacgacgatctccaggcacaatgaagggagcaaaaggatctgccatacctgccaagaaagataacaaaagcctctcaaagaaggctgaagaaacgaacctgaagaagaagaaatcagtggccaaggaagcaaagccaaagaggcagtcaaagaaagctgccaaagaccctgacatgcctaagaggccgcctagtgctttctttgtctttatggagggctttcggaagacatacatggccgaacaccctggtgttaaatctgtctcaatagtgggtaaggctgctggagacaagtggaagtcactatctgaagcggagaaagccccatatgcttccaaggctctgaaaaagaaggctgaatatgagaagttgatgcaagcgtataaacaaaaaaaggttgcaactgaagctaacaagtctgcggtccatgaagatgatgaggaagaggaggaggaagaggaagaggaagaggaagaggaagatgatgaatagaatcacacatcttcaccatggttgattccagattcttggttgtgataacggagcgatggcccagtcattgcaatcctcttttggaccatctcaaaggcagtttaggttgt

SEQ ID NO: 5628 - DNA, 687 bp, Artificial
  Synthetic
gctctctctctctactccctctttcatcctcagcagccctttccctaacttgccttcttccccaacactaatcaaagcgttgatatggcaaaggagaagtctgggggaaggcaaaagaggcaacaagcgaagaaagatccaaataagcccaagaggcctgcatctgcattcttcatctttatggaggatttcaggaaatcatataaggaagcccatcctgacgtcaaaggggtttcagagataggaagagcatgtggcgagaaatggagagagatgacagacgaggaaaaggctccatatgcaactaaagctgcttcaaggaaggccgattatgatagagcaatgtcagctttcaacaatggagaggtggcaggcaagagcaatggggcaagtgctcttgctgagagtgagggggagtctgagtagaccaaatgatggaataagtgaggctctaccagaacccaggaaatgttgaatggttggttgtgccttttttactcccttcaaaactgtcctctttcatgtatcacacaccatcccttgcttaatttgctttggcaatctttacaacctcctagaaaatccatgtttctcctctttagagaggattagtttggacttcatgtatttctctgggaaacaattgcagcagctcataatctgtgggaaactatcttgtgatcattc

SEQ ID NO: 5629 - DNA, 560 bp, Artificial
  Synthetic
tttctaatacaaagaaagagagagagagagaagttgtaataacgagattactactactacaacataaaagaaagagagagagagagagatttgcaagctttttttacgacgaattgccaacccacccaggtttcttcgtcctcaggcagcacaatgaagggagcaaaaggatcagttgcagcactgccaccacctaccaagaaagacaacaaaggcatatcaaagaaagcggaagaaacaaatttaaagaaaaggaaatccgcagtgaaggaagtgaagcccaagagacagcctgtaaaagctgtgaaggacccaaataggcccaagaagcctgctactgctttctttgtctttttggaggagttcaggaagaccttcatggctgagcaccctgcggtcaaagctgtctctgtagttggcaaagctggtggagaaaagtggaagtcgctaacagaggcggaaaaaactccatatgtcgccaaggcagcaaaaagaaagactgattatgagaaaactatgcaggcatataaccagaaaaaggatgtagcagaagccgagaa

SEQ ID NO: 5630 - DNA, 622 bp, Artificial
  Synthetic
acgcgtcggtctcgttgtagcacttgggacgatgctttctctctctctctctcgttttaggaccacctcggtcgccatagctagtgtctaccctctttcatcctcagcagcccacccccccttgtattcttccctaacattacctatcacttatcaaagcgttgatatggcaaaggagaagtctgggggaaggcaaaagaggcaacaagcgaagaaagatccaaataagcccaagaggcctgcatctgcattcttcatctttatggaggatttcaggaaatcatataaggaagcccatcctgacgtcaaaggggtttcagagataggaagagcatgtggcgagaaatggagagagatgacagacgaggaaaaggctccatatgcaactaaagctgcttcaaggaaggccgattatgatagagcaatgtcagctttcaacaatggagaggtggcaggcaagagcaatggggcaagtgctcttgctgagagtgagggggagtctgagtagaccaaatgatggaataagtgaggctctaccagaacccaggaaatgttgaatggttggttgtgcctttttttactcccttcaaaactgtcctctttcatgtatcacacaccatcc

SEQ ID NO: 5631 - DNA, 513 bp, Artificial
  Synthetic
tgctggggtctttctctctctctctctctctctctctttcttcgtatttctcgtaatacgaagggaaactctctatagtttttagtagttacgttttattactaacaactagtagtactactactacaacgaggcgaagctcgccatctttacgacgatctccaggcacaatgaaggtttcaaaaggatctgccatacctgccaagaaagataacaaaagcctctcaaagaaggctgaagaaacgaacctgaagaagaagaaatcagtggccaaggaagcaaagccaaagaggcagtcaaagaaagctgccaaagaccctgacatgcctaagaggccgcctagtgctttctttgtctttatggagggctttcggaagacgtacatggccgaacaccctggtgttaaatctgtctcaatagtgggtaaggctgctggagacaagtggaagtcactatctgaagcggagaaagccccatatgcttccaaggctctgaaaaagaaggctgaatatg

SEQ ID NO: 5632 - DNA, 691 bp, Artificial
  Synthetic
  misc_feature (83)..(83): The residue at this position can be any nucleotide.
tgggtgttattattattttaactttgtagggagttagtagtagcagtactggttaacagttttgtttataatttgaactactntgcaaagaagggagggggaagagagctattacacctaatcacttaccttcaacggggcttgccatctcccgcaggcacaatgaagggagcaaaagggtcagctcttcctgccaagaaggacaacaaaggcctgtcaaagaaggctgaagaaactaacttaaagagaaagaagtcagttgcaacagaagggaaagcgaagaggcagtccaagaaacctgccaaggatcccaacatgcctaagagacctcctggtgctttctttgtcttcatggaggagtttaggaagacctacatggctgagcatcctggaactaaatccgtgtctgcggtgggcaaggctgctggggacaagtggaagtcattgtctgaagcggagaaagccccgtactctgccaaggctttgaagaagaagggcgagtacgagaagtccatgcaagcgtataaccaaaaaaagagtgcggcggaagctaaaaagtctgaggctcaggaagaggaagatgaagaggaagatgacgaggacgaggtcgaggaggatgacgacgagtagccatgttatcttcaacaaatctctctttaacccatcttttattcaaatcaggcgtgccttc

SEQ ID NO: 5633 - DNA, 684 bp, Artificial
  Synthetic
cccacgcgtccgtattttacaagcctttctccactaagcccttctctcttcttctcttggcctctcacttgaatctcccacaaagcgatcaatcacaaattccttcttctctctctttcttttcgtccccaagaatcaattatgaaaggagctaaatcaaagactgaaaccaggagctccaagctctctgtgaccaagaagccggctaaaggagcaggacgtggcaaagccgctgcgaaggaccccaacaaaccaaagaggccagccagtgctttcttcgtgttcatggaagatttccgtgagactttcaagaaggaaaaccccaagaacaagtctgtagctactgttggaaaagctgctggagacaagtggaagtccttgtctgattctgagaaagctccttatgttgctaaggctgagaaacgcaaggttgaatatgagaagaacattaaagcttacaacaagaaactggaggaaggtccaaaggaagatgaggaatctgacaagtcagtgtcagaggtcaatgacgaggatgatgctgaggatggtagtgaagaggaggaggacgatgactaagaagctgaatgttggtagcattagtatagatggctgcaaaaatctctctggttttatctttacttgaaatgttaacggggctgattaaaatgggtctttctttttatc

SEQ ID NO: 5634 - DNA, 465 bp, Artificial
  Synthetic
cccacgcgtccgtattttacaagcctttctccactaagcccttctctcttcttctcttggcctctcacttgaatctcccacaaagcgatcaatcacaaattccttcttctctctctttcttttcgtccccaagaatcaattatgaaaggagctaaatcaaagactgaaaccaggagctccaagctctctgtgaccaagaagccggctaaaggagcaggacgtggcaaagccgctgcgaaggaccccaacaaaccaaagaggccagccagtgctttcttcgtgttcatggaagatttccgtgagactttcaagaaggaaaaccccaagaacaagtctgtagctactgttggaaaagctgcaggagacaagtggaagtccttgtctgattctgagaaagctccatatgttgctaaggctgagaaacgcaaggttgaatatgagaagaacattaaagcttacaacaag

SEQ ID NO: 5635 - DNA, 812 bp, Artificial
  Synthetic
gggtgtgtccctggctcccctccttcctgctctcctttcccctcctctcttcccccctctcacaagagagagagagcgccagactctccccaggtgaggtgagaccagtctttttgcccgattcgacgcgcctttcacgccgcctcgcgcggatctgaccgcttccctcgcccttgtcgcaggattcagccatgaagggggccaaatccaagggcgccgccaagcccgacgccaagttggctgtgaagagtaagggcgcggagaagcccgccgccaagggcaggaaggggaaggccggcaaggaccccaacaagcccaagagggctccctccgctttcttcgtttttatggaggagttccgtaaggagttcaaggagaagaaccccaagaataaatctgtcgctgctgtaggaaaagcagccggtgataggtggaaatccctgaccgaagcggacaaggctccctatgtagccaaggccaacaagctcaaggccgagtacaacaaggccattgctgcctacaacaagggcgagagcactgccaagaaggcacccgccaaggaggaagaggaggacgacgaggaggaatctgacaagtccaagtccgaggtcaatgatgaggatgacgacgagggcagcgaagaggatgaagacgatgacgagtgagccttccagtggacaagatgggagcagcaagacgctaagggcggcgggcgtcctaaggagcctatccatcatcatcatcatcgtctactagaattattcagtttcacttcacatcgtgatgttttactttttctctcgtcctataac

SEQ ID NO: 5636 - DNA, 601 bp, Artificial
  Synthetic
cccccttcctccctctcctctcctctccgccgctgccgctgctgctgcgtgctcctctcatccccgtctcttccccctccgcgcgcgccgcccactcgctgggaggaggaggaagaggagaccttccccggaattcgtgctcgccggatcgggctcgccgcaatccatgtcggaggaagcaggtcgacccttgcccaagtttggtgaatgggatgtcaacgacccagcttctgctgatggattcacagtgatattcaacaaagccagagatgagaaaaagggtgggaatgggcaagatactgattcaccctgcaaagagactaggactgagagggtggaatcatatgcccccaaaacaaactcgaagaaatggttttgctgtgtgacatccagtcctacacaatcttgatgaaaacgagttccatgggttgcaaaattactatcctttaattttgctatatacatactatccataagaccttgtagagatgcccagactctgctgtggtgcttgattgggcatctcttaaaactctgaggtgtgtgtatgtatgtgtgaggggttatcagatgcacattcggataaatgaacttctgattg

SEQ ID NO: 5637 - DNA, 538 bp, Artificial
  Synthetic
tttctctctcttgctgcacagcaccagtcatattctctgaagaacacttctgacttatcccggattcatgtcgcaggaaaagggtcaaccattgcctaagtttggtgagtgggatgtcaatgacccagcttcagcagagggattcacagtgatcttcaacaaggcccgaaatgagaaaaaaacaggtggcaatccagaatcaccttcaaaggatgattccaatacaaagcaagcagcagacccgttcaaacctcaagctaaaaaatggttttgctgcttgcaaagcccccatgcagaatcctgataaggttatctgtctgccaaagtcgaatattggattcttattcataacgaactccagaacttcctttgtgttggcgctggagatagaggaactgctcgagtcctttttgtcttgtaaacttgtgatagtggggagaatgtgaaaaacaacatgcttgatgtacctatgtgatgtattttgtattttacatttagcagacaaagttttcgattgcgttcatatacgtgtgattag

SEQ ID NO: 5638 - DNA, 329 bp, Artificial
  Synthetic
aattcggcacgagatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcc

SEQ ID NO: 5639 - DNA, 537 bp, Artificial
  Synthetic
gcgtgatcaatccattccgatgagctgcgccatggattgcgtcttgtcagggccatcgccttcgaattccgtggagctgcgcggcggcggcggcgatggattcgcctcgcggaagctggggatcgagcagctgcatttcgggctccaatcgcgagccagggtcgtctcctccaggaatcggtcaattcatccccgggcgaggcgggcagtggttgtgtgctcgcaaaatgggtacaatgtagccgccacagactctgctaacgtcaactctgctctaaagactaaaggcaaagaattggccaaggatctcagggggacgtgcttgttcctaactgggatgatgggcagcgggaagagcactgttggaaagcacttggcggacgcgttgggatactacttctttgacagtgacaagcttgttgagcaggcagccgggggtgccagtgtagctcagatcttcaaggaaaacaacgaagaaggcttccgcgacgccgagagcgaggtcttgagccaattgtccggaatgttccgtctggt

SEQ ID NO: 5640 - DNA, 660 bp, Artificial
  Synthetic
gaattcaagatcttatttgatcttttaacacctcggattatatctagagtttgtaaattttgatttctgtttggggttttaggttatttggaattttgggggaaatggatgcaactacatgtgcttcaagtttgaattgttataagcaaaatgggtttaatgagatagggaggaggaagaaatcatctaatgggtttttgagattatcatctgacagaaatggagagattgtaagtttaaagatgattaaatctagggatttgagatgtaataagaatttggggcacaggaaattggatgggtttgagctttcttgttcttataagaattatcaagctccagcattggagtcggagaaaagtcgcggtttagttgacgagccttccattttgaagaaaaaatctcaagatgttgtgccatacatgaatggacgttgcatatatcttgttggaatgatgggttctggaaaaacaaccgtgggaaagattttgtcggaagtattaggttattctttctttgacagtgacaaattgattgaacaggctgctggtggaacttctgttgctcagatcttcaaacagtatagtgagagttttttcagagataatgagagtgaggtactgaaagagttatctttaatgcgtcggctggttgttgcca

SEQ ID NO: 5641 - DNA, 794 bp, Artificial
  Synthetic
tggtatcaacgcagagtggccattacggccgggataccagaatttgtcaacacacaatttttcctctttttcttgcgctaaattcgaaagggtatgtcctgaaattaggtgtaagagcaaatagttgagatatattagtaataaagatgaagatccagtgtgatgtatgtgagaaagctcaagctactgtaatttgctgtgctgatgaggctgctttgtgtgctaaatgtgatattgaagttcatgctgcaaataaactggcaagtaagcatcagaggcttcatcttcactgcctctccaacaagcttcctccttgtgatatttgccaagataaagcagccttcatcttctgtgttgaggatagagctctcttttgcaaggattgtgacgaagcaattcattcagctagcagccttgctgctaaccaccagcgcttcctagccactggaattcgagtagctttgagctcaagctgcaataaggaagcagtaaaaacccaattggagccaccacaaccacctcagcagaactcccaacaagttggtttgaaaatgcctccacatcaattgtccggtatcacgtcaccgtcttggcctgttgatgatttactaggatttccggattatgattcgactgacaagaaggaactacttgaacttggtgaactggagtggttgggggacattgatctctttggtgaacaaacagcagctgaagtacccgagctatcagtatctcagtcgagcaacacacataatatttacaagcaaaccagatatcaaatgtcttacaag

SEQ ID NO: 5642 - DNA, 939 bp, Artificial
  Synthetic
gggttacaatcaaaggcattcttggattgttaatggctaatgtagaaacaactgaagatgaagatgaagaaaatgttggaaatttcaagaaaaataagaggaagaagaaggttatatcattaggaatgggtgatcctacagcttattcttgtttccattctcctgatgttgcacaaaatgctgttcttgaaactctggcttctcacaaatttaatggttattctcctactgttggccttcctcaaaccagaagggcaattgcagattatttgtcgcgtgaccttccagaaaaattatgtgcagatgatgtttatgtcacagctggttgcactcaagccattgaaatagccttgtcaattctggctcgcccctctgctaacatattactaccaaggcctggtttcccaatttatgcactttgtgctgcctttagacacatcgaagttcgatactttgatcttgttccggacaaaggctgggagattgatctcaatgctgtcgaagctctagctgatcgtaacactattggcatagttgttataaatccggggaatccttgtggaaacgtttatagttaccagcatcttcaagaggttactcttagtactctttttaaatgcaacgattacttcctcagttttatttcatgccttagtttgcccgagcatgaagtttaagaatgcaaagaaattttctgcagcttatcgtcttaaactaaaggtgtgtataacataccaaaataccctttgaattttgtggtcttagacatagtagtgtcattagggtaaaatgagaatgttgaaattaagagtctactaaatatagaaaggcgacattccttttgaaacagattaaaaaaggaaagtaagacatagaaattaaaacgtgtggaatactattcttttcctttctttttgcagtttgcattagttctaagaa

SEQ ID NO: 5643 - DNA, 704 bp, Artificial
  Synthetic
gtcttcttcagtttgccggagtcattttcccttcgaggggttaaggttgtcttttcacagccaattacttgagaatggccaacccacatgtcttctttgacatggccatcggcggcgtcagcgctggtcgcattgtgatggagctgtacagtgacacaaccccaaggactgcggagaatttccgggccctgtgcacgggggagaagggcactgggagcagcgggaagcccctccacttcaagggctcctctttccacagggtcatccccaacttcatgtgccagggtggcgacttcacccgtggcaatgggactggtggggagtccatctatggcactaagtttgccgatgagaacttctccaggaagcacacaggtgagggtgtcctctccatggccaactctgggcccaacaccaatgggtcccagtttttcatctgcactgtcccctgcaactggctcgacgggaagcatgttgtgtttggccgtgttgtcaatgggatggacgtagtgaagaccattgagaaggttggttcgagctctggaaagaccagcaagcctgttgtagtagctgactgtggtcagctctaagcactagttagtaatattgatgataaagcttaataaagtttgcctggagttgtaattggactagtttggatggtttggttggttagcccagtctatgtaccgcttggctactac

SEQ ID NO: 5644 - DNA, 583 bp, Artificial
  Synthetic
gccattacggccgggggaaaaattgtcccgaagacaggggagaacttcagagctctttgcacgggggaaaaaggaactgggaaggctggaaagcctctccattacaaaggtagcactttccacaggatcataccgagcttcatgatccaggaggcgatttcactcgtggtgatgggcgaggtggagaatctatatatggtgaaagctttgcagatgaaaacttttatctaaaacacactgtacctggtattctgtcaatggcaaatgctggaccggacaccaatgggtctcaattctttatcacaactgtaaccactggctggttggatgggcatcatgttgtctttggcaaggagctgtctggcatggatgttgtctacaaaatcgaagcagaagggagaggaagtggaaccccaaaaagcaaagttatgatatcaaatagcggggaactccttaatgatccaactttccatgtatcaaaacacctcagatgttttgataatgcttgccctcgagcaaaaggcagtttcatatgctggcaagaaatctgttatgcgactattgcggcctgtaaagttaaaac

SEQ ID NO: 5645 - DNA, 619 bp, Artificial
  Synthetic
cggacgcgtggggtgtttccatatatggaagcaagtttgaggaggaaaacttcattgccaagcacactggtcctggcctattgtcaatggcaaatagtggaccaaatactaatggatgtcagttctttgtcacatgtgcaaagtgcgactggcttgacaacaagcatgttgtttttgggcgtgttcttggagatggtcttttagtggtcagaaagattgagaatgtggctgttggagctaataataaaccgaagctggcatgcatgattgctgaatgcggggagatgtaactggtgaagacgaaatatacacatagtgattggtctattgacactaaggtttcagcacatgatatgtacctggttacatttccttggcttagtctagagggcctgttaagttgattcatgagctcataatgattttttttgacaatagacagaggctctatgggtgaactattggagtaaaaaatttagtctcaaaagcttttttgcttgagcttgagttggtcctatgctcacatttagtgaatcctctagactctagtaatcatacttttgacttttgagattcccacttaccatgacgggagaatacatcattatcattctttttc

SEQ ID NO: 5646 - DNA, 550 bp, Artificial
  Synthetic
  misc_feature (400)..(400): The residue at this position can be any nucleotide.
tccgacgtagacagcggttctctaacagtgaatgcgaacaaagatggcaaagaattcatttgttttgctgctcttcagtttagtcattttcggaactctaacgtctgctcagggcaaaaagtcccaggaaagtctaaaagaaataactcacaaggttttctttgatgttgagattgatggtaaacctgcaggtcgtattgttatgggtctctttggtaaaacagttcctaaaacagcagaaaatttcagagcattgtgcacaggggagaaaggtatcggaaagagtggcaagcctcttcattacaagggaagcacattccatagaataatccccagcttcatgcttcaaggtggtgatttcacccttggtgatggacgtggtggtgaatcaatttacggngagaagtttgctgatgaaaacttcaagatcaagcacactggacctgggcttttgtcgatggcaaatgctggttctgacaccaatggttcacaattcttcatcacaaccgtcacaactagctggttggatggtcgacatgttgtgtttgga

SEQ ID NO: 5647 - DNA, 772 bp, Artificial
  Synthetic
cacaaatcgtacacagcgaaaacctcactgaaaaatctagagagatggcaaaccctaaggtgttctttgaccttactatcggcggcacaccagctggccgtgtggtgatggagctctttgccgacaccgtacccaagacggcggagaacttccgtgctctctgcaccggcgagaaaggcgtcggaaggatgggcaagcctttgcactacaaaggttcaaccttccaccgtgtgatcccagggttcatgtgtcaaggaggtgatttcaccgccggaaacggtaccggaggtgaatcaatctacggcgccaaattcgccgacgagaacttcaaaaggaagcacaccggccctggagtcctctccatggctaatgctggacctggaaccaacggttctcagttctttatctgtaccgctaagacagagtggctcgacggcaagcacgttgtgttcggtcaagttgttgaaggctatgatgcgattaagaaggctgaggctgttggatctggatctggcaggtgctccaagcctgttgtgattgctgactgtggtcaactctgctagatctgaggacgttgatgatgatctagtttatctatatttaagtcgccgtttttggctttgtttttaattttaatctatcggttactgcttgcttactgtgggtctagttctagggttgtgctgtaattggtattggttctacttctaccagtttatgtttaatcttaagactatggtttaaataagataatactcttgttttctctgct

SEQ ID NO: 5648 - DNA, 633 bp, Artificial
  Synthetic
atcttcttcagtttgccggagtcattttcccttcgaggggttaaggtttgtcttttcacagccaattacttgagaatggccaacccacatgtcttctttgacatggccatcggcggcgtcagcgctggtcgcattgtgatggagctgtacagtgacacaaccccaaggactgcggagaatttccgggccctgtgcacgggggagaagggcactgggagcagcgggaagcccctccacttcaagggctcctctttccacagggtcatccccaacttcatgtgccagggtggcgacttcacccgtggcaatgggactggtggggagtccatctatggcactaagtttgccgatgagaacttctccaggaagcacacaggtgagggtgtcctctccatggccaactctgggcccaacaccaatgggtcccagtttttcatctgcactgtcccctgcaactggctcgacgggaagcatgttgtgtttggccgtgttgtcaatgggatggacgtagtgaagaccattgagaaggttggttcgagctctggaaagaccagcaagcctgttgtagtagctgactgtggtcagctctaagcactagttagtaatattgatgataaagcttaataaagtttg

SEQ ID NO: 5649 - DNA, 660 bp, Artificial
  Synthetic
cacgcagcgatctgaagtgaaacagcaaaaaaaatcaaacaaaaagaaaaaatattccccatctgtgaaattcgcaaaaccctagcgcggcggcgatgtcgaacacgagggtgttcttcgacatgaccgtcggcggagctccggcggggcggatcgtgatggagctgtacgcgaaggacgtgccgcggacggcggagaacttccgcgcgctctgcaccggcgagaagggcgtgggcaagagcggcaagccgctgcactacaaggggagcaccttccaccgcgtgatcccggagttcatgtgccagggcggcgacttcacccgcggcaacggcacgggaggggagtcgatctacggcgagaagttcgccgacgaggtgttcaagttcaagcacgacagccccggcatcctgtccatggcgaacgccgggcccaacactaacgggtcccagttcttcatctgcaccgtgccctgcagctggctggacgggaagcacgtcgtgttcggccgcgtcgtcgagggcatggacgtcgtcaaggccatcgagaaggtgggatcccgcggcgggagcaccgccaagccggtcgtcatcgccgactgcggccagctctccgcggccgcttatccgtatgatgttccggattatgccgagctctacaaac

SEQ ID NO: 5650 - DNA, 692 bp, Artificial
  Synthetic
ggcgggagagagatggagggaatgtggcgggcgctgctgttgctgctggcgctggtggtggcggggatctcgctctccgccgccgcgaagaagccggagaagaacctggaggagatcacgcacaaggtgttcttcgacgtggagatcggcggcaagccggcgggccgggtcgtgatggggctctacggcaatgcggtgcccaagacggcggagaatttccgggcgctgtgcacgggcgagaaggggactggatcccagggcaaggcgctccacttcaagggctcgtccttccaccggatcatccccagcttcatgatccagggcggggatttcacccacggcaacggcatgggcggggaatcgatctacggcgccaagttcgccgacgagaatttcaagctcaagcacaccggccccggggtcttgtccatggccaatgccggatccaacacgaacggatcccagttcttcatcaccaccgtcaagacgagctggctggatggcaagcacgtcgtgtttgggaaggtgatcagcggcatggacgtggtgtacaaggtcgaggcggaggggtcgcaaagtggctcacccaagtccaaggtcaccatagccgacagtggcgagcttccactatagtaattcttatttatattgtacccgttttcccccttgtttaattgaagagattgggtcca

SEQ ID NO: 5651 - DNA, 529 bp, Artificial
  Synthetic
ctttttctttctctctctctctgctattttccatcccttggtttttatatatatagaacccacttcctttcttttcctttatcccctgaatcttcctccctttgcttacaaaagcctcctcttttcctcctttctctacttcagaactcttcttcaaagttctctctctctctccttgtggaggggttgtagtggagttgggcggtgccttgagcttcatccatggctcctgtaacctccaatcacatgcaataccgcaacctaggccggacggggctcaaggtcagtgccctctcctacggatcatgggttagcttcggaaaccagatcgatgtgaaagaggccaaggtcctcctttcggcgtgccgggcgcaggggatcaacttcttcgacaatgcggaggtctacgccaacgggcgggctgaggagataatggggcaggccataaaggagctcgggtggaaacgctcggacctcgtgatctccaccaagctcttctggggcggacccgggccgaacgacaagggcc

SEQ ID NO: 5652 - DNA, 1219 bp, Artificial
  Synthetic
  misc_feature (1138)..(1138): The residue at this position can be any nucleotide.
tccatcccaaattctcatattccccacttttactcctttctccttcccgtttcttccttttaaaacaacaaatcttcatttcctcttttttcttcttgatttgccccccaaaaaacgaaaaaaagtgcaaatgcagtacaagaatttaggcagatcaggcctaaaagtatctcaactttcatacggagcatgggtcactttcggcaatcaactcgatgtcaaagaagctaaatccctcttacaaaaatgtcgtgaccacggtgtcaatttcttcgataacgccgaggtttacgctaatggaagagcagaagaaattatgggtcaagcaattcgtgaattaggttggaaaagatcagatattgttatatctactaagattttctggggcgggtcgggtccaaatgataagggtttatcgaggaaacatataatcgaagggacgaaagctagtttgaaaagactggatatggcttatgtggatttgatttattgtcataggcctgatgctagtacacctattgaagaaactgttagggctatgaattatgtgattgataaaggttgggctttttattgggggacaagtgaatggtcagctcaacagattactgaagcttggggtgttgctcaaagattggatcttgtgggtcccattgttgaacagcctgagtacaacttgttgtctaggcacaaggttgaatctgagtacctccctctgtatagcaactatggcattggtcttaccacatggagtcctcttgcttcaggcgttctgactggaaaatataatgcagggaacattccagcggacagtcgatttgcactggaaaattacaagaatttagccaacagatctttggtggatgatgtgttgaggaaagtagatggattgaaaccaattgctgaatcactaggtgtacctctgcctcaactggcaattgcctggtgtgctgcaaatcctaatgtctcatccgttattactggtgccaccaaagagtatcagattgaagagaacatgaaagctatcaatgtcattccaatgttaacacctgctgtgatggagaggattgaggctgttgttcaaagcaaaccaaagcgccaagattcgtataggtagataaattttaagatccattangtcttaagagcactactatttccagaatgagttttccttgctattcgttttgcaccccctattgcttgtcttaagtatact

SEQ ID NO: 5653 - DNA, 669 bp, Artificial
  Synthetic
gggcggtgttggtggtggaggggggttcggggttcgagatgtcggatgaggagcaccagttcgagcacaaggcagacgcaggggcctccaagaccttcccccagcaggccggtaccatccgtaagaatgcttacatcgtcatcaaaaatcgcccttgcaaggttgtagaagtgtcgacctctaagactggaaagcatggccatgccaaatgtcactttgtggcgattgacatcttcactggcaagaagctcgaagatattgtcccttcctctcacaattgtgatgttccggaggtgactcgcactgattatcagctcattgacatttctgaagatggatttgtgagtcttcttcaagagaatggcagcacaaaggatgatctgcgtgttccaactgatgaaactctcctggtgcagatgaaggagggttttgcagaaggtaaagatcttgtggttactgtgatgtcggccatgggagaagatcaaatctgtgccttgaaggacattggaccaaaataggtctgttcaaaccttgactaagatcccgtgtggtgctccttgtgtggtagagggtgtgtaggatgaactctttcaactcttagttgctttaatgtggataagaccaattggcctctcaaataaaagagaaggatatactggtttagaatat

SEQ ID NO: 5654 - DNA, 1021 bp, Artificial
  Synthetic
cgcgagcttatcacttatcatcaatcggcgcctccctctctctcgctcaccgcctccttctcctcgcgatctatccaaacaaggggctcgctaagatcgccatgtcggactctgaggagcaccatttcgagtcgaaggccgacgctggggcgtccaagacctatccccagcaggccggaaccatccgcaagaatgggtatattgttatcaagaaccgcccctgcaaggtggtggaggtttctacctcgaagactggtaagcacggtcatgccaagtgtcactttgttgccatagatatattcaatggtaaaaagcttgaggatattgttccttcgtcccacaactgtgatgttccacatgtgaaccgcacagagtaccagctgattgacatatcagaggatggattcgtgagccttcttactgagagcggtaacactaaggatgatcttagactcccaactgatgacagtctcctgggtcagatcaagactggatttggtgaaggcaaggatcttgttgtgactgtcatgtctgccatgggggaggagcagatctgtgcgctgaaggacattggccccaagtaactccctcaagtggaaggcagaacagagggatccttatgtatcaaacctaaactaaaaaacaaagacatgtattgagaaggaatgctacaaaagacatccacccagcttgaagccgcagtaaaagtgcagtgattgctgggtgtggcattatctgattaccgctaccccatcatgacatttgggatcctgtattttccatggttttatttgtgccctctgtttggtatcaataattgatttggaacggtggaaaccatatactgaagctgaagattatcattgggtcatttcgtgcctatgtatttttctctgaaaatttccctagtcactgtttaatctgcaaccaatttgttgtgttgtgtcgtggccctgaatccctgttgcgtcgcgcttacattggaaaacttatacatcaaattttgttaacattgaaaaac

SEQ ID NO: 5655 - DNA, 702 bp, Artificial
  Synthetic
gagaaagagagagagaaagatgtcggacgaagagcaccattttgagtcaaaggcagatgcaggtgcctccaaaacttaccctcaacaagctggtactattcgcaaaaatggttatatagtcatcaaaggccgcccctgcaaggttgttgaggtctccacttcaaagactggcaagcacggacatgctaagtgtcactttgtggcaattgacattttcaatggaaaaaaacttgaagatatcgttccttcgtcccacaactgtgatgtgccacatgtcaatcgtacggactatcagctgattgacatctctgaagatggttttgtctcccttcttactgaaagtggaaacaccaaggatgacctccggcttcctactgatgaagctctgctgaagcaggttaaagatgggtttcaggaaggaaaggatcttgtggtgtctgttatgtcagcaatgggggaagagcagattaatgccgttaaggacattggtaccaagaactagttgtctctgcaaacttaaatcgattgctattgttaagacattattatatcctaatgtcgtacttcgatatcacttgattaaaaacttgcgttaaaaatctcatattgagatggcttgaatattttgatttgcacaaaagatagaagacaagtgctgctggttagggaaagaaatggctttgagcctttgacaacacaagc

SEQ ID NO: 5656 - DNA, 341 bp, Artificial
  Synthetic
cccacgcgtccgcaccagcaagaaactcgaagatattgttccttcttcccacaattgtgatgttcctcatgtcaaccgtactgattatcagctgattgacatttctgaagatggatatgtcagtttgttgactgataacggtagtaccaaggatgaccttaagctccctaatgatgacactctgctccaacagatcaagagtgggtttgatgatggaaaagatctagtggtgagtgtgatgtcagctatgggagaggaacagatcaatgctcttaaggacatcggtcccaagtgagactaacaaagcctcccctttggtatgagattcttcttcttcttct

SEQ ID NO: 5657 - DNA, 759 bp, Artificial
  Synthetic
cccacgcgtccgggttttttttcccttctcccaatctcatcttctccgaaaacctttcttctctcaaatttctgtgaaaacatgtctgacgacgagcaccactttgaggccagcgaatccggagcttccaagacctatcctcaatcagccggtaacatccgtaaaggtggtcacatcgtcatcaaaaaccgtccctgcaaggttgttgaggtttcgacttccaaaactggcaagcacggtcacgccaaatgtcactttgttgctattgatatcttcactgctaagaagcttgaagatattgttccatcttcccacaattgtgatgttccacatgtgaaccgtgttgattaccagttgattgatatcactgaggatggcttcgtgagccttctcactgacagtggtggcaccaaggatgatctcaagcttcccaccgatgatggtctcaccgcccagatgaggcttggattcgatgagggaaaggatattgtggtgtctgtcatgtcttccatgggagaggagcagatctgtgccgtcaaggaagttggtggtggcaagtaaacaagtatcattcgatatattattaccagtttgacaacggacgtcaatgttataagaaccaaaagatgtttttctttttcctaatttagaccctttgtgtgtgtttcttgttgcaagacaaccatatctattggttttggattgttggaaaagtttgtgttgaaacattcaaagtttcttatgagatgttattcttaa

SEQ ID NO: 5658 - DNA, 701 bp, Artificial
  Synthetic
cgacacgcgtcgcggtgttggtggtggaggggggttcggggttcgagatgtcggatgaggagcaccagttcgagcacaaggcagacgcaggggcctccaagaccttcccccagcaggccggtaccatccgtaagaatgcttacatcgtcatcaaaaatcgcccttgcaaggttgtagaagtgtcgacctctaagactggaaagcatggccatgccaagtgtcactttgtggcgattgacatcttcactggcaagaagctcgaagatattgtcccttcctctcacaattgtgatgttccggaggtgactcgcactgattatcagctcattgacatttctgaagatggatttgtgagtcttcttcaagagaatggcagcacaaaggatgatctgcgtgttccaactgatgaaactctcctggtgcagatgaaggagggttttgcagaaggtaaagatcttgtggttactgtgatgtcggccatgggagaagatcaaatctgtgccttgaaggacattggaccaaaataggtctgttcaaaccttgactaagatcccgtgtggtgctccttgtgtggtagagggtgtgtaggatgaactctttcaactcttagttgctttaatgtggataagaccaattgccctctcaaataaaagagaaggatatactggtttagaatatttgatacatgctttcagttgtgg

SEQ ID NO: 5659 - DNA, 726 bp, Artificial
  Synthetic
agttagggttggggccagcagcggcgacaatgtcggacgaggagcatcacttcgacaacaaggcggatgccggcgcctccaagacctatccccagcaggcgggcaccatccgcaagaatgcctatatagtgatcaagcagcgcccctgcaaggtcgttgaggtgtcgacctccaagacgggcaagcacggccacgctaaatgccacttcgtggggattgacatcttcaccgggaagaagctcgaggatatcgtcccgtcatcccacaactgtgatgtcccggaagtcacccgcaccgactaccagctgatcgatatctcggaagacggatttgtgagcctgctcactgagaatggtgacaccaaggatgacctccgtcttcccaccgatgaccagctcaacgggcagatctcctccgggttttcggaaggcaaggacctggtcgtgaccgtcatgtctgctctgggagaggagcagatctgcgccatcaaggacatcgggcccaagtagcccagcgcgcagcatcaaaagccgaggaccactggttttgtacctgcctttttaagtcattttactctatagttcgttctttttccttgcaaccttgttgtaaccagtgggggacgttcttttttccatagtagggggggaaaggggggagtttgggtcggctactatttgtatgctttgacgaagttggacgaaatctatttttttattcattgtg

SEQ ID NO: 5660 - DNA, 777 bp, Artificial
  Synthetic
gatcctcctctccctaaacttctctccggtgaagtgtaaacaaagaatagtacatcaaatcaaccatgtcggacgaagagcaccactttgaatcaaaggccgacgccggagcttcaaagacgtatcctcaacaagctggtactattcgtaagaatggtcatatcgtcatcaaaaaccgtccttgcaaggttgttgaagtttccacttccaagacaggcaagcacggtcatgctaaatgccactttgtggctattgacatttttactggaaagaagcttgaagatattgttccctcttctcacaactgtgatgttcctcatgtgaataggactgactatcagcttattgatatctctgaggatggatttgtgagtctgttgaccgaaaatggtaacaccaaggatgacttgaggctcccaactgatgataatcttctggccctgatcaaagatggttttgctgaggggaaggacctggttctgtcagtgatgtctgccatgggagaggagcagatttgtggtatcaaggacgttggccccaagtagctgcaggaggtggtggtgtatgttataaagtttcaaaaaaagctgtatcaaagctatgtagaagtaccaaaacttctttactttttgttattccagataactgttattcaaccatatggtatgactggattcttgtgtccactacgtgtttcctgttttctgatattgctacctgttagtctgtctgcgtgaaaagctctgtttctgcattataaagatagatttctggttt

SEQ ID NO: 5661 - DNA, 665 bp, Artificial
  Synthetic
cccccccgacctctctctagttgcagaccatcacttacgtagccctgtgtgcaacggcgcaagtgcttgtacgctttcagctagcgtagccatggcttccagggcattcctcctcgtggctctaaacctggtcctcttcttcaccgtggccagcgcctgcggcaagtactgcccgacgccttcgacgccgtcgacgacgccatcgacgccgtcctacaacaccaagtgccccaagaacgcgctcaagttcgcggcgtgcgccgacgtgctgggcctcgtcagcgccgaggtcggccagccgccgtacgagccgtgctgcggcgtcctcggcggcctcgccgaccttgaggccgccgtctgtctctgcaccgccatcaaggccaacgtgctcggcatcaccctcgacatccccgtcaagctcagcctcctcgtcaactactgcggcaagaacgtccctagtggcttcatctgtgcttaagctacgtaacgcgcgtacggtgtaacgacgtgctagctttgcatgcatgcagcacgcatgcacgaacacatcgttcgttcttgagtgcctgcatgcatatcggtcgagtctttacttactctgttattagttctgaatgtagaactgcttcagatatcaatccagcgagttaactgtacttgatttg
